United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 21

SEQ ID NO: 82111 - DNA, 557 bp, Triticum aestivum
  unsure (1)..(557): unsure at all n locations
  Clone ID: PAT_TA_82111
cacttcagcagctcccctcacatcccacgccaagccccacgctcgaaccaccaccaccaccagcacccatggcacccaaggcggcggagaagaagccggtggcggtggccgcggagaagacggcggcggggaagaagcccaaggcggagaagcgggcggcggcgaccaaggaggccggcggcgaggggaagacgaggggccggaagaagggcagcaaggccaagaagggcgtgggagacgttacaagattctacatcttcaaggtgctcaagcaggtgcacccggacgtcggcatctcctcccaagccatgtccatcatgaatccttcatcaaacgaatcttcgaagaactcgccggcgatccngccaagtnggcgcgatacaacaagaagccaacatcacttcccggaatncaactncgtcgcttggtcttccccggggattcgccagcaancctttccnnaggcacaaggccttacaattaaatcacatagttcctctccgntcnatggnttatggcggaggctcttcatttntngcacatacatntncatcctt

SEQ ID NO: 82112 - DNA, 565 bp, Triticum aestivum
  unsure (1)..(565): unsure at all n locations
  Clone ID: PAT_TA_82112
cccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactggggaagcatggtcacgcaaagtgtcactttgttgccattgacatctttaaatgggaaagaacttngaggatatcgtccttcatccccacaactgtgactcccccatgtttgaccgccaaagattatcaantgattggacataactgatgatggtatttcagcnttctcaactgaaattgggtacactaaggatgacctgaacttccccactgatgatgtcctgcttggcaattnaaaactggntttgctgatggnaagacctattctgtccgtattccgccagggttnaaaanaatttgccttttaaggaatccgtgggnggnaataacaatttcttggttct

SEQ ID NO: 82113 - DNA, 178 bp, Triticum aestivum
  Clone ID: PAT_TA_82113
ggtgagcccagattccgcaaaatggcttgaagccatgaaatctgagatgggatccatgtatgagaacaaagtgtggactttggttgacttgcccgttgatcggcaagccatcgagaataaatggatcttcaagaaaaagactgacgctgatggtaatgttactatcaaaaaaaaaaaa

SEQ ID NO: 82114 - DNA, 534 bp, Triticum aestivum
  unsure (1)..(534): unsure at all n locations
  Clone ID: PAT_TA_82114
gtccaccctccacctggtgctccgcctccgcggcggcgccaagaagcgcaagaagaagacctacaccangcccaagaagcaaaagcacaagcacaagaaggtgaagctcgccgtcctccagttctacaaggtcnacgacgccaccggcaaggtgaccaggctcaggaaggagtgccccaacgccgactgcggngcgggcaccttcatggccaaccacttcgaccgccactactgcngcaagtgcgggctcacctacgtctacaaccagaangcttanangttgcttgcgattgctctgctcntttacctacctatcgagagtnnaactcacttacatgtgtcccntttgtcgttanactgaaaccttgagtctangtttctgaaaattcatctctacggctgtnacgcgatgcgtgctaaattttggngccgtanccatcatcnaaatgctttatccaatccagtccgtattcatncttgtgattctanaaaaacaaaaaancanggggggcggtacaattccccacaggatct

SEQ ID NO: 82115 - DNA, 339 bp, Triticum aestivum
  unsure (1)..(339): unsure at all n locations
  Clone ID: PAT_TA_82115
cggcgatcggctggggctgctgcagaagtacctcgaggaccagctggagctcgtcggcgcggaggcaggggggctcctccgcgacctcagacaagggaagtgcagcggttgacggtcgcgtttccttgttctttttggaggtctgtaggatggctaatgtttggaagangccgagacgattttgggtcgtgttttgtgctttgtgaaatgaaacatcgagaaattagagactactacttccttttgcgaaaattagaggaantagagactactgctaacattcctgtcaacgtgantaacaaagatggaaagaaagaatnngntactaaaaaaaaaaaa

SEQ ID NO: 82116 - DNA, 625 bp, Triticum aestivum
  unsure (1)..(625): unsure at all n locations
  Clone ID: PAT_TA_82116
gcccaaggtgaagaagaagcagggagtacattagagattgatgattctaggatctagaacctcatgaatcatatacgtagaacagagtaatggatccagtttttcttccataacaccttccttattgcttccttgctggattccttatcactcctgagtcctgacagaaggagaagactgaaaggggcattgctttcctgacacggttacctgcgaacagtacttgtcacccctgtcactgattatgaagtcctacaacagaatgatatggtcaaaatgtattgtcttgctttagccttttctaccatgtgtttatccttttattttaacatgacccttgaggattctgctctcattcgacagagatatggattgtcatactgacggttttatggctgtggtggctcatcatacacatgtctggttactggaagaacaactgagtcctgctgctgtgttanagcggacaantgcaatgagactgtacactggagagaagtantcantcggacaatacgtantccgantggagccttcaaattatttgtcantacgaaggcntcatttgcggcttatacatcccctcctcgcgccaaatnaatgctcccaaatctcaatcgtaaaa

SEQ ID NO: 82117 - DNA, 246 bp, Triticum aestivum
  unsure (1)..(246): unsure at all n locations
  Clone ID: PAT_TA_82117
agacagatccgccgcaagatggttgagatcatggtcaaccaagctgcaagctgtgacttgaaggagcttgtgaacaagttcatccctgaggtgattggaaaggagattgagaaggccacctcaagcatcttccccctccagaacgtgtacgtcccgcaagggtgaaagattcctgaaggccccaaagttttgaccttggggaaactcaatggagggtgaacgtgactaacaanggaggatgtttgg

SEQ ID NO: 82118 - DNA, 630 bp, Triticum aestivum
  unsure (1)..(630): unsure at all n locations
  Clone ID: PAT_TA_82118
gtcttatcttcgctggcaagcagcttgaggatggccgcacccttgcggattacaacatccagaaggaatccaccctccaccttgtcctccgccttcgtggtggcatgcaaatctttgtcaagaccctcactggcaagaccatcaccctggaggttgggtcctcagacaccattgacaatgtgaaggccaagatccaggacaaggagggcattcccccggaccagcagcgtctcatcttcgccggcaagcagcttgaggatggccgcacccttgcggactacaacatccaagaaggagtccacccttcacttggtgctccgtctgcgtggtgggcaataagctcctggcgatggagctctgcttcgtcntcggtgtccttcaatggatctcgtcttgtgcctacaatgcctgaattgtcttgttccgtaccgtacngtatcaatgtcanntttgganctaaaantcgctntgtgaanaacttggggaactataataattagcctaattcgtcaaaaaaaaannaaaaaaaaatcanggggggccgtaccaattccctaangatcgataacnnccangcctctttaantctacggaaaccgggtacaataacnctgaaaanccttnaagngg

SEQ ID NO: 82119 - DNA, 460 bp, Triticum aestivum
  unsure (1)..(460): unsure at all n locations
  Clone ID: PAT_TA_82119
tctctctctctctctctctctctctctctctctctctctctctcgccatcgcnaagtacatcgaggagaagcacggcaagtctctcccggccaacttcaagaagatgctctccgtccagctccgcgcctccgccgccaagggcaagctcgtcaaggtcaangcctcctacaagctctccgangccgccaagaaggacgcgcccaagcccaaggccaagcccgcagcccccaaggctgcggcgaagcccgcaaaaggacggnngcaaaggcnaanaagaagngtcggcaaagccaaagaaggccgccgccnggacaaagcgaaaggcgccgganaanaanacctggtcgcaaaggcaaaaaatcgccgcgggcaangcaaggaaatcgaagacgncgctcccggcgcaaagaaggcgaaagtcccgccgttatnnttcnatgaataaggnttattccctgg

SEQ ID NO: 82120 - DNA, 267 bp, Triticum aestivum
  unsure (1)..(267): unsure at all n locations
  Clone ID: PAT_TA_82120
cgctcaagcccccagacgccgcagcgccgccactccacccgcagcggcaaccatggcggtcggcaagaacaagcgcatctcaaggggaaggaanggaagnaagaanaangccgtcgatccgttcaccaagaancagtggtatgacatcaangcnccgntgctgttcaccanccgcaacgtcngnaataccctcntgtccatnaccanggtaccaanattgcctcanagggtctgaatcanaaggtgttcnaantatctctanctgat

SEQ ID NO: 82121 - DNA, 395 bp, Triticum aestivum
  unsure (1)..(395): unsure at all n locations
  Clone ID: PAT_TA_82121
gcaaggtggcggccgcgtcgtcggaccaccaccggctccaacaaagatcccacaaggtgagcaagaaggcgcgtcagagggaggagaagcagcagctgcagaaggatcatcaagtcgaggccgaggcctacgatccccgccagcctccgacggattactgaaaccgagacaacggaatgatgtacatagcttccgtcagatcctgattgctgtgttggctttgtgtcgccatgatttttctcttacttttcagttgcttggtgctgaagtgtttggatgattccactgattaaattgcggagatntgcaagactgacaatccggtccgtgtaaaattgggccactaaataaattacgcacgcgggtggatgaaacatttngttaaaaaaaaaaaa

SEQ ID NO: 82122 - DNA, 585 bp, Triticum aestivum
  unsure (1)..(585): unsure at all n locations
  Clone ID: PAT_TA_82122
gcggtcccgaagaaggtggctgatcccttcgacttcggtggtggtcacatggatccagacaaagccactgacccaggcttggtttacgacgtggatgcaagagagtacaacaagttttttaattgcaccgttgggttgttacatggctgcgagtcttaccaactcaacctcaatctcccgtcaatcgttgttccaaacctcaaggaccatgtcacggttatgcgcactgtgacaaatgtgggggcagttggaacaacttatcatgcaatgcttggaactcccagtaagggttgtcatgtccatggaaccatcaaacgatnacattccgctaaaagataataacaagaatgcacatttaagggttnattaactacaaagcggagagtgcaaggtggtttactttggggaantttacatggcaaatggagtaccacgtcangatccatcccaattaagaattgataaaaacttgttgcaaatacatcctaatttaccgtgtangganangtatcatgcataagtattggatcaaaatttataaacaccaaaaanctatgtncatataggaacnacatgnggncanat

SEQ ID NO: 82123 - DNA, 194 bp, Triticum aestivum
  unsure (1)..(194): unsure at all n locations
  Clone ID: PAT_TA_82123
tcggngtttttcccgctctcttcactaccggncagatcgggctgctttgaaggcantgagagtnnttgggttttggttgccctcgatggcagagagancaggagaagcaccaatnacaagtctgcaaaagctttttttttttacggatgtaatgacaagaagccantaaagttcagcagaaaattcacngaaaa

SEQ ID NO: 82124 - DNA, 555 bp, Triticum aestivum
  unsure (1)..(555): unsure at all n locations
  Clone ID: PAT_TA_82124
cctacaaggtcggcgagcatgtcgacgtcaaggtgaacggcgccgtccacaagggtatgccgcacaagttctaccacggccgcaccggtcgcgtctggaacgtcaccaagcgcgccatcggcgtcgagatcaacaagcaggttggcaacaggatcatcaagaagaggatccatgtgcgtgtggagcacgtgcagccatccaggtgcaacgaggagttcctccaagaggaagctcaacaacgacaagctgaaggcggaggccaaggcgcgtggtgaggtcatcagcaccaagaggcagccagcagccccaagcctgggttcatggtgggagggaccaccatccgagacggcaccccatcccgttacaacttcgtcaacatntcaagggtggttaactaaacgcttgttgtttccctgaacaagaacttnaccattctaatactatcttgttccaatttttgggacgagtatctcttttgctccgcgatgtgaattcnccgtggtnacttaaaatcctgtggtgatcatcccacatcgcngntataaaaaaaaaaaa

SEQ ID NO: 82125 - DNA, 571 bp, Triticum aestivum
  unsure (1)..(571): unsure at all n locations
  Clone ID: PAT_TA_82125
actcatcactgtaaccgacgaggagcttggcgaggccggtaacggagaagacaccgggtgatacgtcggcgacagcgccgtgtgttacggatccgggggagtacgtacgtagcggcgatgcagacggcggcgacaccgtcgctgttgtctttgcttcgctctgccagtcagtcgggaccgttgcgcaatctcaggccagattggatctaacctacttataactgtactcatggaaagctggcgatgggggggacaaaggcctcgcctgagacagaagcggcggcacaggaagattccgggcggagtcatgtgctccgactgatcgccgcagcgggccggcgtgacgcgggtactgccagatgtgcatgctgtctcgaagagtcgtcacgtacaaggggctcaagtatctagtgttttcgcgctgaatttatgatcagcaacagcaacgtttacgnattacaatggcggatatggatacatatgtccatgacaaaagtaattgagtaactaattantttccccaatgaagctacattatgagngtataagaataaaaaagnccnaaaaaaaa

SEQ ID NO: 82126 - DNA, 413 bp, Triticum aestivum
  Clone ID: PAT_TA_82126
cggcgacgggcgtcgccatcggcatctgcgccttcagcctcctccgcaacatcaccggcaacccagaagtcagggtcaacaagatggggagggcagcgggagtgcttgagaaccatgaggagggcaggcgctacgccgagcatggcctcagagcctatgtgcaggacaagacccccgagatcatgccaggaatcaacaagttcttcaccagcccgaaatgaagcactttagcctgtcagtggctcgctattagtaactgttgtggtcaagtgcaaacctatttcaagcattcagtaatgttgtcgcgtccataattcaagaggatatcatcaagtgcctcttattgaaagaaccatgtgatgtttgatggcttgctatatatgtgatggttgatggcttctaaaaaaaaaaaa

SEQ ID NO: 82127 - DNA, 563 bp, Triticum aestivum
  unsure (1)..(563): unsure at all n locations
  Clone ID: PAT_TA_82127
ctgattttgtngccctatgatctgtggaaggatacacctatgatttgctagattaatagttcagctttgtagttgcttgtancgtccgtagntgggcattgaattcaactcttaaattcatgtcggtttgccgatattactgttggnttctacgcttgttgacaagcttctcaagtacaaccagnttacatcagctccnattgaaactgcgctggtagatatgctattccctccgtcccataannataacagcgtttttgntacnagtatagtgtcaacaaacactcttatatnatgtcaatcattggcttgttctagtggncagctcctgggcaatttncangtcagctctctagctgatttatctcngttgcaatttcatcttgtngcatgggcggcatcnggttaatcaatgtttgacgtactgcatatatccccggtacngnacttaancngcctcggtcgcnttggcatttacnatncagatcnttntgaanaacccacnggannacatcaccctgangncgatcctcngacacactgncatgtaaggaagatcagac

SEQ ID NO: 82128 - DNA, 643 bp, Triticum aestivum
  unsure (1)..(643): unsure at all n locations
  Clone ID: PAT_TA_82128
tcgagttttttttttttttttttttaacatggaaaacagttgcagcattgtattataaaaaatgaaataacattatttaaatgtttccatatacactaacatgacatcaaagggtcttccaaaatagaataatgatgttctagcaacaatagagtacatttatttcttcttgtggcctgaagtgaacctaggcttgctgctcgatgaagacacacgagagacctcatctgacgttcggctgggaaccaaatgatagcttctcaacaatttcgagtatggaaggtctgcgcctccgatctatctcaacacaagtcaagcccaatatcaatgcatgcttttatctgccgcaagcattcctgcatctaacgacccatacatggacgctatgtgctgcattgtccaaccttggcgtacttttccaataaatttcctggcggaggctgatgtcctccggacaattcgcctcctggggtgatctcgatacaacaacctaaacatatagtccgatgggcggaattcactccgtanatatctggacatgtaccatacgatccacgactttggtgcaaacgggttgcgtcacaaagaccccacatgaaaacanaactcgtacagttcacaaataattcagcttaatcagtga

SEQ ID NO: 82129 - DNA, 642 bp, Triticum aestivum
  unsure (1)..(642): unsure at all n locations
  Clone ID: PAT_TA_82129
gaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcagcttcactgtctgggatgtcgggggtcaaggacaagatcaggccactgtgggaggcattacttccaagaacacacagggtctcatctttgttgtgggacaacaacgatagggaccgtgttgttngaagcaagggatgactcccacaggatgctgaatgaggatgatttacntnatgctgtctgcttgtgtttggctaacaanaaatnttcccaaatgccatgaatgctgctgaatnaactgatagcttggctgcatcccttcgccaacgacactggtacatcaaacattttgcacaacaagggaaggacgtttgaaggccggacggttcaacaantngcaacaancctaatttcncaagattnaaggacaggacncttgntganatgaacacggtacaaggattttggatgatgncatcatcctagtcgntattccgntaatacgacacccc

SEQ ID NO: 82130 - DNA, 612 bp, Triticum aestivum
  unsure (1)..(612): unsure at all n locations
  Clone ID: PAT_TA_82130
agctcatggagatcacggacgtcccgcagtttcccctgagcgaggagaaggatgccgaggtgcggggggccgcacaggagctcgtgcaggtgtgtcagacgctcaagggcggtcttgactcgctggagcgacaggtgcgcgagatgttccaccagatcgtgcacaccacgatagaaatctacaactgcttgagtatgcccaactgttcagctaagaagtttcctcgggccaaacatcgttacatgttcatctaagcgacagcctcgccaacgtcgctcagttgtgctgggttcgacggccactggaccgaacttcctcgaccaccgcggcatgccgctgtactttccgcgacatgtgactggcatctactctccaagcatccaattaagcatcaagcgcactacatacgtcgaattgatcttcatttttccanaaccttntcggaacngncatgncaaanccacagtttacgacgatcgtctcaatgcatgaaaantacattctttaatgcgcnggacnggngatacgagatatacccacttcaggaggaatggtgataattcacacattgngganaangacttagatcgtacaaatngancngtaaaacan

SEQ ID NO: 82131 - DNA, 606 bp, Triticum aestivum
  unsure (1)..(606): unsure at all n locations
  Clone ID: PAT_TA_82131
ggcaatcttagggattccatggcagatttggtaggagccgtcataaacaaatcttacttgagtatgaagtcgtcttttaccaagggtctgcatgactactgggaatggaagccgctttcccttgaacacctgaaatatgcggcaattgtaagtgaaaacttcattttttatgattttctgtctttatatttttgttttactacaacaatagtactttttcctctttacgtatatcttcattttcatccgttttttgttttaaggatgggtatgtgagctacgagctcctactgggcgattttgtcnatgaaaggacatgatgcaccctggtgtccttccccgacacagatncctttgatgttccccggagcaaaaccagatccnactaaattanaatggcaccgtggcctttgtgttgactttccngttaggaaggccccnggaaaattcattcctttttggtangataaganatttaattaacctagganacattggtatcataccgttgggtggccattaatggnaanattttaaggtttcagtacaantnatggtgccttaccaatcagtcantaatgtgatggncanagttgttgganaacc

SEQ ID NO: 82132 - DNA, 627 bp, Triticum aestivum
  unsure (1)..(627): unsure at all n locations
  Clone ID: PAT_TA_82132
ctctggcctttcctcccgggttccgaacatcgcttgcagaatagcctcagaggcgcctgcgatggcttcctcatcgtctctcgaggtaaccagctctacatctgcaacccggtcatccgcacgtgtgctctcctaccggagcctcagaggcaatacaacaccatagccggtttctactgccaccattcaactggagaatatagggtgctctgggtctctcagtcacatgactcatctacatccaagcttatacgtcctcacggtgggattccgacaagccgaggcacatcaagagtcaagaatgccgacanttcatccgccttctgcaagaacaagaactactcaaacaagtgcgtttttcaatccgactgttcaacaaccaatccaacaccgtggtagcttgcactgggcgtcattggtgggaacaagcggcattatnggaagcggcggagacattatggtgttcgacgcaanaacaaatcattccgatggagccgnccaaccaacatgcatngtagaattttcgacatggagggaactgcttgtgggcggtcgatacaagtcactcaaggttcggggatcacattagagctgaaacggcttaanacggatgacttaacgtaagaa

SEQ ID NO: 82133 - DNA, 525 bp, Triticum aestivum
  unsure (1)..(525): unsure at all n locations
  Clone ID: PAT_TA_82133
ccgccgcgtgcttcctggnaatangcatggntatcataatgtcctcatggagtgaaaactatggagatcaatctgaangcanggatctcatgtctcagttcaaggttgccgccaaggcaatcgcntcagatnanaaaattgcattgctgggagccattcagtcgttgttcgagggctccatgtacacttttgtcttcntctggactccagcgttgagcccaaatgacgaacacattcctcatggnttcatatttgccaccttcangctgtcgtctatgctgggtanctccattgcatcacgcctgttggcccggaagatgaaggtcgaangttatatgcacatcgtgtttgcantatcagccttcaaccntttcctcccggttgccannagcttctggngacgacctctcagtgaaangnatcggatctccttngngggcccctacaactgcttggtttctgtncctttgagtctgcgtcngatttccnggcatcaacatgagatagatccaatnatccgaagag

SEQ ID NO: 82134 - DNA, 458 bp, Triticum aestivum
  unsure (1)..(458): unsure at all n locations
  Clone ID: PAT_TA_82134
gcaaaaggtagggtttccagttgcaagccgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacattggcttcatcaagtaccgttaagaatgggaaacctcaaaggaagcaaggactangaaatttcaaacgaactgtggtgcttcanccaagntggattctttaccctaataantaatgttaatgaactactaataangtttggatccctgggtnacaaaaccgtngaaccaagttaaccacngctgtttgacaatttaaaccgatattcngttacggcttccattangtaaaaggtgcccncanccttaaatttttaaaaaaa

SEQ ID NO: 82135 - DNA, 616 bp, Triticum aestivum
  unsure (1)..(616): unsure at all n locations
  Clone ID: PAT_TA_82135
acggatgccgcgaagcaggagaagtttatggaagtgttgaatgacgagctgagtatgcagttgatggtggcaacatttgccaactaccaagagttggtaggtagggacctcatgattgaaggcaagcaacaatagatagagagccgcaaaaggaagtatggataggggaagtacaactctggagctcagcagaagcctcgttttccccaagaactcgggaggacatacccaacataactatggaggccacactcacaatgggagggagttcacataaccacaatggcccaaaaatgggtaatgggaatggaggaaacaacggtcagaaccgtttcaaccccactacacccgccaagaaggttctaatcacattacttgtttcaaatgccgggaagaatggacactacccaccgatgtcctgaagtaaagaatgggaaatggcaatggnactcanggaagaagcaancccttcaccaaaggcacgtgaactacanaatgtggaggaattnaagatnacctgaccatgatgggaagtttgataatcattacgntccatctttgcacgggcatccatcncattcaggngatctggcattaagtgcacttncgtantcnc

SEQ ID NO: 82136 - DNA, 356 bp, Triticum aestivum
  unsure (1)..(356): unsure at all n locations
  Clone ID: PAT_TA_82136
cgacgccgagaggggaagggtgcaggataccctgggaggcggcgacgtgcccgccggcgcccaagaaggcgaggacggcggtggcgatcttcgccgaccgccggtgcaaccgcgacgacggggaggcgacggagtacttccgcgtgccggcggacctggactccgtgttcgccgtcagccgggtcgccgaggccaactgaatgattccgtccatgctcgcgcgcgtgtagagctgcaagtgcgagcgattaaatccagttaaaagacaagagacagaggagatgatccaataatgcagtgtaaaaattcccattgtcgatgcaatgggatttaaccttaagttnaaaaaaaaaaaa

SEQ ID NO: 82137 - DNA, 259 bp, Triticum aestivum
  Clone ID: PAT_TA_82137
gcccgatccatttctgcagcgcaggtactgttattattggctcgcaattcgcaaagagatgtctgattcttttgggttggattagtttgttcgttcactgtcggtgttcccctcccctgccgggagctgtatagatctatatatgtcgagcaaaatctttgaaacagattaagcatagggattttcccaaaggaaaggatcttactccacttttaagtatactcctgcctctgaaatttccttcatcaaaaaaaaaaaa

SEQ ID NO: 82138 - DNA, 366 bp, Triticum aestivum
  unsure (1)..(366): unsure at all n locations
  Clone ID: PAT_TA_82138
gggaggtgaaggaagaggcggcgcctgctgccgaggccgagccggccgctcccgctgctgctgaggaagcaccggtggaggcagccgcggccgcggcagaggagccggccgccgcggtggccagcgtcagcgtgtgaggcgccagcgccgccggaggaggagctggctgggtcagcgtcgacggcggcggccgtgtgctcctacgtggcacggcgtgatgctgagtcagccagttgagttggagtgctactgctttttacnagtgttganttggaagcgctatccccggggtcccccttaannttggctaaataaaantttttcngggcaattcaacccaatttncggtcaacaancaacaaccaa

SEQ ID NO: 82139 - DNA, 495 bp, Triticum aestivum
  unsure (1)..(495): unsure at all n locations
  Clone ID: PAT_TA_82139
cacacgagtccttcttctctcaaacaaaaacaaatccagcgacgatgtctgggcgcggcaagggcggcaaggggctgggaaagggcggcgccaagcgccaccggaaggtcctccgcgacaacatccagggcatcaccaagccggcgatccggaggctggccaggaggggcggcgtgaagcgcatctccggcctcatctacgaggagaccccgcggcncctcaagatttcctccgagaactcatacgcgacgccgtcacctacacgganacgccgcccgcaaagaccntcaccgccatggactcctctatgcctcaaancncaaggcgacctcctacgttccggagtaatctctatgggccattatgggaatccccgttcnctgtncagtgttttttgtaatgatttacgctttgcntctcttttcccgtctgggttaataagttttataccaaatttttgtcaatgaacattaatctaatnanaaaaaaaaaaaa

SEQ ID NO: 82140 - DNA, 360 bp, Triticum aestivum
  unsure (1)..(360): unsure at all n locations
  Clone ID: PAT_TA_82140
gaaagatcatccgagggtcgatgagttggtgcaggcgttggtaccgactgcctgcaatgcgaagatcagcatcgagcggcccagatccatgataaccaagaactcgttggcaaagttgatttgttgttgagacagtgttttggagacgccgaagttccctgggtccatgcgtgtgatggttgttgggttctgaactgcttccgtgaatgttaggctgggtcatgggatctgggtgggtatcaatctatttccccagtttcatgtgctttgaacaattatacctggganacaactggctggagaaaccttttccgaatgggatgttagctcccaaattattaacaaannaaaaaaaaaaaa

SEQ ID NO: 82141 - DNA, 553 bp, Triticum aestivum
  unsure (1)..(553): unsure at all n locations
  Clone ID: PAT_TA_82141
agtacatcgaggagaagcacggcaaggctctcccggccaacttcaagaagatgctctccgtccagctccgctcctccgccgccaagggcaagctcgtcaaggtcaaggcctcctacaagctctccgacgccgccaagaaggactcccccaaggctaagcccgcggccaagcccgccaaagacgccgccaaggccaagaagacggtggccgcgaagcccaagaagaccgccgccgctggcaccaagcgcaaggcgcccgagaagaagaagctggtcaccaaaggccaagaatcgccggcggcaaggcaaggcgaaccgaaacgtccgtccccggccgccaagaagacgcaaggtcccgccgcctgatttgattctatccgatatctgggcttaaggatgcttggtgttcaangggtgttcaaaagatgctcanccnccctggttaagtttcggtctgcnagcaattatttacctgggtggtttaatgtatgtatggtgcttaaaaattttcaagtcnaatcngtgaatgatcgcattctcataaaaaaaaaaaa

SEQ ID NO: 82142 - DNA, 612 bp, Triticum aestivum
  unsure (1)..(612): unsure at all n locations
  Clone ID: PAT_TA_82142
agtcgtgttcgtccaaagctggacacatcgactcggacagctggagtaagtttggaaaatggtaatctatctcgaaaggatgctggtggtatctcctttgagcgagaatttccacaccttagttctgaggataacgatgggaagcaagatatcagtagagttccatctcctgggaattagcaccccacttcaagagcataccattggttactgcacctggatggctggnactcggtgctagcagaagttcctgggacttaagtgagccaagcaataactangttccttcnggtttacacatgctggttctgggtaggnancctgaatntcaactgcggacggactagcatggttgaacattatgcagaccattaagtttccacaaaccanttccgttgagccaaaaatttanaaanattttagtaaccccgacttatcaaacaaaacctaacattgnccngtanttaantaanggcaaacgggatcaaggctgtgaaacgtgcaaacgtaaaaacntcaaagccgtctatcatcaatcgancgtaagcaccatcagagttaatctacccacaaagnntgaaattcaaaaggncaaacccggaccgttangaa

SEQ ID NO: 82143 - DNA, 613 bp, Triticum aestivum
  unsure (1)..(613): unsure at all n locations
  Clone ID: PAT_TA_82143
gtcccctccctctcctgtcgcgtgcgctccgccagcaaaagcttccacataaggaccaacaagagaaaccttaatctgttcggtgccagtcaaacctcaacaacaaagtttcatgtctgatctcgacgttactctgccatctgccttcgatccttttgctgaggcaaatgctgaggatgctgggtgcaggccccggcgcaaaagatatgtgcatgtgcgcatccagcaagcgcaacggcaggaaganctgacactgtccaaggcctgaagaagganttcaactacaacaaatcctcaaggtttcaagaaggattctgctgcaatggacantatccaagattcnggactaggcaagtcattaacttaaggtgatcagcgtaaaaagttcnaatttccaancaaactnggattcnaanaagancatcaaatcaangtttnaaccttaacnccccnanaaagctcnaaccccacattttcccaaattgaaacataagganataacnccccccctgttaacntgtctgctnannaattggtntcccnataaaagcnnngatacaaanacattnggttgcaaanttccgcnaaaaaatcgttcttgaaaaaaaaaaaa

SEQ ID NO: 82144 - DNA, 674 bp, Triticum aestivum
  unsure (1)..(674): unsure at all n locations
  Clone ID: PAT_TA_82144
gtaaaatgactcaactcgctggtgaatcttcctccgaattccactctttgggtttcctcccttgcaagagattagttgatgctcactacagatgcatgactgatgacaagttcggctactccattgaagaagttcccgaagtcggtcttaacagcgcttagaagttcttcgactgcactttctaacaactcaagcccatgcaatcctgcagaagattcttcgaccaagtcgtcagagatgtttaccgtgtcaatggtagccaacttatttgagttgattgattgacattctctatctactctcccttactcctccacccatactcacctacatccctacctacctttctctacaatattaaccactatttcaaagaaaatcacatgcgcgctcataacacctcataatactacttttaaancaataaatcctgcactaacacctcctantcgcataaaactcatctgctccctgctaataatnatcccccgattgatatccaaagaaattatatcctccaaagtangaaaataaaanaggngaaacatncataatggntggttatcaaaaattgatgatcatcataccccagganatanagggtnaantcccaaaattgaaactcantaanaaaaaattngaggaatccnagagnaacnnaacctgtcntaaaa

SEQ ID NO: 82145 - DNA, 630 bp, Triticum aestivum
  unsure (1)..(630): unsure at all n locations
  Clone ID: PAT_TA_82145
tggatgcggaggatgcgtgtcctgaggcgccttctgcgcaagtaccgtgaggccaagaagatcgacaagcacatgtaccatgacatgtacctgaaggtcaagggtaacatgttcaagaacaagagggtcctcatggagagtatccacaagtccaaggctgagaaggcaagagagaagaccctctctgaccagtttgaggccaagcgcgccaagagcaaggcaagcagggagaggaagtgcanggaagggaaggagagattggctcagggcccgagagatcatgcaccagcaccagcggctgcagctcccgctcaagcagcaactgcacctaaagaaggcaagaatgaaggtctgataagaactttatctttctggnaatatcaagggttaacctaattttgggacatcagaattcaaaacggtttctgtgcatatctgttggtgcaactgtcaaatacttaatacatanntgtttgtccgttggtgttcaatcaanatgctaacaaattgttaaccattgggtaanggataaatagcttttaccnacaaaaaaaagggggccgtncaattccccaaaggatctttacccccaaggctctttaactcnnnggaaactgnntccacttaccn

SEQ ID NO: 82146 - DNA, 390 bp, Triticum aestivum
  unsure (1)..(390): unsure at all n locations
  Clone ID: PAT_TA_82146
gggacgaccgcggtcgcgagagtcatgctcgctctttctagttatttcggtgcagtatgatgtcgaccgtaaaagaagtcaagccgtgttttttcatcaatcttgcacatacactagattttctctaatacagtaaagctagtgtagcatgtataaaagagagttctgcaagcgcagttacaacgccagcaataggcacggcagacaaccccaaaaaacaaaaacatattactcactctgtccggaaatacttgtcggacaaatggatgaatctagacgtattttagttatagatacacccaattgtagccatctttccgacaagtatttcgggacggagggagtacatgtgtatgtcatggntaattagcaaaancaaaatcaaaaaaa

SEQ ID NO: 82147 - DNA, 641 bp, Triticum aestivum
  unsure (1)..(641): unsure at all n locations
  Clone ID: PAT_TA_82147
tcgagtttttttttttttttttttttttttgcaacttcgtcactttcgtgtacccatcggacggcagccctttcgggggttccttagggaccgattcactctgcgtagattgactgaacgcagaaagccttccactggcaggcgatcgtgtttttcacaggatttctcgttactcatgtcagcattctcacttctgatatctccaggtcttgtcaccaaaaaccttccccgattgacagaacgtcccgctactgacacttgaaaaagctgctttcaaggtctccgtcgcttcggtgaatcacttgagccctgagacatttccggtgccatggagctagacagtgagctattacgcnttctcaaaaggatggtgcttcaaagccaactcctggtgtcatcgctcnataactcctttcaacaagtgaatgctaaggacttacntacatcgggcgttccctcnnacttggatntancaccaacatcntcgtcaaggagacgccgtatcgggttcctgggttgaaaacaaatggggcaccaaccaatngtnncaaccggcaacaataaagccantgaaaattccgaacagnaaccattggggcttnccnacaanancctnttgcaaactggtnngccaagcntnn

SEQ ID NO: 82148 - DNA, 496 bp, Triticum aestivum
  unsure (1)..(496): unsure at all n locations
  Clone ID: PAT_TA_82148
cataaacccaagtcggactcgccttcctcctccccaactactcctctcctctcctccgcgcatcgcaccggggtcacctgagatcacacacacaatggtgaaggctgtggctgtgcttactggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcactgaagatgaaatccgccatgctggtgatcttggnaatgtgacanctggatggatggtgttgctancatcnatattactgactggcatatccccttantggacaaatnnatnttgggcctnctgttgtcctccaaggggacctgatgatnttggnaanggtggcatactganaagacnatnggaaa

SEQ ID NO: 82149 - DNA, 648 bp, Triticum aestivum
  unsure (1)..(648): unsure at all n locations
  Clone ID: PAT_TA_82149
gaacagttgggtacatggcaccaggtactaaattagctagcacttattatctttctcaaccaagcacttgttaaaaccgttgataaaatatatggattcactcaaaacaacaaggataaggtttaatttccatttatattttgttgagcagagtatgggtcgcttggaaaagcatcaaggaagagcgatgtgtttagttatggaatcatgatccttgaggtcttcactaagaaggagacccactgatgctacattcggtgcacaacctaaaccttaaggcaatggggtcaaccgtgcattcccgcagagcttgtccaaggtcattgatggccaactactgcaagaccctctcctttctaantgcggcttgggacaatggctttcttgaatccgtattgagctaagtttggccgtacaagtgaccgcctaacaagaggatgacatcatgatgtggttgtggcgctgaagaagtnaaaagcgagacacaaacatcaacaaagattcacttatgcacacaatgatcctcctcaagcaacttcatccaatatactagtangacaagtacatcccgggatnnaaaacaaanctttnaatggcaggaggatatgttcgttgatgtactgnagtaattgtaacaggttaaaaaaa

SEQ ID NO: 82150 - DNA, 660 bp, Triticum aestivum
  unsure (1)..(660): unsure at all n locations
  Clone ID: PAT_TA_82150
ctcaaccttggtcctcaatacaacgaccaaattaagaaggttgttgaaggtttgtacaagtgctttatcgaaactgacgctatccttttggaaatcaatcctttgggtttgaccattgatggtaaggtccttatttgcgatcaaaagatgaacgttgatgataacgctgcttacagataacccgaaatcgctcaaatggaagatattactcaaaaagatactaaggaaattgaagctgacaagaatgctttgaactatattgctttgggatggtaacatcggttgcatggttaacggtgccggtcttgctatggctaccatgggatttgattcaatccaaagaatgggtatgcccgctaactcctgggattgcggtggtaaggctgatgacagataggcctcgctgctttgaagattatggatcagttctaatgttgaagctattttgttaacacctcgctggtatacaaatgtgatacaattgctaagttaaatagactcttccgaataagtatgaagaaccatctcctanatgaaggnacaatgncaagaagcaataatatcaaganatggntcaanagttagcacgaaattaccaactgcnaaaggcgtaaatgcnnnatccaaatgcaaantnagacaaatcnctacagtgttana

SEQ ID NO: 82151 - DNA, 648 bp, Triticum aestivum
  unsure (1)..(648): unsure at all n locations
  Clone ID: PAT_TA_82151
accgccccctcttcttccaagatgtcgaagcgagggcgcggaggttccgctggaaacaagttccggatgtcgctgggtctgccggtggcagccactgtcaactgtgctgacaacactggtgccaagaacctgtacatcatctccgtgaagggaatcaaggggcgcctcaacaggcttccttctgcctgtgttggtgacatggttatggccactgtcaagaagggaaagcctgacctcangaagaaggcatgccggctgtcatcgtcaagcaacgcaagccgtggcgccnaaaggacgtgtcctcaagtacttcgaaagacaatgctggatcaatggtgaaaccaaaagggagagatgaaaggtctgccatcactgggaccgatntggaaagaatncgccgactggtggccaagattgccaacgcaacgaacgcatcgtctgnttgnttcccggacaactagatgnncaaggcttgataacangtcctctttatcnagttacttgtggccctgaggatganttctggatangtatgctgctggatatggtcgttacttctaaaattgacgtgnttgcacganattgtaattngnaaaanagnctgttatactggtangtcantagcactcanaantagtcttntggcna

SEQ ID NO: 82152 - DNA, 256 bp, Triticum aestivum
  unsure (1)..(256): unsure at all n locations
  Clone ID: PAT_TA_82152
cgtgtccggggtcagcgcctacaccggcgggatctgggtcgcggcgctgcaggccgccgctgccatggcacacatcgtcggcgacggcgacgccgagtgctgcttccgtgcgcggtacctcagggcgaagcgcgtgtacggtgaagagctctggaacggcacctacttcaactacgacaacagtggcggcaagacgagtcgtccatccaaggccgaccagtcgccgggcagtggtacntcacgttgtgtggctcgt

SEQ ID NO: 82153 - DNA, 259 bp, Triticum aestivum
  Clone ID: PAT_TA_82153
gcaggagtcactgccaaatatgcagtgtgttgatgtgttggttgtgcagggcataagagtgagcgagaacttcacgtctgatgaaatcactcaagacttcctggcaaatgccggcgctctggatgaggtgatgttgcccattgtctatgttgcattggaccaccatcctctctctcaatagacagacagaggattgtaagagaaacttttgatctgttctatcaaatagaaggtgatatccataacgaaaaaaaaaaaa

SEQ ID NO: 82154 - DNA, 650 bp, Triticum aestivum
  unsure (1)..(650): unsure at all n locations
  Clone ID: PAT_TA_82154
cagagacgtctttatgaacaaggtggtcttcgggcagaaggtatttttcgtataaatccagagaatagccaggaggagcttgtgagagaccggttaaacagcggaatcgtgccgtatggtattgatgtccactgtttgtcaggtctaataaaagcatggtttagagaactgccgagcggggtgctggaccctattccacctgaacaggtgatgcaatgccaatctgaagaggatgtgctccgggttgccaaatgcctcccaactaagctgaagcggcttacttgactggggccgttaattgatggctgatgtcctccaaagaagaaaagataaacaagatgaatgctcnaaacattgcnatggtttttcaaccaaattttacccaanatggaaatcctttgactgcactaatgtatgcatccaaatgatgaattttctgaaagatgctaatagagaagacctgaaggatagagaggatccaatctggacaagttcttgcccaaaaggaccgtctgatgaaacggcanataacctggcttgcgtcatccacgtccgaagataaagggtcctcttctaacaggaaccttcnaaancctgannagacgaagcaactacagacatctacgagngancgactcggaaaatnataa

SEQ ID NO: 82155 - DNA, 569 bp, Triticum aestivum
  unsure (1)..(569): unsure at all n locations
  Clone ID: PAT_TA_82155
gtgacgggaagcgtcactggactcaaggaagggctccacggcttccacgtgcacgctcttggtgacaccaccaacggctgcatgtcaactggaccacacttcaaccctgctggtcatgtgcatggggcaccagaagatgaaatccgccatgctggtgatcttggaaatgtgacagctgggagcggatggtgttgctaacatcaatgttactgactggcatatcccccttactgggacaaattcaattttggcgtctgtttcctccanngtgaccctatatctttggaagggtgncatgactttacaagacactggaacctggtcgcttttgctttcggacanccggtccaaggtaaatttactccaacngcaanttctanaatttnggaactttnnaaangcaaatttcancncattccaanaacacatgtttttcacttttaagtgcacaatcccgtgatccaaatggaccnganttntaaagtaattgnttccattctacggangtttcaatcttggtttgncttaacncacaactggaatttaaaaccaaattattcaaacttanc

SEQ ID NO: 82156 - DNA, 662 bp, Triticum aestivum
  unsure (1)..(662): unsure at all n locations
  Clone ID: PAT_TA_82156
cgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtggagtacaagaacatcaagcttcactgtnctggggatgtcggggggtcaaggacaagattaaggcactgtggaggcattactccagaacacacagggtctcatctttgttgtggacagcaacgatagggaccgtgttgttgaagcaagggatgaactccacangatgctgaatgaggatgattactnatctgtgctgctggtgtttgctaacaagcaagtcttcaaaatgcatgaatgctgctgagnnactgataagcttggctgcatcccttcgcaacgacactggtaatcaagacactntgctaaacaaggaaggattataaggctgactggcgtcaacaacatgcaacaagcctaaattctcaaattnaaggactaagacncttgtggacatnaacccggtacangatnttttgatggat

SEQ ID NO: 82157 - DNA, 464 bp, Triticum aestivum
  unsure (1)..(464): unsure at all n locations
  Clone ID: PAT_TA_82157
agaagggccgctacgcccagcgcgtcggcaccggcgcccccgtctacctcgccgccgtcctcgagtacctcgccgccgagctgctggagctcgccggaaacgccgccaaggacaacaagaagagccgcatcatcccgcgccacctgctgctcgctgtcaggaacgacgaggagctcggaaagctgctggccggcgtcaccatcgcgcacggtggcgtgatccccaagatcaacccggtgctcctccccaagaggacgccggagaaggaagggcaaggagcccaagtctcctaaagaagacgaccaagtcccccaagaagacaccaaagcttaaatcgatgcgttccattctaatgttcttcgtantggtccggtggtgttcctgtaacggtttcgtttcatcttgttagtgcatgtttaatgggagaactcaagaanctctctgacttgctcaaaaaaaaaaaa

SEQ ID NO: 82158 - DNA, 591 bp, Triticum aestivum
  unsure (1)..(591): unsure at all n locations
  Clone ID: PAT_TA_82158
atggttcacgcccaccgcacttctgcaagagcagtggtgctgtgtcccgcaacatcctccaggagttgcagaagatgggcatcattgatgtggaccccaagggtggaaggctcatcacctcccagggaaggcgtgatctgggaccaggttgcaggaactgttcctgccgaatctgatcaagttgaatcccctcctatgcaaccgtgttccgggtagtagaattgggtacanttttgaataatgataccccctggtgtttgttaatcccaaacttccgttgaagtaaattcgcatgctatccngggacaatggtaatggcctgactttttnaattaacctgcccgcctggggaganccttatgctttgtgagtccttggccataaagaggttttaccccctggccttaatgtatgnttaatgattnggctggccctacattccccctccaangattacatgcttttaaaccaaattnactagttaacaaccaaattcaangngttaccaaggggttaccttcttngaaagganctnaaattggcccnatcgtnaaaaaaatncgttaaaaaatnggagntaaaaaaaaaaaa

SEQ ID NO: 82159 - DNA, 586 bp, Triticum aestivum
  unsure (1)..(586): unsure at all n locations
  Clone ID: PAT_TA_82159
cccccgagcgccgccgccgccgccgccgccgactgcagccatgtcgctgatcgcgggtgaggagttccagcacatcctgcgtgtgctcaacaccaacgtcgacggtaagcagaagatcatgttcgcgctgacctccatcaagggtgtgggccgccgcttctccaacatccgtctgcaagaaggccgacatcgacatgaacaagagggcggagantttcctccggaggaatggaccgcctgatggcggttggtgcacaacccgcgccatttnaaggtgccggctgntcctcaaacaggaagaaggactacaaggacgcangttctccaattccntttcaaacccnttgganataanctcangaaaacctttaaaggtcaaanaaatttngganatccnggctgcttaacaacnggnctcnttccgttggcananacaaaactaccggaggaaaggaaaaatttggttcccaaaaannaaactgntnaaaagttcccaaactttcacaacgttgggcantcaaaatctaagatgtctgtaaacatacttgtnagtttgccaaaaagtctntcgacntaaaatgnctna

SEQ ID NO: 82160 - DNA, 517 bp, Triticum aestivum
  unsure (1)..(517): unsure at all n locations
  Clone ID: PAT_TA_82160
cctcaacctcctccgtccgctcgcagctcgaaccaaggagagaccgtcagccatgtccggccgcggcaagggaggcaaggggctcggcaagggcggcgccaagcgccaccggaaggtgctgcgcgacaacatccaagggcatcaccaagccggcgatccggcgcctcgctcggaggggcggcgttgaagcgcatctcccggctcatctacgaanggagaccccgcggcgtctcaagattttcctccgagaacgtcatcccgcgacgccgttcaccttacacggagcacgccccgccgcaaagaccgtcaaccgccatggacgttcgtctacgccgctcnaancgccaaggccgcacctcctaacgnttccggcggtagtcttcctcngcnacccaactgcaatttccgaaantttggatgatacccactngtgttantcccngtccctccngtttcgnttcctccggtttccgtaacgatcctgcaacaaatttcccattgttngaaaaaaaaaaaa

SEQ ID NO: 82161 - DNA, 503 bp, Triticum aestivum
  unsure (1)..(503): unsure at all n locations
  Clone ID: PAT_TA_82161
gctgtcccatcctccccgtcgccgccgccactccacctcccacattgggatcccctcgcccaatttccctcgatcccctcgcccagccagccactgagtaccagccacctcctccttaggatcttccccgatccaaacccgaagccaactaccttccccttcgtttgagccaccacccaatccaaccagcgccgattcccatccggtccagccggccactgctcccatcgaccccgggccgaagccatgggttgagaagccctccagccctctcctggtaactggttgtccaaccaagattcggccgntcatgttttttttccngcgcaacgaattttactatttttatccaagaacaacagatttggcaagaaaccctccaaaatccatgcatacatatccaanaccgtgcatcngttaaagtttatacaggtaatgcttaatttcactttcatataccatctccatcccangataaaagtattcgnttaaaatctttgtcn

SEQ ID NO: 82162 - DNA, 533 bp, Triticum aestivum
  unsure (1)..(533): unsure at all n locations
  Clone ID: PAT_TA_82162
tcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtgggtccgtgctcggcgtggctcctggagaacaaggcggggcattcgaggtggcccgcccgggcagtccggcgagggtgcagctgcggcgacaactgcaatgcaacccctgcaactgttaactgcatcacccctacntacttacgtnttatggtgttaagagtatacttntaataacagctcctgattctgatggancccacaagggtgcntntgccttttatttgcttgctcgtctccgcctatgctccgccaangggccttgngtgtaagtgtnttcccattctccctggtattctcaatcnactccaaactaagggatggattgatnaatatgttangaagaaaaattacctaattnactatcannaaaaaaaaaaaa

SEQ ID NO: 82163 - DNA, 583 bp, Triticum aestivum
  unsure (1)..(583): unsure at all n locations
  Clone ID: PAT_TA_82163
agcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctgggaggtcgancctctgacaccatccgacaacgtcaaggccaagatccaaggacaaggagggatcccaccggaccaacagcgtctcatctttgctggcaagcacttnaaggatggcgactttnngcggactacaacatccaagaagganccanattcaattggggctccttctgcncggtgggcaattancccctggcatggttttgctccggccccnggtnnaaatcncgttgtcctcgtgcctcccaatgntcnggccgttncccttnatcctaangcctttntttgtaacanatacnggagcatgttacnttgnactgaatcgctggttgcggacttgatgaactaaaatatgacctgatcggtcanaatcgttgctgcaattgntgacgnggttctcaacttcgancattgggaaaaaaaaaaaa

SEQ ID NO: 82164 - DNA, 634 bp, Triticum aestivum
  unsure (1)..(634): unsure at all n locations
  Clone ID: PAT_TA_82164
gaccattacatccaacgaggctgctccatacaggaatagaaaggggaccctctcccaaaatgtgatggtcgcctgcgacttcgatctcaactttgtttatgtgtcagctggttgggaggggtctgcctcagatgctggagtattgaaatctgctattcaatcaaggcttccatgtgcctcccgggcaantattattggttngacgggaggtatgcaaacacaccacanttcctactcccntaccgttggantccctttaccatcctnaaaaattcccgtaaaagtggcctcctcccaaaaaaccccaaagatccttccatcctnaagcatcccgtctaacnggacatataagcgtacattnggtgtttgggaaagcattcccnattttnaaanttggcnacattacccatttacacncnancaaatccctaatggcggagtnnttccacnaataancccgggtcccaanagggatnacatgggtaatacccacaatnaatgacccctcaattgtncnctctgaggngatgcanactcaatgttctaatctnacatcaagggaccttgnattcatanaataattcacaganttgtgcacaaattnatgaantttccggttacacaaattagttta

SEQ ID NO: 82165 - DNA, 256 bp, Triticum aestivum
  unsure (1)..(256): unsure at all n locations
  Clone ID: PAT_TA_82165
cgctctaaaaataataatagatgtattcacccgtgatactagctgtagttaacaatatataagctcatatgtgggcaccacagctgatcaatatatgcgacctgccgccagtagggtgacgaggccaaacctgccgcggcctgacgtggtagcgcagaaggaggcggntccgggaaaantttcttcncnccaagaactnccgttggttggttaccacggcgaaggaggaccnaccacnttataataggntgtgggg

SEQ ID NO: 82166 - DNA, 320 bp, Triticum aestivum
  unsure (1)..(320): unsure at all n locations
  Clone ID: PAT_TA_82166
ctgcttaccatcatctcaggagtcagaagctaggagcgtgtgatgtgtattacgtatcatagaagtgtcaaatacagtacagttttgaggaacaaacaaatattttgtgcttgcattcttgcctcttgcttccattctctttgcacttctggtagtatgtgtcttttttccgagtgtcttggtaantcttttaggaatttaggaggatacacggtcactccaancctctcttaaccatttcattttaaacatccgaatgacgcatgtnantcaaatacttttaaacctaacattttttgggatttannaaaaaaaaaaaa

SEQ ID NO: 82167 - DNA, 255 bp, Triticum aestivum
  unsure (1)..(255): unsure at all n locations
  Clone ID: PAT_TA_82167
ttatttagttcactctcggttaggtactcaacaatattaaatgttggttagcatggcaagaggtgaagtataacaaaactataccatctaaacaatttaaatggggccggatataccaaataatgaatccggtaaatccccatatgccttaagtaatatattgccacaacagtataaacatttaatgttgttatcatgatgcggatgacatgaacaanttaagcaatttattaaaagtggacaagacatttatga

SEQ ID NO: 82168 - DNA, 238 bp, Triticum aestivum
  unsure (1)..(238): unsure at all n locations
  Clone ID: PAT_TA_82168
ctcgagttttttttttttttttttnttttttttttnttttttttttttttttacaataccacgatgggatnaagggnangacaacancananttgcaacgaacaacaatggttctgaggtcttcancatagacatangtttgcttcatcncaaaccaaaaggancatcanatatcaagttggttcgncttactcatacctaacaaccagatttcttctanacaaaagcttangaccta

SEQ ID NO: 82169 - DNA, 547 bp, Triticum aestivum
  unsure (1)..(547): unsure at all n locations
  Clone ID: PAT_TA_82169
tgcctctgatcctcatcctgaggaacagactgaaatatgctctcacctaccgtgaagtgcaatctatccttatgcagcgtcatattatggttgatggaaaggtccgcactgacaagacctaccctgctgggtttcatggacatcatttccattcccaagactgggtgagaactacaggttctgttatgacaccaaggtcgcttccgccttcantctgtcaaggacgaagatgctaattcnanctctgcaaggcaggccntccaattttggccaaaangaatccaancctcaaaactatgatggcnnncaatccggnaccaaacaatcatcaaggcaatgaccaatcanctttacctggaaacanaaaatgttgnattaacaatttntacntccgnaacntggcaanggaactggtgggccanatggcttttgggtnttaaaacaggagacataaggactctagnacacacgtgaggatccaaggcacaatcncaccgttgggaactgtnacatggaaggnacaaccttgtancnccangcaggttca

SEQ ID NO: 82170 - DNA, 421 bp, Triticum aestivum
  unsure (1)..(421): unsure at all n locations
  Clone ID: PAT_TA_82170
ggccggcaacctcggcgactccgtcaccgtcacgcgcgacaagagcaaggtcaccgtcacctccgacggcgccttctccaagaggtacctcaagtacttgaccaagaagtacttgaagaagcacaacgtgcgggactggcttcgcgtgatcgcagccaacaaggagcgcaacgtgtacgagtccggtactcaacatcngctggagaatgaggcgaggaggaggtttagagtgcatgttatatgtagtgctggttgagttttgatacttgatctganactccctagttacccacctaccttatgttgtgcccctttttaacatggatggttnattccnaaanccttanatttgtctgcgtgtancatatttctgaacctaataacatattangaattgtcccgtttccaccgaatgcggngc

SEQ ID NO: 82171 - DNA, 565 bp, Triticum aestivum
  unsure (1)..(565): unsure at all n locations
  Clone ID: PAT_TA_82171
cgagaagcgagtggaggggctgactgtagaactgattgcagctaaaggatctcttgagttggcccatgctgcacatcatgatgctgaagaacgtagaatcggcgcagtactggcgaaagagcaagattgccttgcttgggatagagagttggtccaggcacaagaggaggtgcaacaactgaacaataagcttctgtcccaaaatgatttngaagaggaacttggaagcaaattgcgcaantgcatggctcaatctgacttgcagatatgtgggagagtatactgtgcaaagaactttaagattnccaaggacatgatcctgaagatctagacaatttacactcaatttaggaactctacttccaacacagaaagaccccaagaggtttaagcaaacattgaaatacaaaactgaggcaatntttanattnccgnacatccncaattaaacccacaggagaactcacttgacccattcancaagaggaattatggacatgcattctcacaaaacgactaacagnccaaaagaataaacngtagatcaggaganatccagaaaatg

SEQ ID NO: 82172 - DNA, 643 bp, Triticum aestivum
  unsure (1)..(643): unsure at all n locations
  Clone ID: PAT_TA_82172
agtgcgtacatgcgaacgaaggtaacatacacaaattacacgattcaataaaaaagatcaatttacatgagtgacgacaaccggctgactttctcagccgactgagcagtaaccacgcccttacataaaaccacactcaataattaaccaatcccgtcaaatgaactccgttcaatttaagctaaagaaacaacctgggcgtgtaaagtatgacgtgatgaataatagtaaaggagaancatagtctatgggatgcatacgtatatgaaacaaatattctgccatatacaaagagcaancaaccaacccaaaaaaaagaagaagaagacaanccatgatttgcatatatagtttgcccatcccacccgtgggtaacaactggnacctaattnaatncanaacaaggcgcctcaacttccgctacgggaccgctccccaacaactcnggacggttaacgcgccgngctngctctcactnactctctctccctctcngggcggtgctgccagcattnacatggcggacagtctgcgntctgtagtagatggttgtggtcatacaagtgatcattcgcgtctatatgcgntcnctgatanccgtnaataagcatngacacataacccccgttttgcacatgncccn

SEQ ID NO: 82173 - DNA, 591 bp, Triticum aestivum
  unsure (1)..(591): unsure at all n locations
  Clone ID: PAT_TA_82173
ctgattcggggcatgctaagttccggttccttctctagctctggttggcctcctctcagggatgttcgtggcggcggtgaggtctcggtgttcgacgtccttcgaagatgttgcaggctcttgttgctcggcatggtgcccaggtttgctcatttggtgatggtggtccgatgtggacaccaagaggaggtgcactgctccnctccggtgggaacattgcccttccgggtgccatcaaggacttcccgttctccgccgatgccaccttnggtgatgggatgcccttccgacgggtttcganctccctaaggccttcaaantccaagagtgattcnctgggcaagcccggaatttttcctcctanatcgccttgatgtccggnaaccgttccattgattcnaacaaanctcccttctcttccncgtttgttcnattccgttgggtgccagttnaagnttttacngcnaaggaaatccttcggtcccnctcggtcccgtggtcctctgtgggngtgttgcacactgtatcctgcgtgacctgtnngtttanaaataaaatgtcaggcggttttgctgctacaaaaaaaaaaaa

SEQ ID NO: 82174 - DNA, 638 bp, Triticum aestivum
  unsure (1)..(638): unsure at all n locations
  Clone ID: PAT_TA_82174
gccctatatatactacttactccccccctcaaacacggagacgagtttaccacggtttccacccctccctctataccgcagcaacaagtatttttttacccctttcccctccctctataccgcagcaacaagtatttttttacccctttcagaacgcgctcctcgcgccacaaagccgcctctagacgcgtgaccaatgagcagcgagctaaaacatatcgcaaatgtcaaaaataatataacggggttaatatatatcgcgcacatgcgatatgtttgtcacgaggcgcaaaaaataattaaaaagggaatgcaacacgaggacttcccaagaggtcaaccatcctagtactactctcgcccaaagcangcttaacttcanagttctgatgggattcggtgcttantgctggnaagatcgcatccgacatgttaccccacttcgtcccntangcntgcantccaagtcaacgcaaagatgattgncatctacacattaaacgttgctaanaangggaatgcctaataacactaacccccgctaaaancagggantncanggttcanccccccaancgaaaaangntttttaccttaaaaggnctcgcaaaacgctcaacctncaagganantaaatt

SEQ ID NO: 82175 - DNA, 564 bp, Triticum aestivum
  unsure (1)..(564): unsure at all n locations
  Clone ID: PAT_TA_82175
gccatctccccgcctacgccgccgcagccgcctcctgctacccgccgccgagatgacgaagcgcaccaagaaggccggaatcgtcgggaagtatggtaccaggtatggtgccagtttgcgtaagcagatcaagaagatggaggtgtctcaagcactccaagtacttctgtgaattctgtgggaagtttgctgtgaagaggaaagctgttggaatttggggatgcaaggactgtggcaaggtcaaggctggcggcgcctataccatgaacactgctagtgcaatcaacgtcaggagcacgattcgtcgcttgagggaacaaaccgaagcatgattgccctactgttgtcctgaagaatccaagggntcgtnatggatngaagacttaaaatcnccgtatttggntaacnaacgatgntanccggtaataatttggtcngaatttagatttttgaaactntaatatgtncnaaaatgccgtttgcttatgcaaccaantgtattttgtganngntccaatctcaacctctgacccaatcaactttaaaaaaggggggccgtncaat

SEQ ID NO: 82176 - DNA, 617 bp, Triticum aestivum
  unsure (1)..(617): unsure at all n locations
  Clone ID: PAT_TA_82176
ctgactacaacatccagaaggagtccacccttcacctggtgctgaggctccgtggtggcatgcagatatttgtgaagaccctcaccggcaagaccatcaccctggaggtggagtcatctgacaccatcgacaacgtcaaggcgaagatccaggacaaggagggcattcccccggaccagcagcgtcttatctttgctggcaaacagctcgaggatggccgcacccttgcggactacaacatccagaaagagtccaccctccacttggtgctcaggctccgtggtggtatgcagatttttgtcaagaccctgaccggcaagaccatcaacctggaggtcgagtctctgacaacattgacaatgtgaaggcaagatcaagacaaggagggcatcccccggacaacaacgtctcatcttcgctggnaaacaacttnaggatggcccaacctngcgattanantcaagaggatcaactcaactntcctccgcttctggagnatcaatcttgnaagactcacggnanatacacttgaggtgatcatctaacatcacactgagcaagtcaagaaggaggatccccggcaaaagctacttctggaaactngatgcnactgaaaa

SEQ ID NO: 82177 - DNA, 369 bp, Triticum aestivum
  Clone ID: PAT_TA_82177
gccgtctcaggtgcatctcgggggtacgttcttcgtggccgtcaaggacggtgacggggaggacgccgtggccgtgccggtcatgctgccgaggacggccatggggctgttcgcggcggagatagaaacctcgctgaaggcttgattatacacctgaaaaataagctgcgtcgacgtgcgtacgtagtactctcctattaatatgtcttctccgaaatagaaaaccagttttttcacagatctcatgctgcttatatctgatattctgaacttcacccactcatactgcttatatatgaacttcacccactgggttgtgtacaacatactaccagatagtataagcatgctgtatataaaaaaaaaaaa

SEQ ID NO: 82178 - DNA, 581 bp, Triticum aestivum
  unsure (1)..(581): unsure at all n locations
  Clone ID: PAT_TA_82178
cctcaacctccccggcgcatctccgacgacatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccaagaagagcaccgagctgctcatccgcaagctccccttccagcgcctcgtccgcgagatngcccaggacttcaagaccgacctccgcttcaagtcctccgccgtctccgccctgcaagaagccgccgagtcctaactcgtcgggctgttcgaggacacaacctgtgcgccatcacgccaagcgcgtcacatcatgccaaggacatcaactcgccgccgatcgtgggaaaagggctaggcgcaatctgaatcatatcctcgtcctgtaggtgagtctccgtggaatggtgtcnataaggttacaatttcgtttgtctgtaaggnggatcgtatcctaactatggacgctgttcataacaattcatggaataaagtggtgcgtccan

SEQ ID NO: 82179 - DNA, 616 bp, Triticum aestivum
  unsure (1)..(616): unsure at all n locations
  Clone ID: PAT_TA_82179
gccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggaccaagtgctcttcaacaacgacaccaacgacaacactgtccgcaactttgcgtcaaagcggcggccttcancaacgccttcacgacggcatatcaagatgggaaacatcgcgccgctcacgggaccaagggcaantnaggtcaactgctcaaggtgaatcntgatgacgttgcgtcggaacacacactgaatgataagcccaaacatggcaatacactntatacaacactgatcttattnaaacattgcacacaatcatnatnatcactngntacacgtgatcccattncatnaaagnagggatnttcatccactaaaaaaaaaaaa

SEQ ID NO: 82180 - DNA, 253 bp, Triticum aestivum
  unsure (1)..(253): unsure at all n locations
  Clone ID: PAT_TA_82180
actgcaagtgcgggaagatgtaccctgatctgacggagcagggcagcgccgccgccgaggtcgccgccgtggtcgtcctcggcgtggcgcctgagaacaaggcgggacanttcgaggtggccgccgggcantccggcnanggctgcaacttcggcgacaactgcaagttgcaacccctggcaactgtttaacttcatgcantcctangttataagtttgatagtgtnanaatatacnttaataaanagcgtct

SEQ ID NO: 82181 - DNA, 487 bp, Triticum aestivum
  unsure (1)..(487): unsure at all n locations
  Clone ID: PAT_TA_82181
gcaccatcggcacccactgcgccgccggcatgaagctagccgtcaccgccggcgactccagccccggtacccccgcggcgggggacgccgcccaccaccccgtccgggtccggcggctcccgcgtgcgcatggaggccggccccgtcctcgcggccaccgccggcgttcctcctcaagctcgccctcttctgatcctccgatgattcgatgttggaaatttcgtcgatcgttctacgttttcttctgacggccacgcacacgctagtttgggaacgagatggttgcctgtgcttcctgatgtgatatgattggttggttccgtagtaattggcgtgagtgacttgtatggattattatctcgatgtttctacctatataataggatcctcatacaaggtgatcaaataantttggtccttcaaaaaaaaggggggccggtaccaattnncctatatnagcctatannccgctcantggctcntttaa

SEQ ID NO: 82182 - DNA, 400 bp, Triticum aestivum
  unsure (1)..(400): unsure at all n locations
  Clone ID: PAT_TA_82182
agggcacccgcgaccgcccctacgggcactgcctcgtcgccggcctggccaagtacccgaagaaggtgatccgcaaggactcggccaagaagacggccaagaagtcgcgcgtcaaggtgttcctcaagctcgtcaacttcacccacctcatgcccacccgctacaccctcgacgtcgacctcaaggaggtggctccggggcgcccgatccctcaactccaangacaanaaagtnggcgccgcaaaggccgccaaaggcaancnccaagaaaagttcaagaaccgnaaaaaaggngtncttaacaanttcgtttcnaaggtttaagccaaccgcaagggttttcntgcnttnaaacnaacctttaaattttaaccgcntnccctggaacttccctttttgg

SEQ ID NO: 82183 - DNA, 482 bp, Triticum aestivum
  unsure (1)..(482): unsure at all n locations
  Clone ID: PAT_TA_82183
gctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaaggccgccggcgccaccctcctccgtctccgccaccgccacccacaaggcgaagctccggcggcatggagatngccggcccgagaacggcggctgcngctgcacccaatgcaagtgcggaccagctgcggctgctcctgctgcagctgctagatnatttgatcatcgattaatgcatcaccgcgcgtgcacatcgattatatcgatttactaactacatacatgttaccctactnattnaanggcttatctatcacctgactgcatcaacatcaagtgcatccancttgttntaaaaagccccctnaataaacccctgggttaactaanaaaaaaaaaaaa

SEQ ID NO: 82184 - DNA, 479 bp, Triticum aestivum
  unsure (1)..(479): unsure at all n locations
  Clone ID: PAT_TA_82184
gaaatcagttagaggtcggtattttggtaggcacctggtagaaaaatagccagggccggagtaccgaacaaccgactgctatcttgttttctttcgttgtgtaactgatcgtatacctgtcgttgccgcgtctactcgtgtcacggatcacagcatcatgggaggcagcggagaagaaaactgcagctactgggtttgtcgccaccgccgctacaacagcnaaacnggggaaccgcgactcctatccggttcacgcccgatttaaccgggcgcttgttagtncaannccgacgggcgttttnccatgcaagtcatccggcacgtccgtnatnacnaacgtggtttccccaacgngtctacntcccaaggtcaaggcnactcgctccgcaancaactcnccaactaaataaacgttgggttnaaccncgaacngcaataagangcgctatggacatcnccggaaacatgtggggaatgga

SEQ ID NO: 82185 - DNA, 484 bp, Triticum aestivum
  unsure (1)..(484): unsure at all n locations
  Clone ID: PAT_TA_82185
agaaggggatactgtccatccccacctcgatgcctccacagctttccatcgagcactaaccacatgggcatcatgggtcgaccgctacatcgatccgcgcaaaacgcaagtgttcttccgaagctcgtccccatcacacttcagcggcggggagtggaattctggggggcactgcagagagagcacaatgcctcttaatgacactccgtgcaaggccggtgcccgagagaaatgcgatctttgggacaagttagcgaagcaaatgaagatcctggtaacattctgaacattacaatctatctgggtcaaggataatggaaccctctnttnnggaagtaaggnaggaatttaacanatccaagcacccaanatgnaccacgggccttccctganngcctggannatggaatnactttttaacaatttagtaccncanatnaaacngttttaantttaggacggttgcaacctaaaagtcccttnn

SEQ ID NO: 82186 - DNA, 470 bp, Triticum aestivum
  unsure (1)..(470): unsure at all n locations
  Clone ID: PAT_TA_82186
tgtacatgactgaccttgacaagcagcagatagttcgtgtgcggacgttgggggattacgcgttgttcatcgggcacaactatacttgttgcctttccacacaggactacccagggcttctgcggaaccatgtctattttacggacgatgacnagtattggctgatagattcgaaagacaatccgtcgggatgttggaatactagatttggaggatttaagtgccactgatgttgtatctcctcaaccatggttgaattgggcaatcccgtaaggatcacccaagttttaataagatccataaatagtctccgaagagaatgccttgcttgtcataaatatttactccanaactatcctggtgtantttttctgcgaanaanacagtangtttgtgggaanaaaatctctgcttgtcaaaaatattaccccagaaatatccggcgttccgcatacctggccntgaanaaa

SEQ ID NO: 82187 - DNA, 476 bp, Triticum aestivum
  unsure (1)..(476): unsure at all n locations
  Clone ID: PAT_TA_82187
ctcacccacccctcttctccgatggcccgcacgaagcagacggcgcgcaagtccactggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccaagaagagcacggagctgctcatccgcaagctccccttccagcgcctggtgagggagatcgcccaggacttcaagaccgacctgaggttccagtcctccgccgtgtcggcgctgcaggaggccgccgaggcgtactggttggcctgttcgaggacacaactctgcgcatccagccaacgcgtcacatcatgcccaaggacatcaacttgcaagccgcanccgcngggagcgcgcctaagttttaattcgccgccttnacaatatgggtataactctcttcngntttctg

SEQ ID NO: 82188 - DNA, 478 bp, Triticum aestivum
  unsure (1)..(478): unsure at all n locations
  Clone ID: PAT_TA_82188
gtggcctgcgctagctctgtgtcattgctgcttcccctgatcgcaggttgcctccgtcccatgaccaagtgttgttttcccccctctgaactgcttcctctttgctgtagaccactacctctgagccaactgccgctactgcacgaagccatctactgctatgcagcttatttctcatctaattttccaatggaaacctgggtgctgcaacttctatagatttgtccgcacagggaagaaaatagaagattgagagaatgcacatacagtggtgggaagtgtgaagctagctatggatgcatagccaaatgaatccacgagtggagtatacagtataatatgtttggtacacacnggagaagacacgctagaggacaagaaagatcatgtgatttanaaaaattgatgaccgtgctttttgttaaaaggaacacatctccaancattcgtgtgttgcacatgctgccatgaaacaaca

SEQ ID NO: 82189 - DNA, 490 bp, Triticum aestivum
  unsure (1)..(490): unsure at all n locations
  Clone ID: PAT_TA_82189
tctgaactcgtaccaatccccaccaccaccgattcagcttcctcatgtaaaatcgccaccagtttcttcaacatctccacagcctctgcaccactacagctctccaccaccatcgcttccaaactcgtaccaatccccaccaccaccgattcagcttcctcatgtaaaatcgccaccagtttcttcaacacctccacagcctctgcaccactacagctcaccaccaccatcgcttctgaactcctaccaatccccgccaccaccgagtcacctgtcataagcaacaggaaggacttcttgaaatgatcaagacgtgggcagaataaacagaagagttnaagactatctcgaagaggaagaagcgccgcaactggagtttcaactggtgggtctcaatcnctagnaattatttaccaattnctacggcgcttcagctttcccttggttccnanagtatccaanaatgtaccataatcctagagtatggtng

SEQ ID NO: 82190 - DNA, 203 bp, Triticum aestivum
  unsure (1)..(203): unsure at all n locations
  Clone ID: PAT_TA_82190
accaggtccaccgtaggagcaaggaagggagatccacctaacccaccaatggcggccgctgcttcctccagcgcgtggaaggcgaggtggctccgccccgaggcgtaccctatctttgcggcgacgggcgtggccgtggggatctgcgtcatgcagctggtgcgcaacatcaccaccaaccccgaggtccgggtgcnaaaaaa

SEQ ID NO: 82191 - DNA, 381 bp, Triticum aestivum
  unsure (1)..(381): unsure at all n locations
  Clone ID: PAT_TA_82191
gcgatggccacgctggagctcactgtggcacggcttctctactacttcgactggagcctccccaacgggattcgaccggaggagctcgacatggacatgatcgtcggcgcaacggcaagaagaaggaaccaactgcacctaattgcagtgccctataatgtcccaatccgatctttaaagcccgatgtttgtgacaantaacttccntcttctgccatgtngggatgaatgtccatatatgcctatttttatcaatgntatgggacaaataaatatttccggcaaatacattgtatatatagagttaattcatttgtnggcactttaattgccanttttggcaatcccaacaaattaattacgatttccaaaaaaaaaaaa

SEQ ID NO: 82192 - DNA, 387 bp, Triticum aestivum
  unsure (1)..(387): unsure at all n locations
  Clone ID: PAT_TA_82192
ggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaaagctgcatgcactcctactacgtgtgttgggtgttaagaattatacttgaataacgagcgtctgattctgatggatcccaacaaggtgcntttncctttnccttttgnttgcttgctccctctcccnatctctgcccatggnnccttgngtnaagtgtgtnttnnagtttnccccggtattgcttaaacnatccccnccnatggaggatta

SEQ ID NO: 82193 - DNA, 361 bp, Triticum aestivum
  unsure (1)..(361): unsure at all n locations
  Clone ID: PAT_TA_82193
agctcttctccttgaacttaccggtgaattaaaaaaagaagcaagcgtgcaacaactgattaccgatatcaacgaattgctactagacaaaaggttaccaaacaggacaatattctttctcctacaaatatacttgaggagttggggccaaaaaatgtccatctttcgcccacccagggtctgcagtgaaatctgggtaaggtgcccaattgctttccgtgctccaccttaagtcagattcgagtattggggaaaagaaaatgtttcngatataaaaaagaccaccattctctccctaaatcctatggtaancaacctnacccacttnccnccgttggatttttaancccttttaaaaaat

SEQ ID NO: 82194 - DNA, 397 bp, Triticum aestivum
  unsure (1)..(397): unsure at all n locations
  Clone ID: PAT_TA_82194
gtttccagttgcaagccgcgccgccgccgccgccgccatgggacactcgaacgtctggaactcgcaccccaagaactacggccccggatcgagggtttgccgtgtctgcggcaactcgcatggcctgatccgcaagtacgggctgatgtgctgcaggcagtgcttccgcagcaacgccaaaggacattggttcatcaaantacgtttaaaatggaacctcaaaggancaangnctaggaattttcnacaatgggggcttcnacagggntttttttcccanaaccctttnangaccggatanttttaaccccggggaaaaacntttaaaaattttnacgcgntttncaantttaacccatttgttacccnctggcacatcggggtnaaaaaaaaaaaa

SEQ ID NO: 82195 - DNA, 506 bp, Triticum aestivum
  unsure (1)..(506): unsure at all n locations
  Clone ID: PAT_TA_82195
gatcaccaagcagaggagatcaagtcgagggaaaagcggtcaaaagagaggcttctctttgatgccgtcaatgaggcgctcaccgagcttacttggacaacagaactgtccgcgtacccatggggccggacattttgttcgcaacgcaaagatcgtgatgatgattcctcctgtaactccgccgccgatgaaatttggcggntataaggaactgggtccgatactccgacaantatccgcccggcgaaatccatccgagaagnactttctgctgggagattattctgaaaaaggagttgttggaanaaccgcaacggcccgacacgacccgntaaagactttgnatcctgcncatngtttcacggtggttttggagactgctttaggagccttgtaattttnctaacanactatgagnactcaaccccaacatgattgctcnccccaatcgtatntccgtcnctnaagaatgcccgcgtnaacttcnattacgtttacgcaaaaaa

SEQ ID NO: 82196 - DNA, 350 bp, Triticum aestivum
  unsure (1)..(350): unsure at all n locations
  Clone ID: PAT_TA_82196
gagcccttctcgacggggccgacgagcggctcgacggcgagtacgatagggcggaggtggagcgcgtgatggtcgccgggctctggtgcgcgcacccggacccgagcgcgcggccgtccatgagagcagccatggccgtgctccagtccaaggatgctaatcaagctgccggtgctccccgccagttatgcccgtncccaacttacgggccgctggtgtcnttngcccaaccggctgtcttcgttnantgttaaanantcaacntcaacttcnaacaancnggtaanggaaaaaannttntaatttaaccgnacnttncaaaattggnttaaangttcccctcccttacc

SEQ ID NO: 82197 - DNA, 525 bp, Triticum aestivum
  unsure (1)..(525): unsure at all n locations
  Clone ID: PAT_TA_82197
gcagcgtccgatggcccccaaggcggagaagaagccggctgccgcggagaagactccggcggccgagaagaccaccgcgggcaagaagcccaaggccgagaagcggccgcccaagtccaaggagggcggcgccgacaagaagaagaagaaggccaagaagagcgtggagacttacaagatctacatcttcaaggtgctgaagcaggtgcacccggacatccggatctcctccaaagncatgtccatcatgaatcctttcatcaaacgacatcttccgagaaagtccccngcgatccgcccaantcgcccgcttacaacaagaacccacatcacttcccgggagtttcaaactcccntccgcttctccttccccggggaantncgccaaaangctttccctnaaggnacnaggcttcacaatttaactcctccttaaatacatttcncngtctcccggggttcanttccnccgtaaggcactgttcngacaanttggcttgtattgtgcnggtgtgtggaaaaatn

SEQ ID NO: 82198 - DNA, 517 bp, Triticum aestivum
  unsure (1)..(517): unsure at all n locations
  Clone ID: PAT_TA_82198
catcgacaacgtcaaggccaagatccaggacaaggagggcattcccccggaccagcagcgtctcatttttgctggcaagcagctcgaggatggccgcacgctcgctgactacaacatccaagaaggaatccacactccacctgggtgctcangctccgtggtggcatgcagttttccgtcaaagaccctgaccggcaagaccatcacctggaggtccnatcctcctgacaccatccgacaactccaaggcaagattccaagacaaggaggnatcccaaccggacaacaacgtctcaacctttgcctggaaacaactttaaggatggcnantttttggnggnttaaanatccaaaaggatccnaanttaattggggccccttttgccgggtgggcaattaacncccggcaaaggtttggctncggnccccgggttnaaaatcccntttccccnggtncccccaaagganncgggcngtttcctttnaancccnaatgttcttttttgtaaacaaaaac

SEQ ID NO: 82199 - DNA, 445 bp, Triticum aestivum
  unsure (1)..(445): unsure at all n locations
  Clone ID: PAT_TA_82199
gaaagatttttactggaatcttatatcgaggacaatgatacagtcaagtggtgccccagcacaccacattgcggaaatgctatacgtgtcaaaggtgatattcattgcgaggtggaatgtacatgtggacgccagttttgttttaattgctcctcaagaagcgcattccccttgttcctgtgtgatgtgggactctgggttcaagaaatgccgtgatgaatcaagagactgtgaattggtaacagtaaatactaagcccgtcccaagtgtcataaaccctgttggagaaaaatggtggctgaacctggttcantntaaatttgggcnacatatccgttggtaagtttggnggnncaccggnaaaattnacacatgggcaacntttaccggcaaaatttttggccntttcananaatttagtcaacaagacanancaacaagggaa

SEQ ID NO: 82200 - DNA, 479 bp, Triticum aestivum
  unsure (1)..(479): unsure at all n locations
  Clone ID: PAT_TA_82200
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcaactgcaactgaacccggcgccangaagccggccggcaaaggcaacacagatnaggaggagaaacaagcatcatatcacatcacaacaccaacgtataatacactaaccgccgcatcgctccgcgcgcgctaaataaataaacgnattgtcctaagtcgtagcctcccntgtatgtcn

SEQ ID NO: 82201 - DNA, 496 bp, Triticum aestivum
  unsure (1)..(496): unsure at all n locations
  Clone ID: PAT_TA_82201
gcgttttcctcgcggcagaagagagggggctcttccttgcggcagtggcgggcgtgttcctcgcgacggcggcggcgacgggcgtgttcctcgcgacggcagcggcgggcttgtcccttgcggcggtggtggcagctcggctgcgtgggggaggtgaagcagcggcggcaacggccgcgtggtcgaaagggaaaggggcgcctaaggttcctccttccccaaccccaaccagctctgcangaaccgacgccccaagctcgccaacgagatctcgctctcaccgtcaacaccaagaaaaagcttcaacccgagatgacttggaggagcaacggaaagcaatactcccgctaaagactgagaagagaaaactagtgggtttaaagaaaattcaatgtacaaatgctaaatgtaatgtttggatnatatggggtcnactgattggtnatatttcanatnantactaaactggtacgtacttncaaatccaaatggnatc

SEQ ID NO: 82202 - DNA, 527 bp, Triticum aestivum
  unsure (1)..(527): unsure at all n locations
  Clone ID: PAT_TA_82202
ggcaaatacacctataacggagagcaatatgacgccatagcgcctcctcaaggagcagcatacgacaagtgcagagaggatgtcaccaaggcgcttaagatcaacgcgccctgccaggccaagaactgcaccttcaacggcgcatggaatggtggtggcggccctggccaagccgacctctacgtcacctccagcttctactacatggcagcagacgttgggttgatcgacagtgaggccacaagcgggaagaccaccctgcggcgttcaaaggccgccgcccgagaagattttgccccgatgggttcaatgggaaccaaaggcaacttacccaaagggcgattccgttcnacacncctaatctgcatggactccttctacaattanccctgccccttggacggtttcggcttgagcccaaccaanggaatcncggtggcgcaaaangngaacatggganatncatcnaacccatggggnccganaacatccaggctttcaaccacaaacggnaacatcatgnttnt

SEQ ID NO: 82203 - DNA, 320 bp, Triticum aestivum
  unsure (1)..(320): unsure at all n locations
  Clone ID: PAT_TA_82203
gttggcttctcctccccactcagtcctcggttcccggcccggttcggttcgttagggtttagtantggggaagaggaggaagaatggnggacgtcgagtaccgctgcttcgtcggcggcctcgcntgggccaccgacnaccantccctccagaacgccttctccaantacggcgatgtcatcnactctangatcatcactgacagggagacnggccgttcccgcggnttcgggttcgtnaccttcgcgtcnnacgaggcganccncccaggcgatnnangtcatgaacngncagtacctngacgncgcancatcancggt

SEQ ID NO: 82204 - DNA, 471 bp, Triticum aestivum
  unsure (1)..(471): unsure at all n locations
  Clone ID: PAT_TA_82204
gacgacatggcccgcaccaagcagacggcgaggaagtccaccggcggcaaggcgccgaggaagcagctggcgaccaaggccgcccgcaagtcggccccggccaccggcggcgtgaagaagccccaccgcttccgccccggcaccgtcgcgctccgtngagattccgcaagtaccagaaagagcacggagcttgctcatccgcaantccccttncaacgctcctccgggaaatttgccaaagacttnnaagaccgacttcgcttcnatncttcgncttttccgcctgcaaggaagcgccccaaggctactccnnggggctctttnnaggganacaacttnttgngcattcaanccnaacggttaacatcatgcccaagaattcaatttnccnccgatccttgnnaaaanggctaaggtggggctgaatccaatcaaggtcntgcaantccnttcatttgngggaaatttttc

SEQ ID NO: 82205 - DNA, 356 bp, Triticum aestivum
  unsure (1)..(356): unsure at all n locations
  Clone ID: PAT_TA_82205
gcaagttcaannacgggaancacggccacggtaagtncaatcacggcaagcatgggaancacggcatgttcggnggcgncggtaagttcaagaagtggaantaatgcgctagctagtaccttcanaatnggtgatgaatcanaaanntacctanactcttcntntatgcttccacanattggnttggtcacggaaagctttgacatgtatctaatcagggtgtgatgtggttctgcncggatntcnatatagcttccatccattcctctatatgattgggacctatctgcctcngtganaatgatatacttncantaactnccggaattcngtctggggctacgcnttnanaaacc

SEQ ID NO: 82206 - DNA, 440 bp, Triticum aestivum
  unsure (1)..(440): unsure at all n locations
  Clone ID: PAT_TA_82206
atataggtatgtttatcttgctgtttcaggttagaataatgattttaagccatgtagataaccttcaactagcaatgccaatcatataacccttgagcatgtgacagagttttcaccctcaccatgtccaagtgacgttgctagcaggagtaagatgtttgggttggcggagtcggcggccggtagtaaagcaagggtgttgtgttacaaatttttcaaccaagaaattcacataggataatttttccctcnaataanaccctttaaattttaagactttcaaaatggttccccccaaataaanangttttggcaactttnaaatttancctttggaaaaaaatgccttttaactnaaatntnaaaagttacccccngggnaaaatcccagcccttnnaaatttggncctttaanagccaannggaccccagtttnantt

SEQ ID NO: 82207 - DNA, 366 bp, Triticum aestivum
  unsure (1)..(366): unsure at all n locations
  Clone ID: PAT_TA_82207
actcgttcgagtttgggacgggaggacggacaaggacggactatatatacagaagaggggtagatcggagtcggagagagagaacggatccgaagttatttcttggcaacaagaagatcccttgggggtgagataccggcgtctactaccatggggcagaaggggcgtcgccgccaaaacctaacccggaatggagtgaatagaaagaaaggacccctctatcaacaatttgcgatggtgattcncaaaaatggcgaaacattgacatattcaatgccatacttccaaaaaaaacttgcatgctgcaacgnccaaggggcctangtttttttcaaaggccggaggttcaaatntnanaaatgnaaa

SEQ ID NO: 82208 - DNA, 505 bp, Triticum aestivum
  unsure (1)..(505): unsure at all n locations
  Clone ID: PAT_TA_82208
cctccctggactctgcagcttgactatcaacaactgctacaatctaaccagctcaccagagattactagggccctatcctctctccagcaacttgcgatcgacgagtgccatggcattcaatctttgccggaggacatgttagccaagctcactggcctcaaagctctgtatatttggaactgtcctgagctgaagaagtggtgtgaatcaagaggagaacagacagaagctcgctcacatccaagtaaaatttgagaaatttgataccaagcaagactggcgtgcatcctccgaaatataaagaagcgtctcagttcttgatttctgagcactaaccgctggaacagcactgcaaggccggcggcattaccttacgggttctgatgatgaatgaaaactctgcaccggaaggcaattttcatccgagtaattagtttaagtccatccgcaaacactctgtccgcagaacatgattcagacacacttgttttagtttcatcantn

SEQ ID NO: 82209 - DNA, 322 bp, Triticum aestivum
  Clone ID: PAT_TA_82209
cggcgccgagctctagcctccagctatgcagctatggccggccggggcaatcccttcgtcgtatatgatgctatgtacacgtcacccccaagtgttccctccattccataattcttcttgtggttttagtttaaattaaaattaaatccaaacccaacactaaggaacggaaggagtctacggtatagtaagtatgtgtatcttatttaattttaattttgagattgtgtatcttataagatatttggcgatattttattgtcacaacagcgctataattacgaatattttcatattatatttcattattaaaaaaaaaaaa

SEQ ID NO: 82210 - DNA, 492 bp, Triticum aestivum
  unsure (1)..(492): unsure at all n locations
  Clone ID: PAT_TA_82210
gatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctgggcgccatccgcaagggtgggacacatccgtcatcaaaggcccgtccctgcaaggtttgtttgaggtctccacctccaagactgggaagcatggtcacgcaaagtgtcacttggttgccaattgacatctttaatgggaaagaagttgangatatcgttccttcatcccanaactgtgacgtccccaagttgaccgccaagattatcaactgatttacataactgatgatgntatgtaancttctcactgagagtggnaacactaanggtgactgaaactcccactgataagttctgcttggcaaattaaaacnggtttgctatggaaggactn

SEQ ID NO: 82211 - DNA, 498 bp, Triticum aestivum
  unsure (1)..(498): unsure at all n locations
  Clone ID: PAT_TA_82211
gttccaggccgtcaagctccacacatggatcaagagatttcagatgaaagaaatgcatgctttagaagattctttcctcatgggggcccagaaatgaatgaactgaaacagcagtttgccaacttcagtcttatgggtcctgggatttaatggtttcgactccattgaagatagatctttgctaagagccgaagcagtggtgggggattcatggaaattctgccccggctttgaggaccattgctccgaaattacttgggcaaccaacctcctcttcctgttctgaaaggaattggagtacatatggcatgatacacaatacattgaggaacaagctcaancctgcacgtgctgaagattaanttttgggcatcaaaacttgcgccttattcaanggaacaccagatatataccnggncanccanatttnggacatngaggagatantataactgtccttggggggctgactcctgcagnaactgaacacacaaatga

SEQ ID NO: 82212 - DNA, 484 bp, Triticum aestivum
  unsure (1)..(484): unsure at all n locations
  Clone ID: PAT_TA_82212
gcaaccttgagatgctggaggagttggatataagcaataatcagattagggtgcttccagattcttttggaatgctgcagcatctccgtgtgcttcgtgcggaagagaatcctctacaggtgccaccaagggagatagctttaaagggagctcaggctgccgtccaagtacatggctgaacatgctgccaagaaaactacaaagccacagccagcgaaggcgaaagaattgggccaanttctgcatttctcccaagcccaaacaaaagaaagcatgaccggntagacactgacatgattcgattgaagtaggttaagattccaatcccaaggcctggcctgtacctgggcaatacttttttnaaanattgttttggggtgnaccccactttcttccaagggggaaacccaaatntttcaatccngggnaacnacatcttgggcattgntcctccctgaaaagggttgcttcaaaanaacttttt

SEQ ID NO: 82213 - DNA, 430 bp, Triticum aestivum
  unsure (1)..(430): unsure at all n locations
  Clone ID: PAT_TA_82213
gtttttttttttttttttttcatttatgtgtagaagtatattatgcccatttagctttgcatatcctcttgctgtgcgacagagagaactgatttggccatctctgttttgttaatgggtacatgaaaacagcatgaatcccttgaacgaaatcgatccttgtaattatccaagtgtccattctctgggtcggtaagttacatgatttatcatgtacgacgacgatgatcgaagaactctaaatcctcctataatacagctaaagagtaagtcatgtctagtttttancatgcagtatgtaccacngtactttaanaatgcaaattgcaagttgcacaatgcactaaaacaacctgcaaaancnctttgtcccngaaaaaagctaccctgaaccanattctgaatnccaagcctgaaggncttttccgaa

SEQ ID NO: 82214 - DNA, 433 bp, Triticum aestivum
  unsure (1)..(433): unsure at all n locations
  Clone ID: PAT_TA_82214
acacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagcccccgaaatgtggcgctgcgccggatatgaaatccaccgtcnacggacctgccgtggacctgcaagaantacgatcngtcaatcccggatatatattttcgcctaaaattnaataaaaccccgacaaatgacaactcatcntcctagctttgttnaccaacaatatttacaatagcctnctcctccngnttcc

SEQ ID NO: 82215 - DNA, 468 bp, Triticum aestivum
  unsure (1)..(468): unsure at all n locations
  Clone ID: PAT_TA_82215
cgcggtcgcacctcagcctgctcgccgcccccgtcgcaacccaacccttcctcccctccaatggatgccgccccaaccacctgatccaataggaagccccagttcggcagcctctgttcccgcccttcagcggccacctcgccacccctccaacgcccagcacgtccttatccaacgccgcccttcancgcccacccatccgcctgcccgcccggccgcgcccgattgaattgtttctgccaagatttgcctcaatgtgggtttgcatcattncggcgaccactcgtcnattttcgactcccggcgggtacatccaagaaagactaccanaatctcgcngtggnagtcttttaaagatactcgcttgtcanatctcgacngaagaagacactttattcatgngatgntctttcccgtttggggcgatgggactattntggngtaanancaacttaagnatccaacaag

SEQ ID NO: 82216 - DNA, 412 bp, Triticum aestivum
  unsure (1)..(412): unsure at all n locations
  Clone ID: PAT_TA_82216
agagcacggagctgctgatccgcaagctgccgttccagcggctggtgcgggagatcgcgcaggacttcaagaccgacctccgcttccagagctccgccgtgtccgcgctgcaggaggccgccgaggcgtacctcgtcgggctcttcgaggacaccaacctctgcgctatccacgccaagcgcgtcaccatcatgcccaaggacatccagctcgcccgccgatcgccgggagaaagggcctgagcagcggtccccgtnttgcgtgcgttgtcaaagagtcctgctgtgatgttccggcctaaactttggtggtgtaactnaattttctgtccgctctcctcgtttccttgcatatgtancccttgctgcgatgattatcaatgnagagtgcantttcctccaaaaaaaaaaaa

SEQ ID NO: 82217 - DNA, 453 bp, Triticum aestivum
  unsure (1)..(453): unsure at all n locations
  Clone ID: PAT_TA_82217
gtcaagaccctcacggggaagaccatcaccctcgaggttgagagcagcgataccatcgacaatgtcaaggccaagatccaggacaaggaggggatcccgccggaccagcagcggctgatcttcgccggcaagcagttggaggacggccgcacccttgccgactacaacatccaagaaggagtcgacctccatctcgtcctcaagttccgcggaggnatcatcnancatccttgcagtccttgccccaaagtncaaccaagagaanattttntgcccnaattgtanncngccctgaacccaaggtgtnaattgcccnanaaaattttggcaaaagaacaaattaggcccaaaaaaattttanaccnagnggaccaacatttttaaagggccggtttaaccaatcngggttncgtttaacaatgcccccttgcccttnacntatttatttgtnnn

SEQ ID NO: 82218 - DNA, 454 bp, Triticum aestivum
  unsure (1)..(454): unsure at all n locations
  Clone ID: PAT_TA_82218
ggtgtgttcgaggccgtgtgttcgttatgtcatatgcatacttgctcttgtgtaatcgttgtgttaactaggtgcacccttttgggctgcgaaaagtatgtgatgtagttagcagtagtactacgctccggttgaggcgatcgagttgtgttgccttcagggggagccatttgggtatgagtgcgcggaggagatgagcgctgaaattaggatgcaatggaagtgtttgatcatgcttccgttttcttgtccattaactataattgagtaccatatgtgtgtgggagtaaatgcaacaaacaacctaaattgccaacctaaatatacctaccaatgaaacgttcccttaaccgttnagggcaancctttggggctaagggtgactgtcaaaatattccctctaccatttagggtgacaaacaaatgcttgagaaacaaaccataggtgtttcca

SEQ ID NO: 82219 - DNA, 453 bp, Triticum aestivum
  unsure (1)..(453): unsure at all n locations
  Clone ID: PAT_TA_82219
ctgatcctcactccctccctcgtctcttccctcacgtgccgccacacacgcaccgcacagccgcgcagagatcgtgcgcctcacacctccttagcctcgccggcaagctctttaccccgctagcacaccctccacaacctctggccggcatcccgagcgactgcgtcgcctcctgtagccgcagcgttggccggcgagtcttcgctgcgccagcacctcccctgtctgggtcgccccgagcgccggcttagctcctgtagctgtggcgtcggcaacctgcgccagaacttttgagccctgtaccctcctctgacaccttccgtcgctgccttgtctcccgcgcgccttcatcctctgggcccgccgtggcattcgacaacccacatctcttcttggagcaaacacgnccaaccttttgcctgggcttctaacggctcttaatgttctaangtt

SEQ ID NO: 82220 - DNA, 340 bp, Triticum aestivum
  unsure (1)..(340): unsure at all n locations
  Clone ID: PAT_TA_82220
gcccccgcccccgccgtcgccgccggcaaggaggaggagcangagcaggggnctcccctcccgcccgtgtgacccgctcnctcctcccatccatcgcttgcgtacggcttactcntccccccgtccgcntcctctgctctacatctgaatgatganctgctgctcgtcgcacgtggnnnactaataaatctcgccgattttgttgcnggtctgccatgtttaaattaattgaattaagattatgtctatctgtgntntgtgtgtgtgtgtgtntgccatgccatgnnttccngttgctgtgtncatgtgaanatcancatgccgncgtgtgggcnatttc

SEQ ID NO: 82221 - DNA, 474 bp, Triticum aestivum
  unsure (1)..(474): unsure at all n locations
  Clone ID: PAT_TA_82221
cccaatctcctcccgcactcaacctcaaccccaatccccacctaccccaaccccatggcgcccaaggcggagaagaagcccgcggcgaagaagcccgcggaggaggagcccgcggcggagaaggccgagaaggcgcccgccgggaagaagcccaaggccgagaagcgtctcccgtcggcgggcaagacctcggccaaggacggcgacaagaagtccaagaagaagagcaagaagagcgtggagacgtacaagatctacatcttcaaggtgctcaagcangtgcaccccgacattggcatctcctccaagncatgtccatcatgaatccttcatcaacgacatcttccnagaagtcgccggggaagccgccaagtccgcgctacaacaagaacccacatcactcccgcgagttcagactcgtccggctctctccccggggaactcgccaaacacgcgtctccnaaggcacaaggc

SEQ ID NO: 82222 - DNA, 476 bp, Triticum aestivum
  unsure (1)..(476): unsure at all n locations
  Clone ID: PAT_TA_82222
gccacgcggacgcagaacgtgcttggtgagaagggccgcaggatcagggagctcacctccgtcgtccagaagcgcttcaacttcccggagaacggcgttgaactttacgccgagaaggtcgtcaaccgtggcctctgcgccatcgcccaggccgagtcactccgctacaagctcctcggtggccttgccgtccgcagggcatgctatggtgttcttcgctttgttatgggagagtggtgctaagggttttgaggcattgtgaacggcaagtcaagggcccaagagagcaatccatgaanttcaaaggacgggtacatattcatctggcaacccgtttaacgaatacattgatgctgcantagcacttcttctcaanacaggcntcttggtacaaagngaaattatctttactgggacccaagggnactttgcctacaccccgctgctgactttcacacaaccccnaaagagaggan

SEQ ID NO: 82223 - DNA, 474 bp, Triticum aestivum
  unsure (1)..(474): unsure at all n locations
  Clone ID: PAT_TA_82223
atcatcatccccgataccaaagctcatcttcttctccttgaaatctttttgggttcacagatttggaggatgtcttgcaactgtggatccggttgcagctgcggctcagactgcaagtgcgggaaagatgtaccctgatctgacggagcaaggcagcgccgccgcccaggtcgccgccgttggtcgtcctcggcgttggcgcctgagaacaaggcggggcattcgaaggttggccgccgggcantccggggaagggtgcanctnccggggacaactgcaaattcaaccctgcaactgtttaagctgcatgcacccnactactgtttngngttaaaatatacgtngaataacagcgtctgatttgatggagttccaacaagggggcctttgcgtgtgcctgtgggtttgcttgctccctctcccaagctctgcccanggngcccttnngngtaagtgtgtgtgcaagttcccctn

SEQ ID NO: 82224 - DNA, 487 bp, Triticum aestivum
  unsure (1)..(487): unsure at all n locations
  Clone ID: PAT_TA_82224
gcagcgcgaaggtgctgtgatggttgcaatgcaagggcagatgatagggccaggtcttggcatgggcaggcagtagcaacagggttgagaggaggacgatttggcttggaggctgttgtcgtccaagtggctaggcaaggaagctgacttggacccgagcctttgtgtacaccatcgcctgtgcgtgtcaccaatagatagagacaaatgggaataaccgaaccacgtctacgaaaccaacagccgcgaccgactattaaattcctcgcgacttcatcctttttcaacctgggatctaatttaaggttaatttgggggtttggctaaaatgcatccnaaagtacatgtcnaccattntccccaaatcattttgtcctccaatanantctgcttcatctcctccctgctggggtccnaacaacttggccnattgcttttgcttgtacaccatttgttttcatggnactttccnccaaccaggctccng

SEQ ID NO: 82225 - DNA, 394 bp, Triticum aestivum
  unsure (1)..(394): unsure at all n locations
  Clone ID: PAT_TA_82225
gagagaactagtctcgagttttttttttttttttttagacaatcatggtgcactatttgatacggccccacacttaaaaaagaaagcctcaaacttggaatctcatatgctagtcgtcggtcttcacgtgccaagaactagcggtacagtacactgaatgctaaccaccaaaggaggagttatcctgtccctgtccacgcactgattagtcttcccactcactatgtatcgtacgtaatcttgcatttcttttctttccatccacaanaaaccagagtctcgatctgcatcggcaccaaccacggcgacgacatgcgcgccgacggcaagcccnacgcggtgtgcgtccccgtacncggcgcangggcacgccaccccgatgatgaaggggggg

SEQ ID NO: 82226 - DNA, 474 bp, Triticum aestivum
  unsure (1)..(474): unsure at all n locations
  Clone ID: PAT_TA_82226
cgagttttttttttttttttttgttcattacaacaataatatattaagccttaaaaataaattctagttacaaccctatggccacaattaccaggtggggcccatcttatggacagatttaacctttatgcatttagcacacgttatgacctgtttggaggtccagttaggatacacacacggagatgcccttacagcaaggcttccttgagtccagtggagatctctangccaatgaactgcactggacaaaccactgcaacaagccttcaagcagctcaagattttcatggttcctgaaccaaaggcaacgcgtaaactgaaactgcaagcatttccaagggcttgatcttttganaattggccaactcaanccatccncaattgcacaaaaatggngtacnaccttggngtaactnncacaanagtcanatttnggaaaaccccgatgacttatncaccnccggcaanang

SEQ ID NO: 82227 - DNA, 487 bp, Triticum aestivum
  unsure (1)..(487): unsure at all n locations
  Clone ID: PAT_TA_82227
acggctatcccgaggccgtcggcatacgcacctatgccgacggctatactacgccgacggtctgacacatctacgctgacgtgatctacgccgacggggctatgccgacagcagccgtaggcatagatatatgccgacggcaaaggacctatgccgacggccctgggccgtaggcataccgcgagtccggtagtggcaggctgcggtgcggcggagggccattntgtgcaagttgccgagcaccggcaccgctctgcccgggcngcaactnaaccgccttctccngagcttcgcttctcaacaacaagaaagnaccgggaaggnangganctgctaaggaaggnagggngcttccatntctgggtaattgagaatcatcgtcccggcggagtttttctanctggtcaaccgacaaatgctgctgctccttgacgncctccgggtgttaattaccggaatgnatgtggcacatatacattnttcaaca

SEQ ID NO: 82228 - DNA, 479 bp, Triticum aestivum
  unsure (1)..(479): unsure at all n locations
  Clone ID: PAT_TA_82228
catccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgtaagggtggacacatcgtcatcaaggcccgtccctgcaagttgttgaggctccacctccaagactggggaagcatggtcacgcaaagttcacttgtttccattgacatctttaatgggaaagaacttnaagatatcgttccttaatcccacaactgtgacttccccaattttgaccgccaagattatcaactgattgacataactgatgaggtatttaaccttctaacngaaattngaacactaaggatgactgaacttccaactgatgagttctcttggcaaattaaaacggattncctgatggaaggactgtc

SEQ ID NO: 82229 - DNA, 491 bp, Triticum aestivum
  unsure (1)..(491): unsure at all n locations
  Clone ID: PAT_TA_82229
taaaatcatgaatttaaaaatgttcatcgattttataaccaaagttcacaaactgaaaaaaagttcatcgactttgaggaataatcatgatttttgaaggaaagttcacaaacttaaaagagttcaccgattttggaaaaaatctttatgaaaaagtttaaaaagttcatcgttttcaaaaaacttcattgattttgacaaaaagtcatcgagtttgaaaaaaaaatagttaatcaagttttaaagaagttcaaaaatttgaaggaaaaatcatcgatattgaaaaaagtcatcagatttgggaaaaantcatcaagaattaaaaaaaanttatcaaatttggaaaaaantcaatggaattaagaaaagngcattggaatttgaaaaaaacatcanatttaaaaaaanggtggattgggaaaacatcgaagaggaagaaggaaaaataaatanatagaaaaaatgaaaacaaaaacgggaaacgaagaaag

SEQ ID NO: 82230 - DNA, 274 bp, Triticum aestivum
  Clone ID: PAT_TA_82230
gctcgccggagtcccggagaagacaccaccccactaatcttacagaagtgaagttattacaacatgaggtggcaatgtctgatcgggtgggtaacccgaaatttctttctcttgttcgttgcgttggtgatcttcgtcacgacgtcttggcatgttgtacgccctgccataagtctagatgatgaaacgtcgtgcatcttttgcgttgtacttcaatgtcgtttctaagatgatgaaacgtcgtgcatcttttgcttgtagtaaaaaaaaaaaa

SEQ ID NO: 82231 - DNA, 488 bp, Triticum aestivum
  unsure (1)..(488): unsure at all n locations
  Clone ID: PAT_TA_82231
cttgattgaagaatctgatcaatctccatcgacagcttctcacgaagttaccttgatgcaagaaactgacataactcagtcattatctttacataaaaataacttaaatctgcaatttaaggaaggagcccagatttgtgatactgaaattgtgccaaaagaagtgggcttgtttgagttttctgatcagaagaacattgttggtgttgatttgttttgtaatgccggggctgaaactatcatccaaatggaagaagaagaaaagctggatcaatccagctcattcaagaatacctaatancctgggtttgggcaacaccctgcaccaagatatcaatgggagccacataaacaactgcaagaaatttggngcaatgttggaaaatttccggngnacaaaattgnnccagttcatnnacatacncggccaatattggnaaagaaatgcatgcaatnaagggcngtttgttctcaaaanaaagacncga

SEQ ID NO: 82232 - DNA, 478 bp, Triticum aestivum
  unsure (1)..(478): unsure at all n locations
  Clone ID: PAT_TA_82232
gcgaaacacctcccactccctctcccacctccgaagcagcagcagccatggcccccaaggcagacaagaagccggccgccgagagcaaggtcgagaaggcggcggagaagaccccggcgggcaagaagcccaaggccgagaagcgggtgccggcgggcaagacggcggccaaggagggcggcgagggcaagacgaggggccggaagaagggcagcaaggccaagaagagcgtggagacgtacaagatctacatcttcaagtgctgaacaagtgcacccggacgtgggatctcctccaaggcatgtcatcatgatnccttcatcaacanntcttcangaactcnccgggaantcggcaaactggcgcgctacaacaagaaccacataattcccggaaatnnaactcntcgcttcttcttccccgggantcccaanaagcntctccaaggaacaaggcgtcacaatttactctcctaaac

SEQ ID NO: 82233 - DNA, 305 bp, Triticum aestivum
  unsure (1)..(305): unsure at all n locations
  Clone ID: PAT_TA_82233
agcctgcgcaccagactgctgacatgcctaccattgtttcacacagctactcgcacgcctcccgatgatactgtgtagcgagcacgcctcccgtcttcttgttccgggtgaaaacctgatctttggatcggacgatggcgacggtccgtggtcgtgccctttttgggaggcatcgtcttgggagcccttgggcccggcgttgtccgttgcactcttcccggatgatctctcatcttgatggtggctccgtcagctacaacngtctttttgccattttgttggccttgggaatccntaaaggttgt

SEQ ID NO: 82234 - DNA, 242 bp, Triticum aestivum
  unsure (1)..(242): unsure at all n locations
  Clone ID: PAT_TA_82234
ctgttntnaactgaacaaatatttcnaatgntcatanagaccanatgnggntgcangtgcgcaaattanttnnatacaangaancttcatnttttttntaccattngatcatgtggcctacctgggatttgcacatctataatgttacaaccttacactgggnaccataattccttgaggttttgcacaattgcaaccttacaacacaaaattggatncttccacnanaangttacatggca

SEQ ID NO: 82235 - DNA, 498 bp, Triticum aestivum
  unsure (1)..(498): unsure at all n locations
  Clone ID: PAT_TA_82235
cccggaccagcagcgtcttatcttcgccggcaagcagcttgaggatggccgcacccttgcggattacaacatccagaaggaatccaccctccaccttgtcctccgccttcgtggtggcatgcaaatctttgtcaagaccctcaccggcaaaaccatcaccctgggaggtttgagtcctcaagacaccattngacaatgtgaaggccaagatccaaggacaaggagggatcccccccggaccagcagcgcctgattttnccggcaagcaactccaagatggccgcaccttngcggattacaacatccaagaagganccaccctccacttnggggctcaagtccgttnggggcatgcaaatattttgngaaacctcaactgggnaagacatcaacctggaggtggancctctgacacatttncaactngaagngaaattcaaggacaaggaggatccccccgattaacaactcnaacttnccggtaacaattgaggatgg

SEQ ID NO: 82236 - DNA, 500 bp, Triticum aestivum
  unsure (1)..(500): unsure at all n locations
  Clone ID: PAT_TA_82236
gcgaaaacaccaccacacctctccccgtcgacgcaagaagcagcagcggcatccatggcccccaaggcggagaagaagccggtggcggagaaggccgagaagacgacggcggcgaagaagaccaaggccgagaagcggccgccggcgtccaaggagggcggcgaagaagaagggcaagaagaatccaaagaagagcgttggagacttacaagtttacatcttcaaaggtggctgaagcaagttcaccccgacatccggatctcctcccaaaggcatgttcatcnatgaatccttcatcaacgacatcntcccagaactccccccggcatncggcaactcnncaagtttcaacaagaacccacaatcacttcaaggaatttcaaactccttccgcttctcctcccccnggggagtnccccaacangcctttccttaaggtaaaaaagcnntaccaatttaatccgcttaaatacctgcctgtgttccctgaattgtgantn

SEQ ID NO: 82237 - DNA, 473 bp, Triticum aestivum
  unsure (1)..(473): unsure at all n locations
  Clone ID: PAT_TA_82237
actagtctcgcgttttttttttttttttttttttggcaaccaaaagtgggttgtggtaatagcctattacaaccctaaaaaaaatataggctttcaattacaatattcaaaaccatacgtataatatgtaaattcataaaattcataattctcatagcaaatatccatcaaatgaaactcaaatataatttcgccatcctaattaactgcgaagactaaaatatccgtgatctagagccagtccagctagtctttgggtccattgctttaaacatccgagatccttgttgcagcttatatgagcgcattngaagaaatagcattgggctttgaacctgaancctaataagactaattnccggtaacagatatttgcaaagttgggttacattcccttggtgtcaacctcctccgtangactgttgggtccaaccngtgggtcattcnaaaacttggcacagttttttcaaatc

SEQ ID NO: 82238 - DNA, 488 bp, Triticum aestivum
  unsure (1)..(488): unsure at all n locations
  Clone ID: PAT_TA_82238
gtttgataacacatggttattaagttttgactgtgtgtgatgtttgttgttcccactcccacctgcatccctcggaaatatctgcccggcttgaggggttttctatttgataacacatgcttggtatcttgggaccatgtgtgatgcatcatccaaattttcaatagcccaggcattttactcccgcgtagtaaaattttcaagtagccgcgtcacttcctcaaacacctcccccctccacacccaccaaaactcctcatgcacgcgcgcacacacacacccaccacaaccctccctttctccggaacctttagcaaggtcaccgccaccgccgccgcaaggctccattggtcaacatcctgccatttacacgtgcagttaccactgatctccaataccaagcccctaatttcctagatgaccctgcaaaccccattccacataccccataccactcaacccaatcaaaganacccaacctaagcnnn

SEQ ID NO: 82239 - DNA, 380 bp, Triticum aestivum
  unsure (1)..(380): unsure at all n locations
  Clone ID: PAT_TA_82239
ctgtctcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccagcaccggcagctgctgatgtagccaagcagatccaagctgggcatccaggtagcgggcgaacaactactaccgttgcaaaanggcaagaacaacgggaacttccttacggacntctttcaaccaaagttcangcnctcccttgcggtggtccnccccttggtactttttttggcggaatggatgttaagatccgcttaatgaacaacat

SEQ ID NO: 82240 - DNA, 410 bp, Triticum aestivum
  unsure (1)..(410): unsure at all n locations
  Clone ID: PAT_TA_82240
cggcgctgctgcagttccacaagcgcggcagcctcaacctcatctccctccccagggacttctcccacttctcctccgtccacatgtacgacgtcgtcatcaagaaccgagaatcgttccgcgtcgtcgatgcatagcccgtccatggcgttcatggcgatctctgatctgaccagtttaagcgtaataatttgtgtccttggctgggcatctctatctgtctgtctgcatgcatgcaggcaggtctccgctgattcaaggtgcccgtgttntttgtacgtgtgactgttatacacgttacgaatgtggtaaaattgttgaccttgttttgccagtgggttgtaccctccttaactttgggattccctttngaataattggcactttgtagtancgttacaantttttgg

SEQ ID NO: 82241 - DNA, 477 bp, Triticum aestivum
  unsure (1)..(477): unsure at all n locations
  Clone ID: PAT_TA_82241
gaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaaggccgccggcgccaccctcctccgtctccgccaccgccacccacaaggcgagtccggcgggattggagatggcggcccgagaacggcggctgcggctgcacccaatncaaantgcggaccagctgcggtgntccctgctgcaactgctaattcatcatcgatnatgcatcaccnncctngcttnacatcattcnatcgttntactaactaccatacatgttaccnactgatntaaggctttatgttncgaacttactgcatcaacatcaaggtgcatgccatgattttaacagcccccctaataaactcccttggattaaaaaaaaaaaa

SEQ ID NO: 82242 - DNA, 522 bp, Triticum aestivum
  unsure (1)..(522): unsure at all n locations
  Clone ID: PAT_TA_82242
tcgttacattgaatgacggtctcccaaagagagacgctaaggaaattattgctgagctaaagcatcatttatatcaagatttctaaaaatttttctcagatgagaagaaagcacaatactaagctaattttgctttgttcgatcgtgacaatgacaagtatataaacttgagcgaattaaaggaattgctcacttcagtgaatattactttcccaagatgatgaattaagaagaatatataaggaattctgcttaactccccaagaagcaagatggaatcaatgaagatgctgtcttaatatcgtctcaaaagaagattaagagataatggacaaagatgagtaagttactcaagnatttaggcttggttgaaaaggaatttaatgaagattgnccnagattcccaatgaaactaaagataggaagnttntcaaganttgacattcaaagattctaaganccctgggaataatggnnggaaatcaancaaatgatcctttaaagtttaaccctaaaatggag

SEQ ID NO: 82243 - DNA, 473 bp, Triticum aestivum
  unsure (1)..(473): unsure at all n locations
  Clone ID: PAT_TA_82243
gctatgagtactgtgactagcaaactgaaaaatgggagcaatctggggaaggatgggaaaggttttggtgatgttattctaaatccatctcttcagaagagagtgaaccaactagctaatgccaccgcaaacacgaagcttcaccaagccccctttaggaacatgcttttctatgggcctcctgggcactggggaaaacaatggcagcaagagaactgctccgcgaactggactagatatgcactggatgactggtgggagatgtttgcaccattaagatttgcaagcaataaccaaagttcancaanttattnactggggcaaagaacnnataagttaccccctcaatgatgaactgaccttcctgttgcgaacgggacaagcatacatgagcgaactcaaaggangtcctnatntccctttccgganaagggacatccaaggaatntgcttgacaacaacaaaagctgtng

SEQ ID NO: 82244 - DNA, 464 bp, Triticum aestivum
  unsure (1)..(464): unsure at all n locations
  Clone ID: PAT_TA_82244
acagggcgtcaccttgtcatattgcacgactggaagagggacaaaattgtgtttgagagcatggatttctcgcggcttaggtcactgacggtgtttggcaggtggaaaccattcttcatctctgaaagtatgatgcttcttcgggtgcttgatctaagaggatgcatcaggtatagagtatgcggatcttggagaacatattaaaatggtgcgtcctctcaantcctttcactacaaggacggcacgagatacacatcttccaagatatatggntaatctgaagcaactgcaacttttgattcaagggaactccgtatcaacctgccaagagaatcaccaanttcaagaactacagtcatacntcccgggcacttgccaactgatcagaacactnccaacaactgttttnaactaacgtaattggntcaaggcctgagattngaacnacgnttcaacctggnnc

SEQ ID NO: 82245 - DNA, 493 bp, Triticum aestivum
  unsure (1)..(493): unsure at all n locations
  Clone ID: PAT_TA_82245
aatttatgattgatatcttttagtaccatatatgtagtggaaccaattttacttgcttgattacattcttgatcagtttagttaattgctgcagggttgtgagcatctaatcggcatgagtgaattattttggcaatttaaacaacatgatggtgttgtatccttgttctgggcggactgatcaagagagatcacacttaatgggataagctataccctgccagtatagggtattccgacggagtgaaatatgggctgttcaaaactagttgacttaactttggtcaatacttgcacancctaccaagaaagatgaacaaagaaaaagatgttaaaactgaggggatgaataatgaccaangatataattngaaagggcataatttccggactgaacacaaangcccaacctttntcaacaacctaganccacaanggctggactngattaacaaatctatatttganccaacaaaagtacatggtgtatana

SEQ ID NO: 82246 - DNA, 434 bp, Triticum aestivum
  unsure (1)..(434): unsure at all n locations
  Clone ID: PAT_TA_82246
gcaatctccatcgaaatcatacacccatcagccctttcttgcgcttacatacacagtcaacgatcgatatggccatggctatgtggagaaagaaggagacggccggagccagcggcgccgccccggcatgcgttgttcgctccgccggcgagggcggcgggaagatcccgaagggctacgtcccgatggtgctcgtcggcgacgccnggagaaaagggaagaaagggtgctggttcacgtcgggatgctcacggagccgcgcgtcctggctctgctggagatgtccgcgcagcggttcgggtacggcaaccgggcgtctgaggattccatncggcgtngaaccggttcnancanacgtcccgtggccaacggcgggagatncaagattctgcttcgcancancacaatagggnagagccgaccccacaattttt

SEQ ID NO: 82247 - DNA, 445 bp, Triticum aestivum
  unsure (1)..(445): unsure at all n locations
  Clone ID: PAT_TA_82247
gcaggactagatttgctgcactcacatagggaaaggtgtctaaagataacaaaactgggaccaacacaaatatgctccttggttgtttgttctttgttgccacagactgtgcatcaccccagtacatcggtagatgcacatggtgctggtgcgtccactgtcccgtgcaactctttagctgttgttaatctaaggccctgtttggttaaaaactcactagcccctacctgcttggttccagagactaaacatggaaaagaggttattaaatgacatgctnaaagaccatgttncccctnngtaatgaacttatanagacaaggtgcgatncctgggcaaccggcnaccggtttgnaaaaatccccaaaaagacctccctccggggcctccttccttantcccaaatgnccaactttaaatccctnaaaatccctccctgttngng

SEQ ID NO: 82248 - DNA, 427 bp, Triticum aestivum
  unsure (1)..(427): unsure at all n locations
  Clone ID: PAT_TA_82248
agctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactccgtacgtacgtgtgttggtgttangagtatacgtnaataacgagcgtctgatctgaanggagtcnancaagggtgctgtncctgttcntgtggttgcttgctcgctctcccaagctctgcccanggngtcctntgtt

SEQ ID NO: 82249 - DNA, 430 bp, Triticum aestivum
  unsure (1)..(430): unsure at all n locations
  Clone ID: PAT_TA_82249
ccctcgcatccccctcggccacgcgcccccgccacttcacccagctccacccccgaccagtcgtgccaccaacggcgcgatgttgtccttatcatcatcgtcacactcgaggaaagctaatgcttgaaggagagggaacaacaaggaaatttgggactggcggagaggacaccgatgtcgtgaaagtgtccagcccggacaccctgcatgttctacaagacgctcattgcttctgacaccagcatgcaggggggcttctctcttctgctacatggcgctggagaccaagagattttgttactctaggtgacntgggantggcttttttggttggcctgtgaangattacgactgcaaanggcgtcccaanagttccngagncccgtgggcaatnaatgntttncatgggaccaaattgggggtcntacan

SEQ ID NO: 82250 - DNA, 446 bp, Triticum aestivum
  unsure (1)..(446): unsure at all n locations
  Clone ID: PAT_TA_82250
gagaagttcgccgacgagaagttcgtccacaagcacaccaagcccgggatcctctccatggccaacgcgggccccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccgggtcgcctgtcgtcgtcgccccgtgtcccgtgtcgtcgatctaaataagagagccgtgtgtccgtgtcgtgtcntccccttggtccgtccgatgagattccgttggtgggtttaaggagggtttaagtggatccttttggccgctggtttgtgtcccggcggcaatgggttnctc

SEQ ID NO: 82251 - DNA, 212 bp, Triticum aestivum
  unsure (1)..(212): unsure at all n locations
  Clone ID: PAT_TA_82251
ggtgccaggtctgcgagcggatcgcgcgggagatctccgcgcaggtcgccgccaagcagcaggcgctcccgccctccaagaaggtgccggagatcgagatcatcgacatcgcggagaatgtgtgcaacctgaagaagcaggaggcggactggntgctccggatcgacatcgtcgagaaaggcgacaggctcattttttggtntccatncttt

SEQ ID NO: 82252 - DNA, 468 bp, Triticum aestivum
  unsure (1)..(468): unsure at all n locations
  Clone ID: PAT_TA_82252
gcaaggtggagaaggcggcggagaaggcccccgcgggcaagaagcccaaggccgagaagcggcttccggcgtccaaggaggccgccggcggcgagggcaagacgaggggccggaagaagggcagcaaggcgaagaagggcgtggagacgtacaagatctacatcttcaaggtgctgaagcaggtgcacccggacatcggcatctcctccaaaggccatgtccatcatgaatccttcatcaacgacatctttcgagaagtccccngggagtccggcaactcccccgctacaacaagaagccaccatcacttcaagagatttcaaactccgttcgctctctccccccgggagtccccnaacangcctttcccnaaggaacaaggcgtcacaanttactcctcatagactgaaatcttcgtccctgtatttgcccntatctcactgtacgtcanctctttcctctcaatat

SEQ ID NO: 82253 - DNA, 471 bp, Triticum aestivum
  unsure (1)..(471): unsure at all n locations
  Clone ID: PAT_TA_82253
ccagtcgattgctgagcctgttggcaagtctttgacgcccctggaagatcctagacactctgtccctggtgattcatgtatcacacttcaacctgtaactcacaagtattcaccgaaagcacgtcctaatcacaaagttcgtgaagatcctgatattcgagatcgccgaattcccaaggacaggtcactccacgagccaccgcacccaactcctgcccctttcatcaacgagcatgcttacaagtctccgccgaaaccatatcctggatcacaaagttgtgaaaacttggatattccgantccgccaaatcccaaggatggtctttccgccgagcgccacacccaatcctgacctttcgtcaacgagcagctttacaatctcaacgaaacacatcaagatcacaaagttgcgaaatctcctatccgagtantcctaccgcccgcggcgcaccaatcctgaccttatcgatg

SEQ ID NO: 82254 - DNA, 457 bp, Triticum aestivum
  unsure (1)..(457): unsure at all n locations
  Clone ID: PAT_TA_82254
ggctgatggcgccacagcagccatagttgtcatcaatccaaacaatccttgtggcgtggtctactctacgcagcatcttctccagattgctgaaactgcaaaagagttgggtattccaagtaatagcggatgaggtatatgcacatatggtctttggtgccagcaatttgtgcccatggcctcatatgcacacatcgcaccagttatcactattgggagcatctcaaagagattcatgctaccaagatgggtctccgttgggttggatcctgtgatnctnaatgggacatcaagcataactgcaactgagaatgctactgaacgtncttnaaggacanctccattatttcaagnagnattcccaaattctttttggttaacatgacatttcatcaaatgtttgacttgcaaanccgcngcgaagcccctacgganatgacaattnacctcaatcacc

SEQ ID NO: 82255 - DNA, 489 bp, Triticum aestivum
  unsure (1)..(489): unsure at all n locations
  Clone ID: PAT_TA_82255
tcaatttctttgtcgtggggcaaggctttggcaactacgaccctgtgaatgacccaacgaggtttaacctcgtcgaccccgtcgagcgaaacaccgttggcgtgccagctggtggatgggtggccatacgttttctcgccgacaacccagtgtatggttcatgcattgccatttggaggtgcacacaacttggggactacgaatggcatggctggtgcaagacgggagcctaccgaaccagaagctgctccccccgccatccgatcttcccaaatgctagtcggagaggatcaaattaagttgttgatttttttccctcatttatcggtgtgctaacttgcaattgatttctccttcanaaggttttgtgtatttaatcaatgcgctggtcttgtaatttcttgtatccttaataaatttttatatagtttgtancgacaatgttttgaccctctcgaataaacaatgatgtcaactgaatgtccaaac

SEQ ID NO: 82256 - DNA, 460 bp, Triticum aestivum
  unsure (1)..(460): unsure at all n locations
  Clone ID: PAT_TA_82256
ctcgtgccgaattcggcacgagcccgcccagatctcgtgctttcttcgggcgtgtgccagcccgccccgctgcaggtgggcagaggggatgccgcagggccagagccaaacggctatgccggccgggctggtgcaagtcggtgccgatgggatgcccatgccgtgtttgacgtccccaattcctcctcgctcagtccaggtaggaggatggcgacgactggtagcgatccacgatgggaaccgcaagatcgcacgatgcctgccactatgccgcagggcgctccatgctttgcatcgagtcctagcatagaagatggtccgaatgcttcaagaacaatttcttttatcaaggacatgtataaggaggcactggatgtgtgtgaatgatggncgagacaagtctgatgaaattagcactganggagaatcttatatactcatgggctaatctagtgccaan

SEQ ID NO: 82257 - DNA, 464 bp, Triticum aestivum
  unsure (1)..(464): unsure at all n locations
  Clone ID: PAT_TA_82257
cgccgacacccagacgtcgaccgacgggatcggcgacgagctcgtgggcatgggggccctgacgtacagcttcttcacggcggcgctgttcgcgcagcggacgcccacctacgcgcagctgctggcgacgataaaggccatcatccgcgagcgcaacgccgacgggcggatcaactgcaagctccccgcgcccgtctgctcgctcgtccgcaaggtggtcaacttcagcggcgtgcaagagccgcagctgacttcgtcggacaagttcgacatcaaccggacgcagtttctgctatgattgaaacatcaacgacatcaaccacgctctgcctctgcacctcaataattacggnaaactttcctacctgttcgtcaaaactggacaagtcaaancgaattgtgctggattaatcaaatccaangttggcttantcaacgggcctnaaaccggggccgcntntntt

SEQ ID NO: 82258 - DNA, 341 bp, Triticum aestivum
  unsure (1)..(341): unsure at all n locations
  Clone ID: PAT_TA_82258
ggcagtagtgcagttggcttgcagcggtgcgtttgctgcggccatgcagttcgggccccgggcaggaagaacctggtgcacttcggttggacgccgcattgaatccttttgcagtttccctggtccattnatttgggatggnnaacccccctcnatgnattcngtcggcgcgtcnatgcantacagcgagtctgtgtaattttgncttctgtttgtgcactgtttgtgcaatgtagcgtgcgtgatcattcagtttggtactagtaatttgtgcgtgtgtatctttgaagctcactttgttctctcacgcaatttggtataaaacccactgttgtccaaaa

SEQ ID NO: 82259 - DNA, 465 bp, Triticum aestivum
  unsure (1)..(465): unsure at all n locations
  Clone ID: PAT_TA_82259
acaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatgttccgcctaaaataaaataaaagctcaagcgagatgaacagcgtcatcgtgcctatgcgtgtgtgtgttggcaacaatgcttatacaagtatgtcntcn

SEQ ID NO: 82260 - DNA, 470 bp, Triticum aestivum
  unsure (1)..(470): unsure at all n locations
  Clone ID: PAT_TA_82260
tgctttgccagaagctcatactcttcgacggaatccttttggatcacggctccatacgagaatatggcgacatattgactgcatcaaatatccaggaataagagcagttcaaagaaattagaagttgtgaaacaatgtaccgagatcttactcgatgtaggccgcacttctattaagttgttaaagagatacagcgaaatggtccgccattcttcaacatccaacgatactggtttccaagcactggatggtgcgagattccctttgaataggctgaggttggattgaccctttttaggatcgtcagcgttgtaccgaggcttcggattatgcaaatgacgatttttggctttgtaagtgtgttgtcacgaattttgatgcctccttaagtgatgaatgctccggcatcgatgcttcnatcctacgttaatttacattttgctcaaagcgtcctccgcatcctcccantg

SEQ ID NO: 82261 - DNA, 415 bp, Triticum aestivum
  unsure (1)..(415): unsure at all n locations
  Clone ID: PAT_TA_82261
ctgctgccgatcgaccccgccgtgttccagctgtcgcccatgggcggcggcgggttcatcatcgattccggcacgacgttcaccgcgctggaggagtgcgcgttcgtggtgctggtccgcgcggtcgcggcgcgcgtggggctcccgctggccagcggcgcgcacctcgggctcagcctctgcttcgctgcaccggaggggaagaccgaggcggtggacgtgccgcgcctggtgtttcacttcgacagcgcggacatggcgcttcccagggagagctacgttgtggaggaccggaacgccggcgtggcctgcctcgggatggtgaacatgcgggggatgtcggtgctccgcaacctgcaacaacagagcatgcactttctgtacatcttgaagggggcgtgctgtcnttcaacca

SEQ ID NO: 82262 - DNA, 442 bp, Triticum aestivum
  unsure (1)..(442): unsure at all n locations
  Clone ID: PAT_TA_82262
gagagagactagtctcgagtttttttttttttttttttttttttttttttttttttttttttttttttttttgttttttttttttttttttttgtttttgccactanactttttaccttcttganaactaccantanctnaatttanaanaaaaacaattaaaagaatatnaagaaaaggaactaatcncaactcctaaagcttacacatacacccacactaacccatgaagaacttgttggttgttaancttcctctgccgctaaccaaaaatcagagctcggcgggcgatatctctnatgtccacggtcccccttttttttccngcttttcttttantttccncctttncttttaacancaacaaacctctggatgcaaanaagcaagaaacgtctaacncaaaacccgtcaatcgaanaaggngttctcctcaactcna

SEQ ID NO: 82263 - DNA, 458 bp, Triticum aestivum
  unsure (1)..(458): unsure at all n locations
  Clone ID: PAT_TA_82263
ggcgaagatccaggacaaggagggtatcccaccggaccagcagcgtcttatctttgctggtaagcagcttgaggatggccgcactctggcggactacaacatccagaaggagtccaccctccacctggtgctccgtctcaggggtggtatgcagatctttgtgaagaccctcaccggcaagaccatcacgctcgaggtcgagtcttcagacaccatcngacaatgtgaaggcgaagattcaggacaaggagggtatcccaccggaccagcagcgcctcatctttgctggtaagcagctcgaggatggccgcactctggcggactacaacatccagaaggagtccaccttcacttggtgctccgcctccgttgtggcaataagtgcctggccatggaacttctaatgtctcttggctcacantccgttgtcttttgtgtacccgttttgattgtcagct

SEQ ID NO: 82264 - DNA, 451 bp, Triticum aestivum
  unsure (1)..(451): unsure at all n locations
  Clone ID: PAT_TA_82264
gcaagactagctaatcttgtgcacaagctagagatgatatattggtgatcttttgagataatatttcctcttctaatgtttcagtcgtaatgaaaatcctaacactaaggcatcacgacggcaaaaacattgtaccggtcacagtacaagtatgagactgtcaaggttctccgtcaagaacgacacccgttcggaagcgtgtcgatgatggatccgtaggagcgatcgacactagtaaggtcgggtagtcgggtcttagcgtgtaaaagaatcttgctcaactagaggctgtgtggttccagttgagactgttgacgtcggagtacccctcttaagagtgtaaaagcgtgaaatttcaaccctgtgactcccgggtcaagaancttgcggtcatgtgtgatgccaaaattattaattctaagcacaccttaatttctctaaaaaaaaaaaa

SEQ ID NO: 82265 - DNA, 454 bp, Triticum aestivum
  unsure (1)..(454): unsure at all n locations
  Clone ID: PAT_TA_82265
gttctcctcacctgctgtgaggattttctcggccgagaacgttcggcagcagctgcaagagtcgatgagggactacatccgggcgtcggtcgggatcaacgacaaggggaagctgacggtcccggcgctgctgcagagctacggcaagggcacggtggaggactcgctgctggccgactggatctgccggcagctgacgccggcccaggtcgcggcggtgcaggacaccacgtcgtcgcgcaagcagcggctcctcggcttccgcagcttcaccgtcgtcccgttcgactccacgttccggtacctcttcctgcccgacgaccagcgctangcagacgcagatcgatctccgcaatggagagagacaagagtgacattttgacagactccgtacatgttgctctgtacatgttgtgtanactcccggggaagctgatccttttgtttgttgccc

SEQ ID NO: 82266 - DNA, 183 bp, Triticum aestivum
  Clone ID: PAT_TA_82266
gatcatcggtacatgattcaaaagtattgaagaaagatcatgcatgctatgtgaacccacaaagccggtacgccacatgtacgagccatttgtccaacgataatacctttacatcaccctaaatttactggccgtgtgcattgttattatgcaaaggctgggggccatacccttttccgaaag

SEQ ID NO: 82267 - DNA, 466 bp, Triticum aestivum
  unsure (1)..(466): unsure at all n locations
  Clone ID: PAT_TA_82267
ccgccgcgccgccgccacccaacccctcgccatcaacacagctgcaggggaggcgattaagcagtcgccgtcgatgccnacnaccccgaccacgccggtgacgccgtcgtcgtcgaacgccgccgcgtggcggtagcgtgtggcgggagcgttttccaccccgggaagcaacctggccaccaaaagcctcggcgccaacctcttcgaccgcccgcagcccaatcccccaccgtctacgactggtttacagcgaacnagaccaagaccaagagcaaccaccgctaaataagaccgacggcaaagatttnagacaggaatttctgcaagccncatgtttgcncccttttggtaaccnaaccctgataacgtacttgctgtctaaggctcattaattgnccttacttccnacaactanctacnaatgcttggaattncttttcttgccncgngnaacccccggatgntn

SEQ ID NO: 82268 - DNA, 220 bp, Triticum aestivum
  Clone ID: PAT_TA_82268
gccgttcaaagttatttcagtgtctgatctgagcattttgggtccgtccgatcggagcaatggacggccgagatctgagccggtgcgttagtagagcatgtagcatgtgttgtgtgtgtagtaaatattgttggttgggtgaaagaattacccaaccaacttgtgtgtgtaccaaaccaaagttaataatacccctccgtttttaaaaaaaaaggggggg

SEQ ID NO: 82269 - DNA, 408 bp, Triticum aestivum
  unsure (1)..(408): unsure at all n locations
  Clone ID: PAT_TA_82269
gagccacccgttgttccaggcgctgttggaggaggccgaggaggcgtttgggtacgcggacgcggggcccctcgagctgccctgcaacaccgaggcgttcgccaaggtgctggaaattttnaaggagggagaagcaatgtggcccccngnnggaggcacaacctttctcaaggggaaactcctatccggtcactttggnacaagctgggctatattctcaagccggtccntaaanatgtcttttggatttggattatccanttttataacttttaatttccngtttagccccattccccaaattacaagttcaaaatttttaaacaacnttaattccccanttanggnaaacaaattttccaatnacccggaattttaaaatttncccccttaancctttttaatttt

SEQ ID NO: 82270 - DNA, 459 bp, Triticum aestivum
  unsure (1)..(459): unsure at all n locations
  Clone ID: PAT_TA_82270
caaacatcgatttttgagaaaatgcaattgaaaaaaatactatcacttcagctaagaagatccatagcgttctgaaatctgaagcacactgtcttctcttcagtttcttgatcctctgttcagcagataggcaagggctcaccgttccactctttggaggcactccgagcagccatccgatgttgcttgccctggntcatggcgacgaacaccttgtccactcttccccaaggagacgcgtcttctctccatcaagtactcagtcccaagntccttggcgcacaaacccggtanaatgggntacaaccggaattccggtatacgttcctgctgcgccggcgggcgttctccantgaaggccgtncaacctcactcccttgggnaaactgaacgggtccngctccaacgcggagcttgggnaaacgagttccaatngcctcggcnacgttngcnaggntg

SEQ ID NO: 82271 - DNA, 301 bp, Triticum aestivum
  unsure (1)..(301): unsure at all n locations
  Clone ID: PAT_TA_82271
cagaggaccgtccctgctgccgtccccgccattgtcttcctctccggtggacagagtgaggaggaggcgaccctgaacctgaacgccatgaacaagctccagaccaagaagccctggaacctgtccttctccttccgggcgtgccctccagcaagagcaccctcaaaggcttggccggcaagacggaaacgaggagnaaggcaagacgcgtccttggtgaggtgaaaggcaattccgaagcaacctttggaactaaaaaggggaacccaccctttgggaaggngctcctgaacctccaaat

SEQ ID NO: 82272 - DNA, 338 bp, Triticum aestivum
  unsure (1)..(338): unsure at all n locations
  Clone ID: PAT_TA_82272
aacaccgacctcaccgtcacccgcctctccgccgcggcggccaccaacaacgccagcgcgggctcccctagccactcctcctcttcttctgcctcttcctccccctcctccgtctacgtcctcngggcctctcctccgcccggcgcacacgcccaaagttggccaagtgcctgttggcaaagcccgccgcaagcgaccgcgcgcgcaagtcgctngccnggcctccgtcctcgccatcttaacaacatnaagagcctacgaatgagtaactanaantcnaaggattgctttnccntgctttaattacaatggnattaatttggccaaatnaanggtta

SEQ ID NO: 82273 - DNA, 437 bp, Triticum aestivum
  unsure (1)..(437): unsure at all n locations
  Clone ID: PAT_TA_82273
ggaaaatcacgtgtatccagatcaggggtatctgttgacctgataacattgatacaaaatgacaagctcaacgacttgttgcgttgagaaaatgcatcaggacaggtaaactaaggctgtctaccggcatttccaattcacagcactagtgttaccaacagtacagtttcattacacgattaatcctccgcaaccgaccaaaaangtttctgcactcaactggganaatntntcccntccaagcaagctgtcctcgtcctcanancatcancatcatcatccccatagccanancttcaacaaatntccngaacaatttcggctggtttcccccttagngcccttccgaggggggaaanaaaacccctcaaaatttccggnggncacactccctttaaacttangcgtccaattctnaacttattttaaggantagt

SEQ ID NO: 82274 - DNA, 491 bp, Triticum aestivum
  unsure (1)..(491): unsure at all n locations
  Clone ID: PAT_TA_82274
ctcgagttttttttttttttttttatacaagtcgcatcggagcatcaatctgattactgaatcaagttatctgcttggcgttaattcatgaaacatttgaaatgcgcaaattctcacatcagctatggatgcaaaagagatcgtttctttatattttccgatcttatttccagctataactggtgtttccaagtttataacttgggcaaattcctggtgagttgctccaaattattcctggaagcaaaaccaagaaagaacgcaccggaaattttacagtgatcccccttaacaaaatgacaatcctaaagctacaattaacgaaatcaatccccggactaacgcctaatccccaagggcgcaaaaaactatccnccaaaaanaccaatttngcngntaaccaagttttggcgattacgaaccgtanattcctgggttgtgctgggtgccccccaatccctngcccgtantgccttctgcaaaganacctn

SEQ ID NO: 82275 - DNA, 311 bp, Triticum aestivum
  unsure (1)..(311): unsure at all n locations
  Clone ID: PAT_TA_82275
aacgcctagaagctaggcgctacactatatagtgtggcgcctaactctcaggcgctgcacactgacttagtaattttcggatcacaagggtgcgacgttggccaggcgtgtagcgcctatctgtgaggcgttgcacagtgtagtgtggcgccttcgtgtcgggcgtcacacaaaaaggtcagcgcgttaaatanttcacgggcantcatcctgtgatttaattccgtccataggcaaattgtcaatttgccgcaattttactacgtcaanttctgcttttccccactgtttttgcaccttaattgcttatt

SEQ ID NO: 82276 - DNA, 222 bp, Triticum aestivum
  unsure (1)..(222): unsure at all n locations
  Clone ID: PAT_TA_82276
cgctctacctactaggnntcatcccccggtgcngnaagtcggcacgangtcncatgtggtgcactgggggnttcctctctttcngntcagatgngggacactntcacctgcattcatcctgangngaccctgccattcacantgagatngggaggcaanccacatggancgctatgctaagatcttaacaaagggcacncatcntganaatntgatnactac

SEQ ID NO: 82277 - DNA, 482 bp, Triticum aestivum
  unsure (1)..(482): unsure at all n locations
  Clone ID: PAT_TA_82277
gccatcggccctctaatcatatcttaacatgcttgctcttcatctattaaagatagattcttgcttcttattcatctctttaaataccttttttttctaatttgtaactcttcttacctatttttggcagaggtacaatggttattgacttgtattatctatttcctgacccaaacaaatctaatatgccaaggtaacaataaaatcagaatggatcaaaanccaaaacacatgttgcatggcttccaaggantaatgtatacttcccggaatcctatttttacctcnnactaacctggatatgtttgaataagtgcatgctcctgctccttgcaagccacatctgcctggtacnatgctgttatttaatgatttccgggggactaatgtcctggattataggaagtgggagaaggaaaaccccggatcaantagggaatacatgataactggtccaactcaacatcctaggcggcaggcng

SEQ ID NO: 82278 - DNA, 452 bp, Triticum aestivum
  unsure (1)..(452): unsure at all n locations
  Clone ID: PAT_TA_82278
gcggcgccaagcgccacaggaaggtgctgcgcgacaacatccagggcatcaccaagccggcgatccggaggctcgctcggaggggcggcgtgaagcgcatctcggggctcatctacnaggagacccgcggcgtgctcaagatcttcctcgagaacgtcatccgcgacgccgtcacctacaccgagcacgcccgccgcaagaccgtcaccgccatggacgtcgtctacgcgctcaagcgccanggccgcaccctctacggcttcngcggctaagctcaatctccgtccggaaaccgtcgctcctcgccttaagcaaaaantcgccccgccntggctgnacctgcagacgcgagaaaactgtcatatcttcgttnagnacctttanccggaacaaatgttcctgttcaccatctgtcatcgcanaagtccctattacctggtactcataaccat

SEQ ID NO: 82279 - DNA, 338 bp, Triticum aestivum
  unsure (1)..(338): unsure at all n locations
  Clone ID: PAT_TA_82279
ggcaaacgaaatccacgagcggagaagaggagatcaggatgcggctttccttccccctcgtcgccggcgccgtcgtggctggagtgatttctgggaatgtgatatttggacaaccgctcaagaaatactgggcaaganaaacaagcaagcaaagaacaagggcggcaaaaaagaaagggcaaaaatgggtccgacttaacgggagatatccttcaatgtttccgcctgagtcaatgtcgccatacttatctccgatncaagacaaaacaanttcacaaaacaaaactaatacagtgatgttaaaatgtnccttgggttaatccattaaaaaaaaaaaa

SEQ ID NO: 82280 - DNA, 481 bp, Triticum aestivum
  unsure (1)..(481): unsure at all n locations
  Clone ID: PAT_TA_82280
aggcgacccccgcttcccgtcccctctctcctccacacgcctctctccctctcccctcgtccgccgccgccgccgccgccaccatgggcaggggcaagttcaagggcaagccaaccggccgccgcaacttctccaccccggaggagatcgcttctgggaactctgggcgtccacgctcgtttaagaagaatgtagctgaagcagnaagaaggaagaaggaagaagtaagaaagaatctgagggaggaaagaatcccgaaagacgacggtgaaagagaaagaaacataaaggaactgaangtgttattcaaatcnaaaatccaaaactgggtgaaaagcaaaagaatataaaagccaaaagaagctgatcttggaaagacaatgaactctcnaggcgttanaaaaaaggagatttagaaacaaaaatctcatgagcgctatatgaaccttaaggagcaanggaaaacagaacaagngaagaa

SEQ ID NO: 82281 - DNA, 191 bp, Triticum aestivum
  unsure (1)..(191): unsure at all n locations
  Clone ID: PAT_TA_82281
cnctnacnagcaaacacatgcgatgccaggtcaggttngcggtacagctaacancacacnctggttgatgcgctcacctcaacccnacaccgggcagncanccgtctgagcngtgcaccaggntaacaggggatgtccttcatcatgctnttcactactaccactncagggactttcacanttggacgacc

SEQ ID NO: 82282 - DNA, 453 bp, Triticum aestivum
  unsure (1)..(453): unsure at all n locations
  Clone ID: PAT_TA_82282
gctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcagtttatctctcacatgaagcgctacatcaagaacctcactgccaagcttgaaggggatgacctagatgttttcaagaagaatgttgagtctgccacgaatatcttcctaacaaagctcaaaggacctcaatccttgttggcgaaaacaatcatgatgangcgcttgngttccccntatnnaaggaggaactgcnatcaacttcccgnactttcana

SEQ ID NO: 82283 - DNA, 184 bp, Triticum aestivum
  Clone ID: PAT_TA_82283
gctgactgctgcatcccagcagtttttagagggtgacctctaattaatttttgtcagattgtgagatcgagatgctaccagcattctttcccagcttgattttgcttcatttgttcttgaaccagttgtcaatggtatctgtttgcttgcgcgttatgaggcgctcgctcataaaaaaaaaaaa

SEQ ID NO: 82284 - DNA, 456 bp, Triticum aestivum
  unsure (1)..(456): unsure at all n locations
  Clone ID: PAT_TA_82284
gaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggangaatctgacaagtccaagtcggagatcaatgacgacgatgacgattaagggcagcgatgaggacnaggacgatgacaatgaagaagaccatctgtcaaagctgctcccggcggacaagtccggagctgctgtncnaaaacggnctgactgtntccgtggtgtcataangagctatccatctccactagaatttccaagttcactcacatcctgatgttgttt

SEQ ID NO: 82285 - DNA, 424 bp, Triticum aestivum
  unsure (1)..(424): unsure at all n locations
  Clone ID: PAT_TA_82285
gaactagtcttgagttttttttttttttttttttttttttttttttggccaagcaagaatccacatttttgtacttctgttaaatgaagatttcatttgttgtcttatatcatatcacaaggggatgataggcagatacacgcaatacaatcctcctcataggaaactatggcacacatgatagacagaaataggatcatttgtaatggagctacttgatagcactagacacttgatcagatgtatcatacttgtgacatttcagactggatgatttcgaattcggactcccatcgggcagcctccagagcagttcatgaaccatgttttataaacacaaactaattcctgcttattttcccctcttcatttccaagctctgctacaacagaannagagaagacnacaattcacctttgctgtt

SEQ ID NO: 82286 - DNA, 297 bp, Triticum aestivum
  Clone ID: PAT_TA_82286
cctcaggcgacttggcgggcccactagcggtgcgatgttgacaatgcaaccttgtgtattttaggggacgcgtagaaattatgtatgtgtccttattcacttttgaggtgagtgcaagggggtgtgtcgttttgctaggtgcacgctctctgggtacaaatgttgtttccttccgtagggatttagtgatcataggataccatctctagatggtccagcagggtcatgacaggtcaataattttgtgtaccataaaatggggtataatgcaatggaagtttgtgtaaaaaaaaaaaa

SEQ ID NO: 82287 - DNA, 435 bp, Triticum aestivum
  unsure (1)..(435): unsure at all n locations
  Clone ID: PAT_TA_82287
aatgtcatgtgggcataagcataaaaattatgatgttacaactagtatcattacaacaaccattatgtcacaacttcaatataatatagcccctggcagcataatctgtcctgtctgtagtctgtgcacttttctttatgggctagtatagcgcacaacatgctgcattatccaactccaagtgctctgaatcatgatttgatatttttgattacccatgacgttgcccagaatgtattaagatcgtcttaggacagttgaagtctgctacattcaaaagcatatatccttgattaggtgtatgtatacttcttgggataatccaattttgggatgctagaagagaatatttaccccagtgctggagcgtctgtttcggagtgctccngggtcaatttggtggnccctggccaattcaaagattagcaaggaatn

SEQ ID NO: 82288 - DNA, 433 bp, Triticum aestivum
  unsure (1)..(433): unsure at all n locations
  Clone ID: PAT_TA_82288
ggttcattgtgttgaaagtggcaaggatgctatctccctacttcaacctccacattgcttccatgcatgttttatggacgttcaaatgcctgagatggatgggttcgaggctactagacaaatacgagaaatggagaagaaagcgaacgaggaaaagagagaacagtcgagttcaggggaaggttcgacatttgttgagtggcatttgcctgttcttgcaatgacggctgacgtcattcaggcgacctacgaagagtgtatgaaatcggggatggatggctatgtgtccaaaccgttcgacgagcagcaagctataccaagcggtctccagattagtggtgggaacaactgattcgggctcatgatctgatcggtcgaaaccggattcgacgcctcgttggntgaancgaagccaaagctgactctgactctt

SEQ ID NO: 82289 - DNA, 422 bp, Triticum aestivum
  unsure (1)..(422): unsure at all n locations
  Clone ID: PAT_TA_82289
tttttttttttttttggtactaatagtcagcatacccattggattaaaattgcatattcagttaaccaacaacagagggccaaaagtaagcaacacatcttcaaggtaactaactacagcaaagccacaaagcattatacatgtcacatttaccatatttagtcttgaaggggatcgttcgttccacccccaaatatataacaatataaaaacgagtcatcagtcactctcgttgacttcgctgcctgcgcctgtccgacggaggccgtcgtgcgcagtagccagagatgggtcgattggacgcggcggtcttggaaggattcctgggcttcngcagtgaggccttcctctcgtagcaccgccaagcagagcatgagcgcgggggtcctccngggctaaggcgcacggctccctgccgaatc

SEQ ID NO: 82290 - DNA, 426 bp, Triticum aestivum
  unsure (1)..(426): unsure at all n locations
  Clone ID: PAT_TA_82290
gagccatgattattgcaatctgaatatttagtgtgtattgttaagtttgatgttcctctagtatggagtctttcaatgccagtcatactttttgcgtaactttgtttctcgctagcctctctgacactcggtattgcattccttaattaggatatcgcatactccgccggtgtacatactacatatacaaatcacagaaattaaaccatttcttcgatgtgtttacatcatacctacattctatagcacatcccttgctattccgcagtagttgattgttccataaacacactcatcaaagttccgaagaagatcaaaagagagtttactgtcatcgtcatgaaccctgccaattcaagcactatgaagagtatattcatcaatattatcatgctctcccacacacatatgagaaancnaccngcg

SEQ ID NO: 82291 - DNA, 429 bp, Triticum aestivum
  unsure (1)..(429): unsure at all n locations
  Clone ID: PAT_TA_82291
gacgacgagatctcgccgccggggcccaatccaggcgataaattaggagatttggtcaggcggcggccgattgggtcaatcaaattaatcaattggcaaatcagtcagtcgatcgccggaacaagatttgatttggtttggaatctgcatagcagtaattagccgcgctagcgatcgatggatggtttgggtttcggttaagtaagtaattcggtttgggtttctttcttttttcttctttggggattccatcgacgaacaaaacagaaacagatangtaagaagaaagaacaaatgggtgtccgctttttcctggacggcgtgtaccatccaccaaaccctgccggttgntggattaacagcttggttgattgattggtacnactgctacaactacaacaatccagatggttatggaggaaaaaaaaa

SEQ ID NO: 82292 - DNA, 478 bp, Triticum aestivum
  unsure (1)..(478): unsure at all n locations
  Clone ID: PAT_TA_82292
tgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaaggtcaaagctgatcgtgatgaatcatccccttatgcagctatgcttgcatctcaggatgttgctgtaagatgtaaggagcttgggaattactgctctgcacattaagctccgtgctactggtggaaacaagacaaaaacccaggtcctggtgctcaagctgcgcttaagagtcttgcacgttctgggnatgaaaattgggcccattnaagaatttacccccgnncccaaatgacacaacccgccggaagngtgtnnaaaaaggaangaggctgtattccaaggcccgttcaaaggatggacaattcaaaccttccaacccgggnnctgcnatttttcgt

SEQ ID NO: 82293 - DNA, 473 bp, Triticum aestivum
  unsure (1)..(473): unsure at all n locations
  Clone ID: PAT_TA_82293
atgagccagtttgtcttgggtgttgctccccttgctggacgcggtgttggccggtggctacgcgatgaaccttcgggccgtgtgtcggcctatggaggtatgcggcgcggcagttgtcacggcggacatggaggcctcggcggcgtggctgcggcgcgcggcgagcgcgtggcgatggcaaggcggggcgagtccggacatggtggtggcacacggcttcgacgtggcaaccgcggctcgggcacggcaagcggacggcacgattgcagagggcgttggaggtgcgcggtggcgttgggcggtggcgttcaaaggcgttccgaaagaaaggacgcngtgggcgcatgcaagccggcggcgagccgcaagacgggcanctggangatgacggcggcacaatgggcgactcccggancgactgcaagccggacccgcaccggctccacgatgacaacaaccgacaagcaataccc

SEQ ID NO: 82294 - DNA, 469 bp, Triticum aestivum
  unsure (1)..(469): unsure at all n locations
  Clone ID: PAT_TA_82294
gcggcaaggcgaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgctaagctggcgaggtacaacaagaagcccaccatcacgtcccgggagatccagacctccgtccgcctccgtcctccccggcgagctccgccaagcacgccgtctccgagggcaccaagctgtcaccaantcactcctcctggatctccgttagttactgtttggtgtgtttgnggccgtgttatcctgttaagatcccatcnctanttcccnggtttccnaagaatantnacggngcctggcctcaacaaananaaaaaaaacncccaggggggggcccggtaccnattcnccctatagtgant

SEQ ID NO: 82295 - DNA, 339 bp, Triticum aestivum
  Clone ID: PAT_TA_82295
cgaggaacttcgccagctgacggaccaagctcgccggcgtcccttcccttcattgcacattcgtgggtcgcggaactgaagaccaatggcatgctgtcgtcaatcaatcaatcaaccatcccatcatcaagccgtaaacaggagatgtactacgaaagatcgagttagttgtattgtagtactacatggaggtcattgaaagcccgccgaggccacgggccccatatgtctgcggcatttgccttagctctgtagcctagctaggttcgttcatcatcagtgaagtgtacatacgtggtgccctgcaataaatctcaatcaacacggctgaaaaaaaaa

SEQ ID NO: 82296 - DNA, 387 bp, Triticum aestivum
  unsure (1)..(387): unsure at all n locations
  Clone ID: PAT_TA_82296
ctggctcgggatgcccatgtacgacgccgactttgggtggggcgcgccgcggttcgtggcgccggcgcagatgttcggcagcggcacggcgtacgtgacgcagcgcggcgccgacagggacgacggcatcgccgtgttgttcgcgctggagcccgagtacctgcagtgcttccaggacgtcttctacggggagtgacaggcaactttctccctcctttgtgtgtgtttgtgaatgtgtgttcagatttggatttggtagaatgcatgtgtacgttgtacgtgccaatgtgtcatatgtcgggcttccaactgttgttanggaaaataaaccataaaatggttgtatacaaacctatctttttttgcgtggataaaaaaaaggggggg

SEQ ID NO: 82297 - DNA, 420 bp, Triticum aestivum
  unsure (1)..(420): unsure at all n locations
  Clone ID: PAT_TA_82297
ctacggcgacagcaaggccgccgccgacgcagcggcggcgcagttcgacgcgcacgggctgggcatcaactggtgcttgaattgaactcatccaaccgacagtccgacaccaaaggccggcggccagcaatcagccgctgctgccgccactacatgcaaagatccagattgtaacgtatacgccgagtttataatactcctagctactaagaaatgtttggtgaggttttggcttgtaaattgtttctcccttacgttctctcttgtttctttcnttccttcatcctgagttggtgattgattgattgatctgtaaaactttgcctgtaaaatncatatgacaacacanaanggtncacgggggatacatatattactttacnctgctataaaaggtgtttgattttgctggttaaaaaa

SEQ ID NO: 82298 - DNA, 272 bp, Triticum aestivum
  Clone ID: PAT_TA_82298
ctgaaaacctcactctcaatctcatccatccatcaccgccatgagagattgaaatcgattcaaaaaattccagcaagtgtacgtcgtcgtgtcatcatcagtaagccagtttagtttcattctctctccctctctctctctcgtgtctttgagaaattcagggtaaacagtgtgagtcagtcagtcaggaataatctcttgtcttggtgtatgtcctcaattatgaatgcttctattccatggtcaagattgatgtttgtaaaaaaaaaaaa

SEQ ID NO: 82299 - DNA, 467 bp, Triticum aestivum
  unsure (1)..(467): unsure at all n locations
  Clone ID: PAT_TA_82299
cgccgatccgaccatggacgccaaccggcagcccgaccctcctgccggcgttgagccgccctccactgccatcggaggcgattggcaccagcccgaggcacgcagcaggatcgtcaataagataacggaagctctaaagaagcgcctcccagtatctgcgccagaggagctgaatcaacttcgagagatcgctgtgcgatatgaaaacaggatctatactcaagaaaccaatcagcctgattatttccggaagatttctctgaaaattctctttatggagatgaagacacaacaggctgcaagatatgctgaagtcattcctgaacgaaacaactccagtaaggaaaaaactggagttcaacaagctggctgaagttgtgangctgggaagctgatggtgctgctactggctgattcntgtcttcaatttttgttcgtcatttacaagcnttggacaaggctacttc

SEQ ID NO: 82300 - DNA, 451 bp, Triticum aestivum
  unsure (1)..(451): unsure at all n locations
  Clone ID: PAT_TA_82300
gtacagtacatactttgtgttattttgcatgctctctatgtgttctcgtcttggcaggggatgcttggtgatgactccttaaatgctctgagtaataattgagaatacatagacaatgtcaaattgaagtgtgatatttgtatgtcatatttactccacaataactttttatgtgtttttctcattctttttacatagacgtaatgatttctttatgccgcaatgttacttatgtcatttggatttggacatgccgcagtgttacttcgatctctggatggttggtggccaccttaattagaatcattangggtaatgtagttgcaatgcagtatctatgtgtgggctaccggatggagttcaacagctgtggtcaaaagccggatgtttggagatgccatgtttgattaattaattaatcatctttgtggtgcataagtccgatccnggc

SEQ ID NO: 82301 - DNA, 507 bp, Triticum aestivum
  unsure (1)..(507): unsure at all n locations
  Clone ID: PAT_TA_82301
ccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagtcgaggacggccgcaccctcgccgactacaacatccagaaggatccaccctccacctggtgctccgcctccgcggcggcgccaaagaagcgcaagaagaaagaccttacaccaaagccaaagaagcaanaagcacaagcacaagaaggtgaactccgccgtcctccaattctacaagtcnaacnactccaccggnaaggtgacaagtcaaggaaggatgcccaacncgactgcgngccnggactnaatggcnacatttnncgcantattcggaatnnggctcactaanttanacaaaagtaaaggtggtccgttgtctnn

SEQ ID NO: 82302 - DNA, 492 bp, Triticum aestivum
  unsure (1)..(492): unsure at all n locations
  Clone ID: PAT_TA_82302
ggaggagcaccagcctgaggtgccaccgcttcctaaggtagaactgccaccgtttccggaagtgcacctaccgcctaagcctgagcttcccaaggtggagttgccgccggtcccggaggtgcacttgccacctaagcctaagttgcccaaggtggagttgcctccggtcccggaagtgcacatgccacccaagccggagctgcccaaagtggagctgccgtcggtccctgaggtacacctgccacccaagccggagttgcccaaggtaagagctgccaacattcccggaggttcacatgccaccaagccgggagatgcccaaggtggagctgccgccgaagcccaaatgccactgttcccgtgttccattcccggagtccggagccaaagcnttagaattgcttacaatattgtnncttgttatactcctctgtctctaattnctatgcctgttgttcatgatctgattgttaatgnggtttaactaaaaan

SEQ ID NO: 82303 - DNA, 497 bp, Triticum aestivum
  unsure (1)..(497): unsure at all n locations
  Clone ID: PAT_TA_82303
aagaagcacaaaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaaggccgccggcgccaccctcctcgtcgccgccaccgccacccacaaggcgagctccggcgggatggagaatggcggcggaggatggcggctgcggctgcacccaatgcaatgcnggcaccaagctgcggctgctcctgctgcanctgctagatnattgatcatcgatnatgcatgcaccgcgcgcatgcatcatatctaagatcnattcatccatccatctagtacatgtaacgctacctgatcnaaggtccttggatgtatgttancactggcaacattgagcanncaagtgatccaagcattttaaccgaccctaataaatctccngnggttaaccaaaatgtt

SEQ ID NO: 82304 - DNA, 510 bp, Triticum aestivum
  unsure (1)..(510): unsure at all n locations
  Clone ID: PAT_TA_82304
catcatccccgataccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtnttggtgtnagagtatacgtnaataacgagcgtctgatctgatggagtccaacaagggtgcgtgtncntgtgcgtgtgtttgcttgctcgctctcccatgctctgccatggngtcttgtgtgtagtgtgtgtnatgttccctgtaatgctcatcnacccantatggatggntgtnatattaaaanaantg

SEQ ID NO: 82305 - DNA, 293 bp, Triticum aestivum
  Clone ID: PAT_TA_82305
gcaaagcgctacttctgggcggagcaggacatcagactgaatgtcaccagatttgctcccacgctgcatcagctgcttcggacactccgggaataggggaactttgatacgtgatactactacctctgttcctaaatgtaatgcaagatttcttggcagtttgaatttaagctgccaaaacgttttattagggtgtaggttacaagaagcacaccatgggagcagagagcttgcttctttcttgttgtttcaatcgtcagatcaatagacaagaattaagcaaaaaaaaaaaa

SEQ ID NO: 82306 - DNA, 328 bp, Triticum aestivum
  unsure (1)..(328): unsure at all n locations
  Clone ID: PAT_TA_82306
gtgtaataatgtaataatgtgaagaagagaaactacggcgggcgctgtcaatcaatcagtgagtcagtcaacggttaaataaatccggtgctcaaggaaggcaagcagatgacaaaaatgttttgagagacaagtccttgctttgacgacgagaagaagatggtgatctgatgttgcacatgtatgcgtgtattgttgtatgtatgtaggagtacgatacaattgtgcataggctaggtagctagcacacatgcatgggaattactagccaattattatactgaaatgccacaaaaatttactaaaanaaaaacaantcaancncagg

SEQ ID NO: 82307 - DNA, 497 bp, Triticum aestivum
  unsure (1)..(497): unsure at all n locations
  Clone ID: PAT_TA_82307
ctatgacccatggaagaattaccgtcgtcgtcttgtttctacgtatacaatggcagcagatgccagcggtagccctgaaatggttctagactctggggctaattctcgctcgacgggtggcctgttgaatccccttcttggcttacaccgtgttgatcctgtctctgtacccaatgaacaccgagacttcaatggaaaatctccgttnggtatttgccgcctgttancaattgcttgntaattgcnncaaaggccgaaatgaagaaagaaacgacaccgcgtcaaggaanattnnacacaacaaaggccgcaagatgtatccaagcggtntcctcnaaaaanatccnagangngcctcncaaaatntgaaccaaatctgcggnnaatccaacttatgacccctgnnatanacaaancgattctggggtattganctgcggccaacaanttgnnaggtactcaaatattntccgctaaanncaaccccgggataantt

SEQ ID NO: 82308 - DNA, 443 bp, Triticum aestivum
  unsure (1)..(443): unsure at all n locations
  Clone ID: PAT_TA_82308
gaaccaccctggtcagatcggtaacggctatgccccagtgctggactgccacacctcccacattgctgtcaagtttgctgagctggtgaccaagatcgacaggcgatctggtaaggagctggaggcgctgcccaagttcctcaagaatggtgacgccggtatcgtgaagatgattcccaccaagcccatggttgtggagaccttcgccacctacctcctcttgggcgcttgctgtgcgtgatatgagacaaacggtgctgttggggnncatcaaaggcgtttgngaaanaanggcccaaccggttncnaaggttaccaaggtgccatcaannaanaaatgagtgctcggggtgtctgccatcngnttatcnagnaaaattttaaggncaancttttttgggnnatcttaggtatttaanngttatcctgggctttttgcantt

SEQ ID NO: 82309 - DNA, 602 bp, Triticum aestivum
  unsure (1)..(602): unsure at all n locations
  Clone ID: PAT_TA_82309
cacacacacaccacagaccacctctccccgcccaagcatccccatccgcatcctcatccatggcccccaaggcagccgagaagaagccggtggagaagaccccggcggggaagaagcccaaggcggagaagaaggtgccggcgtccaaggagggcggcggggacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagctggccggcgagtcggccaagctggcgcgctacaacaagaacccaccatcacgtcccgcgagntccagactccgtccgcctcgtcctccccggcgagtcgccaagcaccctctccgagggaacaaggcgtcacaagttaactccgcctgatccggtcctgtcctgtgtgtgtctctggtggatggatgatgtcccctgtantcctgctcggacttgtctcctgtactgtgctggtgtgtcctgtgtggatanattaagattgngaatatacgngctattagtctgcatgtc

SEQ ID NO: 82310 - DNA, 355 bp, Triticum aestivum
  unsure (1)..(355): unsure at all n locations
  Clone ID: PAT_TA_82310
ggaaggcgaggcaggagcaggaagaggagcttcggacggtgatgtacctcagcaactggggacccaacaactaactgtagcggattagtcattacttacatactagagtcctctagatcttcttggatggctagctgcaccatttcctctggctggatgatgtgagctcagcatgcacattcagtctcgagctagtgtaagacaccttatatacttccatgacccggaaggtttcaagaaacagagattgacatcgcttccgggcggcctcctcaatgcttaacggcaatctgcaaactgtcgctctgaatttacagcgttgagcatacagatttcctacaanaaaaaaaaaaaa

SEQ ID NO: 82311 - DNA, 770 bp, Triticum aestivum
  unsure (1)..(770): unsure at all n locations
  Clone ID: PAT_TA_82311
gttttttttttttttttttggataaaattaattattgaacaccagggcacaaataaatttaattcaacaatattgctacgatgtaaatatggtatgttcatgaaccggtcatattctaaattgatcaccggagaatgatcacttgaactgttgtttgcttgcaaatgtttgcccgaacttccatccaccaggcacaatattgttgaactcaaccgtctgcccatccgtgtcagtcaacctgaacgagagcattttcccggtaagatttgctagagagtgccagttgggcaccccagttacgggacattgacatccagtcgtttgaatcaagagctcttgacatccatcgatttgatcgagccagcggctgcgacattcatcacggtaactangttgaagtaatccgtggcttcgatcttgaaccgcacccaccttcttcaccatgggacctctggtacatgacggggatgatgccgccttgtaaaccaatctctccaagccggtgcgccagtaaagtgtggcctggcgggtgcacagccgcaatgtgcncggagtcgttgttagcggcaaantcnggcgtcacgtcacnanacnctggttgacanatcgntngcaantgcgnccatgcattntgacatgcaanccgacaactaaanacgtgtaagtnctcggacgncccccatngntcanccgagncncaaggtaggacggccctaantccggcccacatttggttccgagaaccaaaaatnnacccaatctgggnggnt

SEQ ID NO: 82312 - DNA, 358 bp, Triticum aestivum
  Clone ID: PAT_TA_82312
cggcaacccagaagtcagggtcaacaagatggggagggcagcgggagtgcttgagaaccatgaggagggcaggcgctacgccgagcatggcctcagagcctatgtgcaggacaagacccccgagatcatgccaggaatcaacaagttcttcaccagcccgaaatgaagcactttagcctgtcagtggctcgctattagtaactgttgtggtcaagtgcaaacctatttcaagcattcagtaatgttgtcgcgtccataattcaagaggatatcatcaagtgcctcttattgaaagaaccatgtgatgtttgatggcttgctatatatgtgatggttgatggcttctaaaaaaaaaaaa

SEQ ID NO: 82313 - DNA, 500 bp, Triticum aestivum
  unsure (1)..(500): unsure at all n locations
  Clone ID: PAT_TA_82313
cccaaatccatcttcgtgcccgggaaaggaagagagagagcggcggagatgtctgggcgcggcaagggcggcaaggggctgggcaagggcggcgcgaagcggcacaggaaggtgctgcgcgacaacatccagggcatcacgaagccggcgatccggcggctggcgcgccggggcggcgtgaagcgcatctcggggctcatctacgaggagacccgcggcgtgctcaagatcttcctcgagaacgtcatccgcgacgccgtcacctacacggagcacgcgcgccgcaagaccgtcaccgccatggacgtcgtctacgcgctcaagcgccaaggccgcaacctctacggcttcggcggctaagcttcctttcctcgtggcggcttgtttacggagggagtgcctgttatcctgttggtgttggtaatttggtgccgaatgtttgttctgatgtaacgtgcctgttcaatgaagtaaatcctgtgtctaattnagaaaaaaaa

SEQ ID NO: 82314 - DNA, 405 bp, Triticum aestivum
  Clone ID: PAT_TA_82314
gggtcatggcccgagggccattgagatcagggaaagagtggacgctctgaaagggatgacgcgagaggcggcggcttcgggcgggccggcggagcggagcctccgaagctttgtcatggcggccggttcaatcgtcggatgaagtttgcaggaatacaccaccaaatctgtccaaatcgattaagtggatgcatgctggagtggatcagctagctctctcgatcggtcggagttaaacaacatttaataaccgggattgctaaatctcagtcgacttcttggtcgatgatatattcgcaggatcttacgtgaagatcggtgcgaattttttaattttcttttactcatgttatgtcactttctcacgccgtatgcagcaacttaatagtgacacgttaattgctt

SEQ ID NO: 82315 - DNA, 307 bp, Triticum aestivum
  Clone ID: PAT_TA_82315
gttctgtacgccttcccaagtctttgattttctttcccctttttttgcgaggaaggaaggagaaaaaaattgagagttcctgggactcgaacccaagacctcttagttgaaaaccaagggtgctagtcacttatgtggcaaacgttccttgtgaggaggacggcagacgaacgcattttgctcgtagttttcttcctatatataaaaaagtatgctacttggtgtccgcttagtcaacaaacgactgtgccaaccttgaccgttgaattgacattcaatgtctgtcacgtttctttagtatcttctt

SEQ ID NO: 82316 - DNA, 599 bp, Triticum aestivum
  unsure (1)..(599): unsure at all n locations
  Clone ID: PAT_TA_82316
ctccaaagccagatccccagcccctccatcccaatggcccgcacgaagcagacggcgcgcaagtccaccggcggcaaggcgccgcggaagcagctcgccaccaaggcggcccgcaagtcggcgccggcgaccggcggcgtgaagaagccccaccgcttcaggccgggaaccgtcgccctccgggagatccgcaagtaccaagaagagcacggagctgctcatccgcaagctccccttccaagcgcctcgtccgtgagatcgcgcaagacttcaaagaccgacctccgcttccaatcctccgccgtctccgcgctccaagaaggccgccgangctactcgtcnggtcttcgaggacacaactgtgcgccatccacgccaagcgcgtcacattatccaangacatcaatcgcccgccgatccnagggaacccnctaagttcntctggtcccggtaatactggcaatactgtcntgtctgtattcgggtgtgttccgngcttcgnttgttgtgtganaanangtgcctcngnccnaagtancncatcccaanaaatcnatggaacggaaanttantttgtcgatnaattttttaaaaaaaaa

SEQ ID NO: 82317 - DNA, 298 bp, Triticum aestivum
  unsure (1)..(298): unsure at all n locations
  Clone ID: PAT_TA_82317
tcaactgaacttgaaattacccgggcggggngggcgaattcacagttttacagaagcanattgacagggtcngncgtcccanatcgatnatcatccacgcttttacanctccacgcacgaacgnaccacaaacngacncgactacnggccgaccgatcnncccagggatggatggattcattcnaagcaaactangacgactcatggcgatggcaangtangccatntnacgaaagctatngattgancacacggntggacagnaaagttccatcaaactgggtgctaagaatcggtg

SEQ ID NO: 82318 - DNA, 500 bp, Triticum aestivum
  unsure (1)..(500): unsure at all n locations
  Clone ID: PAT_TA_82318
ctctctctctctctctctctctctctctctctctctctctctctctctctctctctctctctctctctctctctctctctctctctctctctctctctntctctctctctctctctctctnngtctctctctctcaccanggtgnagaattcgncacgangaangttgtacntgcaggaagggaaaaattgttgatgtggttggacnaanganatgtgagataatgatggntgatgggtnagagnttgtgnagggggtggagtaggatatgcttgaaacagtcctgnnatgganataggggnatgtgcttgtgctctgtgggaancanaagggggtgtatgggcattggnagagangaattcagaggnagagactgcagtantggnggatgncgatacaaaanaatgggggtgtgaaatatatnagattgagatagttgngaccagaatgntngggattgatantctcttgaggagggaatcgtttcaagagtctctaag

SEQ ID NO: 82319 - DNA, 661 bp, Triticum aestivum
  unsure (1)..(661): unsure at all n locations
  Clone ID: PAT_TA_82319
aggtcggctacaaccctgacaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggccgtgttgagactggtgtcatcaagcctgggtatggttgttacctttgggtcccactgggtctgacaactgaggtaatccgtttgagatcacaagatctcncctggangccttctggtgacaacttggctcaactcaaaacttgctgtgaagatntgancgtgtttgtgcancaatncaaagataccggcaaggagnggcaactaactcaagtatacatgaacaactggcaatngnatggnccccanncggctgcaaactccaaatgcgtaatttctacctgtgacaaattaaagcatttgtagactgagcgctccaattctanacggaccngatcgaaatattccaaaccnngttggaactccaaaaccccttggctttntggtaaaaaagttntttgcnanggggaaaanccccccgttaagggcnaaaaaggncncaa

SEQ ID NO: 82320 - DNA, 248 bp, Triticum aestivum
  Clone ID: PAT_TA_82320
ggaaaatcaactcccgagctcctagcgacttctgaacttgaatgtatttccatcagacctgcaagggaaaacatagtacaggattttgattagcagataagtttgtaagtatggttgcatctaattgtgttgcctgacaggcctgcagcagctgctgccagttcctacatatggccatttcaaacggtggaagtattgatatgaagtaacttttgaatttcagagaaaaaatatataaaaaaaaaaaa

SEQ ID NO: 82321 - DNA, 486 bp, Triticum aestivum
  unsure (1)..(486): unsure at all n locations
  Clone ID: PAT_TA_82321
catcgtcggcgccaacatcctcgccggcggcgccttcgacggngcctccatgaaccccgccgtctccttcggccccgctgtcgtcagcggngtctgggagaaccactgggtctactggctcggccccttcgccggcgccgccatcgccgccctcgtctacgacatctgcttcatcggacagcgcccccacnagcagctccccancgccgactactganaacctcaatctcatctcgtccatccgtcatcgccatgagagattgaaatcgcttcaaaaattccancacgtgtacgtcgtcncgtcatcatcaagtangccagtttantttcattgcgctatcntgtccttgagaaattcaaggtaaacagtgtgtgcgatcaatcaatcangaataatctcanccntctctancttggngtatgtaagnactcctcaattatgaatgctcnatcaaggcaagaatgatgtttgcacannaaatcaaa

SEQ ID NO: 82322 - DNA, 576 bp, Triticum aestivum
  unsure (1)..(576): unsure at all n locations
  Clone ID: PAT_TA_82322
cctcacaccccacaccaagccccacgctcgaaccaccaccaccaccagcacccatggcacccaaggcagcggagaagaagccggtggccacggccgagaagaccaccgcggggaagaagcccaaggcggagaagcgggcgccggcgaccaaggaggccggcggcgaggggaagacgaggggcaggaagaagggcagcaaggccaagaagggcgtggagacgtacaagatctacatcttcaaggtgctcaaacaggtgcacccggacatcggcatctcctccaaagccatgtccatcaatgaatccttcatcaaacgacatcttcgagaactcgcccggcgattcccgccaagctgggccgctacaacaaagaaccnacatcactcccnggagntcaagactcctccggctcctctccccgcgactcgccaaacacgcctctccaaggnacaangcgtcacaantnacctatctagctggctcttgtgttataattntggcgnaagcgtctgtctatcgcantatacattacancncgtagaattgcncttnntctaaatanganttcttttaaaaa

SEQ ID NO: 82323 - DNA, 685 bp, Triticum aestivum
  unsure (1)..(685): unsure at all n locations
  Clone ID: PAT_TA_82323
aagatctggaggtctttgtagcaagccacagtttgggccaagtcctttttttgttcataaccaaaccttgccacaatttgccacaccttgacttaggcatccatttggtcccacatgtcaataacctaggaaactgtggcacaaatttcctttagactaaccaaagtggtccaattttgatgatctaaccttacacaaatttggcaaaaagaaaaaaaatgtggcaaactttggtgagtttagtanatataccaacttgctctatgttttggttagttaggaacaattgcaagcagtaactcgtacgtggccaaaaactacaagcgacttgaaatgcatggtcatgcaattatgcctaggggacaatcgagcaactaatttacaatcagtaaatcctttctctctagcctgtgctcggttgttttgcantgctataattgatatcatttgaaagaaagatanctactgtgtaatggaattgttgtcataggaaactagggatctctacacaacacacacacacancacaatccttagaccanctatanaacaaaagtgaatatgtanggtccnantccctanatcgngttctcttcagggangtaaatccgtatgaanaatcgttnaagggtgtcgaatcctatgagtgnggggtantatcgctgtaaatggacccacnagttgg

SEQ ID NO: 82324 - DNA, 747 bp, Triticum aestivum
  unsure (1)..(747): unsure at all n locations
  Clone ID: PAT_TA_82324
cttaagccattaggtgtaggcgctttccagaggtggaagatttacgttcttcctatttgacccgaaaccgatcgatctagccatgagcaggttgaagagagctctaacaggccttggaggaccgaacccacgtatgtggcaaaatacggggatgacttgtggctaggggtgaaaggcaaccaagatcggatatagctggtttccgcgaaatctatttcagtagagcgtatgatgtcgattgcccgaggtagagcaccaatgggctagggtggcccatttcgctttacaaccccagggaaactccgaatacagggcgtcatccttagacaaacagactgattggtgctaagatcaaagtcgagaggganacagccanatgtacgctaaggccctaagcaatcacttagtggaaaaggagtgatcnacgataacaccaagaagtggcttggagcancatccnttgaanaagcgtatactactggccagctcatgggaacaaaattccaaggtcaattatcacnaacgacagacttaagagtttcaatgcatacggactntgnatcggaaggtttgtncancctgaatcanatggangcnctatacagaanccntaaaanatgctcatgaggttccntancatccccaggnngccaggaccaaggtctcctgtacaatcatttanaataaaaaaaaaccgggcgcnttccanncttncccgnctantggaaccgccancnnaacccccgt

SEQ ID NO: 82325 - DNA, 574 bp, Triticum aestivum
  unsure (1)..(574): unsure at all n locations
  Clone ID: PAT_TA_82325
aagaagccccgcataatgctaattgatcggggcaaaacccggaggttcatcaacgcaccgtacattgtccaagggctggaatggtttggttttgaggtggtcaaggttgacccgaagatggactctagtcttgatgaattcgcccgccttgttgactcgtgcgatgcaatcatgggcgcgcatggcgcgggcttgactaacatggtgttcctgcgatcagggggagtggtggtgcacattgtgccgtatgggattgaattcatggctgatgggttctatggaaaaccggaacggacatgggcctaagccatgtcaggtacagcatcagtccagaggagagcacgttctggagaaatatggtggaccatactgtgatcaaagacccaaagccattaggacantggatggacaaggttgggaggttacatgtcaaacagncattgccttacatacaaggttggcctgtttgctnaaaggatanatttacangtagttanggattggtgcngtacncttatcaaaggngggtaggttgaatgtgttttgtacaaanatttgcatttcanaaagtctc

SEQ ID NO: 82326 - DNA, 533 bp, Triticum aestivum
  unsure (1)..(533): unsure at all n locations
  Clone ID: PAT_TA_82326
cttcgagatcgtcatgaccttcggcctcgtctacaccgtctacgccaccgccgtcgaccccaagcgcggcgacctcggggtcatcgcgcccatcgccatcggcttcatcgtcggcgccaacatcctcgccggcggcgccttcgacggcgcctccatgaaccccgccgtctccttcggccccgccgtggtcaagcggcgtctgggagaaccactgggtctactggctcggcccctttgccggcgccgccatcgccgccctcgtctacgacatctgcttcatcggcagcgccacacgancagctccccaccgccgactactganaatatantccgaatccatccatcagtcatcgcatgagagactgaaattgctcaagatcaagnagtgttatcgtgnatcaanaagcccgtttagttcatcgctcctctctgncttgaaaatcaaggtaacagtgatcatcatcatcaggatancncttgctggggtagaagtccaatagaagctccatccatggcatatgtttggaaaaaaa

SEQ ID NO: 82327 - DNA, 489 bp, Triticum aestivum
  unsure (1)..(489): unsure at all n locations
  Clone ID: PAT_TA_82327
ctctcactcactctccccctccgccgccggcgcagcgtcctccccgcgactccgatggccagcaagtgggtcaggcccgaggtgtacccgctgttcgcggcgacgggcgtcgccatcggcatctgcgccttcagcctcctccgcaacatcaccggcaacccagaagtcagggtcaacaagatggggagggcagcgggagtgcttgagaaccatgaggagggaaggcgctacgccgagcatggctcagagcctatgtgcaagacaagaccccgagatcatgccangaatcaacaantcttcacancccgaaatgaagcacttagcctgtcagtggtcgctattagtaactgttgtggcaagtgcaaactattnaagcatcaataatgttgtcgcgtcataattanangatatcatcaagtgctcttattgaagaacatgtatgtttgatggttgcaaanatgtnatggtgatgnttctaaaaaaaaaaaa

SEQ ID NO: 82328 - DNA, 382 bp, Triticum aestivum
  unsure (1)..(382): unsure at all n locations
  Clone ID: PAT_TA_82328
gcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactccgtacntacgtgtgttggtgtgagagtatacgttgaataacgaggtctgatctgatggagtccaacaagggtgctttgcnttttcgtttggtttgcttgctccccccccaatgctctgccaagggtncccttggngtgnangttgngttnccaatttccccngaan

SEQ ID NO: 82329 - DNA, 389 bp, Triticum aestivum
  unsure (1)..(389): unsure at all n locations
  Clone ID: PAT_TA_82329
ctgntcgcancctaccttctcgcctacctgggcgggaactcttccccaagtgccgctgacgtcaagaacatccttgactcanttggtgctgaggctgatgaanaaaagcttgagttccttcttgctgaactcaaaggcaaggacatcacagaagtgattgcatctggaagggagaagtttgccgctgtaccttcaggtgggggtgccattgctgtgggagctccagctgctgcatctgggtgggtgccgcagcacctgctgctgatcanggnaaggaggagaaggttgnaagagaaggaagaatctgatgaaacatggtttcaatccgttcnaactaacgncttnattcctccccccgaacctccngtttaccctaagnnccggcntgt

SEQ ID NO: 82330 - DNA, 380 bp, Triticum aestivum
  Clone ID: PAT_TA_82330
cgcagcctgggtggtggccctcacggccttcgtcttggtcttcctgccggagaccaagggcgtccccctcgagtccatgggctccgtctgggagcgccactggtactggaagaggttcgtcggcgacggccgcggccggggcaaaccagcttcatctccgtctgcatcaacatgagctatgtgttcgtttgtccgttcaaggataaccttgatgtacctgtttcagtaaagaaaagaaaacttggtgtgccgtgcacgcatgctcggttaaagttttatttaggagcgtggcattcttcttcttgcttggacttggagtgtcttgtattgactcgcggatgaatttgcgaattgttatcatggatgctaaaaaaaaaaaa

SEQ ID NO: 82331 - DNA, 751 bp, Triticum aestivum
  unsure (1)..(751): unsure at all n locations
  Clone ID: PAT_TA_82331
gaaaagacaatgtggcgatgttacgcgacgaaatcgtcacttggagccatgtatgtacgttacgatcaggactaattatctcgccacctaacaataaaggacctgcactgcacgcagaaacaaaaatggactacttgtctcatggagccagtcacaccatacaagtacccatggagcccgacttttgtattatttcgtgatttgaatacaaacatacttaaaaaaaaatgaacccatggagccccaagtttcaaacaattcaaaaatcacatttgtgaagttttaaaaatanacgtgcacatcggatgttgtctacaaatgtgtacatttacatgataataaacttttttttgcgggagttattttattttaatacatgataataaacgttgttatggatctctaaccggtcaatccctcaaaacaggttaaaggagtaaaaatttcgttttgaggagttaaaccggacatanccgaanccttatccggnttaccctaaaagatatactcccactaggccgtcngtatacnactcattgtgcccaaactcaggggggccggtaccaatcncctatangatctataccgcgccacngcgtcgttanagtctgactggaaacctgcgtaccactaacncttgagaaancccttccactgntatacaaagncnacgttcctccaaattccactaaggaangaccctncgcgtaccgngttggntccagncnaatnagcanccctttttttnttt

SEQ ID NO: 82332 - DNA, 716 bp, Triticum aestivum
  unsure (1)..(716): unsure at all n locations
  Clone ID: PAT_TA_82332
atttgatattgaagccaaagtggtttgcatgattgcatctaattgatgatgtgcaccggatataatcccaattcttatgtttattgctcacttgacacatttatataggtcactagcagttgtaccttgtaactgtgcgtaccatgttgtgagagttgacagccatgccaataagttcgtttctcctgctattttagttactcagtttcattaccatcttgacaaactcttgattcttaaagaacagtatgcagcattcaagtatatgtcggatgggaaactataatgatcgaatagacagtaaacatagttcatcaacttccaaggatagtctttttcatcactgcacgattataatatgcaacattgctcaagatataaacgttcatgtggttaccagcagcgaccagtgagatgaagtaactgatgatatggatgcntgccggcaataaagatgatgtcntgtgatagttatcttcaataangntgtcnatgcaaaagtatcanatgcacttctcaagtgttcaaatcaattcaaatgatcacaagggcactcatcacaacnacatgnaacctagcaaccggaaataattaatattatagcaaatggggcnggtaacatagtaaaaggggttcatcttgatacaaccataatggatngataataggngancnactanctntanttgagncgttaaacaantttntaaaaaaaa

SEQ ID NO: 82333 - DNA, 384 bp, Triticum aestivum
  unsure (1)..(384): unsure at all n locations
  Clone ID: PAT_TA_82333
cctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgaccttgaagcttcccactgatgatgttctgcttggccagattcaagactggatttgctgatggcaaggacctgatcctgtcctgtgatgttccgccatggggtgaagaacagttctgcgctgttnaaggaaatcccgtgggggggaaagtagcactgta

SEQ ID NO: 82334 - DNA, 642 bp, Triticum aestivum
  unsure (1)..(642): unsure at all n locations
  Clone ID: PAT_TA_82334
caggtttggcattgttgagggtttgatgaccacagttcatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcctactgttgatgtttctgttgttgatctgactgttagacttgcgaagccagcaacctatgatcaagattaaggctgctatcaaggaggagtctgagggaaacctcaagggcattttgggttacgtggatgaggaccttgtttccactgacttccaaggtgacaacaggtccagcatctttgatgccaaggncgggattgctctgaacgacaacttgtcaagcttgtctcctggtacacaacagtggggatacagcaccgtgtgtcgacctcatccgtcacatcacactcaagtaaatanagcataagtacgggganatggttgccaaagatgtcaaagccttctcgagataattttgnnggantagtactaaaccnttatgttaccgatgntgttgctaaccaanttgngatagtctctacaacatnncattt

SEQ ID NO: 82335 - DNA, 749 bp, Triticum aestivum
  unsure (1)..(749): unsure at all n locations
  Clone ID: PAT_TA_82335
ctcgagtttttttttttttttttttttaaacaaaagtgcaacaacggtaacaccgaatttcagagttcagcaactcctttcaactacatagagtaagtagggcatcatcttaaagaaaaaatgcagaggataggtcaccagcaattccacacctttgccagtctctcctccagctgaaactgggcaacagtactgctctgaatttacggggagacaaaagtgtaacagcggtaacaaccgaattacgcagttcagtagctccttccatcatggtgatgccatatgattcacataaaacaatagatcactgtaatccaatgtcactcattgatttcaattaggaccggaagtgaaccacggaatgaagatcattcccagttcctctataacatgttgcctctcctcatcagtccgtggataccttgtcctgggatcgagtcactacagcacttccaaacatcctgtcatgaagagataccctcatgtcaacgcagctacaagacaccctgactacgaatgaagttacatcggttggaagcataatgggagcntggaagatctanctgaaatggaacnatggtcacccacgttcgtgcgagaacancncttcggggcctgctgtncaanatgacatgtccancgngtnaaactctagacgggactcanataaatgcanatacaanctcgaggntcatcaancnattcaaaaggggattgatnggaacaanttttcataanatcctgggatn

SEQ ID NO: 82336 - DNA, 656 bp, Triticum aestivum
  unsure (1)..(656): unsure at all n locations
  Clone ID: PAT_TA_82336
ctcatctccccacaccctcgaatcatcagcctcagctcccatggcgcccaaggcggagaagaagccggtggcggagaaggccgagaagaccacgacggcgaagaagaccaaggccgagaagcggccgccggcgtccaaggagggcggcgagaagaaggggaagaagaaggccaggaagagcgtggagacgtacaagatctacatcttcaaggtgctcaagcaggtgcaccccgacatcggcatctcctccaaggccatgtccatcatgaactccttcatcaacgacatcttcgagaagctcgccggggagtcggcaagctcgcccgctacaacaagaagccaacatcacgtcaagggagatcagacctccgtccgcctcgtctccctggcaactcccaaacacccgttccgagggnacaangcgtcacaagttaactctcctaagntnancctcgtttctaatccgttggttccgtagttntnactcaaaatgtgtctaatgtgtacctgtctgctgtggtctaaaaatatgtggtaaataaatcctcttgcggttnttacaancggttaccgganggttatggacgcataaaaccanttttctttcntcctnanaaatcctaatcncnctaattaagactcttnttcaaaaaaaa

SEQ ID NO: 82337 - DNA, 263 bp, Triticum aestivum
  Clone ID: PAT_TA_82337
ccgaggcgcaccaggcgttctgggacgccgttcccgccgccttccccgtgatcgagaaggtgtcccgggagcacctcgacccggagtacgccttcgaggagtccgatgtgttcatactccgcaggaggccgcggcagtgagatttattcttgttgccaaacatttgctcgtcatttacatagcaggtttgcaagaattgcttattccagttcaaaagtatgagtatttagttgtgatggctggtgaaggcctctgatataaaa

SEQ ID NO: 82338 - DNA, 732 bp, Triticum aestivum
  unsure (1)..(732): unsure at all n locations
  Clone ID: PAT_TA_82338
gtattccgaatattaatgataataagtatttgaatatagttgtaggacacataatcctaacatctcccacttgtccaaaacgatcattcaaaaaattcgtaaacccatagcttgaacatgtttaccaaataccacctgactaagtgacttagtcaagggatcaacaaccatatcagtactaggtagaaactctaaagaaacagacttaagtctattaattacatcacgtatatagtgataccttccctcaatatgtttgatcttgctatggaacttgggatatctggaaacctttattgcagcctgattatcacaatacaccaccactgggtttgctagcactctcaacaatcttcaaagtcgaaagaaattccttcagccanacggcctccttcanagcttccgacacagcaatatacccacctccatggaagataaggccactgaatctgctctacnatccagatataccccccanctaatgtaatngatnccanacttactcggncaccanttacctgcaacacatcatanacctnaaatcngngagattacctctgngccnatctgccgctgccgggcgctctaactgcactgtaaaggctctatctgcccatttaaagcaannccaaacatnacaattccctacaacaanttggcggcaaagtaccattccccgtnttgccaaaacctgggttttgaacccntccagggnccggggggccctccttn

SEQ ID NO: 82339 - DNA, 643 bp, Triticum aestivum
  unsure (1)..(643): unsure at all n locations
  Clone ID: PAT_TA_82339
gtcaaatgtccgtgaagcaatacttcaagttaattgcactagtaccttggtcgcttggatcgattggctgcatcatttcgcgtttcanggcgcactatgacttaaatcacaanattcatttcaattatgacacggttcacagctaatgggcagttagaacatggaccatcanggcgttcccttgcatttgttaacttgcacgaggcatgatcgccctattgtccgttgtctataacaanagaaantgatcgcctanctgggcggcatcttgtgacgcccggataattaggctacagtaaacccaagataatgatgccacgtcaccacngttactgttgttaatttcgtgttagttcaaaatcgattcgaaattaaaactaanacaaagcaaatggtaaacatttcaantattaaaacaagatgtnggggtgttgcaaataatgcatatgtggntattgtggngaaacacaattttagacgtttagagacctaagtaatataaccactatacatanttantgccttaaaatataatatgcanacaattaatagtgcanactgttgncataaataatatacattattagagtgattaaatttgcacacattaagatgacanaagaaatatnagganancagactt

SEQ ID NO: 82340 - DNA, 472 bp, Triticum aestivum
  unsure (1)..(472): unsure at all n locations
  Clone ID: PAT_TA_82340
gcggcgccggctgcaagtgcggcaacggctgcggcgggtgcaagatgttccccgacgtggaggccaccgccggcgccgccgccatggtcatgcccaccgcctcccacaaggggagctccggcgggttcgagatggccggcggggagaccggcggctgcgactgcaccacctgcaagtgcggcaccgcctgcggctgcgcctgctgcagctgcaactgagccggcgcccaggaggccggccggcagaggcgagcacgaggatgaggaggagaagcaagcaccatcaccagttaacaccacccagcgtatcagtttgataacagccgctgcatgcgcccgcgcgcgcgcgctaaaataaaataaaaccgtcgtgttcaacttaatnaatctgtatgccctgcgtgtgttcgacagtgtcttctcatgcctcaacttcaatgaatatatggcgcctcaacttcaaaaaaaaaaaa

SEQ ID NO: 82341 - DNA, 621 bp, Triticum aestivum
  unsure (1)..(621): unsure at all n locations
  Clone ID: PAT_TA_82341
aaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtcctgcgtctgcgtggtggcatgcagatcttcgtgaagacctcaccggcaagaccatcactctgggaggttgagagctctgacacatcgacaatgtcaanggcaagatcaagacaaggagggaatccccggacaacancgcctgatcttgccggcaagcaactggaggatggccgcaccttgcggnctacaacatcaaaaggagtcaacctcaactgtgtccgcctccgtggtggnaataattgnctggcgttgtnctgctggttaaccttggcgccggttgtggggcctgcattgttganggtttccgttgngtatccaatnttgttgaacnncag

SEQ ID NO: 82342 - DNA, 672 bp, Triticum aestivum
  unsure (1)..(672): unsure at all n locations
  Clone ID: PAT_TA_82342
tctgcactccacgccgaggcagaatgggatgcagctgcacgcaaaaaacactgcaccaagcatcgaaccgcattatgcgtgcgtgtgagctgcacagccatgggctgaaacacaaatcgacatgcatacttcatccgactgaaaattgcactgcatcagacgggtaagagaactgcatggttttcttttantcaaacataattttttcaaggacgaagaagtggaccgcacttcacgtcggacgtaagtgaaccacagcactatcgagcagtcaacctcaatactttggtttgncaatttggnaacatttttttccttacacttacgagatgaacaacatcatacgcccaacaacactgttttagactgaaaaccgcactacatcaagcaagnaanggaactacatgatcgttttgtcaaacgtaaattcccggacaaaaattgggtatgctcacatccggcgtaatnnaccgcaaaactatcganagtggnccgcattaccttttttggggttccgtacaattttccnacttcaanttttttggggnntgacccatattaanaantaacncaaacactgaatgaccnttganttttgggcntggnaacttttnagntnatggccntccgtttgntttaaaatttaacncaangncccggngggnnaaaatt

SEQ ID NO: 82343 - DNA, 373 bp, Triticum aestivum
  Clone ID: PAT_TA_82343
tcgccgccgacgtccgccgcggtgtctagctaactaggatgtgcatgcacgcccagctctatccttgcactgggcgatggtgaacgaataaagtgagttgatcggccggccggtcagtggccttgtgtaccgagccacggagttctgtatcgcactgtggtaggtgcgcacgtacgtgttgttttcttccgggttgtcgttgtagcgctagtagtgtttagttgcatggtctcagtatcgatgaataagataatccagaggctagtagtgtttattcacatctataacgagctagctcgcgagttacactccgtgtatattttttggtaagggaaacaacaagacttcgcttaagcctgaaatttttaaaaaa

SEQ ID NO: 82344 - DNA, 600 bp, Triticum aestivum
  unsure (1)..(600): unsure at all n locations
  Clone ID: PAT_TA_82344
gggaggtgaggcgtaccaagaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactggggaagcatgggtcacgcaaagtgtcactttgttgccattgacatctttaatgggaaagaanttgaggatatcgttccttcatcccacaactgtgacgtcccccatgttgaccgccaaattatcagctgattgacataactgatgatgntattcaancttctaactgagagtggnacactaaggatgacctgaacttccactgatgatttctgcttggcaaattaagacggttgcnatgnaaagactgatctgtcgtgattcgccatggtnnaaaaaaattgcctgtaaggaatcgtgtggcagtagaactgtcgtggtncaactcanan

SEQ ID NO: 82345 - DNA, 256 bp, Triticum aestivum
  unsure (1)..(256): unsure at all n locations
  Clone ID: PAT_TA_82345
tctctctctctctctctctctctctctctctctctctctctctctctctctctctctctctctctctctctctctctcactctctctcacactcacacacanaaanagacacagacacagacaancaangaaaaaanaagannaagacagnggacananagcataatataaanncaggataacagagngtanagagatatatngnagaggnaagatagattagtgtnaaantaaanaagncagatacagcaggtag

SEQ ID NO: 82346 - DNA, 300 bp, Triticum aestivum
  Clone ID: PAT_TA_82346
gttacccctcctttgtgtagaggggtgattgcgccactccactgtccgtttagtcgagacagatcaaagtccagcttatacctctgccgctttgtgcatctcaaactggctaaccagtacagtgcggcaattttgttccatttgttcttcgaagggatatgcgtagataggagtgttgtggcacaatggattctgcatatggttgttgaattggatgtgcacatagaaagcacctgtaacatcaactagaatttttgggaagataattctgacttcccttgcacgtttaaaaaaaaaaaa

SEQ ID NO: 82347 - DNA, 562 bp, Triticum aestivum
  unsure (1)..(562): unsure at all n locations
  Clone ID: PAT_TA_82347
ctgtgacccgcaagacccgtctcctggatgtggtttacaattcgtcgaacaatgagcttgtgaggactcagacccttgtcaagaatgccattgtgcaagttgatgcagcccctttcaaacagtggtacctgactcattatggagttgaaatcggtaggaagaagaaagctgctgcagctgccaagaaggaagctgctgagggacaagaggctgaggttgctgctgctgccacagaggaagcaaagaagagcaacaatgtccagaggaagctttgagaagcgccagcanggacttcactgggactcccacatttgaggagcattcaatngtggaangtgctggctgcattnctctcccccttggacantgtggcaaagctgatgggtaatcccggganggcaaagactggantctacattaggaacccacaagaagaaaggnnaaggtgcacaactaagcgaaaactgctgcatttcccctggatttctaaangntgcgtcaagtnagtttcaaacatactgacacaattntgtaaacggtcnatccaaggtnaactgaaaag

SEQ ID NO: 82348 - DNA, 608 bp, Triticum aestivum
  unsure (1)..(608): unsure at all n locations
  Clone ID: PAT_TA_82348
gcgcaccgtgccgtcgattttaagtggaaggactactgtccggtggtcttcagaaatttgagggagatgttcaagcttgatacagcagattacatgatttccatttctggaagtgacgcacttcgggagctgtcgtctcctggaaagagtggaagtatgtttttcttaacgcaaagacgaccgcttcatgatcaaagactcttcgcaaatctgaagtgcaagttcttttgcgtatgcttcgagactattaccgccatgtccatacttatgataacacactccgtgactaaatctttggcctccaccgggtgaaacttccaatgngcnaaatttaaattgtantgatgggaaatgttctgcacacaacttntaaccatcgaagattcgttttgaaaggtcanccctaagnagatttaccgacaaggttanatccacgaagaacacaagctcaaagactgggtntcaactactcatctaactcnaacctcttgggggggangcttgctaaacacatgtgatntcaacgaattnccaaatnaggggaaagggganaacgggtnccggttacaangggggccccaaccttttagagggngtntgnaaaantn

SEQ ID NO: 82349 - DNA, 596 bp, Triticum aestivum
  unsure (1)..(596): unsure at all n locations
  Clone ID: PAT_TA_82349
gttacaagcatgggttatatggaatctgtgcaatgtcgaaaacaagatgatctctgtagagaggattttccagttctcaaacataccgagtgaatcgcctttagtgattgagaactctagaccaagggagacatggccatggtgcggaaccattcagatcgaggctctccaaattcagtacagccctgacatgcccatggttctcaagggcataagctgcacatttcctgggagaaaggaaaattggggtggtagggcggacagggagtgggaagtctactctcatccaagctttgtttcnggtcgttgaccatctgcaggacggatatcatagncggggtggccatncccttttgggaattgcatgatttncgggtaggttgagtattatnccncaagaccatncncttccaaaggacgtcaanaacaacctgtttccctaaaacaaatctggcactgaatatggaagttctgcttaattgccccttaaggaatgnccnagaagcataggtgttanatcacaatanttgagatggcggaaactgatgtgggcaaaggaactttttcttgcangtatgctatnaaaaaanaactnt

SEQ ID NO: 82350 - DNA, 609 bp, Triticum aestivum
  unsure (1)..(609): unsure at all n locations
  Clone ID: PAT_TA_82350
gagtgttagatgagaaagctgctgcaactcaggctattggattttttgcacttcacacaaagagtgcctatgccccgtacttggaggagtcgttgaaaattttaatcaagcacagtgggtattttcatgaagatgtcaggcttcaggcaattatttccttaaaacacatcctaactgcattaagggcaatacctgcacatcctgatatactaagagaaacagaaggatgttcttgatactattatgaacatctatatcaagaccatgacagaggatgatgataaagaagtagtcgcacaagcttgcatgagtgtagctgatatcatgaaagatgtggtttgctgctgttgaactttatatgccacggcttgctgaagcaacacttgctccgttgcatcaaagaacntgctgtcaacaagtagancagatggtgaagatgatggtgacatcgatcatgatgaatcctcaatnggcgcattcaagtctttgcctgcttcgcaaaatgatgcgatctacttgatccaaccttgcgaantattgaccccaatgaanttgctaaactcaatctccaagacaagacnanggtgtgcacccactaggccccaaaaa

SEQ ID NO: 82351 - DNA, 581 bp, Triticum aestivum
  unsure (1)..(581): unsure at all n locations
  Clone ID: PAT_TA_82351
gcaacttggcacctaatgtcaacagcatgcttattggtgacgagtgaaatgaaagaaggctgcaatggaatttgtattaggcatctgttcttcaaatgaggctccaacctgagcaagggcatggtttgcagatgatgtatctgctttatgtgtgttagaagagccctccgacgcccagccgttggtgtctcttcccgaagaaggatcatggttccccacctctctacaactcatattaaaatttgctattccagagaanttagacctccacaaccttagcagagatgaaacaatcaatcagctgagatgcatcacatgatcttttccccttgactttgatgggattgaacccatagaatacttatcaatgggacccttatcagcgttgagaaagtggcacaaatctcatacgcaaggcgattnagctaagaacatcangaaggcttttaggatggtacaacggcaatgcacctaagatangccttaaaaataagggtgttcccccnttgnttacaaaagcacagaggttagcccanttatatganatttgttanagaatcanaactggactaccaagtnta

SEQ ID NO: 82352 - DNA, 376 bp, Triticum aestivum
  Clone ID: PAT_TA_82352
ctacttccaaactacatgttagatggccacggtacttttattctgtttttaaaatgatggcctcggcacccttttgaccaaacaaactgaccacgcgatttgaaccacatctcatctctctgctgtgcgcggcagaggctgtaaaatgtattccaaagtaacatttcctccttctagcgattcttttttatttcatttttcatcggtgctatttcctccttttcgtacttactttccatttgtagcatctctggtcgcttttctttaaattaattctacttccaaactacatgttagatggccacggtacttttattccgtttttaaaatgatggcctcggaacctttttggaccaaacaaactgaccacgtgatt

SEQ ID NO: 82353 - DNA, 256 bp, Triticum aestivum
  Clone ID: PAT_TA_82353
gcggcgtcaccatcgccgccggcggcgtcctgcccaacatccactcggtgctcctccccaagaaggtcggcaagggcgccggcaccggcgggtccgcatcccagtcccaggagttttagagtaccagagatctgagtatggcgtggtggtgcttttaggttggtagattagttcttcttggctaatgttcttgttggttcatgtatcgagggtggatctggttggaatggaatgcatctggttcaaaaaaaaaaaa

SEQ ID NO: 82354 - DNA, 371 bp, Triticum aestivum
  unsure (1)..(371): unsure at all n locations
  Clone ID: PAT_TA_82354
tggaagcgattacatgttcctttgtttaaaatcatgggaacctggatccattcaagcctatcttggtgaagcgcagcacaagttattcaggtgttaaaaaactatagctattttaaacaaatactaaatttcaaagatatatttaggaaactaaacaagttgttgagggaactgctgctacaaccgttgaagatgcaaataatgttctatgtgaccaagctaaacgcaaaaggtatagactcgtactctgttacatttaaccagtttcatataagatgtgtgtctgtgtgtgtgctactgaacttggtgcgacaactattgtttggtacatgggaaagaatgcttcctcctctccttcaactaaatgcatn

SEQ ID NO: 82355 - DNA, 578 bp, Triticum aestivum
  unsure (1)..(578): unsure at all n locations
  Clone ID: PAT_TA_82355
gcgttcttggaaaagttgactgcaggtgagcaataaacctatgtttctttactgtttgtgaccgtaccttagtttggaacttgtgaagtattcacgtggtaagctaattgctttctttgcaaaatgctgatgtgaatataaccacttgaatacctgatttgatgttctgtatgaaaaatgctgccatataatgtaattggcggtcattaaagttgtgatttacaaagattcttcgttttacccatgtttacaatgaatgttggcatgttatgtaaggaaaataaatttagnccttcatccattttttgaatttgtcctgggaggatattatggtgaagcaatgggatgcttaatttgcaacctccggcattacatgttccccgactttcnacattttaggtggacgaatgagttcaaccaagatccatcctaaggaatttctccaacaaaactgccgctcctccgtgacatgttttgcctcccgcggtggcatgttgaccctgcggcatgtaacccgaattacctagataatgccaaatgngatcaagtggtaaagttgancagcctgacacngaaan

SEQ ID NO: 82356 - DNA, 780 bp, Triticum aestivum
  unsure (1)..(780): unsure at all n locations
  Clone ID: PAT_TA_82356
gttgattattgtgagagttctagctgccgacgaaaaaagattattgagagttttggagaaaaggtacaaccaactttatgccaacgcacatgcgatgcttgcaagcacccaaatcaagtgtcctcacatttggaggaccttcggcgtgtgcccaactgtcgctttaacaagatatctccagtcttccaaacctcatcagttgacccaaaacactttaacacggaattttggaatcgtgaagatgacgtaagcatatcaagatgaagatatatcaagattctgatgatgaggaagaggcactgagcaatatcaccatttcaaagcttccatcaaaaggagggtcngaagcaagacccaagccttggagcgtgctgaaaatgcttacaatcaaccaaaggcaaactaaaccgcanggtggcaacctgttgacaagaagacatactcaaaccctaagagatcaagcangaaaagatgtcaagtgcgcntggacaaacaaactcgtcttggggatcgccggttgctgaaaaggctcgctaacaccttgaacagatgctcaagaatacanaagtgggaagacttcnaantccanaaactgcacggtcgtggcggtcgcctcanttcncaantcaggcgatcagccctacacagctnanagctgggacacaanncctgacattcgancttgnaacgaaccncaaacnngtacttacncaacgcctttanattnaacaggttnnaaaggctcaagtcccnaanctgaacaaaaggnttgnggcccaa

SEQ ID NO: 82357 - DNA, 559 bp, Triticum aestivum
  unsure (1)..(559): unsure at all n locations
  Clone ID: PAT_TA_82357
gcaccgggggtcacctgagatcacatacacaatggtgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcatgtgcatggggcaccaagaagatgaaatccgccatgctggtgatcttggaaatgtgacagctggagcggatggtgttgctaacatcaatgttactgactgccatatccccttactggacaaaattcaattgttggcctgctgttttcctcaacggtgacgctatnatcttggaaaggtgggcataacttacaagacactggaaacctgtgccgtgttgcttgcggatcatcggctcaangctaaatgnatctccaccggcaactctaaanttgggaacnttcaaaatnaaatttnaatcncatccaaatancnatatcttgtact

SEQ ID NO: 82358 - DNA, 544 bp, Triticum aestivum
  unsure (1)..(544): unsure at all n locations
  Clone ID: PAT_TA_82358
agcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcagcgtctcatctttgctgggcaagcagcttgaggatggccgcactttgggcggactacaacatccaagaaggatccacacttcacttggtgctccgtctgcgcggtgggcaataactcctggccatggttctgcttctgtctccnggttaanaatctcgttgtcctccgtgtctccaatggatctggcngtgtccttgatnctgaatgtcttgttgtatacaaatacgtgatcaatgttacgttgtatctcaaactctgctgggtgcggaancttgntaactaanaataatgaccctgantcgtcataaaaaaaaa

SEQ ID NO: 82359 - DNA, 755 bp, Triticum aestivum
  unsure (1)..(755): unsure at all n locations
  Clone ID: PAT_TA_82359
gcttagtttagtagattttacaatggattcaaattggatttacggtgtttttagtagatttacagtggtattttatagtgtgaatcttagtgtaattttagttgatttatagtgtaattttagtgttttttgtcattttcattttaattgtgtgtggttagttttagattggagatgggaaagttttgccttataacgttgggttctttttctcctttctcgctactttgcctgtgtgggtttaaaagagttggggtgtgggacccgttaacatcttgatgcgggtccatttaaaagctggacaaaaaggaacagaagggaagcgggacaaggacacttgtcatcctctaactggcggaaaaatatgactgaaagccaatttgtttcattgccaatccttttagtggattacaatgtcatttaagtgaattttacgggtcnttcaattcaanctacacgtaagtctantgggcatggtaaaattatgtgtatttagnggnttacactagtttctgagnaatacattgtaattactctctgcaagtattttgnggtggaaatcatgttggnccgtagcactaaaggcaacagtncaaggcatcancatccccagtggaaatcagttgacacaggatgccgtggccatgcacgacctacanccagnccaacccatgggatcgcngaacctctcctgtnggccctcnntgcaggcaccgnaaggcaactccttttaanccccanaccaaacccttttg

SEQ ID NO: 82360 - DNA, 250 bp, Triticum aestivum
  unsure (1)..(250): unsure at all n locations
  Clone ID: PAT_TA_82360
catanntgatntttatgaaactaaaattatcagagtattttctgttcaaagacattatnagcancttctagtattattgaaactaanattatataaaattgatgcaactaaaattatcaangtattttctgttcaagaatcattaatnagcaaaaaggttttcatanagaactttttttgntagaaactttaatancatnaagaattatcatagnatacaattaataagtaattataaaananatacaaa

SEQ ID NO: 82361 - DNA, 399 bp, Triticum aestivum
  unsure (1)..(399): unsure at all n locations
  Clone ID: PAT_TA_82361
gtcacgctcggcggccccgccgccgccggggacgtggtgaggtacgtggacgcggacctgcgcaggagggccgaggaggtcgtcgacagggctcgccgcctctgcgccgccaactcggtgcagggagtggtgaaggtgatcgacggggagccgaggtacgtgctctgcaacgccgtcgagaagcaccacgccgacttgctccgtccgtcggcagccatggctacggcgccatcaaagagggcatttcctttgggagccgttnagcgactaactgcgcccaacaacgcgcaactgctcccgtncatgatagtccaagcagccccaagcccaaaggaatgattcnatttgaattttccatttcccantttttgganttgtccattttccttnccaacttat

SEQ ID NO: 82362 - DNA, 321 bp, Triticum aestivum
  unsure (1)..(321): unsure at all n locations
  Clone ID: PAT_TA_82362
atcgggttcgcggtgttcctggtgcacctggcgacgatccccatcacggggaccggcatcaacccggcgaggtccctcggcgccgccatcatctacaacaagaagcaggcgtgggacgaccactggatcttctgggtgggcccgttcatcggcgcggcgctggcgggcatctacacgtggtggtgattcggggccatccccttcaaagaacccgcgactaatccaacaatcaaacaattcgcgaaatgggatccttaacgcctgtcaaccgtccggtccatncatnaatgttgtgggtngttggtggtggnntttccctgg

SEQ ID NO: 82363 - DNA, 403 bp, Triticum aestivum
  unsure (1)..(403): unsure at all n locations
  Clone ID: PAT_TA_82363
ttttttttttttttttagcacacatataaaatcaatcataataattaatgttcacacaattcacgaatattacaaattcatattttataaatcaaattattcaaattcaaacacaccgcatgcttcaaatgaagtacataacatgataaaaacacttctacgaagtgctatggagatgtcttgatgctcaacaagatcatcttggagttgggtatgaactctcggtctccgatcctacgatgtgctncgaggaatgcccngaacctattaggatncgtgctccnggtctacangatttccattggggtgatgtatcaaaagttcncaagnaagtccccccncaacnnccaaagantnagttaaggtaaggggattccaacaagnccangattggcanaaacct

SEQ ID NO: 82364 - DNA, 399 bp, Triticum aestivum
  unsure (1)..(399): unsure at all n locations
  Clone ID: PAT_TA_82364
gcgagccgcagcggaggagcgtcgaaggctcacatgggagcagctggagcggaatgcccggaatgccgaccctgcattccgaccagccaacacgcccccttcttcggcccctccgagagtccccaccgtgacatgacacgggtccgaatattctccaccccaccttcccttgcttcctagctagctagatgaagttgcttgcttccctggggatacagaaggcgtttgttaccttttgtaaacccccccaccctttgccacaaagtccgntaattaatagttgttgattccnaagacaaatggttccttgatttttccctccnctttttttgcggggaattcncnaattaaggggaacaagaaacgaccaantcctgganctttcaanttctttcanat

SEQ ID NO: 82365 - DNA, 415 bp, Triticum aestivum
  unsure (1)..(415): unsure at all n locations
  Clone ID: PAT_TA_82365
cggcacgaggtggtggcggcggctacggcggtggctacggcggcggcggtggcggctacggcggccagcgcggcggcgactccggcggccagtggaggaactgagcggcggggccctccagttatcgatctatctaccatctcgtcgtcttcgtcagcaagttatcttcatgtcctccgtcctcgtgttccctgtgttcatcaatcttgatcctgtgtgtccttccggcctgtgggtgttttttgattcgccaactccaagtgtcntcctgtcccggggttaattaaaactgggttaccccaaggaaagaaacacatgtgttancctttcaatccgnccctgtttcgtcccgtgatgcaacaatccctttctgttcaangatttganattaaagttttggaancccaagttttac

SEQ ID NO: 82366 - DNA, 398 bp, Triticum aestivum
  unsure (1)..(398): unsure at all n locations
  Clone ID: PAT_TA_82366
taccaaagctcatcttcttctccttgaaatctttttgggtccacagatttggaggatgtcttgcaactgcggatcaggctgcagctgcggctcagactgcaagtgcgggaagatgtaccctgatctgacggagcagggcaagcgccgccgccgaggtcgccgccgtgggtcgtcctcggcgtggcgcctggaaaacaaggcgggacatttcgaggttggccgcccgggcaatcccggcgaagggcttgcagctgccgcgacaactgcaaattgcaaccccctgcaactgtttaagctgcatgcacccctacttatacgttttaatggtgtttaaaagtatacgttnataacancgtccnattctgatggagtncacaatttncctntnttttttgttt

SEQ ID NO: 82367 - DNA, 258 bp, Triticum aestivum
  unsure (1)..(258): unsure at all n locations
  Clone ID: PAT_TA_82367
nggntttccagttacgcactgttatacanaanagagctatgtatcttangaactccaanagntccttgtagtttatgaaanttcaggcaatatcagctaccaggtcctgcatancttgggctcagcanatcatacntctgagaanattaccanctcancaacacactanatggnatgtcnggaaaaagtgcnggctangcncccgcaaattctcctgaacctgttgcaanttgtaactgnattttttttccccggtaa

SEQ ID NO: 82368 - DNA, 619 bp, Triticum aestivum
  unsure (1)..(619): unsure at all n locations
  Clone ID: PAT_TA_82368
ggagggggagaagaagggggagagacaaaaaacctcgtccaccactgaccaccgctcgctctcgccggcgatcgattccggctcgggagaatggcggagcattgggagcagctcctccagtcttacaaggaaggtttgtgttgatctttcgctatttgcatcatcacatgaagctcgcaaaatgcaggagcttgctcgcaggtattcgcagaggattatcgatgataatcaaaagcttagttctgaactggagtccaagatgcatgatcttgactcagtatacaagcatctggacgaactagcttcacaaggcatctctcacacgaggaactatgagcaagagaaaaatgagataatgcagaaggagaaacacgtcgctttattatttgacatgtttagagcaagaaaggaacccaagcagaacttgagttanaaaataaacactcaaggacaaattggaacctgtgaatcaaagaagatgatggctgaacagatccgggattacaagacantgtgagttatggatcattcagagacttgttataaggaaggaagcatctgnctcaatctctcgatgactaaacatgcttgntntcatggcacatcatgnacaaagnng

SEQ ID NO: 82369 - DNA, 576 bp, Triticum aestivum
  unsure (1)..(576): unsure at all n locations
  Clone ID: PAT_TA_82369
gccaggccagcatggcggcgtgccacccagtacctccacccactccacaacgctgcagcacctccacccgcgctaccgcaacccatccatccaccaggcgccatcacatccagccaccatcacctcgcgcgccctacaagactagaggtcgtggttgtctggtgccccacgccatcctccacctctcttcttcaacctgctgctgttcgccctcaaccctctctgctgcttctctcacccagatgcccctgctgctccttctcccacgtcttgctgctgcttctcttctctgacccccattgttgttgccttctcctctgaaccctactgttgatccttttcctcaactctctctgctgctcctctcacgcccctgctgctatcctctcaaagcctcacgctgctgctcctttctttactcctattctgcgctcttctctgaaccaaanagtgccgctcctcntctctcttactttgcaaattctgaaactgtaggtgaacctgtgtattgttcaaacactaattttgtaaattgagatantatacttgtagggtagatttagatacttgaacaan

SEQ ID NO: 82370 - DNA, 518 bp, Triticum aestivum
  unsure (1)..(518): unsure at all n locations
  Clone ID: PAT_TA_82370
ctagtggatcccccnaggctgcaggctaanaaactacttctcagctggagcaatgatttggatattgtccggcattggaattgttctcttaccaagcagtatgcacaacttcatgtatgccctttcaatcacgataggagcggccaatgcacttatgacagtcacaagtatcagcatggaaggtgttttagtaggagaagatctaaatggttgtgcttttgtatacggctctttaagttttattgacaaagtgtcatgtggcatagcgttgtatatcctcgagtcctaccaaggaagcaccaagatcagtgagaaccaagaattggcatacggctattccgttacgagactcggtctggggctagttccagccgtcttctcgcntctttcagccatagtagctcataccatggacctccctgaanccgacggagactctagtggagcctcttcttgcctaaccttgctggtaacacttgcactgttgaaatttgatggcaaccctgcatataactcgg

SEQ ID NO: 82371 - DNA, 334 bp, Triticum aestivum
  Clone ID: PAT_TA_82371
gtgtggcgcaacctcagcgccgctgcctccggcggcggggatgccggagcggggagctacggcgacgagatgtgaactgtgatcgatcgggcagcaggtgccaggtggtgcgaagtatctgaagcgtgagagtgagtgaaagttcatacgtgtgggaaggtggtcgcgaatggaggctctgaagaaaaatggaagtatatattcccgcgaaaaaaatgcaagtatatatgtgtgtgtatcgtggtttgttacagattacagagacatggttggtgatcaaacttgatgaaataaaatgttatgcacaagcctttaactttctaaaaaaaaaaaa

SEQ ID NO: 82372 - DNA, 441 bp, Triticum aestivum
  unsure (1)..(441): unsure at all n locations
  Clone ID: PAT_TA_82372
gggcagcaaggccaagaagagcgtggagacgtacaagatctacatcttcaaggtgctgaagcaggtgcacccagacgtgggcatctcctccaaggccatgtccatcatgaactccttcatcaacgacatcttcgagaagctcgccggggagtcggccaagctcgcccgctacaacaagaagcccaccatcacgtcccgggagatccagacctctgtgcgcctcgtcctccccggggagctcgccaagcacgccgtctccgagggcaccaaggccgtcaccaattcacctcctcctagacaacttangtttgatcctccgtcgcttcatgcttctgtatgtacgttagttngcattatgatgttacaactttgtaaggattgtgttgcttgctccgcggcttgaaagaaatatgatgttgttgttgtttgaaaaaaaaaaaa

SEQ ID NO: 82373 - DNA, 617 bp, Triticum aestivum
  unsure (1)..(617): unsure at all n locations
  Clone ID: PAT_TA_82373
ccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccaagaaggaatccacactccacctgggtgctcagactccgtggtggcatgcagatcttcgtcaagaccctgaccggcaagaccatcaccctggaggttgagtcctctgacaccatcgacaacgtcaaggcaagattcaagacaaggagggattccccggaccaacagcgtccatttttgctggcaagcagctcgangatggcgcacgctncgctgactacaacatccaagaaggatccacactccactggtgctcaagtccgtggtggcatgcaatcttcgtcaagacctgaccggcaagacatcacctggagtcgatctctacacatcgacaactcangcaagtcaagacaaggaggnatccacggacaacaggtccatcttgctggnaacacttaggatgccgacttgcggctacaatcagagggtcaacttacttggcnccttgcngggg

SEQ ID NO: 82374 - DNA, 394 bp, Triticum aestivum
  unsure (1)..(394): unsure at all n locations
  Clone ID: PAT_TA_82374
ccgacgacgatggccgaaggatacgtgcacgcgggtggcgcggagctgacactggacagccgcgactcgccgtgcttgcgcccggacgccggcccggcctgctgccacgacctggaggcctacctgcacctgctggacgggttcatgggctccggccggccgttccgcgccgacgcgagtcgcagcgtggcggggctactggtttaccaagcggaccagcgtgaagcgtgcctacgtggagcgcgcgagggtgctcgggttcgagccggcggccatgccaagggccgccacggccaacggcgctggcactgctgatggacagtacggttcctggcatccctcgtgacttttatnaatccatgcatttatgtatctgggtatctgcattgnactt

SEQ ID NO: 82375 - DNA, 582 bp, Triticum aestivum
  unsure (1)..(582): unsure at all n locations
  Clone ID: PAT_TA_82375
ccctcatggcccgcgacgccgtcgtactcgcaggaggccccacgtggcccgtcgcgctcggacggagggacggccgcgtgtccatcgctaacgagacaaaccagcttcccccacccacctccaacttcacccgcctctccaagatgttcggtgccaagggcctcgacgccaaggacatagtcgtgctctccggcggccacacgctcggcaccgcgcgctgcgtgtccttcacggaccggctgtacaacttcaccggcgccaacaaccccgccgacgtcgacccagcactgggacgccgcatacgtggccaggctgaggtccaatgccggagcctcgccgacaacacacgctcgcggagatggaccccggcagnttcttaacttcgacgccgntatacgctcgttggaaacgcaaagnatctaaattccgatcgcgctctagaacaccgacacaagnatactcaacgcaagcacggctctcgccgccaattctcgcgacttccgagtcatggtcagatggnactcgggtgtcacgagaaaggnganttgganaatgtncccttaaataancacgttcaccacg

SEQ ID NO: 82376 - DNA, 593 bp, Triticum aestivum
  unsure (1)..(593): unsure at all n locations
  Clone ID: PAT_TA_82376
tgcccgttctgcagcaattgtcatgagagctgtaagaaagacagtggacacgggacgaactattgtatgcacaattcatcaaccaagcattgagatatttgaatcatttgatgagcttctacttatgaaaagaggtggtcggatcatatatagtggttcactaggcccacattcttgcaacatgatagattatttcgaggctataccctgtgttcctagaataaaagagggacaaaacccagcagcatggatgttgaatgttagttcaaacacaacagaatacgagattgggactgggactatgcagaaatttatcgacgctcctctctatacaaggagaacatgatctagttgacgagcttggaaaaccaacacccggcatagaggatctacattttcctccaatatactggcagaactttagcgcacaatgcatggcttgcttgtgggaacaaagatgtgcatattgggaaaaacccggacataatgttgctcgatncctaaacacgttgtcaatcaactatgttgggagttgtatttggcaaactggataacaattaaacagcaacaagattatcacatacaagnaccat

SEQ ID NO: 82377 - DNA, 532 bp, Triticum aestivum
  unsure (1)..(532): unsure at all n locations
  Clone ID: PAT_TA_82377
cggtagcggaggctacggcggcggcggcggtggctacggcggccagggcggtggcggctacggccagggaggcggtggcggctacggccagggcggtggtggctacagcggccagcgcggtggcggcggctacggcggcggcggcngcggctacggcggcggcggtggtggctacggcggccaacgtggtggcggtgactccggcggncantggaggaactgagcggcggggccctccagttatcgatctatctaccatctcgtcgtcttcgtcagcaagttatcttcagttcctgtgtcagtcantctgagtcgtcntntgtgtccttnactcntgtggngtttttgatcnccnagctcgagtgtcgctctgtccnngttaantaaaactggttacgcgaggaanaaacaacatgtgttactttcaatccttnnccggtcggtcgtcggtntgcataatcccttcggtaanggattggatgtaantttgnaatacccangtttnatccngttaaatggncanatcaattcc

SEQ ID NO: 82378 - DNA, 569 bp, Triticum aestivum
  unsure (1)..(569): unsure at all n locations
  Clone ID: PAT_TA_82378
ggaggttctaatttccactgcaaggaagaaagaagaggagaaccaccgtcatttcagtgcactaaataccttggaaaactctgcccaacaaaaaataaagaaggaggccaaaagaatgagggatgaattcttttcgttcttcaaaaacttcgagaggcaacatgctgcgataaggatgcgaaggggtgcatcaggtgtcgatgttgattctggtaattgccgcaatgcatccccaataccagatctcgctgtgtcaacgccttgcaatgccaaaccaacacctccagcgagcggcgggtgtcagggcaacacaaactcatcaacggacgtttcnangtgactcctaagcggttcaaaaggatagcaaagaaaccgaagaaacaatacgttnaacttctgccctggaanatgnaancccggaaanaactcgcctgtctcaacatccactagacanttgataaganaancacagaggtcaacagtcangnaacaaattgttacggtccactgcaacaaggatccaccnggactncaatttaggcaatcancggggcaaaaaattcaggtgg

SEQ ID NO: 82379 - DNA, 514 bp, Triticum aestivum
  unsure (1)..(514): unsure at all n locations
  Clone ID: PAT_TA_82379
gcaccgactcatgacgctcaaaccctgaggaggcgccagtatagacatactgttcagctccaccgtcatcctcatcctcatccatggtgacgtcatcagcgactaatggagcctcctccttaccccgtccactatcacccaacccgacacccgacgctaattgggtaggtggggtgttgatgttcataccttgctgaggctgcgtgctcgtgggtgtgctcctgaccacctccaagacgaagcagactctttggccacaacangacccaaccattccaaacaatcaacaagccgccgtggtgtctcctccgtcatccaacaattatattggaggaagcaaatctcntnggccggttcgacactgggcacnggaaccttgaagactttgggggatntggccngtgttggacaatgggtcctccggttcaataangttccctttccaaattnaacttnngggccccnnngggttaaaaaggggaacgggtttcccgcctnaaaaaaatctgcactt

SEQ ID NO: 82380 - DNA, 308 bp, Triticum aestivum
  Clone ID: PAT_TA_82380
ctcgagtttttttttttttttttttgtttttttttgccttaggttggtcttcgttgcaagtttgttgtttgttttttgaaagctggtcttctgtaactttacccccaaagccctcgagataacgaggcgtcctgtggggatctatatgaagggcaacgtgtgtaccatgcaacaaatcgttgggctaaatgctgtaacttttgaggtgcaaaaccaaggtccgctgtaacctttgccccgaaagccctgagataaagaggcgccttgtgaaatctaaatgaattgcattgtgtgccaaaaaaaaaaaa

SEQ ID NO: 82381 - DNA, 450 bp, Triticum aestivum
  unsure (1)..(450): unsure at all n locations
  Clone ID: PAT_TA_82381
gaaaggatcaccgggccgcagcgacaacgacggcgacgacgaccaccagcacagtcactaccacggccagcacttctcccgtggtcgtgaaggaggagacgttggcaggatcatcgtcggaagcgcaggcgagagaccagagagccatggacactgtgacaggagtactgcagcaggtcgaccaccgtgagctcatggaccaggtgttcaacgaagagctacaggcctatgataccgggggtccggccaacaccatgangactctttgctgactccgccgactcccccaactggatcaagacccaatgacctcatcttctccaaaggatacatgggaancaagccaaccgtgggtgccaggattatgggnggcaaagagaaggcgttgcaaaggactggttcctttcacatgctaaattggccactactcttacaacgcagggacacttt

SEQ ID NO: 82382 - DNA, 601 bp, Triticum aestivum
  unsure (1)..(601): unsure at all n locations
  Clone ID: PAT_TA_82382
ctccatcgggtgggaggttgatgtcatatgctcaaaagtgttatctgccaaaatgttaaaaaggacaaaaattaatctcaatgaaatatcccacaactctgcaatgggccttgttagaaaagctattgataatggagttctactaacagaggtctatatcgacacagttggagatcctgagaagtacagggtcaaacttactgaaaagtttccaggcatcaaatttgtggttgccaagaaagctgatagctctacgctgttgttaagtgggagcaagtatagttgcaaaggcactanggatagagccttacgaaactgggtatttggatgaaacagccaaaatatgcacatgaacacgggttaaggtaccaagagatcctaatacatacaatggttaaaagatcataacatcatattgggttcccaacttggggccttaattggggaactncacgccatactncaagaatggagttgaatcacatggaatccgatgaantgatgaantcaactggtacggaancccaacaaagtcacttnncaactaggctcaanggtcaaaggatcgggaatnaaccatngaaaggcttgaattctcagc

SEQ ID NO: 82383 - DNA, 485 bp, Triticum aestivum
  unsure (1)..(485): unsure at all n locations
  Clone ID: PAT_TA_82383
ctcgagtacctcgcagccgaggtgctggagctggccgggaacgccgccaaggacaacaagaagacccggatcgtgcccaggcacctgctgctggccatccgcaacgaccaggagctcgggaggctgctgagcggcgtcaccatcgcccacggcggcgtcatccccaacatcaacccggtgctgctccccaagaaggccgctgagaaggctgagaaggccggcgccgcccccaagtcgcccaagaagaccaccaatcccccaagaaggcaccaaggctaattcngccgtccggtgaactgatggtgtcccggaacctcgtgtgccaatntccccgtgttaatttantaatgggtnttccaaaaaangtttnaccttnncttttgcnttgccccaacaanttaaccttaacaaaaagaacntcttgttccccgtttntcnaaccanccgggtccaatgcatgttggttaaatgccaaaaaaaaaaaa

SEQ ID NO: 82384 - DNA, 564 bp, Triticum aestivum
  unsure (1)..(564): unsure at all n locations
  Clone ID: PAT_TA_82384
ctccgatggcccgcaccaagcagacggcccgcaagtccaccggcggcaaggcgcccaggaagcagctggcgaccaaggcggcgcgcaagtccgccccggccaccggcggcgtcaagaagccgcaccgcttccgcccgggaaccgtcgcgctccgggagatccgcaagtaccagaagagcacggagctgctcatccgcaagctccccttccagcgcctcgtccgggagatcgcccaggacttcaagaccgacctccgcttccagtcgtccgccgtgtccgcgctccaggaggccgccgaggcgtacctccgtcgggctgttcgaggacaccaacctgtgcgccatccacgccaagcgcgtcaccatcatgcccaaggacatccagtcgcacgccgcatccgcggggagcgcgcctangtctgtatgcccctgtgccaactgcactgatcctgctaatgtttaatanctgtattgtcgctcctatgttgtttccgtccttgtaatctgatggatgcataaatgtcaaatccnaatcgttgtgcgtgattgtctgaaaaaaaaaaaa

SEQ ID NO: 82385 - DNA, 616 bp, Triticum aestivum
  unsure (1)..(616): unsure at all n locations
  Clone ID: PAT_TA_82385
gtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccgggaccagcagcgtctcatctttgctggcaagcagcttgaggatggcccactttggcggactacaacatccagaaggantcacacttaactgggtctccntctgcgcggtggcaantaactcctggccatggtctgctcngtcncngggttaanaagctcgttgtcctcggtgtctcaatggatctggtcgtgtcgttgatctgaaatgtcttgttgnaacanatacgtatcantgttancgttgtactnaaacttcgcngngtcggaacnttatactaaaanaatg

SEQ ID NO: 82386 - DNA, 348 bp, Triticum aestivum
  unsure (1)..(348): unsure at all n locations
  Clone ID: PAT_TA_82386
ggacaatgggttcaagacgtacgacgcctatagcaaacgaaacttcataatgcgtgtctggtacatgtactcgatgcatgacttgccgacgtatgcgctattcgttggttggtgtgtgcatggaaggttcccgtgcccgacatgcaagggagatcttgagtttcgttggcttcaggccggtcgcaagttttcttgcttcgacatgcttagacagttcctggatcctcgccataagttcaggaaagacaagaagaacttcatcagaggtagagttgtaaaaaactctgcaccacctgcgttgacaggccaacagaccctgggatcagttaaacgnctccnaaggggggg

SEQ ID NO: 82387 - DNA, 559 bp, Triticum aestivum
  unsure (1)..(559): unsure at all n locations
  Clone ID: PAT_TA_82387
gtcgaggagaccaaggaggtggcacctgccgccgctgagacggaggaggccaaggagcccgagccagcagctgcggccgagccggaggccgaggcccccaaagagacagaggcgccagccgtggtcgagacagagaccaaggaggccgtggctgaggcagagccagcggcgcccgaggaggtgaaggaggaggccgcgcctcctgccgagccagaagcaccggccgtcgccgaggaggcaccggctgcaccggaggaggcgcccgcggccgcggcagaggagcccggccgccgcggtggcagcgtcagcgtgttangcgccgcccncccgaaggaagagctggccggtcaacttccaacggcggcggcgtnttctcctaacgtggnacggctgatgctnatcaaccatgnattgnnttggaatgatatttttacaagtgtggagtggaatgctatccccgggtccctgacttggctaaataaatgtntcggtcggtcacccaatgtcgtaacaacancaagaatgcantctcccggctctcgctcgctactgnnctttt

SEQ ID NO: 82388 - DNA, 406 bp, Triticum aestivum
  unsure (1)..(406): unsure at all n locations
  Clone ID: PAT_TA_82388
ctcgagtttttttttttttttttttttttttttttttagagctaatattttttcttattgtagaagataatacaatcacacacacaaaaaagttcatttctcatggcctcaaccaatttattagtacaaaccaaataactcaaggccgttatatctttgtgctgaaacggtatgaagagtaggagatgctggtgttggtccaactgtggtggatcagctccgccctggactcctccccggcggcgccgagcgcgacgtgcagcgggtagaaatgatgcggcgatgggtgcgccacctcagcgtgcggcgccttctccttgtatcgcttcacgtcctccgtacctcccgctcatttgacacagctggagtggtgaccgaaaaccanttggntatcttgggngatagg

SEQ ID NO: 82389 - DNA, 256 bp, Triticum aestivum
  unsure (1)..(256): unsure at all n locations
  Clone ID: PAT_TA_82389
ggaagatgatgacgatggtccattaagttctgcaattttctgtgaaagaataaggaagcttactcgagatgagaccatgaatattaccgtnacnttnccatcnagtgtnnccttcatggggaagccatttgtgcaccgcttaactaaaaccaacatcntgaaaaaagtcntgaagttncctatcaaatntnttttcngagtgggcattcccgcccccgggancancttgggtntaccatggggcaccaaggggtgt

SEQ ID NO: 82390 - DNA, 408 bp, Triticum aestivum
  unsure (1)..(408): unsure at all n locations
  Clone ID: PAT_TA_82390
gggaggcaggttcctgctggccaacgtgtacgacctggtgatggagctcatcgccaaccacaggaagtacgggttctcgacggccagcgtggcctgctgcggcaacggcggcaggtacgccgggatcgtgccgtgcgggccgacgtccagcatgtgcgacgaccgggagaaccacgtgttctggggacccctaccaccccagcgagaaggcaacgtcctgctccgccaattacatccgtccgacggcgacagcaaatacatctccgcccatgaacctcaaggaagtcttcnaagtcctaagacangacagagagactcnaccagattnaatttcnggttccttccgtccgggtacatttttgcgttttngggtcccccaaatttgggcgtgttaaactttgngaaata

SEQ ID NO: 82391 - DNA, 383 bp, Triticum aestivum
  unsure (1)..(383): unsure at all n locations
  Clone ID: PAT_TA_82391
ggcaaagnngaaccacgtgganacatatcacaagtttccgggggganttccaanaaaaaggccctgttttcgaggatggtagtctttgaaaatncaccaaatggannactatacgancatttacaccatggggaggcatcccaattatgttggcttaggcgaatgaaaatagccatcggcatcgctcaaggtttaaggtatttgcacacggagttgcagcctccatttcctatatcaagggctgaactccattcagtttatgttacagaanttttactccgaaactgggtttatttttgaaatgctgggaaaancangttttccaaagcatgagaaagggcncggcaantttaatacaaaaccggcttttccaangcccccaa

SEQ ID NO: 82392 - DNA, 405 bp, Triticum aestivum
  unsure (1)..(405): unsure at all n locations
  Clone ID: PAT_TA_82392
aaccaggacaagaacaaatacaatacccccaagtaccgttttgttgtgcgatttaccaacaaggatgtcactgcacaaattgtgtatgctaccattgctggtgatatcgtgatggccgctgcttactcccatgagttgcctcgctatggtcttgaagttggcctcaccaactatgctgcagcctactgcactgggtctgcttttggccgtccgtgtgctcaaagaaccgttgatctttgatnaggagtatgaaggcaatgtttnaggccactggcgaagacttctctgtttgagccttctgatnagaggaggctttcccgtgcgcttttggatgtttggtcttattangaccaccactggaaaccgttgtgttttggggccctttaaggagctttggacnggtgg

SEQ ID NO: 82393 - DNA, 381 bp, Triticum aestivum
  unsure (1)..(381): unsure at all n locations
  Clone ID: PAT_TA_82393
cccctcctctatttctctcgtgcacagccacccgaccgcgaccatcgccgccgctcgccgttgccgtgaccatcgccgtccctacgacaccccgagcttcccaagagctccatctcgttcccctcttcgtcatcaccgtcccgtgcagcgctggacgccctcgaacaccgtccatgccgtcttcttcaacctcgagtttttttttttttttttttttttcaccaagaacaacgagtgatgttcaatctgtcatatgtttgctatttagttgtctgtaggagcaatctcccacaangtcttcagtttaaggataatanttanttacngtgatgtgcantcngttaaaacataaatnaatccccacaataaattttcnnnttc

SEQ ID NO: 82394 - DNA, 373 bp, Triticum aestivum
  Clone ID: PAT_TA_82394
cgagtttttttttttttttttttggttaatgttgacctcacattttattcacatgtactacagtgatataaagggagcagaggaaagtggccaggtaaatcaagtgcaagccacttggataccgttcctaactctcaagcatcctatcctttttaagcattacaagtcgctcaactaccgccgccatgtcgggccgatcttctacatcttcttttaggcactcaattgccagcttgccaatttcttccaggcaatagatatcttcttcttcagttgcgatctccttgtccatcatcgccctaccgctcttttctttctcacaaactttacggaactccaaaatgaggctacagtattcgtcgtatacacttgg

SEQ ID NO: 82395 - DNA, 352 bp, Triticum aestivum
  Clone ID: PAT_TA_82395
ggaatcaaacagtttggatttcatcatgcatacaacaatggtagaaattgtatatatgaactacgaagcaaatcaatctggtgttccatcgttccacgttattacatccgtatacagtaaacaactcaaaaatccatatatagtaaacaactcataaatccgttgttcatggctgcatggagacatggcattttgcagcgcctgtagtttatgagagtagagggcagcaccacctcacgcttaaacatgcaagactcgacaaaccgaagtaggcataacccaacgaagaggctacccagtaagagagcatgtagatttagcaacagtctgacagcttcgacttcgacttcgg

SEQ ID NO: 82396 - DNA, 591 bp, Triticum aestivum
  unsure (1)..(591): unsure at all n locations
  Clone ID: PAT_TA_82396
ccaaagtctattggacttctttcgtttgatggtggtatagcaggctgccagaagataattcatgaaatattgacatgggaagcaaaatcagatgtgaaaattgaagttcttcatgaccttaaggaaatcggaagtgctttgtattggatgagccttctggacattgttttgagacaaatcgacactacacagttcatgcaatcagctccatggttgggattggtaccaggaagtgatgggcaagtgaagcatgcctactctgataatactccatttaccacattgctcaagtgctgccaccaagtgcagttgcatcgagtcctgcgtgcgcaaatccatcttcataccttgtcatgtcaaagcaagctgaagctgccagcctattatacaagtcaaatctcaactcaaggagcgtgcttgagtatgctcctgcttcacaagtgctgcctgggatagacattacacaaatggagtgcaactcaaagacaggttcaatgacataaccacatcaaggactcaacgtgttttagtggcctcagtaagctacttggagtacatgacaatcctcaagaacnagaaatgtggcgacnc

SEQ ID NO: 82397 - DNA, 393 bp, Triticum aestivum
  unsure (1)..(393): unsure at all n locations
  Clone ID: PAT_TA_82397
gcggcgtggagttcgcgctcgggcaggcgctgggcgggcacatgaggcgccaccgcgcccacgagcaggaggggagcactcacgggccggtagtcgccgagcgggagcccggcgagacaagaagggggctgctgctgggcttggacctgaacgctactcccgctgagcaggccatggacctctctctctgggcctgaccgaaccgaggaccggtgggctgctgttccttctgcaatagctcccctcctactactcttctctaacctaagggggggttggaggttcctttcttgtacaatattggttgctgtcaattgattgatttggatttttcaaccccaaaaaaggatnggctgttatatcaataaactttcnnttcnttcctaaaaaaaa

SEQ ID NO: 82398 - DNA, 600 bp, Triticum aestivum
  unsure (1)..(600): unsure at all n locations
  Clone ID: PAT_TA_82398
agcaaacaagtttttaaattgctccatcaaacaggatagtatacaagtgctcttcccaataggttattagtatgtaagtgctgcaacttcagtccgtcagttgatatgcctttgcaaagtttatgactgatatagaatagatgcaccatattcaatatctaaatatcttaaatatgttaggattttacctgctattttctttgtgacacacatataagtagattcctattgactcattcgtaaaatgatttgccgatgtgaccaactaagttattgcatgtagtatatgtgcttccttttcgttgtcaggtttaaaatattgttgttaattgccctaagagatcttgatttggaatttgtatacattttttcctgccggttgcatcctgtctaatggggaaaagnataataanttattatctatgtgattttatttcttcttcggtcaattaatagcaatatgaacctatctccttaagcaactttctcacacttanttactcctgcagaagtggaaaaagagacaatatatacgtgaccctatcctcgcaaccnacttgaacgtaacgacacgccactccatccccacggtgcggnctt

SEQ ID NO: 82399 - DNA, 540 bp, Triticum aestivum
  unsure (1)..(540): unsure at all n locations
  Clone ID: PAT_TA_82399
gcgacggagaagacccccgcgggcaagaagcccaaggccgagaagcggctgccggcgggcaagacggcgtccaaggaggccggcggcgagggcaagacccgaggccgcaagaagggcagcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggccgctacaacaagaacccaccatcacctcccnggagatccagactccgtccgctcgtctccccggggaantcgccaaacacgcctctccgaagggcacaaagcgtcacaaattaactccccctaaatgacatctccttttgtacanattngtgcgatgtctcaatnnaatatantctttgtaaagatgcaaccttttggctctggtgtaaaatgactttctttgaaactgaaatcatcaaaaagttcgtttgacnaaaaaaaa

SEQ ID NO: 82400 - DNA, 473 bp, Triticum aestivum
  Clone ID: PAT_TA_82400
actggtttcaccaacattgcctctgatcctttcacgacctacggctgggagcagtggtctgaaattgcctcgctgaacactggcgttgttgtttctcagtcgtccgctacctaccttgacattcctagcaatggtgatctgtgcatcccaatggatcgttttgactctgatactttcatcatgtcgttccccgatggattttccaacacccccgcctgcggagacaacacctctcccgacaccgtcttcgattgtgttgatggctggacgtccgcaactgggaaacaacaacatgttcaccctgaactaccgtcagatggatgctaagctgggcacgactgggacacttcttcgtccctctcccctctcattgccctctccatcatcttggctgctctcctcgccctcttctaaacggttgttgattccttttcgttttgattgtaagagtaaaagacgaaaagcacgattaa

SEQ ID NO: 82401 - DNA, 599 bp, Triticum aestivum
  unsure (1)..(599): unsure at all n locations
  Clone ID: PAT_TA_82401
ctcngcgcagttgtgctctgcactgatacctgttgttctgaccttgttatccacacaaaggaccacccctacatttctgaagaatatgagctacccaaagtgggcactcgagggcttcataattgcaaacgcaaaaagatatcctggagtttggctaataactcgctgcggcttgctcttcaggagtggtttcaatattcacaactaccaactctgtattgtggttctcttcatgtatggtatcttcttcaggattgttgcatttgtggcaatggttctgctgaagaagagatgaggggagcgcaattgcaccaattttttcatatttaatctcttcattttttccctgtacatttgtaaatatttttgatttttttcttactgaaaattatagaatagtcacagagagatcatntacagaattcagacacagatgtacaaaagatcgacactttcgacacattttgtttgccacattaatttcgccactcgacatgtaaattgcccttcatanattcaagtcctagatcaaagggggggccggtaccaattcgcctaaagganctataccgcgcnactggcctngtttanacntcttg

SEQ ID NO: 82402 - DNA, 607 bp, Triticum aestivum
  unsure (1)..(607): unsure at all n locations
  Clone ID: PAT_TA_82402
gtgatatggaagaaataaaagcgacagactgcataataaagttctttatcacaagcggcaatataaagtggcgttcttttgcattaagattgtgttcatccaaccataaaagcgcatgacaacctctgcttccctctgcgaagggcctatcttttaattttaacttctacccttatacaagagtcatggtgatcatcacctttcctttttacactttttcctttggcaagcactttgtgttggagcaatgcggatatatatatatatatatatatatatatatatatatatatatatccccttgggatgtatgttttcataaagtattactgttgacattacccttgcggtaaaaggttgggaggcgaaactataagcgcctatctttctctgtgtccgattaaaactttgaacccataaatacacgtgagtgttatcaatgtgaaagattaaatgatagttgagtatgcggagtttgctaaatcaaantcttacatagaccctcctgaaaataagatgattgcaantgcntgatgacaagtgcatggttgtagttcaagaaagtaagatcaaacttacagtgaataaatgtactgataagaaagtn

SEQ ID NO: 82403 - DNA, 585 bp, Triticum aestivum
  unsure (1)..(585): unsure at all n locations
  Clone ID: PAT_TA_82403
cttacacgggattacctgtgatcaaccgccccgcctctacaagcaggcccatcgtgcgcccctggaatcagtgcggattggagaaggagaaccatccaaagtgcaagttctgtgacgtcatcattcgcccaaggtatctcaataattctcagttttagttttgtgctcaggggatttccggattgttggcacaagtgatgtgttctgtttttgtctgtccagtcgacgtacgagagcaaaataagcactgtctgtctagcagtggtgtttgaaacccattttaaccatgaaacccatagatgattaagactttgcatgctatttaattgggtgaaccattgggttcccaaagaacccaaaaatgcgatgagaccaagacaacattcttcagtgcgcacaaaagagacaagcattcaattctaatttgctaaaccattttganttattcaattaacgaattattcattcaaattgtcantcacgtcgcgtcaacatcanctgcncctttttggaatatcnaaacaagttcttctccgaatcaccactacgcgcgatgtctttacaacagttattggtgantcatan

SEQ ID NO: 82404 - DNA, 519 bp, Triticum aestivum
  unsure (1)..(519): unsure at all n locations
  Clone ID: PAT_TA_82404
ccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaaccctgcaactgttaagctgcatgcaccctacgtactgtgttngtgtgagagtatacgtgaataacgagctccnattctgatgagtccaacaaggtgcttntgcntntcctgtggttgcttgcncctctcccaagctctgccaanggtnccttgngtgnaagtgtgtgtgcangtgtccctgtaatgctcaancatccccactaatggatggagtgatgaatatttagaatgaaagattacctaaaaaaaaaaaa

SEQ ID NO: 82405 - DNA, 371 bp, Triticum aestivum
  Clone ID: PAT_TA_82405
ctcatggcgtcagaggaagacgatggcggtgaatcaagtgcgtttcgtgcccaccaagacgaagaatcctcccctgtcggttccttgacccagaggctgatacccacgaccacgacagactagcagtttacaggttttgcattttcaaatcggtttcgggttcgaaaaggaacaactctgcatgactggaacttttatttcatttatatttatttatactaagagataaaagtaattcagtcacgtgatgcatctgaccttctcaaaatcattcatctggcttgtgactctgtaacctttccaaaacgttacaccataaacataaatcggctggcagttcgaaccgctgcagggttatgaaaaaaaaaaaa

SEQ ID NO: 82406 - DNA, 524 bp, Triticum aestivum
  unsure (1)..(524): unsure at all n locations
  Clone ID: PAT_TA_82406
ccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgagggctgcagctgcggcgacaactgcaatgcaacccctgcaactgttaagctgcatgcaccctacttatacgtgtgatggtgttaagagtatacgtgaataacgagcgtctgattctgatggagtccacaagtgtgcgtgtgtgtgtggttaacttgctcctctccgtctaagctcctgcccttgctgccctgtgttatgtgtatcatgtttccctgtaattgctcatctactccactatggatggagtggtgaatatttanaatgaaagattacctaaaaaaaaaggggggg

SEQ ID NO: 82407 - DNA, 397 bp, Triticum aestivum
  unsure (1)..(397): unsure at all n locations
  Clone ID: PAT_TA_82407
ctattgtcgggggaactggtgagctcgcgatggcctctggtgttgtaaacaaaagggtgcacgggaaaactgatggtggagacataatcgagcttaccatccacggcttctgccgcaagcagatcgctcccacgaaggctggtccatggggtggcaatggtggttctgctgttgaatctgataaaccctggaagatagagagcatcaccatcctgtataaaggagtaatgggtcacttggaatattccttacatcaagccaaaaatgggcaacaagcgcaccgccaggcccttgggggtaattaagaaccccaaacccgcgcccgagatttgtgctgggcctggggaagttttttacagaatttcccnggacaattttccaaacatnataacctccn

SEQ ID NO: 82408 - DNA, 185 bp, Triticum aestivum
  Clone ID: PAT_TA_82408
gcggttaggccaatggaaatgtatattttttgtgccgttcgctcccgtttgtgattgatatactcccatcctggactctggagtgagtagatacgtgttgtgccgggagcaagttaactccggaaagaatccatttcttgtttaagcatcaataataccatgcgaattgtgtcaaaaaaaaaaaa

SEQ ID NO: 82409 - DNA, 579 bp, Triticum aestivum
  unsure (1)..(579): unsure at all n locations
  Clone ID: PAT_TA_82409
cagaattgaggaggcacacagattgcgaatgctggacaaccagcatttgcagtggcggtgcatcaatgctcggacagatgcaacccttctggtgcagagcttcactgccgagaaaaccctacacagtgcatggaaggaaatatcaaagttgcgtgacaatgtcagttcgaaaaggtgcaaactccagcttcaaaaacaaaaactgaagctgtttgctattcttaggggagagatgtcttatctagaggagtgggctcatgtcgaagaaacaccattcaantctttgtcagcagcaattggaagcactaaagncattacctccgtctccagttttgggggtgcaaangctgatcccaagtgtgaaggagctgttaccancggttgatgttatgcatacaatggnatctcnatgtgtatttgtttccaangtggaggggacaaactcttggggtaagaactgcgaaacttgcaacacaagacaaatctgtttgnccaatcaagggatcgtttcacgtggnacgatcantcaacantgnacttgaaaancacttctgnacaaacaaaggaancaacacattg

SEQ ID NO: 82410 - DNA, 591 bp, Triticum aestivum
  unsure (1)..(591): unsure at all n locations
  Clone ID: PAT_TA_82410
tgatctttgctggcaagcagctcgaggatggccgcaccctggcagactacaacatccagaaggagtccacccttcacctggtgctcaggctccgtggtggcatgcagatatttgtgaagaccctcaccggcaagaccatcaccctcgaggttgagtcctcggacaccattgataatgtgaaggccaagatccaggacaaggagggtatcccaccggaccagcagcgtctcatcttcgctggcaagcagcttgaggatggccgcaccttncagactacaacatccagaaggatccaccttcacttggtgctcaagtccgtttgnggatgcaaatttttctcaaaacctcaactggnaagacatcanccttgaggttnantcccccggaaacatcaanaacntttaggcaaanttcaagncaagggggattcccccngacaacagntctaacttcnctgggaacaactnaggatggccnacctttcggttanacaccanaagggncaactcactgtctcgccttctggtgggatcaatcttgtnagacctatggaagacatcacctggaggtgatctcaaacattacatgtag

SEQ ID NO: 82411 - DNA, 307 bp, Triticum aestivum
  unsure (1)..(307): unsure at all n locations
  Clone ID: PAT_TA_82411
acctcgtccgagtccgacatcttcgcgatggccgaggagaccaacaccgccaccaggcccgcgcccaggcttgtccgtggagtgtccgaggctgggctggaggcatgggccaagacacaccaacttgacaacaaggacttgcaactgaaggccgaggcggaggaggtgacatcactggcagccgcgatcaagaagaccagtaaggccaagccccccaacaggatcttcaagaaggagctggctctcgccttcctcctcctcatcgccgcgacgcgcagcctgctctcngcgcaangggctgcacttt

SEQ ID NO: 82412 - DNA, 317 bp, Triticum aestivum
  Clone ID: PAT_TA_82412
cggcggcgagttcgtccccttcttgaaggcgtcgtcacgatcctcattgcccgtcgtgttgctccaggggaaaccctgaccctcggttcgggcggtggcggcactcatgtgtcgtaaccttcctgaaggcgccgccttgaagctcacggttcatcgtctgcagctacatctcttcgcggtggcatgttcacggttgaggatcccggcagctcttgtagtggctgggtgtggtattgctgcgtctagcgcctatgtatctagccttgggtgtgtgcgtgagttgtgggtggcgtgtgtttggtatcagattgtggttg

SEQ ID NO: 82413 - DNA, 306 bp, Triticum aestivum
  unsure (1)..(306): unsure at all n locations
  Clone ID: PAT_TA_82413
ccaacgtgttcgacacattcccatatatagctaaaggtttcctaaagaataaagaagcactagctcggttcttcgcgaggttttataaattctgcgggccttttatcgtccctcttgttgcatattataccgacgtccctattcttgcatattatacccgcttctggtcatatgtggcacaaggattcactatggtgctcaacatgctgtataacattttcaagcggttcatgtaaagtactaatatcaacattcagaagaaaaacaaatctcgaagataccctgtgtggttgcaatcaattaccn

SEQ ID NO: 82414 - DNA, 296 bp, Triticum aestivum
  Clone ID: PAT_TA_82414
gatcagtccatctagccaaggttcatgtcagcggaatactgcatggtccagccatgagccatcagaacagctaacccaatttgcaccccgtgaaaactgatggaagatcgatccctatatccgacattcatgtgtgcggtcatgtcaatgttgcagacagagtacgtccacgctgaagacccaaccacaaccacacacagacacacccttggttctaaacggtttgttttttcttattattgcttcatatgttgaattgcgatcagttttatatacacatctctgattgcccatca

SEQ ID NO: 82415 - DNA, 363 bp, Triticum aestivum
  unsure (1)..(363): unsure at all n locations
  Clone ID: PAT_TA_82415
agcggctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagaccccgacaactcgccaggaacccctttggcaaagttncaacttttcaagnatggganacttgtanncttcaacnantnccaatttcnagtatgcnttcccgccaagaacaagccanactgtttnaaggagggcgacatcaaggagtccacannggtggtgtnttggtcccag

SEQ ID NO: 82416 - DNA, 327 bp, Triticum aestivum
  unsure (1)..(327): unsure at all n locations
  Clone ID: PAT_TA_82416
ttttttttttttttttgatccncaagcccctgtagggtagcaaatgccatttattccangttttgatccttctgggctgagaaacaagtggtnaaatgccaacagcacatgacaaacacctatgagtgtcgaagcgcagacctctttcaaaagccaccatgcttaatgcttgctgtcccctcctccaaaantccagtacttcctgtgggcaacantgattnagccacctgntccctgaccttgacctgatgatcaacnccccatatggtttccaatgacaangcnggttctcaagantcaacatcacngaatgactcncaaanacgg

SEQ ID NO: 82417 - DNA, 321 bp, Triticum aestivum
  unsure (1)..(321): unsure at all n locations
  Clone ID: PAT_TA_82417
agcctccttcgcctttgtcgtcctttgatccctaagcaccctgcctancttgggccgccactctctttctctctctctctctgtctctctcatatttatgatccaattcttaccttttgatgtgttacttctgttcatgtggatgagtcgctgattcaaatcctcctatttgaagtgtggttgtacaaaaatatgaatccttttttttcagtgcacaaatgcacaatangtgtttgtgttaatgcgtaggaagagaaaccaagctgattgtgttttgaaaatttgatattaagatgttctgcaacatttaaaaaaaaaaaa

SEQ ID NO: 82418 - DNA, 722 bp, Triticum aestivum
  unsure (1)..(722): unsure at all n locations
  Clone ID: PAT_TA_82418
cctaaacagggtcccgggctgcaggttttcaagcaatgaacatattttggaattgcgatatgttaaacatctaaactcctttgggtatttttaaacatgaacatttcataattacaactcttttgaaaattttgaatttttttaagtgaacatttcataaattattgggaatgttattaaaactcataaaaagataaatttggtgaaaatctattctaaagccatgaagattttccaaagagaaaatagacaggaaaaggaaaaggaaaaaactaacttgaataaaancggtgggaaaatttatacgaggacatgaccgaaagaaccacaaaagaccaatcannaactaacagctagcaagaaaatgtaaaaaaaagtgccctcggtacctacgggcctggccataacaatctgcgcgaatctcaacanttgcacaatgaacatcaaccangattgccagtnttacctcccttttttgcaataatgatagatacaatttgcanagatgtncaagaaagnngggtattattagcatagctcacacagacgctgccnctggacaaatggcgacatacacccccataagcaaataacaggaanacancaccntgtnctnaaaaacacaatcnttccaatatgctcnagtaaaggagnacgtcactgctcggagcncntctgaaagtcaacggtcaaccatangctnacaggnggcaaatccgttc

SEQ ID NO: 82419 - DNA, 258 bp, Triticum aestivum
  unsure (1)..(258): unsure at all n locations
  Clone ID: PAT_TA_82419
gtcccggtgagatcgacacanctgtgaacctntcaatcatgcgncacaagcctgtcaactggaatcaagngatacaatctangcgtcaccgaaaaggcntagtggctgccggatcncgaaagtccacacaaaaaacttnccctagcgcctcgatcctgctgacggccacgcctgtggacgtggncggagaacctgtgtcaaaaccccccaaccaaaattctgcaacgagattgcaagatgagnaaggacanagnaaga

SEQ ID NO: 82420 - DNA, 367 bp, Triticum aestivum
  unsure (1)..(367): unsure at all n locations
  Clone ID: PAT_TA_82420
ccactcctccctgcttcgtcgctgcagcttcacctcctccccggcgctcctcccccgcctgggctggacggcagccgccggccggagggttgcgcgcttcttcggcacacacnctgccggcggctacgccaagatgtatgtggcttcatcatatggaggcatgttaccacnatggaaggatgcatctgaataaattcacacggnagcaactactgtataatcaagctagcgtaccgttagttctcatgtcgtccattctcaatgtgtgatgtgaacctcaattgatacctgtattatactgaaaatcangtgttaaactctgaaacttgttgaagcnttgagaacatgtttattnaaaaaaaaaaaa

SEQ ID NO: 82421 - DNA, 407 bp, Triticum aestivum
  unsure (1)..(407): unsure at all n locations
  Clone ID: PAT_TA_82421
ctcgagaacacatacctcaaagggtcgttncgttctaacgttacggggggacacaagggacgaccctcgtgagcgtctctcacggcggggtagcagacagaagccaaccttaccgggcattggaccctcactccggcgagagcctgaaaatcaaccgtctcaagatacatccatggtcgacaaaatatcccaaacatatcgtcggggcgcttggctgnatcgggatggacanaagcaacacacagagattcacacatacacaaactatacatacacttngnatggtatcactgactggacaacaatacggtggtaaatgtgnnataatatatgncaactgcacnntgcattcgctgtgtacacaacatnactgntttaaaaacaatacatcattatttaaaaaaaaa

SEQ ID NO: 82422 - DNA, 534 bp, Triticum aestivum
  unsure (1)..(534): unsure at all n locations
  Clone ID: PAT_TA_82422
ccaaagccatcctccttctccttgaaatcttttggggttcacagatttggagggatgtcntgcaactgtggatccggttgcagctgcggctcanactgcaagtgcgggaagatgtacctgatctgacagagcaaggcagcgccgccgcccaagtcgccgccgtggtcgtgctcggcgtggctcctgagaacaangcggggcagttcgangtggccgccgggcaatccggcganggctgcagctgcggcgacaactgcaagtgcaacccctgcaactgttaagctgcatgcactcntacgtacgtacgtgtgatggtgtgagagtatacttgaataacgagcgtctgatctgatggagtcaacaagggtgcgtgtgctgtgattgcttgctcgctctccgcctatgctctgccanggtgtccttgtgtgtangtgttgcgnagtcncctgtaaatgctcaactatcnccacaatggatggngtgatgaatattaanaatgaaagattacctaattactatcctaaaaaaaaaaaa

SEQ ID NO: 82423 - DNA, 328 bp, Triticum aestivum
  unsure (1)..(328): unsure at all n locations
  Clone ID: PAT_TA_82423
actcatggccgganttggtgggggaatccattgaggaggctagggagatnatcctcaaagggacatgccnaaggtgacatcgtcgtcctccctaacgggtcggcaatgaccatgggactaaggagcaaccgtgtccgcatcctcgtcgacactgtcgcgacagctcctaacaatggctaactagattcctcgctaggagcgatgtgcattggcaagcatcccgtgtgctgatgacaagtaataattcaataatggatgaataagtacatgctgaccgcaacatgttattatggtcaatgtacttttttgttgggttaaaaaaaaaaaa

SEQ ID NO: 82424 - DNA, 708 bp, Triticum aestivum
  unsure (1)..(708): unsure at all n locations
  Clone ID: PAT_TA_82424
ccaaggatggcgcaatatggagaatgacagccaacgattgaaattgcaaacaagcccaatacaggatgacactacatactcccacagaattggtactgactatatttgctaagggtgttcaactgacanctggtgttgactttggtgaacagatgctgagtgtccaattgactcccggtgaggaacatacatttcancctcntctgtttcaaagatctccacataagtgcaatatactgtgttgtctacaaaggtgaatgcgccttcaaaaactgagcataactggncatcatggntatactggtaaacaaaggncccagaagataaatgtncaactgaatcanccagaggcatctatccatcacaaatcaaaaaggctggggaaactnaactaatgaaaacaggngaagggtgaaaactntggngatcnncattgacaaattttctgaattcatgatgcngataaaanatgctnaacaagataatccttttggggcaaaggaacttcccncaccggagggnntggaaaanggtntggancccccnggnnggccaaaggggtnangntcatacccttacccgcgggcgngnaatgngactcanaatcgcggatggtgccnnnctcccttaacttngggggggtttacntttccnntgnaaacccccnggggagaactttggcaaaccgaggtttntaaaaaaaaaaaa

SEQ ID NO: 82425 - DNA, 573 bp, Triticum aestivum
  unsure (1)..(573): unsure at all n locations
  Clone ID: PAT_TA_82425
ttgttgttgtacctgggaatggcnaccgacccantcttggagaacaatcaanctcgggggancccttggctggaggactcccggtgacaaatgggggcgaaccaanggcggaangtggacctgtccggaatccccggcgcntgtcgtcgtccttgtnacgaacctccaaccgctgtctcgtctcgtccgcggcgttccggcgcccgcggtcnatgccgtcattaagngctggcggcggcnggcncgntgcggnattgttggaattggggctcggttggtnatnacccgaagcctccttncgcgtggctccaaatnacnaagacaagccgcctgtcggtgcantgccgcgganctccggactcttctaaaggacccccaagtggccctctcggcgcaaggcgccgctcngggctnccgggaaganttagacgatcctnagtanctnaaatttaaangggactnaancaaatctactctccccgggancatggnttggcccaattctccaatnangaanatgncattatggacaataacttttggccgaanaacatnttnaaaaaacacanacag

SEQ ID NO: 82426 - DNA, 642 bp, Triticum aestivum
  unsure (1)..(642): unsure at all n locations
  Clone ID: PAT_TA_82426
cgccgtcttcttcagggtgtcaaaggaagaacgacaaatncaaaggnctcaagtgcaaccgactctcaaagggccaacactaaanaacggngtgtnaaaagccgcctacgggggcctcttggacatggacatcaaggcgcacggggggattatctccctcaaaacaatggtgacacccgttgtngagaactcggcggcgggggccggactgcatcacggngccggtgtaccccggacactcttgaacgggaaacaagcaactgtactgtnaacaacggggaccggggcccttcaaggntcaaacctcaccnttgganatggcaacggngaacgtgaactnctccccgacnggctgatngcgcaactcgtnggaaactcaagctataagattcggactggttcgtccgtggcgttgtgtggtggcattgatcacgcnatggttcctgccatgtngtaagntnaatgggncccatgtttcggaaaacgaaaagtcttgggncaaggaaaatcccgaattttcaggtaattttanttaaaanaaaaantttnacccccccnntggnttggcaaataaantttnggaacnggcttaaaaaaaccccttnnaaaaaaaanaatttttntnaaagggggccctcccaa

SEQ ID NO: 82427 - DNA, 542 bp, Triticum aestivum
  unsure (1)..(542): unsure at all n locations
  Clone ID: PAT_TA_82427
acaccgtcttctctgcaaccgacgccaagcgcagcgcaagagactccaactcccaattttggggcgcttccaaccgggttcgcggggttcctggtncactggcgacattccatcacggggaccggatcaacccgcgagtcctcgggccgcatcatctacaacaagaagcaagcgtgggacaacactggatctctgggttggccgttatccgtgcggngcttgcggcatctacactggtggtgataagggcatcccctcaaaancgcgactatcagcaatcaatctgccgacatggacgggtggatctatcgctgtcaacgtcatcatatgtggtggtggttgccntgctactggtaattccacgcntaatctcancnacgtcctcgtcctcnccncgtgtgttgctgcgaanctcactgtggnnaactgtcaatcgcaantgtgtacttccncctccgtatgtacgctccaccgaattaaggagntgatagtngtaatataattagaggactcatnattattacccgggatananaggtaac

SEQ ID NO: 82428 - DNA, 304 bp, Triticum aestivum
  unsure (1)..(304): unsure at all n locations
  Clone ID: PAT_TA_82428
aaacatggtcccggtgagnatcggacacacacaagcactgcatgctgcatnacctgcgcaatgccacgttggtcantcanccgngacactggccgncgcattgacacctacactcgtangcaggctgcagaaatatgntgaaacctgacacacggggaagtttcacccaagctgcctcacggaagggcccacccctcaccacgtgcaagananattgacaagatntcgtcgtnnatngatatattgtaatcctattgtaanagaactctgataantgcntaaatcatgtccttaataaaaaaaa

SEQ ID NO: 82429 - DNA, 528 bp, Triticum aestivum
  Clone ID: PAT_TA_82429
cacagtccgccttctatgtacaccatcaatgtattccaaatttctttctacaaataacaaaagaaatgtgtccgactctctataaacttcacctatacatcacaagggtatttatccaatttctgctctactactctagtcatagcagaaaacattactgtaatcaagaataaaattgtttccatatacaacttcttcaaatgttcagatgtgagtaaagaatttagcacaaacctacagtataacaatgaaaaaccaacagtccagggtgctcagtttgacaagctagccaacaagttcacccaaagctgaagctattagcctcttgaataataatggttgctttcttgctatatatacatgatggctgaatacggttgttttcttgctactctactactctatatatacatcacggttgctttcttcctactttgttttcctcagttttcctcttgaataatgacttaatatggtattatttaaagtggccgggtttttcaacagtatcttggggcaaagggtttt

SEQ ID NO: 82430 - DNA, 255 bp, Triticum aestivum
  unsure (1)..(255): unsure at all n locations
  Clone ID: PAT_TA_82430
cgcggtgggcgaaacgctcctagaaactaagtgggattcccccggggcctgcanggttacaagcaataagttagtggttagggcaaacaannngaaagcaatccggctgggtaactaaagtccttggttagttttnaatngatggtgactaanaatcctaacgaattaacctcccnaagaattagcttnatnctttcggtanaaanattgtttattttttcacttttgattgncgttataggtgctttaaggttt

SEQ ID NO: 82431 - DNA, 515 bp, Triticum aestivum
  unsure (1)..(515): unsure at all n locations
  Clone ID: PAT_TA_82431
gaggtgttaatcacggctgtcttaacaatccaatccactgtcattggactatgcgcttcaagccaatccattcgcagaattgcatcataagtgcccagaggtaagacaacctgtgcgcaagttgattgcaacctgcgttacaaattcaaacccacatctcttctcatccacggncgcagaaaagaacatgcaccctcaaccatatccgttganttttcctttcattcttcctctatgctgtttgggaaatctgttttccttttttttttcacggatggcgcctttttcagcactttttggaagcttctagaagctcttcgttattttttatttccttttctacgtttcttcctggtttccgtttcggtttttccatgttcattttatttcatttttcctctcctcgtttatctttttttttaaattaatgagcattttaaaatttcggcacattgtaaagttcttcaataattttaaactcataaatgttttctcaaatccatgatatttttana

SEQ ID NO: 82432 - DNA, 232 bp, Triticum aestivum
  unsure (1)..(232): unsure at all n locations
  Clone ID: PAT_TA_82432
aaaatctccggcttaccatttgtgtgaaggccataacccggcgtgacgtcattccctggactccgggtaatccgccgtgacgtcatcttccattaagcccgttttttactccaccagatncgcaacggntcttatctttactaccatcccgaaaatcgaggcgtttcatggggagataaccacgccgtggnctcctcgttttgcgccatgcattacattcaaaaaaaaaaaa

SEQ ID NO: 82433 - DNA, 513 bp, Triticum aestivum
  unsure (1)..(513): unsure at all n locations
  Clone ID: PAT_TA_82433
atgatattagagcggtttgtccaacgacgacgatcctagtaccttccaccacttccgcagcgcgccgcccccggggagatcaatctcctctcccggnacccgatcaattagagattagatcggttctcttagttatcaagttagattagatcaattccaattttcgagattctagtagattgattttaattttttcagaaataatctggngagtctcaaattcaggtgaaagcactgcagaatcagcggcgactacggcaagatccgaacaagcagctcgcacggncttctacatcgaccttaggtccctcgtcacccgcacctgcatcgactcgcgcccacggggcgacggcagacgcgtattgggtttaatccaatctgcatcgaanccgcggctgcatcgcctccaagcttcaatgccaagtgcatccatccatgtgcacaacaagatgccatgaatgcatcaccacnggaangnaccaaggnacaaaagcaccgcctgcttcgtcatcg

SEQ ID NO: 82434 - DNA, 523 bp, Triticum aestivum
  unsure (1)..(523): unsure at all n locations
  Clone ID: PAT_TA_82434
ccgataccaaagctcatcttcttctccttgaaatctttttgggttcacagatttggaggatgtcttgcaactgtggatccggttgcagctgcggctcanactgcaagtgcgggaagatgtaccctgatctgacggagcagggcagcgccgccgcccaggtcgccgccgtggtcgtcctcggcgtggcgcctgagaacaaggcggggcanttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgaacgtctgatctgatggantcaacaanggtgcgtgtgcntgttcgtgtggtttgcttgctcgctctcccatgctctgcccatggtgtccctgtgtgtangtgtgtgtgcaagtgtcccngtaattgcttcatcnatcccactatggatngagtgataatatgtaagaatgaaagattncctan

SEQ ID NO: 82435 - DNA, 772 bp, Triticum aestivum
  unsure (1)..(772): unsure at all n locations
  Clone ID: PAT_TA_82435
ttttttttttttttcagcacgattattaggacgatgttatgtgagacatcattgttttagagagggctgagcaatctcaccaggtcaactttgtttgtaagaagaagaaaaaaacccatgaataaatcagtgaagaccacccaagaaacacatatacttacactacatcagaggaggggggaaaccaacacattggtgaggccaaggattatacacacacccacacaccaaccaaccaatgtgtccaaaaaaattcgaacaatcatcatcatcatcatatcatagtccaggttatattatcctttgctgcaagagaaanttccatcgccttcttcctctcctccttggtatattctacgtaccatctagtttcatgatgaagtaantcggtcacctcaataatgggtgcgcggcacagcggcactccctccactctgaacaaccgnttngcgcattcgaagcacgtgcacatgtgcccacatctgtcagaagagaatcgatggngtacacagcatacacagcaagtgccttctcaattcatcatttcnatcatcgccatggccccctggttcccctcngcgattcgacangaggattgntggagtcantggtggatnccttcagccaccacaggttcaggatcagggaatntnangccctcgcgagtacaatggttcgccnaatattggctaattaanancggggggttcatcaggnggacgggnatnctgnattgggcgttccgnataaggnccccaagntaananatttg

SEQ ID NO: 82436 - DNA, 362 bp, Triticum aestivum
  unsure (1)..(362): unsure at all n locations
  Clone ID: PAT_TA_82436
tttcgctcancccatgctagcttagaaaaacatcacccatctttttatttcanttttttagttanattaaatgatgtttaagtaactttaaaaatattatgaattttaaaaacctcaaattttggaaaccattcatgattttaaattatattcatggtttcaaaaaatattcacaaattaaaaatgttttcaaattgaaaaaatgttcacaaactttaaatgaccatgaacactataaatatccacacattatcgatattactgaatttaaaaaatatgaattttaaaatatgtttatgtttcttaagtacacaaattttaataatcgctcatggnttancatgaaaaatatnacaacaaaa

SEQ ID NO: 82437 - DNA, 480 bp, Triticum aestivum
  unsure (1)..(480): unsure at all n locations
  Clone ID: PAT_TA_82437
cggcacgaggccagggcggcggtggctacggcggccagcgtggtggcggcggctacggcggtggctacggcggcggcggtggcggctacggcggccagcgcggcggcgactccggcggccagtggaggaactgagcggcggggccctccagttatcgatctatctaccatctcgtcgtcttcgtcagcaagttatcttcagtgtcgtcgtcgtcgtgttcctgtgtcagtcagtcttgagtcgtgtgtgtcgttcggtcctgtggtgtttttgatcgccagctcnagtgtcgctctgtccggggttaatagagctggttacgcnaggaaagaaacaacatgtgttaccttcaatccgncgtgttcctccggtgatcaacatcccttctgtcaatggattgggatgtgatgtttgatcctaagtttgaatcaatttaaatggntgaagaaatcaantgatactgcaaataaaaaaaaaaaa

SEQ ID NO: 82438 - DNA, 382 bp, Triticum aestivum
  unsure (1)..(382): unsure at all n locations
  Clone ID: PAT_TA_82438
ggaaggctctatttttagatgttccatcgagttttgttaggatttgtgtcctactcagaagaacgagacggcggtggctctctgaagacggaataaggttctctttgtccccgtcctgatgatgtgtctagtatcatcggtgggcatgtagaggtgtgtttccggcggatctatccttgatgggtttgctcggatctggttgttgttccgtctacgtttctccaagttgaatccttccgatctacgctatttttaatcggcggtggttgttgttcctgctgcgctgatcctatagggccttaacacgatgactttccaaactgtccacacantttgccgtccanccaanggaanggggcnaatgncggttgcccccctttgt

SEQ ID NO: 82439 - DNA, 373 bp, Triticum aestivum
  unsure (1)..(373): unsure at all n locations
  Clone ID: PAT_TA_82439
caatgaatgctaaaatttcagattttggactagcaaaaatatttagctcaaataacaatgaaggaaataaaacaagaaaggtggttggtacatagtaagtttcctctgaattactccatgtatgaatatttttattataactcaaccatatagtaattggacatacactcttgctttgttttaagtggctacatggcacccgagtatgcttcccatggcctcttctctgtcaaatcggatgtattcagctttgggtgttttagtcttggagatcattagcgggaagaagattcccatgagtgtgggctttcattaacctccatgggtatgtgagtgcatatttacacatcacatnacaatatatatattgttt

SEQ ID NO: 82440 - DNA, 379 bp, Triticum aestivum
  unsure (1)..(379): unsure at all n locations
  Clone ID: PAT_TA_82440
ccgacgctcaagcccccagacgccgcagcgccgccactccacccgcagcggcaaccatggcggtcggcaagaacaagcgcatctcanaggggaagggnagggaagcangaagaangccgtcgatccgttcaccannaatcagtggtatgacatcaangcgccgctgctgttcaccagccgtancgtcggcaataccctcgtgtccaggacgcagggtaccangattgcctcatagggtctgnnncacagggtgttcgatntatctctatctgatcttcanaangattangacnangcctatangaagattannctccgtnctgaggatgtgcaagggatgaatttcntcacaantttctngggcatgggncttcancnt

SEQ ID NO: 82441 - DNA, 372 bp, Triticum aestivum
  unsure (1)..(372): unsure at all n locations
  Clone ID: PAT_TA_82441
atcgagtcttcacctgcctctcccctccggctttccaacgtccagaacaagttcatgggtgttgcaacatgccgtgacccgtcagacttggtcgacggttcttgctctgggatgggctgctttcagacggacatggattttttctaactgtatgcgcgcacaactcgaatcgctgccgctcatcatgtgtgaagtccaatcgacgtggcccaccatcctgtcagccatgcaatgtatggtacaatcctttatatttttattaccacaccaacgctgcattcattacattgggggcggtaatgctagacgcaatccttttnagtgngtgtccaactacgttggatgcaattagattttgacaaacgaattatn

SEQ ID NO: 82442 - DNA, 287 bp, Triticum aestivum
  unsure (1)..(287): unsure at all n locations
  Clone ID: PAT_TA_82442
tttttttttttttttttttttttttttttttttttggcgcactcanaacgtcatcntattaatttattccnaaattgcatttccaatcaatattctatgcactgncgctgcaccananatgctcccangataccattgntanaanatccgatagaaaatttcnaanaaaccananatttcanacngtatgttggnctaatccatctcacnttatcganattctgacctccacaccacaatctaccanatgctctttcacngntagaatgggaaccnctttccgaggg

SEQ ID NO: 82443 - DNA, 365 bp, Triticum aestivum
  unsure (1)..(365): unsure at all n locations
  Clone ID: PAT_TA_82443
gctcgatgattctcaancggcattttctgcacatctgccagtcttattgccggtgtcggtgccttgagggtggtgaggatggcatgcgggatggtaggaatctttggaatggcagcgacatacagcctgttggtcgtatacactgcagagttgttcccaacagctgtacgtaccgcggcgatgggatgtacagcacaggcatcgcagatgggcgccatactggcgcccttggtggttgtgcttggggagcaagtgccattcccggtgttcggcgtgtttgggcatcattggtggggctgcttgtgatctgcctcccaagagactatgaacaagccttgtacgaaacantgtggagnaaaaagggg

SEQ ID NO: 82444 - DNA, 538 bp, Triticum aestivum
  unsure (1)..(538): unsure at all n locations
  Clone ID: PAT_TA_82444
tctgggtttcacattcactgccaatggctggggtgcaatcttatggatcaaggtgtgtcaagccaccgattatctacggtgatgtgagccgccccaaccccatgactgtgttctggtccaagatggcacagagcatgactgctcgcccaatgaagggaatgttgacaagncctgtcacaatccttaactggtctttgttanaaatgaccaaccgaggnttgagacttgctacaagattgctcttgcaatcaanaaggaggtcnaggaccttgaaggctgggtggnaatcaaggtcatccaaattgacaaaggctgcttttaaanaggtctgcaactcccgcaantctaagcatgctttcaacttggacnggggccttgnacccctcaaggataacaaactgcgggntngaaggaaaccaccaagntnaaaacccaaattngctaanccaaanttaangaaatcatccantccacaacaanaatgggccctaanttnttacaancaaaaancccggncgacaaaaacttctttcntttc

SEQ ID NO: 82445 - DNA, 563 bp, Triticum aestivum
  unsure (1)..(563): unsure at all n locations
  Clone ID: PAT_TA_82445
agcgaagatgttgaaacacttgctgctgaaggagcacttgccaagactcaacgatggccaccaatggaatctaacccacccattctgtcagctctgggccacgcactcggtctgaacgaggcctatggcttccgtgacgtgatgggctatgatcctgagctgttctttctccttcccgacgagatcttcagcatcatccagctgttcccttcaaccgtcaagacacctgggctctgacgaaagaccaaacagcagagttttcgccattctttttgaaccagatcccgcgctgggacgacgcctgtggcaccattgctccttgtgcacctctgctcaaaccaaacgcgagcgccttgggcttgtcgtcagggaccttgatcgactactcaaacgcgtgaangatttgtcccctgttgtccgcggcaacagcttggcaactgaccaaagttctacgagctgcacgcaaacatccgcacaaggggcagactgaaatgcctgaagatgcgtctcttctggaaacacttgtgtgctccgtcantnaaaaggngacaacatactctcaa

SEQ ID NO: 82446 - DNA, 552 bp, Triticum aestivum
  unsure (1)..(552): unsure at all n locations
  Clone ID: PAT_TA_82446
gaggtcttgtactgctgctgtcttgtactacagctagctagcctccttgcaactaatggcttcgccaagtactgctgctgtggtggccgtgcttgtcgtggtgctgttgggaatgggatgcccggccgcggcgaccatagcatgcagcgactgcgcatcgcaatgcagcttgtcatgcagcgccggcaacttcccatgcagcagcgactgcagcccgattccggcgtgcgtggagaaatgcaaggccacagangtccccaattgcgttgacggttgcncacttacctgcaanagnacttgcccaaccngggggtgnaattggccaatgccttgcaaaggtgccanaangggttncaatntcattnnaaagtgctgggcccattntaattctttgnanacccgtaaagggantatcccttaatttaancccngtggacnccccaacngaanaaanttntgccgataattaantttaagtccaacccccccaaagggcaaggtgcaaaattaaaattgccgnaacccttccaaattcttcttgcaaaanaaatt

SEQ ID NO: 82447 - DNA, 435 bp, Triticum aestivum
  unsure (1)..(435): unsure at all n locations
  Clone ID: PAT_TA_82447
cggcgacaagaagggcaagaagaaggccaagaagagcgtggagacgtacaagatctacatcttcaaggtgctgaagcaggtgcaccccgacatcggcatctcctccaaggccatgtccatcatgaactccttcatcaacgacatcttcgagaagctcgccggcgaggccgccaagctggcgcggtacaacaagaagccaaccatcacgtcccgggagatncagacctccgtccgcctcgtcctccccggcgagctcgccaagcacgccgtctccgaagggcaccaagctgtcacaaattcaactccccctaagtgtcgtcctnccggttcncntaanttactttccggtgtnttgtggcctgttatccngtnagaacccaccgcgatggtctgttcnccaaaaatgggnatggtgcctgcctcaaaaaaaaaaaa

SEQ ID NO: 82448 - DNA, 533 bp, Triticum aestivum
  unsure (1)..(533): unsure at all n locations
  Clone ID: PAT_TA_82448
agcttgtttctgtactatatactagatgataatttccttgcatgcgaacatgctaattagtagctgcactacattcctgaagcttttttgaactattgggaaacatgagagttgttacacagaagtaaatggttcntgtttccatttcaaacaaaacgaaggctaaaagttgctacttcngtagtactgctatagaacaattagtgtttagctagactgtcaatcntacagtttgttactaaccgctgcctctgtaggctatgtccaatgctgggtggaaaagcacctggggctgggaaagaaagcaaactgtacctatcacccaccgtgcatgcatgcaataagattttcaaaaacaatttgaaattggtgaatcctaaccagatcaatggtattaaccggtcntttgcanaacaaaccccccttnctganacccgngnaattttggngcacgganaanatgaagatttatagcccaactccccctcaaaaaatcatgcccccccccgggttaanaacaattgtnggngaan

SEQ ID NO: 82449 - DNA, 293 bp, Triticum aestivum
  unsure (1)..(293): unsure at all n locations
  Clone ID: PAT_TA_82449
gtggaccggaagaggaacaacttcgtcgccgcgtcggagcttgagcgggccgtgaaggcgctcatgggggcgcgactccgaaggcgnggaagagggcgaggggaaaagggccncggagatnaaaaggccgcgttccngnaaaggncgttcannaaggcnggtcctcctactctgcgctcngggaagctctctgangagataatcaaangcgccaataaattattnacnaacatccggagacnaacttaanagagtgttgggtngctctgtggtttgtanttcttgttntgccc

SEQ ID NO: 82450 - DNA, 493 bp, Triticum aestivum
  unsure (1)..(493): unsure at all n locations
  Clone ID: PAT_TA_82450
agaagctcctagccaacaccaatcaaagcctccatccaatcccaagcaacctcgaggatgtcttgctgcggaggaaactgcagctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcggctgctcctgctgcaacctgctagatntatcatcggtcatgcatgcaccgcgcgcatcatatctatgatctatctacaatctacttaccatgtnacgccacctgatcgaaggtctttgtatgtatgttaagcacctgccaacatgagcagagcaagtgcactgccatgcatgttaaccgacccctaaataaaactcccgtgggttaacctaaaaaaaaaaaa

SEQ ID NO: 82451 - DNA, 511 bp, Triticum aestivum
  unsure (1)..(511): unsure at all n locations
  Clone ID: PAT_TA_82451
gaacaagcaagtcagaacagattgattattaaaattgcatagaaatctgcaagaacaccaaatggctcgaactctgctaggtatgaagataggttgcgtgcaaggatcctttacagagagcttttgttctaaccaaattcttggtctaatccagcatatgtatacactgtttgttcagttctgcttgtagtactgtatcaaacttaaaaacaaattgggcgatatccatcatttaattccttgtatttctgtatactaacntttttggattaccttggttggctggttcccaataaaactgaactttgaaatagattaaaatnggtcgctcaagttacaactgctttggtcccaacatagttcaagatgattgaattatgtcntagacctgggcccatgattaaaaacgctccctgccancctgacatacatatgccttcanttaacaacataaagagaggcctggaaggttccttccgcaaacnacgagtcggngggggncnccccgcgn

SEQ ID NO: 82452 - DNA, 527 bp, Triticum aestivum
  unsure (1)..(527): unsure at all n locations
  Clone ID: PAT_TA_82452
aaagagtggaaacgtcatctacaacattcattggacaaactgagggatcacttctgccgacaatatgtcttatcatttatttacttggaagggaagtcacgattggatgctagaatgtacttggaggggaacagggatgatcttttttgggattctgatcccttaccttcactacctttccaggcgttgtttgggaangttcagcagctagctagtgttgctggtgatgttccaacaaggcaaaggagaaaatncnaaaaggttgccttncaangggnaactgaaacggttncaagtggctcccccaatggacaagaattccggggantnccttttgaacnatcccacccaactccaacctcttngnctctaanaacttattccccgnaatcactccncccccgnnaaaatccccnttnggcgggnncccccccaaacaatttaanacttgtgcccnattttntccaancaattggacttccccccaaggnggttccccaaaacccccccgngganaangttcttcn

SEQ ID NO: 82453 - DNA, 563 bp, Triticum aestivum
  unsure (1)..(563): unsure at all n locations
  Clone ID: PAT_TA_82453
cttcttcttcttcttcttcttctccttctcctctatcaaggcccttaccagcggctttctcttgaacaaatccttgccaaagtacttgtcaactgcttttacaacctctccaaaagtcatagtggcaaaatttgcagcacccaatatacagaagacagcttgtctcagctcatccttgcttggtttcggtgcctgcttccatggcttcgcatctcctctagacataattttaccaccagatttctccttgggaatctgtgttttggattgcctttttcttggtaagagaaatgtttttcttcgttgaagccaccatatccgtgtcatcattctcaacattggctaactaactttggcagatggtgttgtgattagcgtttgttcatctgtangaaacggtactcctgggagcggaagtacagctaattccccaaacgcggagcaattaccccttcaaaaggccaaggttacttggtcctcccaaattgtccgtctngtaacccccaaggggggcccggtaccaatcgcccatatgagtctatacgcgcgccacnggcgtcgtt

SEQ ID NO: 82454 - DNA, 510 bp, Triticum aestivum
  unsure (1)..(510): unsure at all n locations
  Clone ID: PAT_TA_82454
gatctgacaacccctgatgctctttgcatctttcccatgataacatcactgttcatcatgcttacctcagagctcaagtacaatgcttcaaagaaatgcaaaaaatgctctcgcacgatgcacaaagaagcaagggaagctctgagagtaatgtctcttctatctatgttgttgacagcaacccttcctcaggcgatttcttgttccttggtcacctgggagttttccnaagtcctgcagaaaggatagctctccgagcagccagctcctggcaagaaantactatatggcacccccttggaaacaaagaagatgntcctggtgatggacaagaagggccaactggctggaagatccccttctggcaaaagagcaagaagagcaanttccccaagagacaaagaanctccngagctcannagagacatccccattagaaacngaccaaaagacgnttaatgtnnacanttatactggccattttttttttggggatgaactacacacttc

SEQ ID NO: 82455 - DNA, 545 bp, Triticum aestivum
  unsure (1)..(545): unsure at all n locations
  Clone ID: PAT_TA_82455
gttgtcgtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccancctgttattctgcatatgctgggatattgaatttgctgctgaaagctcttaaaggtgtcaaagatggagtttgattgatgccgcatttcnactttcaaagggagttttgcaacaactgatgttgtttnagcctgcactggtgtgaatgtttcnngtatngtttgtgggattccccacgaaaggaagnatngaaaggaagatgttntnacgaaaaatgttcaatctacaaagctcaancatctgccttgaactcatgcanccccaatttnaagtctggtntttccaacccanaaaaacaatgtccatccggaagggtttgtccaacnaccccgggaaaaacnaatttttnnncccctaanacanaaaagggn

SEQ ID NO: 82456 - DNA, 402 bp, Triticum aestivum
  unsure (1)..(402): unsure at all n locations
  Clone ID: PAT_TA_82456
tcggcacgaggcggctacggccagggcggcggtggcggctacggccagggcggcggtggctacggcggccagcgtggtggcggcggctacggcggtggctacggcggcggcggtggcggctacggcggccagcgcggcggcgactccggcggccagtggaggaactgagcggcggggccctccagttatcgatnctatctaccatctccgtcctcttccgtcaagcaaagttaatcttcaagtgtcctcctcctccntgttccctgtgtcaatcaatccttaatcctgtgtttccttccgncctgttgtgttttttgatttcccnaactccaatgtccctctnttcccggggtttaattaaagctgggntaccccaagggaagaaacacatntnttntctta

SEQ ID NO: 82457 - DNA, 379 bp, Triticum aestivum
  unsure (1)..(379): unsure at all n locations
  Clone ID: PAT_TA_82457
aaaccttggaagacattaaagccctcctctccaccaaccccaacctagcagcaccaggtgtatatgaaacgatgatattgtacatctcgtccacaagttaggtggtgagcgcagttctcatggtcgagagagacatggagggccacaaattccaggtccagagacccgtctattatgtctccgaggtcttaacccccgtggcaagtcatgataccctcactaccaaaagatagcatacgccatctttatggcttcaacgaaaacttcaagcactacttccacgagtgttccngttaacgttgcatcctgacatccccgttttaagtgacataatcccataatanggatgcaacggggcgttaagcccagtttggcatan

SEQ ID NO: 82458 - DNA, 350 bp, Triticum aestivum
  unsure (1)..(350): unsure at all n locations
  Clone ID: PAT_TA_82458
ttcatcatgtttgttcatggaacccttggctaccttgatcctgagagctttaccagtcgccgcctcaccgacaaaagtgacgtatacagttttggggtggttcttctggagctgatgacacgaaagagggctatatatactgacagcttcaatgaaaaggaatcattgtcatatacttttcctttgatgtttcatcagaagacgcatcacgttatgctggactctgaaattacagatgatgcaggcatggtggtccttggagaacatgactgaacttgcagttcactgccnttagccagaggggaaatgacanggcaacaatnaagggaattttccaaagagacnaagat

SEQ ID NO: 82459 - DNA, 775 bp, Triticum aestivum
  unsure (1)..(775): unsure at all n locations
  Clone ID: PAT_TA_82459
tttgtgatggccttgttatgaactaagaaaagtttcttgagaacaggagttgttctgataaatttactcttatctttctgctatggcactcactaagcttatgccctgtgaactggttagggaaaaaatgaaatttcacttgtactaagtgccatgccttttcgcttggtaacatgctgcatggatgagctagttcatatgttttgactgaaagtgtactttaattttgtcttcacaaacatgacatattgatcaacttttggcctaaaaaactgcagggaatcttgtgtctcctattgttgctcacatattgtgtaacatgatgggtttgcctgcgttctcatcaccgcgaacaagangagtgacatcgctagcgtttctggccggttcaatatccttcttttgcctccttccctgctacaagtccaaaactgtacaatgcgangttanacgatcagttgctggcatggtacgcaaatggagttacacaaaactgaacgtggggaacaatgctcatcgtcctgtggtgactgggaacgaatnaattggtnanccaaaaatncaactaaanaggggcctttcggnncttcgcatgtgnaaaaatctgncnactgctgcctcctgantaaaatntccagtaaagngtaatttgttaaattcaaccaactggcctaacatagccntttngncaancgaatgtantaaaaaaaaaccngggcgncatnccaggctncccagctttaacangaacgtcctactnanctcncggaaggcc

SEQ ID NO: 82460 - DNA, 629 bp, Triticum aestivum
  unsure (1)..(629): unsure at all n locations
  Clone ID: PAT_TA_82460
gctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcaagaggaggagctcaaggaggcttcaaggtgttcgacaaggaccaaaacggttcatctctgctgctgagctccgccacgtcatgacgaactcggcgagaactcaccgacgangangtggacaaatgtcctgaaaccgacgtcaacgtgatggcaaattaactatgaggagttgtcaaagncatgatggcaaatgacaaccaaccgnctccaanacaggagngaantgtnattcatattanttaagatcaacnctaattgatganttcaattancatctacctactntactgcaaaacggttggcnaccaattctgcaagttcccatnggttcaaacncctggttaagtanttgncccccngggaccgannngttcccttnnnaattttcccaaaa

SEQ ID NO: 82461 - DNA, 505 bp, Triticum aestivum
  unsure (1)..(505): unsure at all n locations
  Clone ID: PAT_TA_82461
gaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttcgtgccggagaagtcggcgctcgaggtcgacgagattcgcgtcgacaaggagacatggacatgctggcgttcctcggcatggccgacctccctggcgtcgagcgcgcccccgangtcactcctccgccgccccctaacgtcagccgttcaacgggcccgtggtggaaaccgcgcctaagttcctccgcatctctcgtaaccctatatatgcttaagtcattaaatntggtacttgtggnaaataatgttttgactcaaaanttaaattcaagtgttttgatctgcntatggtggacatatntgtttatccacctttaccnaagtgattcnataaatanggtgatttttggaaaaaaaaaaaa

SEQ ID NO: 82462 - DNA, 658 bp, Triticum aestivum
  unsure (1)..(658): unsure at all n locations
  Clone ID: PAT_TA_82462
attgaagctcaaaatcaagaagaaagaaaacggtgtcttgaaattggcagcaccaaaggaaggaatgaagggcattcttgagtttgatgcagaggtttttgagtttgcgccttctttgcatttagttgaattaaagaaaaccaatggagacactatagagtataaacaactgatgaaagatgagataaggcccgcacttaaggatgtggtttgggcgtggcaaggcgagtcgcacccgctccctgagaaatttatccgaggagagcagcagcagtcacctttgccatcactgcagcaacaatcanctttgtcatcgcaacaacagcaatcanctttgccantgcagcaacaccagcaatcacctttgccatcgcaacaaccacaggagtaatcngccccattgcaatctgctacacaaaacaaagacanatcaaccactgccgcatggnatcacaatactacaaaactattgttggaacacnataacatgcggncaatnaacggcaagatacatgtnctggtcaacaggtaacctggttagaaattattncnacanttgaattcccctcnttaactcctttgatgcngatttctcnagtttaacccttcaanacccaattttggacctttgntnaaaaaaaanaaaaaannaaaaaaa

SEQ ID NO: 82463 - DNA, 761 bp, Triticum aestivum
  unsure (1)..(761): unsure at all n locations
  Clone ID: PAT_TA_82463
aagacaactactcacgaccacaatgtgctaaacatactaaattaaaaaaattcttctagtggttgttgcctcgcaacacttaaatattattcaacataaacaanttgataccattttttgaggtgaaactaaaagtgccaagagaccatataatgcagtaaaatccgagttttgagataacacatcatcaaggagatggaaggcacatgttgaagtcatgaaaaatctatctacaggcaacactgcgctcttttttatttactatcaaatatcaagaaggatattcctaatgctacagttttcatcaattagcacttccaaattgatctcacacaactacactggatgtatatgtattatggatgtatatgtttctgtaaaagtgattaattcaagattgtgttcaacataacatcctccacgggcgtctcctgatcccttcctgtggnacancgacggcactccgatctggcctcgntcaacggtcgtcgcatgcccaactgcagcaacaacgcgcggtgcaaacatcanctgatccngggtactgcaactgcgcacaangccgtctcatcacgtgcanctatttggtatacannaagncaagngaatcataggtgaataanttggtccttaaaggggcaaattcangnaaaanttcaccccttngnttggataatnncaggnatatnccttntncttnaaaaatcacgcnaaaaaaacgnttttcccnacaagtccggatnanggnatttccngggtta

SEQ ID NO: 82464 - DNA, 381 bp, Triticum aestivum
  unsure (1)..(381): unsure at all n locations
  Clone ID: PAT_TA_82464
angtttgtgtgttggtccctctctctctctctgtctatgtcactctctctcactctctctctctctctnacaaacttcagttctgtcgcangcntccaacacacaaaccttgttggtccctctcccttcatctctatctctctctctctctctctctctctctctctctctctctgtctccatctctctctctttctctctctctgacaatcttcagattctgatcgcangcattcannacncaaaacttgttggtccctctcactccatctctctctctctctctctctctctgtgtctctctctctttccctccatctctctctttctctcngataatcttcagttctgtcgcacnnatccaacacataaaccttgttn

SEQ ID NO: 82465 - DNA, 388 bp, Triticum aestivum
  Clone ID: PAT_TA_82465
ttttttttttttttaatcataagccaatggatgtgctaatcataagcaacaatgtgctgatcataagttaacaaatgtgacattccagattaattttctccatagtcccataggctacactagttcacctcttcaccatacatctcaccaggtgcaggccttctagctttctgaagcttagtcccgcttctgcttggggtcatgttggaatccttttgcgccctttcagcaaatgatttaaccgacaacttatcattttccatgaaatgtacgtacttgttatagcaagataatgggcagtcaatgactttgatctcccactccctctgggtaggtgtgctctactcgccacatgatgggcagtcagtgagccttcaacttttcttcc

SEQ ID NO: 82466 - DNA, 616 bp, Triticum aestivum
  unsure (1)..(616): unsure at all n locations
  Clone ID: PAT_TA_82466
acctcactactcttatggtgtttgcacactacaagtggtttaagcatgaaggtggtttgttccattttgtgcattccagatttagagatgctacatcaattcaacagctcatttcgtgcaagcccagacagtccattctcagtaaagagcatattgtaactgtgatgtttgttggaaacttcattggcattgtgtgtgcccgctcattacattaccagttttattcttggtacttctattcattgccttttctgttgtggagaacacagtttccaacagtagtcaggatcattttgtttgttgtcgtggagctctgctggaacgtttatccttctaccgcctattcatcactacttctgttgttcgcgcacctcctcatcttgttcggcctatggagttcgcctgccgagtaccctatgtcgataaaaaggacaaggcggcagtaaagaatcgggcaangcaatgtgaagctcccgcangatattcatccttgagtacantatacaagaacctgatacagcacatgcanagaggttctcaaatctgaaacattcncggnggactcttgtntacaaagatgacattgtacctgtagatanataaacatcagactaaa

SEQ ID NO: 82467 - DNA, 384 bp, Triticum aestivum
  unsure (1)..(384): unsure at all n locations
  Clone ID: PAT_TA_82467
caccataaagaccatttattacgggcattactagtcacgtttaggacttaactctcattgaacccctgtgtaattgagggcagctaagggccggcgcactctatataagccacccttcccctatggcattagggttcgcaccccttgtaactattgccacactccagtcaaccgagaagtagggctattacctccttcgagatgggcctgaactcgtaaagttgtgtgtacaacctcgccgtagctagggtctggcccttatcctacatagcccctacttctactgtcaagactcattcccacgacggtcgtcgaggcaccgtccatgccttgcgcactgacgccgcgangcggttggctgctttaaacaatagttcatggctt

SEQ ID NO: 82468 - DNA, 376 bp, Triticum aestivum
  Clone ID: PAT_TA_82468
gtgagggagtgagtcaagtgacatacagacacaagaaatattcagttatgaggattgaagaaattaatgatcattcagtcattgaggatttgagaagagacatcaatgctccagtagaggtgttattgaagttgtggctgtcaatagtccttttattgatgctaagtacatggatccattgagatcgtggatgattcagtattggagattaatgcgaaaagatcacaaccacaggcgaaagagggaaaggagaagtctgaatgcgccaacaagtagcgaccaatgagctgtcgtctatggattggctaagcgaggagttgtcttgcgctgcaagggcatcttgcaaatcgatttccttggtttgatgtgtttcaag

SEQ ID NO: 82469 - DNA, 572 bp, Triticum aestivum
  unsure (1)..(572): unsure at all n locations
  Clone ID: PAT_TA_82469
gagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaangtccgcactgacaagacctaacctgctgggttcaaggncatcaattcaattccaaagactgggtgagaactacagcttcttttgacaccaaaggtcgcnttcgccttaatcttcaaggattaagatgctaaattcaaactctgcaagncaaggccgttcaattntggcaaaaaggnatccctaactgaaaactatgatggcgcacaatcgctaccaagaccatcataangggaatgcncatcaaactcgactgggnacaacaanatnttggctcaccanttgcgtc

SEQ ID NO: 82470 - DNA, 568 bp, Triticum aestivum
  unsure (1)..(568): unsure at all n locations
  Clone ID: PAT_TA_82470
acccaaccgtgcttccttctgagactgtgctgacgatggctactattaatggtgcaaaagcggttctgtgggataatgaaataggctctctggaggtcggcaaaaaggcggacctgattgtggtgaatccatttaagtggtccatgcttccgttacatgactgcattgccaacactgtttattgcatgcggtcagaaaatatcgaatctgttatgtgcaatggccaatggattatgaaggatcaagaagattatgaatgtaaatgaggaggaggtaatttcttcagcagtaaagagagcaactgccctcctantgcgagctggcatcaactccctgaaaggatgaactacttgtgantttatcatgctagttctctccccgaaactttaatccaatgatcaagctgaatatggagctcaagcataacctttcntngggtaatcaaagctggtctctccctgaaacgcaattttgcacttaagcaagttaatgccattnagaagganaatccacgattaattgggtggnggcaacaagcataatctcaaccaatgacaaacnaantggn

SEQ ID NO: 82471 - DNA, 553 bp, Triticum aestivum
  unsure (1)..(553): unsure at all n locations
  Clone ID: PAT_TA_82471
ccccctccgatcgaagcgaagtcaaggntctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccaagaaggaatccacactccacctggtgctcagactccgtggtggcatgcagatcttcgtcaagacctgaccggcaagaccatcaccctggaggttgagtcctctgacaacatcgacaacgtcaaaggcaagattcaaggacnaggagggcattccccgggacaacaggtctcantttgctnggaaacaactcgaggatggcgcacctcgctgactacaaatcaagaaggatcaaactcaactggngtcagctccttggnggatgaaatttncgtcaanacctgacgggaagacatcacctggaggcnatctctgaacaan

SEQ ID NO: 82472 - DNA, 543 bp, Triticum aestivum
  unsure (1)..(543): unsure at all n locations
  Clone ID: PAT_TA_82472
ggctggtgcgccngcgcctancggtgncanatttttcatgagantattcgcacagctacgcganggcggctggctggcggaganncaantttgcnacngtacgcttnangaagagngttgcaacgtatcggtggcgcggaggaggcttgctgcgngcggcctancgggacncaccggcctcgagatcgcaagatgaggntgatcggcttgacgggtggaattgcttcggggaangagcaccntctctggncncttcanatcggccggcgtccctgtcgtcgacgcggacattgtggctcgggtaagcatccaacntccagnatccntgtgttgcagctgcaanacatgcgtgcctttcangcatgttgtggttactcaatcatcncaactanggaancctaccgnacccaagtaannaattacttttgtatcccnttangtangcngccaattcacntttggggggaaaaantccgtccaaaaacaacccccngnaatcnagtggtcngccnaaangttccatttgcncggnataactttcan

SEQ ID NO: 82473 - DNA, 454 bp, Triticum aestivum
  unsure (1)..(454): unsure at all n locations
  Clone ID: PAT_TA_82473
tgtgactgcctcatccgtgcttaagctaggggccattgtcctctgcgtcgtgctcgccgcatcgtccgtgcggcgaacggcgccgcgggactgtgactcgctctgcgagaccgcgtgctcctacctcgagtcagcggcctgcaacggcctctgcggggtccccgccgccgcctcctccgagaagccgacatgccagtcctgcaaggaggcgaccaagaagtcgtgcaacaccgagtgcgtcagcatgtgcaacaccacgccggattcgccgtctacctgcagtgccagtgggaacaagtagatngatgcagccaggcaagtggcaaggtcagcaagccggccggggaagaagctaactaccgccggcgggatgcatccgtgttgtgttgtaattttgtttggttcnccaaattccgagttgctaattcatactctccgtctcaaaaaaaaaaaa

SEQ ID NO: 82474 - DNA, 338 bp, Triticum aestivum
  unsure (1)..(338): unsure at all n locations
  Clone ID: PAT_TA_82474
ggagattcttcttcaccttcgtaaggttggatttttcttaggattgctgattcccaatcattgtacgtagatcgtctctctgtaaatacctcctctccttcttgctattgtcattgtctgttcaggcatactttttttttttttttttgcgaaatgttcaggcatactatcttgctgtcagaaaagaaacaacaaatactaagcactgtggttcaggcattgtgtgctttcaacatgtttccaggcacatgagctgcagcaagcctgcgggcaaacatatttttactgaattactgtgaaaattgaatgaagtgtagatttttccaanaaaaaaaaat

SEQ ID NO: 82475 - DNA, 564 bp, Triticum aestivum
  unsure (1)..(564): unsure at all n locations
  Clone ID: PAT_TA_82475
ctgaattggtgcctatgatttttagatgtaaaatggtttggataagcaggcaatacgataaccttttatagcttacagttataacgtcttaactgttactcttttggctttctgactgcagcaggaatggcacaattgagggcattgtccatttaatgcctgtttctgttgagtgttcaatggtttaagttctcctcttcttggatttagtttggatatatgcttccattcttgtcaactgagacggcctgagaacactgcatttgccttggtgttttgatttgtctttcttctgcaacacagacatgagagttctcattgagattctacccacttactcagcagtgcctgctgtactttgctcatgaaggacttcttttctccatttctctgttatgtaaggaggagtatataagtaaggtgtactgctgggcttgggacaagtcttctgtttcaacaacttgtcgagcagttttactcaatactttggactgaaattaatcgttnattatacaacatatgtacacctttaattgtaatttgctatgcctgctctccgcaatt

SEQ ID NO: 82476 - DNA, 540 bp, Triticum aestivum
  unsure (1)..(540): unsure at all n locations
  Clone ID: PAT_TA_82476
gataaagttgaggttgcaagctattgcgcttcggtggtgatcgtaatatcaaatattttgacagatggaaagcatttggtgcctatgatatcccgtgatttaccgttcctggagggcctacttgaagttcttccagaggtccctgatgatgaccaagctcgatatgcactttggagtatcttatcgcgtgttctggcacaagtgcaaggaactgagttgaactccttgtccctcgaccggtttgcgtctctgttctcaggcaagttcggcctcatcaaagatgacctcgagagtcaggtggttgatgaagagaagttaacacctgaggatgctctcctgaagggatggatatcgagatgtctcatggcaatctccttcttcaaggagagatggatcgaggagaatcctcccaagggcaacaaagacccatcgacaatgctcgggaagtgctgagctactgccagaaggcgctccgctaactggnaacccactccactgacaagcttgctgcggtttgtgataaacgctgctgacctgana

SEQ ID NO: 82477 - DNA, 423 bp, Triticum aestivum
  Clone ID: PAT_TA_82477
ttttttttttttttttttttttgtttaatacaggtgagagtataataataataaaattaatatcacagccaacagagcattaaagtgacaacaaatatcaaatgtcaagttatgacaagagtaacacaaaacggaagtattagtaaagggttccttcaaatagttctggagacggagataaagcaaatgcatgttgcccaatgagccggtaatgcttaacctcctcgaccatccaacgtctgcaatggtcataacagcacagcaaggttaaagatatgagtcccaaacttccaacaacaaataaatcaggtcgcattagctccatgaaaccttaagcctttcccagtgttgaaagaatgcctcagcttcgctcatatcacttcatctcccgacataaattatcatacccggacgaaggggggg

SEQ ID NO: 82478 - DNA, 434 bp, Triticum aestivum
  Clone ID: PAT_TA_82478
cagcagaaggttttcaaagtgggtgacaaggtcttcctcaagctgcaaccatacaagagcaaatcacaagctggcctacaagttctacaggccctttcccatcattgacaagatcaacgaagtggtgtacaaacttcaacttcccccacaagcaacggtccatccggtgttccacatttcgctgcttcgacaagctctccttccaggtatgactgttgaacctcatctttctcattgtttggatgatctagctttgccggatgcaattctccagacccgttggcgcaacaacaaagacggcgtccaagagcaattgaagatacaatggtcagctacttccaacctgggcatcacttgggaagataaagccaacttgatggcccggtttccacatgaggaggcttgggggcaagcctcttcaaaggaggagggga

SEQ ID NO: 82479 - DNA, 543 bp, Triticum aestivum
  unsure (1)..(543): unsure at all n locations
  Clone ID: PAT_TA_82479
ctcaatatggcgacgttgttggatccaaccaggacctacccttacagatacagagcagctgttctgatggacgaaaacaaggaggaggaggcgatcggggagctgactcaggcgctggctttcaagccggacctccagctgctccacctccgcgcggccttccaggactcgatgggcgacagcgcgagcaccctgcgcgactgcgaggcggccctgtgcatgcacccgcagcacggagacaccctggagctctacaacaaggcttcctccaaggctgatcatcaatccgagagctagctgggtctatcctgcgcgtgcgaccaccatcgtcgatgatcagctagctgaatgatgaagcgattttggccttccacagcaaggagagaaaatgtagagcgaggcgggcagaagagacacggacggaccgatnagtgtaagcgaacatacatcaatgcaacggcgangcgaagtcgtcgactctgcgtgtaacgtcaagagttgatgagaaactgggtgctgtacaaaatgttagaatacaaagct

SEQ ID NO: 82480 - DNA, 547 bp, Triticum aestivum
  unsure (1)..(547): unsure at all n locations
  Clone ID: PAT_TA_82480
ttttttttttttttttttttcatattgtataacttttgcatgatagatgttaatattttttcatataaatatggtcaaactttacgaagtttgacttcagacaattcttatatacagagtaaaaaggaccgaagggagtacaaactctcccacaagatggaatcaaaagcttttctgaagtctagttaagaactaaggcaaggcctttccttttatgacaggattgcacaactgcttcaaggatgaaatttttcaagtgatatttccgacctttgataagcctccgattgggtccgcaaagttaactcctaaagaaaacaacaccttcttttttggaggaaaaaagagaacacccttttaattacatttttttggacgccggataacgccacacgtgtngacacaatagactacatttttttgggacgccgataactgccacacgtgtggacacaatagacacccgcccacacaaccgtgtggnatacccaatggcacccacacatcctggtgtgggcncntgccgattcnggacganagagnaagg

SEQ ID NO: 82481 - DNA, 428 bp, Triticum aestivum
  Clone ID: PAT_TA_82481
gcggggggaaccaactccttgtgcggtgaaaggggctgcacggcgccggagttgtcgggtctgacgccaccggtggcgctggtgacatcggggcaaggtcggcgtgcggaaaaccaccaccgctccggccacttcgatcgcagatgtaggccaccgccccgcctgccttcatcatcatcttcgtccccgcaggcccattcttctcgcaggtcacaggggcagcagctgagtaaccggcatgtgtccttggatgcggcgagccatcctcaccctcactattgtgattgacttttatgtttttcctttcaaatccaactgcatgcattttgctgctccggttgtaatgttataagcgacatttgatccttgaatcccaagaaaaaaacagttccggataaataactgccatggggtccaaaaaaaaaaaa

SEQ ID NO: 82482 - DNA, 340 bp, Triticum aestivum
  unsure (1)..(340): unsure at all n locations
  Clone ID: PAT_TA_82482
tttccctgcttcttgctgccttatagttccacggacgagaggcgccgcagggggttcaaggttttggtcgcgctcatggaccacgcactgccctgcttcacacacgaaatgcaggatatactgctcctccactctcccactcctatgcctaaactatagatagatcactcatcaaggaagcgatcgatgatggaggatgtctcatgtttctttctttttttctttcttttttgcaagattcatcttcctcgagcagtgtagttggccggtggtaatctgtggattccacatgtatcttcatgttttccttgtaaaaaaactgcttcattccaaaaaaaan

SEQ ID NO: 82483 - DNA, 423 bp, Triticum aestivum
  unsure (1)..(423): unsure at all n locations
  Clone ID: PAT_TA_82483
gcacatcgacctcgccgtcgccgtcctctcccgcttcctcggccccaaggagctcgcccgcctcgccgagttgaccgaccgtgccgcctacctaggagttgagattagccagcccactggnactacttcacctgatccatggaggctgtcgacatgggactgatccctttgaagccatgctcctcctatcactcattcgtctatcatcttcaatcattatgcagacttgtggtttcagttcagtttggtcagattaatttgctgctatctgtgtttaactaattcctgggacggccgtggcaatctatattttcttgatctattangggtaataaacatagcactcctagtagtgtaacattgaactgggatcgaatcgaattgcangagctatcttaattaattagcttcaaaaanaaatga

SEQ ID NO: 82484 - DNA, 244 bp, Triticum aestivum
  unsure (1)..(244): unsure at all n locations
  Clone ID: PAT_TA_82484
catcaccggctggtngtggattacgtcttcgccggggctgttgtttggtgtttggtcatgctgggtggccgaaggttgaagggactgganctgaaaaaataaaggggcacncttttggttcaaccaantccaaatgggattccgggttaaccgggaantttgggntaaaagcaaaancanctttgngccccaccaaagacanggcctttttagncccccccnggaaattttngaaaaaccttca

SEQ ID NO: 82485 - DNA, 535 bp, Triticum aestivum
  unsure (1)..(535): unsure at all n locations
  Clone ID: PAT_TA_82485
ctcgcgcccgcaccccaggaaggtaagttcaagaggcttttctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctggaaggaacaaattagaccagtaccagtcctcaagtacccgcttaccactgagtctgcgatgaagaagattgaagacaacaacaccttgtcntcattgtcgacctcaaggccgacaagaagaaaataaagctgctgtcaagaaatgtatgacattcaagccaagaaggttaacacctcatcaggcctgatggcaagaagaagctacgtgaactgacacagactacgatctcctggacgtggcaacaaatnggnatcatatagccagaggaaggcctgcaatagcctgttccttgt

SEQ ID NO: 82486 - DNA, 431 bp, Triticum aestivum
  unsure (1)..(431): unsure at all n locations
  Clone ID: PAT_TA_82486
aatgaaaattatataatatttgtgaccccctttcgaaacaaagagggcaggaccccatacatcagagtgaacaagttcaaaaggtcgttgagaaacagaattactagagggatatggaagttgtatctgcttgccaagcttacaacccatacaagttagtgaactatcaccagatacagaccctagaacaccactcctaaccaaagaagacaagcgggagccacaaatgtgacccaatcgatgatgccactgagcgaaggatgtggtggaggtggcagctgaagcaaaaggggtgggtgatgtccgactgggctagatgacgcagcggaaggaaggcgcagccaatcgactcccaaaggcgctgagatcatggcgccgangaccgattccaaccagatccccgtacgacgattctgaacacaacggggggg

SEQ ID NO: 82487 - DNA, 519 bp, Triticum aestivum
  unsure (1)..(519): unsure at all n locations
  Clone ID: PAT_TA_82487
cacccttgctgactacaacatccagaaggagtccaccctccacctggtgctccgcctcaggggtggtatgcagatcttcgtcaagaccctcaccggcaagaccatcaccttggaggttgagtcatccgacaccattgacaacgtgaaggcgaagatccaggacaaggagggcatccccccggaccagcagcgcctcatctttgccggcaagcagcttgaggacggccgcaccctcgctgactacaacatccaagaaggagtccaccctccacctgggtgctccgtctcaggggtggtatgcagttttccgttaagacctcaccggcaagacatcacgctcgagtcgatcatctgacacattnacatgtgaaggcnaagttcaagacaaggagggcatccaaccggacaacacgctancttgctggtaacantcaagacggcgacctcctgntacacncanaagggtcaactcacnggggccttccctggggcattattgctgcatggactctagtcgtn

SEQ ID NO: 82488 - DNA, 541 bp, Triticum aestivum
  unsure (1)..(541): unsure at all n locations
  Clone ID: PAT_TA_82488
gcttttggtggctgtggagattctgttcttgaacttaagtcattgttggaggagaatattatttctgacttattggagaaagctgatttagttgtcaaggatgaaagaacgctggaagcgggtggttcaaaatgttcctgctttaccgactctagtgagatgaccaatggaacctcatataaattggcttgtagagataactcaagtgacaattacatatattgcccaaatgctagagatgttcaaaatggagctttagatcatttccaggagcactggttgaagggtgagcctgttattgttcgtgacgtgcttgagttaacttccgggttaagctggggaacctatggttatgtggcggctttacgaagaaaagaaagacaagagcgaacatgagcgacctcaattacagtccttgagtgtcctggcgtggtcctgangttgaaataaacactactcctttttaaggggtatcccctnggactgttngccaaaggtttgccgtgttaccaacttaaagatgggcacaacacaactaatc

SEQ ID NO: 82489 - DNA, 546 bp, Triticum aestivum
  unsure (1)..(546): unsure at all n locations
  Clone ID: PAT_TA_82489
tccaaatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctgggtgctcagactccgtggtggcatgcagatcttcgtcaagaccctgaccggcaagaccatcaccctgngaggttgagtcctctgacaccatcgacaacgtcaaggccaagattcaggacaaggagggcattcccccggaccaacagcgtctcaattttgctggcaagcagtcgaggatggcgcacgctcgctgactacaacatccagaaggatcacatcaactggngctcaagtccgtggtggatgcagttttcgtcaagacctgacgggnaagacatn

SEQ ID NO: 82490 - DNA, 528 bp, Triticum aestivum
  unsure (1)..(528): unsure at all n locations
  Clone ID: PAT_TA_82490
tcccaacccaagtagccgtgactgcgatcatcgctgccactggcgcggtggacgcgagtgcaagttgaagcaccttgttcatcctcttgagcgttctaatctccctgttcttgtcagccatctcctcgatgaactcgtctcggtcttcagtcacctcccgcagcttcattcgtttagcttggattctcttctgcacgtattgctccaatacatcctcccacacatagacctctcacactctcctctgaacctatacataggaatgaagaaacaagagcaaaagaatctttagtcagttgaggtactgaatggaatctgctacatttcttcttttctgcattttcttaccccatagtnacccagctgaagtagaactgatcctgcctccgccacagcagaccagtttcctgggcgcatggcagccgcgttcacatcgaatatcagattacaatgggcatttcttctaattattgggtatgcagaaaatgttgtggtgancacttcaatcacccgtaagnttnacctggg

SEQ ID NO: 82491 - DNA, 543 bp, Triticum aestivum
  Clone ID: PAT_TA_82491
tttctttctgcctgcaactgggatgccttaccatgcaacatggagcacctcacagcgctcaagaaactggatatacagtcatgcgagaatatacaatcgctcccaacactgcccaagtctcttgagtggtttcaagtcatgggctgcatatgggatgccttaccaggcaatatggagcacctcacagcgctcaagagactggatataaaatcatgcaagaatatactgtcgcttccaacactgcccaagtctcttgaggagtttaacgtcatgaactgcagcagggatgccttacgaggaaatatggagcacgtcacatcgctcaagaaattgagatcaggtcatgcaagaatatgcggtcgctcccaacactgcccaagtctcttggacgatttatagtgtgggctgcagcttcaatgccttgccaagcaatattgagcacatcacatcactcaaggagactgaatatacatcatgcgagaatatgcattgcttccaacacttcaaatctctggaggatttacacctaaaatgcagctggag

SEQ ID NO: 82492 - DNA, 577 bp, Triticum aestivum
  unsure (1)..(577): unsure at all n locations
  Clone ID: PAT_TA_82492
ccaacctctcgctgcaaaaggttgcttgtcatggcatcaaagcgcatcctcaaggaactcaaggacctgcagaaggacccgcccacatcatgcagtgcaggtcctgctggtgaggacatgtttcattggcaagcaacaattatgggaccccctgacagtccctatgccggcggtgttttcttaagtgaacattcatttccctccggattaccccttcaaagccaccaaaggtatctttttaagacaaaggcttccatccctaatatcaacagcaatgggagcatatgccttgatattccttaanggagcaantggnccctggctttgacnattttccaaaggcctggcnccccaaccngctccctggctgaaccgnttncnaacccggntgttccccttgttcccgganattgcccanattttcaaanacggnccggtcaaaagtacnaancnaaaacccgcaantgggccaaaaatnacccanggttnaaanaaaactgnatcnttggcaactgaatgcncttcaaagaaaaaattaangggcatggtnctccattgttgcggtgtgttaanccnt

SEQ ID NO: 82493 - DNA, 531 bp, Triticum aestivum
  unsure (1)..(531): unsure at all n locations
  Clone ID: PAT_TA_82493
aaaagatggactcataactgagtcacaaactagaatcattttagaggaatccactgattgtaatgccaaccacttggtgacatgcaatacttgtggaagcttggatgttccactaaagatgcttatatgtgattcttgtgaagcagcattccatttgccttgttgcatcccttgtattaaggtggtaccagctggtgaatggtattgtcagccatgcttgaagaagaaacctaagagtctttatggtcaactgttagagggcaaggtcaagtcttccgggaatatggaccaaaggcctcatggcatgagtcatacagagtacatgttcaacgatgctgaatcatacgttactgggggttccgacttggtggagatttcccaagctgaagtgccaaaatggtctggcccattccaagtaacgatggtattcacagcgccctctgaattgatcctggcgaaccaagaaacgaattctgttcaaagaataacacaacaanctcaagtcaacggtaatgggtacaatgcgtgagg

SEQ ID NO: 82494 - DNA, 540 bp, Triticum aestivum
  unsure (1)..(540): unsure at all n locations
  Clone ID: PAT_TA_82494
ttttttttgcgtccgaacagtcaagcagacagatacatgaccgcgttggatggctgaacacgtttgcaccgtactgtccgaatgtttgcgaacagtttgttggagatgccctaagaagagagaccccatgtagtttgatctactatacacgtatacatttttactagcaagcaacaagaaaaagaaagagaaatcctcactatgcccccacaagatgactgagccaagaataagaacaagagaaattcttcaaaacgattcttttttcaggcgaggacgatatctcaggcccatatggcaagcacggacatgagagccgtcccaagcagcaatgagaggtttacgatgacttgcagccttccgttgccctgcaccctaaggttcatgaagtcttccgcgaggaggtcgacganggcatgtagttgaggattccggcggcggcggcgctgaggatccttggatgatcagggtgttggggctgttctcgtcgtagacagaggatatcccgatgccgatnacgacccgaccgggtggtgagga

SEQ ID NO: 82495 - DNA, 526 bp, Triticum aestivum
  unsure (1)..(526): unsure at all n locations
  Clone ID: PAT_TA_82495
ggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactnagagtggcaacactaaggatgacctgaacttcccactgatgatgttctgcttggccagtttaagactggtttgctgatggaaggactgatctgtctgtgattccgccagggtgaagacantttgcgctttgaaggaaccgtggtggaantaacacttgcgtggttcctacctcgatactggg

SEQ ID NO: 82496 - DNA, 476 bp, Triticum aestivum
  unsure (1)..(476): unsure at all n locations
  Clone ID: PAT_TA_82496
catcgggcgcttcctcaagaagggccgctacgcgcagcgcgtcggctccggcgcccccgtctacctcgcggccgtcctcgagtacctcgccgccgagctgctggagctcgcgggcaacgccgccaaggacaacaagaagagccggatcatcccccgccacctgctgctcgccatcaggaacgacgaggagctcggcaagctgctcgccggcatcaccatcgcgcacggcggcgtgattcccaacatcaacccggtgctgctccccaagaagacggccgagaatcccccaaggagcccaagtcgcccaagaagaccgccaancccccaagaaggcttagttccttgcgtattaggtgtagctggggtgtatggatgggtgtgcttgaggatactcaattcgaagtagacgttcttgctttgtcnttgtatttctgacgtgattcaatgaaacaataattgctttgaaaaaaaaaaaa

SEQ ID NO: 82497 - DNA, 534 bp, Triticum aestivum
  unsure (1)..(534): unsure at all n locations
  Clone ID: PAT_TA_82497
accatcatatagtcttctatgattgctaacactcaccgcgtacacatgagcaaaatgtttcaaccggacacataggggcttatagtttcacctcccaacgtattcacctcaagggtgatgtcaactataataactcatgatatctatattcaactggacatatgtgcctagatctttcctcaccatatgatgcttgccaaaggagaaaaataaaaaggaataaaaggaaaaactttgactctttgcataaaagtaaatacataaaattaaaagataggcccttcacaagagggaagcagaggttgccatgcgcttatttgtttgtatgctcaaccccttaagtgcaaaagaacgtcacgttacattgccccttggtgatagcgactttattatgcatctgtcctttatcctcaacatcacaatttgtgcaacgccaatttcccttacactaaatgatccacacatttaagaacattttaataccttttgcatcaatgacaacttactngagggatctgccatccctagnagtag

SEQ ID NO: 82498 - DNA, 533 bp, Triticum aestivum
  unsure (1)..(533): unsure at all n locations
  Clone ID: PAT_TA_82498
agcaccatgatgatcctccctgggacatgcccacatcagaactattctgcttctatttacatggtagatgcacaggactccaatacttcaaattcctgagattactatcagtttatggctgtacaaatatgagcagttggcaagaaagcatcctcctccttacctcccttcaaaaactggagttgcatgagagcgacatgcctggatggttgtgtaaactctcctcactgcgtgaacttcacatcataaagagcaaaccaccgctcaacctatcccagtttgtttatgatcgtcaccagattgccttaagaatcgaggattgccaggggacactcaagcaggtgccttctgtagtgattttgggacatgataagacacatcacttctgtgggaaataattggttgtgagccgatatgcatgcagagtgggcgaaatggtgaatcctcaaagtgcaaacttcgaaanccagtgagtggtacatgcgcgtgcaaatctgggncactggcgacacctgggacaggcaagaggacgg

SEQ ID NO: 82499 - DNA, 325 bp, Triticum aestivum
  unsure (1)..(325): unsure at all n locations
  Clone ID: PAT_TA_82499
aatggcgcaccatgggcaggtgctccattagtaactttttttttattttttgacttattttgaattttgaatgcgggaagatagtatggcgcaccatgggtaggtgcgccattagtaagtttgatttttttgaatttttttgcctctccagatcttaaaagccccgtatctttttttctgttcggtttttgaggatttgaaaatgtttaacggggtttccccgctaaatccggatgtaacttttgagtagatgatttttcatataaaaaacttttcanccgagtcgtacgcaaaagtatgccatttacaatctcnaagggggggg

SEQ ID NO: 82500 - DNA, 536 bp, Triticum aestivum
  unsure (1)..(536): unsure at all n locations
  Clone ID: PAT_TA_82500
tgngngggccgctctagaaactagtgggattcccccggggcttgcaggnaattcgggcacaagttaaagggaaccgaaagggtngttattccaaatttgaaaaatcccaaaacctgggttgaaaaagcaaaangnaatattaaaaagccaaangaaagctgattcttgggaaaagacaactgaaactctcganggcgtgncgangagagggagantggagaaancaaatttctcatgaagcgctatattgaagcttcanggagcaacggcaaagacangaacaangccanagaaagatttngggaacgtcnttgctttaantaanngcagcaaaagagcanatgctgcaacagaaacctncaagagggaagaaaagctgctaaaaagaacnagacgaaagacttgaaaacgccgcanntaactgcgaaaggttnttgnggnaantaagctaagcngaattgngtttgtccngggnaattaattccnagagcatccccaancaaatttatnaccnggnccnctgtttccacanccca

SEQ ID NO: 82501 - DNA, 613 bp, Triticum aestivum
  unsure (1)..(613): unsure at all n locations
  Clone ID: PAT_TA_82501
tggaaattctgaagaattttcaggcttcagaaatttcacgaaatcagttctacaaaacatatttttttgacctaataagaagcanggagaattttttgcaagttctcaacaagattcaatttcaataaagccctgggcttcaaaacttcaatggttttgggtngcctacaaacacttgttttggtgtgggttggatgggcctaaactggaacctcctaatggggatggcaatccaacgggcaatcaatatccaatcctaaatgccatggtttggtacggggaactacacaatcaaaacttcctgggggcaacaattcccaacaatgaacgggaactgaaggtgaccaagttggttgatgggccccttgggtccaaaaaatactcccnaacttcaaaaacaaataagggacttccgggtgcaacaaaggatttcaaanccaaggatacaaggtncgtttnccggaaaaggcgccgggncnaanggaaaaggaaaggnacggtgcttgcaacccaanggcngattgccccancnaatttcaaaaattnaanggnaacccaaaaggccccntaattggcaaggcattgccaancccatttgnggggccntnangcc

SEQ ID NO: 82502 - DNA, 417 bp, Triticum aestivum
  unsure (1)..(417): unsure at all n locations
  Clone ID: PAT_TA_82502
agcgaacgtcctccgcccggggccactaagtttncgccttggcttaanccccaataatgccttccngttaagaagcaaatttgaaaacaaaaatcnncaagtagattgatcagcaaatgggctttactttactgggggtggctgtnactccgtttatcactttgtttggacgctcacttttgctcccnaatactttgaaatgggcttccattctgggccccnatggcaaaactgttcttcaactggctgngctaagtctttccttgncttcaaatgggtngctgcttatgtttacgaagcattttgcncggccaatgtttgtgaanccccaaataantccacatctggtacgttccanagggaaaaggagaaagttggatagaatcctgatgacgtantcctcaagcngcctgataa

SEQ ID NO: 82503 - DNA, 560 bp, Triticum aestivum
  unsure (1)..(560): unsure at all n locations
  Clone ID: PAT_TA_82503
agcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaaagaagaatgttgagtccgccacaaatatcttcttaacaagctcaaagaccttcattctttgttggcgaagagcatgcatgatgatggcggcgtggtgttcgcctactacaaaggagggactgctgattcaactttcctgtactttgcacatgggctgaaaaaggtcaaagtgctaacccactgtatgctaaatcaancntctcaatattttgcnctancaaggttgcaatcnaccnccaagttggngccatnacngcaaatttaatgtctgnaaattcnganatgggggatgcttgtaaggnaaccnaaatgggtggtggtttggtaacaaaaatcn

SEQ ID NO: 82504 - DNA, 473 bp, Triticum aestivum
  unsure (1)..(473): unsure at all n locations
  Clone ID: PAT_TA_82504
tgcacaagcgcccgcaattcccctccccctcccttctcttaaaccaatcagacgctagaatccttgggcaattcgccgctcctccgatcgttcgccgccgccggggatcgaccatgtcgtacacctacctcttcaagtacatcatcatcggcgacacangcgtggggcaagtcatgcctgctgctgcaattcaaccgacaagagggttcaaanccgtgcaacgacctcaacanccggcgtccaattccggggccgcatgatnaacaatcnaccacaaanccaacaaactccaaaattggggacaccggttggcaaagatcatcaaatntattacaagtnaaaacaanaaaggggtgcggggnccttttggttatgggntcacccaggngggaattttaacacctggganctgggtaaaanatcncaacagcatncatgccaaatgcaatgtgtttanccgnaaaatgtgattg

SEQ ID NO: 82505 - DNA, 557 bp, Triticum aestivum
  unsure (1)..(557): unsure at all n locations
  Clone ID: PAT_TA_82505
ccaaagctcaanctccttctccttgaaaatctttttgggtccacagattttggagggattgtcttgcaactgcgggattaaggctgcaagctgcggctcagaactgcaagttgccgggaaagatgtaccctggatctgacgggagcaagggcaagccgcccgccgccgaaggtcgcccgcccgtggtcgtcctcggcgtggcgcctgagaacaaggcgggacagttcgaggtggcccgccggggcaatccggcgaagggctgcaactgcgggcgacaactgcaagtngcaaaccctgcaactgttaaagctgcaagcactcntacgttagtacgtgtgatggtgttagaatatacgttaataacgaagcgtccgatctgatggagtccaacaaatngtgcctgtgtgtgtgggttaactngctccgctctcccgtctaanctctgccctngctgtcccngtgtgtaagtgttatcangtttccccggtaatngcttaancaaccccactaaggatggattgggaatatntagaatgaaagattncctaattacnaan

SEQ ID NO: 82506 - DNA, 494 bp, Triticum aestivum
  unsure (1)..(494): unsure at all n locations
  Clone ID: PAT_TA_82506
ctccttccccctcgagcacggcgcgtcgtcgacagcctccatccctcttcttccctcttcatcagccgagcacaactccgtttcacaggtccttcagaaaatgggaaaagtgggttttcttcatgtttatctacaaaatgttcaatgcctcctgtttnataggaggcacggagatgtttccctgggacggatgtgcaaatcctgggttaaaatggggcgaagggcacaaaattaaggcccttaagaatccgggaatgggcgctccttaagatgccaatttgattcaaatnggagtgggtgcttgtgtngtcaagaataaagacatgaattgtgttaangggattnanaaaagaaatngtgnaanagataatgccatagncttggtaaatcctgattttagnagatgcatacacatgtgtnnacatcccaattcaanacccananttccccnacttttttttggaaaaaaatgtgccccggctaaaaaaaaaaaa

SEQ ID NO: 82507 - DNA, 388 bp, Triticum aestivum
  unsure (1)..(388): unsure at all n locations
  Clone ID: PAT_TA_82507
cggcacgaggcggcggcggtggcggntacggcggccagcgcggcggcgactccggcggccagtggaggaactgagcggcggggccctccagttatcgatctatctaccatctcgtcgtcttcgtcagcaagttatcttcagtgtcgtcgtcgtcgtgttcctgtgtcagtcagtcttgantcgtgtgtgtcgttcggtcctgtggtgtttttgatcgctagctcgagtgtcnctctgtccggggttaattanagctggttacgcgacggaaagaacacatgtgtaactttcaanccggcctnttcgtcggtaatnaaaatccttcngtcaatggttggaatntnattttgnaccaattttgaatccatttaaatggttaacaaattca

SEQ ID NO: 82508 - DNA, 350 bp, Triticum aestivum
  unsure (1)..(350): unsure at all n locations
  Clone ID: PAT_TA_82508
aggaattgcaggggattgtatctggttcttgaaagtaggtagtgcgtatggcaccatacacaattcatttacaagttacatcgttgtatttgtagagcaagtacaacttaagcgcgtttacatggcaattttgcctatatggaggagagatacatgaaaaattgaagggagtggtctccgtgcaagagcctagctatatttgcgcttgtncgccanataaaatataaagaangttgattgagagaagatggaaaaaantactgctccttatggccaaccttattgttatgaaatgactaagtgttaagacatgggtaacatcatatagtaaccattaaccatgcctcctt

SEQ ID NO: 82509 - DNA, 549 bp, Triticum aestivum
  unsure (1)..(549): unsure at all n locations
  Clone ID: PAT_TA_82509
ctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacagttcgaggtggccgccgggcagtccggcgaagggctgcagctgcggcgacaactgcaagtgcaacccctgcaactgttaagctgcatgcactcctacgtatacgtntgatggtgttgagatatacgttaataacgagcgtcctgatttgatggagtcaacaattttcntgtgtgtgtnggttaacttctccgctcctccgttctaagctctgcccttgctgtncctgtgtgtaagttgtatgcatgtgtccctgtnattgcttaaccatctccactatggatggntgggngaaatatgttagatgaaaagattacccnaattnactnanaaaaaaaaaaaa

SEQ ID NO: 82510 - DNA, 528 bp, Triticum aestivum
  unsure (1)..(528): unsure at all n locations
  Clone ID: PAT_TA_82510
ccgccggcggccgccctcctgcagctcgacttctcctgcagggctgcaggctccagcctctgccggccgcctccctcccgcagcctggtgcccaccggccgtcttcggatccccttctgctcgccctcccgcagccccgtgcggtggtgcccgccgaccgcagcaaggaaacagcttaggacatggcaatggctgtggaggcgcgtctccggcaggagaaggtgaagaatttgaagattcgttgaccggcggctcaaagcctgacctccgttaacgccatacccagcgcgataacttgttcccagcagcagaagnattcttggtttngaagaagaacatcgaaaattttggaaaanatggtgtnacgagtatcgatttaatggtcaatccnttgggtcaaangttacatgcaaggaagaattgccngacacnaaacaatcttttgnggatattggccaagntttcangttgganttacttgggaanaggttngcatttaaaccgttaaaanaacaaggttggcaanan

SEQ ID NO: 82511 - DNA, 486 bp, Triticum aestivum
  unsure (1)..(486): unsure at all n locations
  Clone ID: PAT_TA_82511
gatcgccgagccttcaggagtaactcgtgcaacagcaagaacacggcgcctcccccctcgccctcggcggcgtcggcggcggtgtaccggacgtcctcggcgccggtggggggctccaaggacaacgtcggcgagcgcaaggcgctgctgccccggcgccccgagggcggcacggcccgcaaggcctacaagggccccaagcggcgggtgcagtggaaggacacccacgggaagaactcgccgaggctttggattccaacctaatgattcaagtacccggattatgatatttgatacttgcatatctcaatcatttaatacgncaaaggcttaatctccggtgcatcntncncaagtnggagattccantgtttttncaagacttaccttaangtntngcatttggctaanatcttttttanaaaaagttaatccaaaaggtcaaatactcangtttacaancaaggggggactacaaaggcggga

SEQ ID NO: 82512 - DNA, 512 bp, Triticum aestivum
  unsure (1)..(512): unsure at all n locations
  Clone ID: PAT_TA_82512
gcttttaaaaaatattccaaatatggtacctactaataaaggaaggtacgttcagctacgaaaagatttgtttttctattcgaggtggtactatctttttgtccgtttgtctattagaaaaaaaaatgacaaacctcgtacatgggccgcccacagtatggcccagcaaagacaggccagctactttcgtgtccatgcaggtgtaaaaaccctatttatcgcaacgagcattacatagtcataagttcgcacttggcgcccaagctgggctaaaatttattcttttttgtttgttttgtgttatgtttctatttttttttttacgattctttcttcatttctttgggatttttccctttcaagtatattttgtctcctttttttgtaaattcaaaattccccaaaaaacttcataatatcgtaaaaatccanttttttaaatgtgcagaacttttaaatatgttccatttccttttcnanacctactaataaacaaggacgttctctgattt

SEQ ID NO: 82513 - DNA, 545 bp, Triticum aestivum
  unsure (1)..(545): unsure at all n locations
  Clone ID: PAT_TA_82513
tttttttttttttttttttttttttttttttttttttttttttttttttttttttttttttaaaatgcaaatataaagtanattgaaaaagtgcatggaggnattagggacnanacacgttcgggnaanccncccacccctganatcaacncaaaacncnggggcacggngtgtgcacttanancaaaccaaaacattattgaanttgcaanancaaaanatcaagtcancanancactanccaanatactcanacaagttacnacgtacnaatacaatanancaacaatttatcaaacataaaagacncaancagaaacggcantaataaagcancagctganttcnagcagctagccagctagcgggccancccntgaacgcccggnnggtttacgnnccggcgcccggcgcggcgcccaanttgaggngcaacccntttcggggnccaaccgcgggccttganccccttgtacngcggcaaaacccgcatggnccaanaaaatggcnaaaaatccaaaaggncttccggaacctnanggccc

SEQ ID NO: 82514 - DNA, 524 bp, Triticum aestivum
  unsure (1)..(524): unsure at all n locations
  Clone ID: PAT_TA_82514
atcccgccgagggtccatttgtggcattacgacccatcaattctggaacatgatctttcagagatgctacgagaagcaattacaaggcctttgctttgtctgagaaaagaattacatgatcgggtagcatggcgtgtgattgtaatatgcttagtttgctccccactggcgttcttggagatgcggtccttattccatatatggtttcttgcgacgggtatgggttctgtgctaggactttgcacagcagtggtatcatcagtattaagatattcttctcgagcctacaggatggggaatatccatggaactaggacagaaattccctttacacatgcttattcccaagccaacaaagggattactgccatactaactggaccatatcatgcagacattttgggtctggttcctacatagaactaggtttctggggtaaaacaaacagcgacaacgttcaagggaaaacatacaancacaaccatcaaaagggcacacttagnaagaacaacaaccaaggatgg

SEQ ID NO: 82515 - DNA, 533 bp, Triticum aestivum
  unsure (1)..(533): unsure at all n locations
  Clone ID: PAT_TA_82515
taaattcctattgtatatgattcatgctagagagacggcagagtcaccgtatggaggaaagttagtatggcatcagattttatgtggtctgatgctcagacactactggaatttcttcattctattaatgaaatttcatttgatgatacatcatatgtacctgtcaagagtcattagattactacagatgaggtactgcagtaatgcctttgctctgtatgcctactgcgtaacttgtattctatcttatgatgctgactgattgattgtacgagatacgaaactttggtcaagattatgtgttggatgaaagtanttcaaccatatattgaagtggtacacacacataaggaaanaccgttgcctcctcacatgttacaccaaagntggtggtacaatgacggagaccaaggtcaaagatgagtggactangacaacttctacaggaatggnagatttaggcctcatcatccatngaaaaccgaagagagaagaacaccaatncatcaaggactgantcatttattaagaat

SEQ ID NO: 82516 - DNA, 518 bp, Triticum aestivum
  unsure (1)..(518): unsure at all n locations
  Clone ID: PAT_TA_82516
catccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaagttgttgaggtctccacctccaagactgggaagcatggtcacgcaaagtntactttgttncaattgacattctttaatggaaagagcttgaggatatcgttccttcatccacaactgttaactccccaatgttgaccgccaagattatcagctgatttacataactgatatgtatttanccttctaacngagaattggnacactaaggatacctaacttccaacnataattccgcttngcaatttaanatgntttgctgatgcaagactatctgccgtaagtcgcagggtaaaaaatttcgcnttaagancnggn

SEQ ID NO: 82517 - DNA, 511 bp, Triticum aestivum
  unsure (1)..(511): unsure at all n locations
  Clone ID: PAT_TA_82517
gagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtgggtgtcgacgagccccgaaatgtggcgctgcgcggatatgaaatccaccgtcgacggcacctgcngtgggccctgcaagaantactgatcggtcatgccaacatgatatttccgcctaaaatgaaataaaactcaaacnaaattacaagtcaacctgcccanncntgtgttttttggcaacaatattttacaattatgcctgtcttctcgcgtgttttcncccccaagaaattggggttcttgttntcaaaaatcccggancc

SEQ ID NO: 82518 - DNA, 535 bp, Triticum aestivum
  unsure (1)..(535): unsure at all n locations
  Clone ID: PAT_TA_82518
tcgagttttttttttttttttttttttttttttttttttgaaacagctgccaaaattgcatttacactcattcactcagtttacctctgttctgtacagctttaatgcgaggaattttttgataaatcaaaagaataaaggaagcacaacctagagagctaatggacaaactgtacagattaacagctaaatacaacccccaaacaaatgaatgaaatcactacatgactacaagaactaacacatcaggatatacactttacaggtaacggcgaagaaactgctccagagtaaagagccttaagtacagaaatgaacttcaaaagagtttcttcagaaaaccacctcagtttccaagtnagtactgngntattttcaaccgctgctngtccgncaatttcaangctggcgntaaatctccctcngttaagtgtttgtgcaagattaantcaagcatccctgtcgtgctgatcanaacactccttaatacggtggtagaacaacntcacnanagagaatatggnggggtgaacac

SEQ ID NO: 82519 - DNA, 542 bp, Triticum aestivum
  unsure (1)..(542): unsure at all n locations
  Clone ID: PAT_TA_82519
gacatattgccctgaccaagtgcaaccagtgcggccggcgctctttgtgttcggagacgggtttacggacgtcggcaacaacaactacctagagaacaacgaagtagggaaccctgtaagagccaatcactcttactatggcatagacttccccaattccgtggccaccggaagattcagcaacggattcaacttggctgacttcatcgcaaaggccatgggattcgagatgagccctccgccttatctgtctcttaatagtcccacaaaaatggatgccggttttgctgggagtcaactatgcttcggcgacttctgggatttgggagagacatcgacaccggactgggacatcccactggatggaccaagtngaagaacttcgccggacacgataggcaaatgggtgccaaccgttancagcaagacctgaacaagatttgtccaatccctcctcctcgtcaagaaccggacactgactctatcaatctacaacatcaacaacaatgggggtcaaacactaaaacaatttccacacncac

SEQ ID NO: 82520 - DNA, 229 bp, Triticum aestivum
  Clone ID: PAT_TA_82520
gctcagcgcagccagcctgcttgcttgcgtgcaagcccgccgcctgcctgcccgtccgtccgtgtgatctatgatcgcgtcgtctccttccttgccatcaccatgagtcgtttaagtttgcttcctgggtcgatcagtttgtggtgagttcgtggagctgtaaaaccgtggacgacactgtcaatttgcttctgtaaaactgtgaattcgcccgtccaaaaaaaaaaaa

SEQ ID NO: 82521 - DNA, 409 bp, Triticum aestivum
  unsure (1)..(409): unsure at all n locations
  Clone ID: PAT_TA_82521
ccgtcgctcactgtcgctccaaggaggaagcggcagaggcggctcggctcgcaaagttgaatcagcaacaggacagggccgtccgccggatgaaggcgcaggcgacgatcacagctccatctcttcctccgacaccaagatcctccaccagccacggacgcctacagctacgccggtgaccggaaggggaatggcccggcgaggaagtggtgaagacgctcctcctcctatgttttatcgattcacatgttgaagttaagaacttgtcccgtgatgaactcccatgatcttttgggatgatgtacatccgtttatgtgcatttgcttgtccgtttgatgccgattccgtttggcgttctttgatcacgtagattgctcctacnttgcatgttttagtaaaaaaaaaaaa

SEQ ID NO: 82522 - DNA, 506 bp, Triticum aestivum
  unsure (1)..(506): unsure at all n locations
  Clone ID: PAT_TA_82522
tttttcttctttctgcaaattgcaactagttagcctgcgaacttgtgtgcaccatgggcatggctgagaagagctcggcgacgaggaaggccgggctgattaccaagacgctggacaggtgctggagcacaccaatgaggaacaagcccgcagagggctgtttctctgtctacgtcggtgctgggaggcagcggttcgtggtgcggacagtgtgtgtgaaccacccgctgttccgggcgctgctcgaggangccgaggaggtgtttgggtatgcggccgcanggcccctcnagctaccctgcaacnccnanatgtttgccggggtgttggagcaaatcgaggaggagaagcanatggcgggacgaaggaagtgcggccttgccagggggaactcctaccggctgcttggnaccggtcgggctgtcatcatcgatcggtcntangatatcattanattgatgatcccanctgataactctaattttgttaacnccaatcngggaana

SEQ ID NO: 82523 - DNA, 502 bp, Triticum aestivum
  unsure (1)..(502): unsure at all n locations
  Clone ID: PAT_TA_82523
caacaattgaaaaagatagtgaatgggccattgttggcgggacaggtgagtttgcaatggctcgtggtgtcatagcgagaaaagtgcaatcaatacaagatggagaaaggcacgaactaactatcgacgcgatctgccgcatgaagaaccaacccattcatacaaagcttggaccatggggtactcaagggacaaagaaacatgacattcaggataaacctgcacatctatatagtgtggaaattcggtatggcagtctcattgatgcgatctcattttcctacattgaccaatctgggcagtttcggacagcaggtccttggggtggaagtggtgggaaagaaactaagatccaactaggtcccggtgaagttgtgaaggaagtatcggggacgtcgatggcggtttcgtatcctcacttaagctggtcaccaacatcaagaacatatggaccttttggagaaaaacgtgnacctccttcaacgcacccgtgcccctgaat

SEQ ID NO: 82524 - DNA, 505 bp, Triticum aestivum
  Clone ID: PAT_TA_82524
cccagcacgacgcccttgttcctcgcagggccggcggccggcgaccgtgtctaattccttctctcatctcaggcggccggcgatcgtggctaattcgttctctcttctccggcggctggcctactgcgacaacccagcagtacgccccggcgaccggtgaccggcgcggctaattcttctccggccttccctcatctacggcggctggcccaacacgccaatcatcctctgagcattccccatcggattggtactggatctaagtctgaaggtttgctggtggcagtaaagacatgtgaaggtttcataaacaaagactactgcaggatgtttggagttgtagtggtgcactgatacgttcttcagcttgtactccagttatgtccgatatatgaacgtgagatttactatgactgttaatggctaatgagttagtgatgtgtctgttgtaacgaaagacctagcataatgcggttaactactgtacgtgtcaagttgtaacaaa

SEQ ID NO: 82525 - DNA, 456 bp, Triticum aestivum
  unsure (1)..(456): unsure at all n locations
  Clone ID: PAT_TA_82525
gcgcagcatattggttgcctacttggcaaaggtggatccataattgcagagatgaggaaggtaacaggagccagcatccgaatttttgggaatgaacaaattccaagatgtgcacaacgaaatgaagagctggttcaggtcaccggtagctttcagtccatccaagatgcattgcgtcatatcactggaaggattagagatctcatcattcccccgaagccacatcctagtggaggcatgcctccgtatccacctgttgggaacccttctcatcaccaatcaagacaagaagctccaccacatcacagtggangcatgcctccctatcctaagcatcctttcagacctaatcctcctaagggtccttttgatgtggcagatcatcgaccacctggccaagctctttcacatccaatggaancatgggtgctgataggatccctanccgtntggtgg

SEQ ID NO: 82526 - DNA, 489 bp, Triticum aestivum
  unsure (1)..(489): unsure at all n locations
  Clone ID: PAT_TA_82526
aagaggtgcagtttgagactttgcctgtggtaaagtctcaggacatattcacgtttgtctttccaagagaaacgtgcatgacaccatctggtttgtggccaggctatgttgtggatgcaacaccagaatacgttttctttatagactgcccttgtcatgaatacgcagcatttgggtctcccgtgtttaatgtacgaggccagctggttggaatgtgttatgcatttcagagccgcattcatacttgggctgtgcgtaagctgaaatcttacttcgataagtatcttgatgaaaaacaatcgggaaggatttgttattttaaggatggagtccaaatctccggcaagaaaattggtttgcctgagtgacatgttgtactccctaagacatctatctactagctgctaaaaganggcctatcaaaagtgcaaaaacatgcttccnataattatccnaaagttgctgctatagaagtctaagacatataac

SEQ ID NO: 82527 - DNA, 498 bp, Triticum aestivum
  unsure (1)..(498): unsure at all n locations
  Clone ID: PAT_TA_82527
ccggttcaagcacggcgtgctgagcatgccgacggtgcccgtggacgactccaccgagtacatgttcctcaacatgatggcgttcgagcggctgcacgtcggcgccggcaacgacgtgacggcctacgtcttcttcatggacaacatcatcgactcggccaaggacgtggcgctgctgagctccaaggggatcatccagaacgccgtgggcagcgacaaggccgtggccaagctgttcaacagcatctccagggacgtggtgctggagccggacagcgcgctggacgccgtgcagaggcaggtgaacggctacttcaggcagccgtggaacatgtggcgcgccaacctcatccacacctacttcaggagcccgtgggcgttcctgtccctcgccgccgccgtcttcctcctcgtcatgaccatcatgcagaccgtctacacggtgctgccgttctataagccggacagcaacagcccgccgtcgntcatctccgatgt

SEQ ID NO: 82528 - DNA, 455 bp, Triticum aestivum
  unsure (1)..(455): unsure at all n locations
  Clone ID: PAT_TA_82528
attgagacaaaaattgatggtgttaaaactttaaacagatgatccttcgatatttcctgattattttgtaaagaattggggtgtttagtattccacgctctcactaaaaatgacaagagaacttgtgtagttgcaatgtgaaattctcctcacctatccacgtgttgttttcagttatatttcaagctccttacaagctgggaaacaaaatcttgaattcaaaatgtgcttatctgcccatgatatggttaatagtcattgcagggcggtactgcattctctttttgacatgcctcaaaaggccaaaccaatttgttgttacctttcttgcgcttggattttattctagtattggtgcctcattttgccataaaccatgtgtacatcactttgctaaaattgtttgtanaccttcagttgcctcgcatgctanagaccgatgctgttgcncccaa

SEQ ID NO: 82529 - DNA, 474 bp, Triticum aestivum
  unsure (1)..(474): unsure at all n locations
  Clone ID: PAT_TA_82529
gagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgcttcgcggatatnaaatccaccgtcgacggcacctgcggtgggccctgcaagaagtactgattggctcatgccaacatgatatgtttcgcctaaaatgaaataaaagctcagacaagatgagcaacgtcctcgtgnctaancntgtgtgtgtggccacaaatatgttaacaattagncntgtcctcgtccctttgtttcn

SEQ ID NO: 82530 - DNA, 472 bp, Triticum aestivum
  unsure (1)..(472): unsure at all n locations
  Clone ID: PAT_TA_82530
cacgtgtccgcgcactacacacactcgatggtctggctcccggctagcagcccccggtggcgcgcgctacgcaaggtgtgctcgggtgagctcttcgcgccacaccgcctcgacatgcaccagtccctgcgccaggagaaggtgcaccaactcgtctcccacgtgacgcagctggcacgagagggcgtcccagttcacgtcggccacctggcctttacgacagcgcttaacctactctcctccaccatcttctccaccgacttggccgacctcgacgaccgccatgtcaagcttggggagttcaaggccgtgctcgcagagctaaacgtgaccgttggattancaaatctgtcagacttcatccctgaagtggcgtggctaganctgcaaggagtgaggagactatccgagggcttgtttcaacnggtgcatgcatgatggacgaacacatcagcntcacatgcnggaacgt

SEQ ID NO: 82531 - DNA, 467 bp, Triticum aestivum
  unsure (1)..(467): unsure at all n locations
  Clone ID: PAT_TA_82531
tttttttttttttttttttttttttttttttttttgattaagctgcaaacctgtattttaataatgcaatttcctttcagcgatacataaaggatggctcctgaattaagcactacagatatatttgctctgtgccaaaatcctatcacactaccgacaagtgttgctataccaacaactgctatctttcgacacattcgatctggatagtcagatcttgaaccccagcttcttgaaatatccgtgaagcactttctcttataacagacttgtcagcttcagctgatatatgaagatgaaaagtgcctacaatatcagtgtttgtcaagttccataaatgaacattatggactccaatcacaccattnatctcctaacatcatccaagtgctgctcgaagtccttctcaaggntccttgggaacccttgcaacaaaattcagcaagaattctcaacaatggganggg

SEQ ID NO: 82532 - DNA, 348 bp, Triticum aestivum
  Clone ID: PAT_TA_82532
gcgccgatcaccctgctggaaccaccaacaaggagaccatcagcaccgagtccagtctcgagatcagcatcactttagagtagccatttcaattccattcaggactcagtgcacactacatgcgtagggtagaatgatttgttcgtaagcgacctaatcctgggtattttgtcactagacaaagatgttcaacccatttcaggcagtcttttagttgccctgtcttcagaaacacatggcttggagatgaacagagcttcagacatagcgaggattaatgaaacattgcagatacttgtctgagaatcgaggaggtcctcttattcaagggattttcaaagaaaaaaa

SEQ ID NO: 82533 - DNA, 481 bp, Triticum aestivum
  unsure (1)..(481): unsure at all n locations
  Clone ID: PAT_TA_82533
acgacttgattaaaggcgttcatatattccacaagatctgacccttcctgcatcctcatctcatacaatttttgcttcagatacaccttggtcgtcgcagtcttggacataaactgactttccagcttctcccagatcttcttcagcgaattctcatccatcacatgataaataacctggtccgacagacacaaccgtatagtctcggctacttttaactgtaactcctcccagtcatcagcctccatcttagctggcttggcttcctgcaacaacgccttcaagcatccctgttgtgccaacaaatcttttatccttgtctgccataacccaaagcttccagttccgttgaatttctccacctcaaacctgatacccgatggcgccatggttctttgtacagctgactccatgaaaaataaccgagcagtcttcctgtnatcccaagtacacgaatagaacgtcgcgtactgctgcaatc

SEQ ID NO: 82534 - DNA, 521 bp, Triticum aestivum
  unsure (1)..(521): unsure at all n locations
  Clone ID: PAT_TA_82534
caaagctncgggggggcncaagggaatcaacaacgggagccaagcaaccnacnccaccaatggggtnatccccgccgtngactccaatngcaacaaagccgcccggggccaaccgggttggggaaagcaagaaaggctttgggaggaaagaaagcgaaaagtatgaagctcggcccgccagccagccaacactaagctttcgagcaacaagacagtnaggagggtccgtgttcgcggaggtaacgtgaagtggagggctctccgtcttgacactggtaacttctcatggggtaatgaggctgtgacccgcaagacccgtctcctggatgtggtttacaattcgtcgaacaatgagcttgtgaggactcaaacccttgtcaagaatgccattttgcaagttgatgcaacccctttcaaacagtggtacctgactcattatggagttnaaatccgttggaagaagaaagctgctgcagctgccaagaaaggaagcttcttaaggacaagaagctgaggtgctc

SEQ ID NO: 82535 - DNA, 501 bp, Triticum aestivum
  unsure (1)..(501): unsure at all n locations
  Clone ID: PAT_TA_82535
cctcagctctcatggcaccccagcagcagctcctcctgctgctcctcctcctggccacgccgttgccgcggccggccgccgccgacgacggggccgctgggcaaccgccactggtgcatccgttcttctactactctcctccgccgccgtcggcgcttcctctcaccgtcccgccgccgacgccgacgccgacaccgtgcagctgcgggccgatgcagtcgcccaccactgcttgcaactgcgggaggatgccgccgcctgggatcgaccgccgcagcccgccggccgggcgccacgggctccattccgggtcccacgcgcagaccggagtgcagctccatccccggatgctctgcgctgtcgccgccgcacttctcctaaggtggtgctaatcagtcgctgctgtgcactcagatttgtagtgcgtactactggtgctatgcaatactactngcatgcntaattaggacangggaattcatcagattccgcgaggatatn

SEQ ID NO: 82536 - DNA, 194 bp, Triticum aestivum
  unsure (1)..(194): unsure at all n locations
  Clone ID: PAT_TA_82536
gggacaacagcgtngccaggttcgcncaggactanncgaacaagcgcgccgccgactgcnggntgcagcactccggnnggccgttcggcaagaacatcttctggggttccgggcagtcntggncggccgcgaacgccntgaantcntgggtggactacaagcggtactaccacctcaacaccancacctgcgac

SEQ ID NO: 82537 - DNA, 501 bp, Triticum aestivum
  unsure (1)..(501): unsure at all n locations
  Clone ID: PAT_TA_82537
agagcagctccatctgcccctgcagctgtccctgccaccattttggtgcagccccctcagccagtgcaggtgcaggtacccgtgtcagtccctgtcaagatggatgactcgctaccagcactgccccaggctccaatgcctgtgacagtgaccatggagggttccgagccactcaggtttccaagtcatgtcacctcagtcaggaattgtcgatgtcgaagaagaattttctgacgcctatgtttaaggagatgattcacgcagtggataaatatgggatccagtccgtttgggtatgaaacttcctgagccgccacacggcttgcctatggaaggggagaaatggagaaacagcgaatcctgggagctggaagtgtacttgaagcggattcgaacggctgcaagacaagtgaaggcacactngaggactcaaatcctccacacctangactngaggtttttaagttaggaacggatacggngtcccccaataanaaatcn

SEQ ID NO: 82538 - DNA, 489 bp, Triticum aestivum
  unsure (1)..(489): unsure at all n locations
  Clone ID: PAT_TA_82538
ctcgccggagaaagaagcgtcgacgatgtccggccgcggcaagggagggaaggggctgggcaagggcggcgccaagcgccaccggaaggtgctccgcgacaacatccanngcatcaccaagccggcgatccgccgtctggctcgccggggcngcgttaancgcatctcggggctcatctacnaggagacccncngcgtgctcaanatcttcctgganaacgtnatccgcgacgcggtcacctacaccgagcacgcccgccgnaagactgtcaccnncatggacgtcntctacgccctcaatcgccagggccgcatcctctacggattctgcngctaagccacgctaatcnatncccccaccacnatatttgtgctcntanctanctatggctgtgtatcaatggcttcgntgtaatngctgcatctctctgctgtatgtcctggccntgactgttgttcctttgatgtantaatcctgggatnaaattg

SEQ ID NO: 82539 - DNA, 483 bp, Triticum aestivum
  unsure (1)..(483): unsure at all n locations
  Clone ID: PAT_TA_82539
caacaacgtcggggtcatgatcgtgtacatgattattataggtgatgtgctttctggaacgtcctctggtggtgagcaccactatggtgtattagaaggatggtttggtacacactggtggaatgggcgattctttgttctcctggttactactctcggtgtatttactccactagcgtgtttcaagcgtgtcgattcactgagctatacatccgccatatctgttgctttggcagttgtattcgttgttatcactgccggaattgctattgtgaaattgatacacggncaaattccgatgcccaaattgttccctgganttccngnatttggaaccggccgggaancttttcacagcagtgccagttcttgtcactgcttaagtttgncattataacgttnaccaatccataatgnaccaaggatcttccaaatnaaagccaataatgcaccatcactggntccaagccaacngttaaacaa

SEQ ID NO: 82540 - DNA, 517 bp, Triticum aestivum
  unsure (1)..(517): unsure at all n locations
  Clone ID: PAT_TA_82540
gcgaagtgcaggatctgccgccagtactggagacaccttgtcaagcaccacagctacgcagatccaagccgctgtcgcgcacccagtcatcatcgccagtcatcgtcttcttctgcagcaacgacccaatctcgtgcgtgggtggagtcgacaagcgccggtttcttcttcctcaacgacggccaccaattccgaatcccaacagggtgaagaatacgaacatctagagtacatcattcgaggaccaccccctgctatccaatactgcggagagcttgaaaagtactgtcactggggcaatgaagtgaagctctatcggcgccatgtggacaagttgtatgcaatgttcccccgcaaaataccagatatcaaatactatgtctgcaccgtcaacaaaacattcgcacagcaagggcaacggatgtattttcaagtccactacaccaaaataaaactgaaaaatacattaatccagatgatgacatgctcaagncaagctcgcaaacagtatctgcca

SEQ ID NO: 82541 - DNA, 298 bp, Triticum aestivum
  Clone ID: PAT_TA_82541
gaaggccgagaaggcgaccggggaggtgatgccgctgcagcggtggctggacccggacaaggacctggcgtccactgtgctgtacctggtcggcgacgactcccgcttcatgacgggcaccaccatctacgtcgacggcgcgcagtccatcgtgcgccctcgcatgcgctccttcctgtaggtaggtttgtcatgcctgtcctgggactggttgaccatgtctggatttccactttccatcaggatgactcctgatatgttgttgttgaataacagtggtttgtgcaaaaaaaaaaaa

SEQ ID NO: 82542 - DNA, 461 bp, Triticum aestivum
  unsure (1)..(461): unsure at all n locations
  Clone ID: PAT_TA_82542
gcgaccttgttctgccggatctcgtccttgagctatgctacgtcagtgtggtccgcctggaaattgctgccccgaatcgctttgcctctgttgcgctagctgcagcggtgcactgtacgttgtacactgcctcttcatgttggcccccgtttaactccaccaaggtagccgagaggaacggggcatgcaaatcctgctggactcaagcttgctactctgcaaagctaagttgttgttcttgctcatgtgatttttgtctatcggtgctggtcacaacatacgagtgtccatacccaactaatcaactctgatcaaccaaaccattgagtgattgcaactagctaggaacatgcgtgtttgtagctgctatcaactagctagctagttagctaattacgttgctgcataataaagcacaaccaaacangtcacagtattcccaatactgcaaaaaaaaaaaa

SEQ ID NO: 82543 - DNA, 292 bp, Triticum aestivum
  Clone ID: PAT_TA_82543
cttacgtagtagtattaggaagtgtgtgatagcttcagctgtgtgtaaatcatgtagtgtgcttgcactgttaggacactcaccactgaactgacgacatgttgtaatcggactgacagatcgaacgacgtccctctctctctctctttctcgctctctctcgcgtgcgtagcgcagaagatgcgggcgaagtgacggtgagcggcgagctgcatccggtagcggcgccggatttggagcaaaggatagagtggagggttcacgcgacgacctctgaaataaaaaaaaaaaa

SEQ ID NO: 82544 - DNA, 256 bp, Triticum aestivum
  unsure (1)..(256): unsure at all n locations
  Clone ID: PAT_TA_82544
caangacaaggccgctgctcacttnaagggtggtgccaagaaggtggtcatctctgccccaagcaaagatgcccctatgtttgtggttggtgtcaatgangacaagtacacctcanacgttaacattgtctcaaatgctagctgcaccactaantgccttgctcccctancaaagatntttnaatgnnaaattcccnnttatttnggggttnnttnccacagtttntnccatcacaggnacacaaaaaaacntttt

SEQ ID NO: 82545 - DNA, 439 bp, Triticum aestivum
  unsure (1)..(439): unsure at all n locations
  Clone ID: PAT_TA_82545
aactggaataacatancgcannattcncacaagatgttngtttaccacacangnncaaggataacaaannancgatgtcnngttcaacacaanttgctggtacgggaaanaactaanagtaaagatataatacatctcaaggcacagtcgcgaacanaatctaggcaacaatcacgacagcgccgccggnggacttgatcttcttctcgganatcttgagagatgagcttggccttgaaggacgatngncttctccggcagatcnccttnccgagcaccttgaagtagccgaactgnnaaacgtcgnccacgggggggcttgncaacaaccggncctctgccgcctnctcgcaagcttggttgaatatgccncgacatcctaaaggnnaatgggngtcaactcttcaaanacgcacngtcctcctaacatcatgcactg

SEQ ID NO: 82546 - DNA, 469 bp, Triticum aestivum
  unsure (1)..(469): unsure at all n locations
  Clone ID: PAT_TA_82546
gagaaatgcccgcgcgccgccgcctcgccatcgccgccgttgctaaatcccacgccacgctgctcaagtccggcgtcatctcccccacgccctggatcgaggtgaagaatgaggtgcactctttcaatgcagaggatggatcgcacccaaggatggatgaaatatatgagatgttgagtttgttgcttcacaattttcctgtgcagcctgtgcatcaagaaacaactgggagccatcgactggctaactatcaaattatgggattaaccaancagcccctgttggagatgattgacaacttcnctggnaatcccggnggttganattaaccgccccgaatgcaatgggaatgaaaccccgnttcaaaatttnaagggnacggttttggngnctttggnaatccaggtnaaatccaatggatttttcnatgggaananttgttnaacttaactttccnaaaaaaaaaaaa

SEQ ID NO: 82547 - DNA, 528 bp, Triticum aestivum
  unsure (1)..(528): unsure at all n locations
  Clone ID: PAT_TA_82547
ctgagttcctctcgtccttaaaggagttcggacaggccgagatcgacgcggcgccaatcagaaagcataccagatccagcagcttttggaacctggtgcacaagaccgtcgactctcaagcctccgattcaagcacacccgagcggccactcagccctcacagcccgctccaccaatctcctctccacaagcagtacatgagaaggctgcagggcattcacgccacaccgagtatcagaagctgatcgtcactggagcaccaagaagaccgaattcgccatcggtctccaatgtccgaagatcgcgccagcgtctcggnctacttcancttcgttggatcacgccgtccgttcgtcncctatcgctcaagacaaaagcaagacgaacaagaaganatggccaatttcgggtttcgacaatacttcnccaacatttggaaatgacccaattcaacgttatntgtgcccggatgaacaccttcnacaagcatcaaccctcnaagtcaaagatgcggcatcgccgcanaat

SEQ ID NO: 82548 - DNA, 554 bp, Triticum aestivum
  unsure (1)..(554): unsure at all n locations
  Clone ID: PAT_TA_82548
caatgatgcgcacacacatatatctacagttgctgctggcactctcggctacctcgaccctgagtaccatgcaactttccagctcaccatcaagacagacgtttacagcttcggcatcgtgctcttggagatcatcactggcaagcccccggtattgatggaccctcacacctaccacctaccaaactgggtacgccaaaagatgcaaaaggcatattcaaagatatccgtggacaagaggctgttggttaantacgacgccaatccctgcaaagcgtggtggaccttgccatgaactgcgttggagagtgcagcatcgacaggccnagcatgaccgangttgtgtcaaagntaaagtgttgttgccaacactccaaagccaaaaacagtagcttccccntcttccangaattccatgattgatgaatgcnaagngtncanctgttntnctgngaaangcaacaaggaaanccaaannctccatncgggnatacaatccggataaacacggtccctaactggncgtgaaaggaatggcaacgantattgtgcgn

SEQ ID NO: 82549 - DNA, 549 bp, Triticum aestivum
  unsure (1)..(549): unsure at all n locations
  Clone ID: PAT_TA_82549
ctctccttctcctacctcaagttccaacacccaaggcttcagccaaaacactccaaactcctgaccatgtccggatccagccttcaaggccggtggatggcctcctccgtcacagaggaggatatcaagaagcttagggcggcgaggtacttgacagcggaaattccccacaggcttcctgctcaagggcaggttatccctactcccaagtccgaccagtgtgttgtgtttatctctcatttcctctggagggctaaggctcatcttcatcccttccgttaagagggtcatgntctattatggggtaatttcaatgacctagctccggtccttccttcacatctcgcctttancatccgtgtgcgaggcttcctccgcattgtgtacacttcggttaaggttnaaacctttaagntacatcnaanatnataaacnggaaaacncggatncggaggggcaagaataacaattgccaacctttttgggnaaaggtcctcccanangttccgactgtgggaacggatantttcanacagctccaaggaaaaa

SEQ ID NO: 82550 - DNA, 550 bp, Triticum aestivum
  unsure (1)..(550): unsure at all n locations
  Clone ID: PAT_TA_82550
tttttttttttttttttagacgaatatatttttttgcaagaaaaacttccaatcaattcatcttcaatcatggtagtacaacgaacactagaaataataaaagttacatccagatccgtaaaccacctagcgacgactacaaacactgaagcaagccgaaggtgcaccgctgtcatcgcccctccattctttgtcccttctctccatctcctgggtcagggccagttgcaatctaaaccctttggcagtcggcaccttcaaaagctgttgacatttgtccggacagcaaaccttttactgaagtactctttgccacctgggttatccntggggttcaaggacancaagacagaaggngggactaagaacagatacaagagancggatcctttgataatatcaacgatagnattcccagatccataaanggtnggccaanggcangccntgaacaatttatgggcgcacttgtttaacgccncaanacaattctccaaactggncccngggtaacaaggacncacctggataaaggananatanggccntt

SEQ ID NO: 82551 - DNA, 535 bp, Triticum aestivum
  unsure (1)..(535): unsure at all n locations
  Clone ID: PAT_TA_82551
ccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcactttgttgccattganatctttaatggaaagaacttgaggtatcttccttcatcccanaactgtgactcccccatgttgaccgccaaattatcanctgattgacataactgatgatgggaagntaaccttcnaactgaaaangggaacncnaaggntgacctgacctcccaccgaananttcngcttggcaatttaaaaacggntttcccgaagggaaaggctntccgntcgtaattccccaagggngaaaaanattttccctttaagaatccgggggggnatn

SEQ ID NO: 82552 - DNA, 535 bp, Triticum aestivum
  unsure (1)..(535): unsure at all n locations
  Clone ID: PAT_TA_82552
gccaatggtcttctcctagcagtagaaacttccctgccaaagcaaaagaagtcacaagctgtttcagagttcaagtgttctgttgttttacataaaaggcgggctaaagtccaacaagagcctgaccccccagacataccaaatgatgtgcttgttcatatctttagttttctggacacgcgttcgttgggtggctgctagtcttgtttgctggtcttgggaattcatctgcaaacgacaacaagctgtgggagaatgaactaccccttttccttaacacncccatttgcgctccaaatacacgcttgtctccaangggtgtcttgcacagaatatgtggttccanatttgatgattccaatttgaactggaaagagttttcctacaagaagcatgcananacataactggantgccgcacaaataganatatgccanaatgcntcanttctccnggctgacaacttnaccctgcnccctcacatggtcctaagaaaggnaaagagaaataaactaagcctgttactnagcaatg

SEQ ID NO: 82553 - DNA, 555 bp, Triticum aestivum
  unsure (1)..(555): unsure at all n locations
  Clone ID: PAT_TA_82553
gcgacgatgtcgagctcgtcgccgtcaacgaccccttcatcaccaccgagtacatgacctacatgttcaagtacgacaccgttcacggccactggaagcacagcgacatcaagctcaaggacgacaagactctgctctttggcgagaagccagttaccgtctttgggcgtcaggaaccctgaggagatcccgtggggtgaggctgggtgccgattacgttgtggagtccaccggtgtcttcactggacaaggacaaggccgctgctcacttngaagggtgggtgccaagaaggtgggcatctctgccccaaagcaaagatcccctatgtttgtggtttgtgtcaatgaggacaanacacctccagactttacattgtcccaaatgctaactgcacaactaacgccttgctccccctaactnaattcattnatgacacttccgtattaatgagggttngatgacacgttcaanccatcacngcacacaagaaacgtnnatggcctccaacaaggcgganaatgggaaggcgcaagttaaatcatccaacaacatgg

SEQ ID NO: 82554 - DNA, 417 bp, Triticum aestivum
  unsure (1)..(417): unsure at all n locations
  Clone ID: PAT_TA_82554
aaggatctgaattttcaagctcagcaaggcctgcatgttgcagtctgtgggacggccggctctggaaaatcaagtttgctctcttgaatggtatggttccaaagctattaggagaggccaagacttgcggaacaatgccatatgtcagccaagactgcatggatacaaagcgacaaaattcaggacaacatactgctctgcaagaganttgagagggagaaagtatggcagggccttggagtggtgttcgctaaagaaagactggagattaagaancattggagagtgatccncacccttantgcctggcaanaagcaaaggacccggatacccggacattgtancantaagctgacatccnatttantccaangatccgtttaaaccantttaaatacagggtnccatttttcaaa

SEQ ID NO: 82555 - DNA, 524 bp, Triticum aestivum
  unsure (1)..(524): unsure at all n locations
  Clone ID: PAT_TA_82555
ccttccagaaggttcttgaaccagtttttcacagtttttctttttctttttctgtttcttttttttctttctttgtttttctgtttctttagttcattttcaattcctttttcttctctttctatttcctttttgttcttcagattttcaaattcctttctgtttcttttttcatttcttcttttttcgttttttctgtttgttttctttctttggtctcttatttctttttcttttctctctatttttcaaaatattcaaattttggttgcctttccataaaatgttcagtttttttcctaaaaatgttctcaaaattcaaaaatgttctccgttacaaaaaaagttaaaacttccgaaattaatataatgtaccaagactttaattttttggtcccattttcaaaaaagttcaaccttccaaatggtcgggattttcaaatgggtctctgttcaaattttttctcaatattaaaaaaagttcgtgctttaagaaatggtcgcgctccaaattggtccaaaan

SEQ ID NO: 82556 - DNA, 478 bp, Triticum aestivum
  unsure (1)..(478): unsure at all n locations
  Clone ID: PAT_TA_82556
gtcctgaaaaatcttttaattgcatctgtcattccacaaaatgaaggaagcatccatgaaatgaaggaagcaatgctcgtcaagctaagtcggaactccatcatcacatgtaataacctgaactagatcatgctgtgaccatcctcgctctccctacatgtgtgcgtcgtcagtgcaggcagagatatgtcttgatccattttctctacctgtagttgtcagtaggtatttttattccgcctactaattttgcaaaatgtcccttgggctctgaaaccatgtccgtgtgtgtgacatgtgagtgagagcgtttgtgttggcatagcctgtccgtgtgtgtgtcgttgggcattgggcccggatangagtgtgttaacctggcaagtgttccncatcccctcacgcatagcangcaatgatgcctcccnggcaaactgggctaattnaggagacaatgaacgggtgacatgagatctta

SEQ ID NO: 82557 - DNA, 409 bp, Triticum aestivum
  unsure (1)..(409): unsure at all n locations
  Clone ID: PAT_TA_82557
aatggtaccactctctgagtccgagcctgagctcttgtccgagctgacacgatgtatccagattgggctcctctgcatccaggaaactccttgtgacaggccgaccatgtncgccgttggttcccatgttgatgagcacgacgtcgcaaatcgaccggccaagaagaaggccacctttgggattgcgaaggattcatgccttcaaattcatcaaaatggcnncaaaaccaaaccttgagatcaactacgattgattgacgttagaacaagtcggccacttggttgcctcccttggctagcaatccgatttaactaaattcctagtangaattgctttttntcccgtgggctttttggggtacccacggtacataattcttaactctctaaaaatgtcngccttccctaa

SEQ ID NO: 82558 - DNA, 488 bp, Triticum aestivum
  unsure (1)..(488): unsure at all n locations
  Clone ID: PAT_TA_82558
cccatgggctgctgctggtgctgagtacgttgttgagtccaccggtgttttcaccgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctcttgctaaggttatcaatgacaggtttgggcattgttgagggtttgatgaccacagttcatgccatgactgcaacccagaagactgttgatggccttccancaaggactgganaagtggaagggctgccaacttcaacacatccaancaacactggtgccgcaaagctttggcaaagtgctcccaaagcttaacggaaatttactggaatggctccntnttccancggtgnagttccgttgttgatcgacgttaacttcnaancc

SEQ ID NO: 82559 - DNA, 322 bp, Triticum aestivum
  unsure (1)..(322): unsure at all n locations
  Clone ID: PAT_TA_82559
ctgctgtgcggcgtcgacgagccgccgccgttctggccgtgggcggatcaccagcagttcaactgatcgcccggtcggtcgatcgggacgatatatatctttgttgcagtcaatgacgtctgctttgcttgcatggtcagcaatgagcgtgcataaatattcgatgcgtttggattcttgatgaaggacgtacgtacggtgggagacggttgtacatgcatgtttgatgaagaggcaantcagttcanccatgaggaactactgaagacattgtatgcatttgagncatgnttcaattcgagtttgatnataaaantggggg

SEQ ID NO: 82560 - DNA, 458 bp, Triticum aestivum
  unsure (1)..(458): unsure at all n locations
  Clone ID: PAT_TA_82560
ccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgactgaacttccaactgatatgttctgcttggcaaattaagacngatttgctgatggaagncctatccgtcggtgatgtcgcaagggtgaaa

SEQ ID NO: 82561 - DNA, 475 bp, Triticum aestivum
  unsure (1)..(475): unsure at all n locations
  Clone ID: PAT_TA_82561
gattcccgaagatcataaaagcaaaaaatgaaagtttgggaaagtccttttattccctctcatttaactttcaaaaggattcgaattcactcactttcagtcaatcaatcaaacaatcaatcaaaactatctatttaatataacattccaaaatttagaattttgggatgttacattgggtcgtggcaacagtgctgccgtctatcgggcgatcaccgtcgccattccccatcttatctggttaatggcacatggggccctagggaggagtcggccgactctagggaggcagactcccacaggtccgtctttgggcgcccaggccgccttcggcccacccactgacaggcggccgcgccgccttcgggtcgtacaggctgggcatcatgggcacagtgtactgcgcactgtggctgangtcaaggtaagcatggcaacaatgccgcgcctcgtcggagatnttccancgatacgg

SEQ ID NO: 82562 - DNA, 427 bp, Triticum aestivum
  unsure (1)..(427): unsure at all n locations
  Clone ID: PAT_TA_82562
ggtggaggagcctcagctgtcttctgcttgcaagtttgacatccaccgcgagccgttctgcatgtagaacccgcgtccgggttcgtcgtcgttctgcactcgacgattaccacctacacggctaatcatcgaccgtatcgagatagccgatcagtgggacaaataactatgatgcttgctgctagtatgtgtgatagccgatcacctcaccagccgccatgacatccagaatgagcatagctcatacaaggctctggaggaccacgttccctactgtactgtacgtctgtatctacgtacctcactgtaataaggctgttgtggtgttgtgtgtcgtctcataccctatcaaattatatgctgcttcatcttcaaaagagatgcgtaaaagcatccaaattgtgggnattatgttaaaaaaaaaaaa

SEQ ID NO: 82563 - DNA, 498 bp, Triticum aestivum
  unsure (1)..(498): unsure at all n locations
  Clone ID: PAT_TA_82563
ctcaaaaaggaactccaaaagaaagaagaagagaaatagcatatggttgataatttaataaaaatcgatacggatcttcaaaacattcaagaaaaacaagaaatttaaaactaaaagtagcagtaagagcttaaggaagaacaatagaacaagactaatgaatagcaaaaagaaaaccatggcttcaaagattaaaagaaaataaaagaaagtgaaaacattctggagaatgagccagtaatccgttgtaaaacaattggcatatccgtccgaaatccgaagaagaggcactccaagaaataaatatccattccaacacagcaaagattgaacaaactggttttgcatacatcaacccctttagtttacgattnatcccagttatagcaagagcaacacaaatttagtccaagaaacagacagaaagtggttttaaagctacaacaaggtaatccagtttagtgaccatggaaagttagcacaacagttataactccc

SEQ ID NO: 82564 - DNA, 417 bp, Triticum aestivum
  unsure (1)..(417): unsure at all n locations
  Clone ID: PAT_TA_82564
gactcctggtggccctctggatctggcaaccgtactgctaggaaaccgtataatcttcattggtcaatacgttaactcgcaagtggcacaacgtgtgatatcacagcttgtcacactttctgctatagatgaagagggtgatattctgatatatcttaactgccctggcggaagtctctattctatcttagcaatttatgattgcatgtcttggatcacaccgaaagttgggacagtgtgctttggtgttgttgctagtcaagcagcgatcattcttgctggtggtgagaaggggatgcgctatgcgatgcctaatgccagagtaatgattcatcaagcctcaaaggtggatcggagggtaatacgggaggaggtgaggagacangttggggaaaccattatgccccaagggggggg

SEQ ID NO: 82565 - DNA, 517 bp, Triticum aestivum
  unsure (1)..(517): unsure at all n locations
  Clone ID: PAT_TA_82565
ggcgcgagcggcaaggacatcgccatggaggtccgcagggtcgccaaggaggtgcacctggtcgccaagtccatggaggaggtaacccaggagctcgccaaggtgctctccaagtacagcgccagcctgcacctacaacttcacgtggagcggctgtgcgaggacgggcgggtggtgttcggcgacggctccagtatcctcgccgacaccatcatctactgcacagggttcaattactctttcccgtttctggatacggagggagcggtcaccgtcgacnacnactgcgtgggcccgcttttcgagcatgtgttcccgccgtcgctngcgccgtcgctctccttcgtcggtatacccgtnaaggtatttgcgccttgggttcttttaggctcaagcnaaatgggtngcgcaagttctgtccggcaagagaagcttccccccgaggaagagattgtgcggtccgtgnaggatatancgcgccaggaagccnccggcgcgcccaanaattacaccacan

SEQ ID NO: 82566 - DNA, 183 bp, Triticum aestivum
  unsure (1)..(183): unsure at all n locations
  Clone ID: PAT_TA_82566
acgtccgccacgtcgcgcacgtcaccttcgaccgcctccaagggctttcctccggncctccccgttcaagttcaagctacagatcccctgcccaancccccagcgccagcgcgagcgtcttcgggggtgtcccgggagtccaancaattgnggctacaaccaaaaggggaaatnccgtcccca

SEQ ID NO: 82567 - DNA, 221 bp, Triticum aestivum
  unsure (1)..(221): unsure at all n locations
  Clone ID: PAT_TA_82567
tatataacgttgttgtttctgtctcatcttaaaattctgtgaatttcttagtcaaatgcaatggtaggttctgcaactgtctttcaaactttgtgcccttcctaagtaacaagcttnaccaatttnagggaagatnaatttggataaaaaattgaataagctcctaaggnaaccaaaagggaaaaaatattgcaagtcantggggntctccttcaaangac

SEQ ID NO: 82568 - DNA, 515 bp, Triticum aestivum
  unsure (1)..(515): unsure at all n locations
  Clone ID: PAT_TA_82568
gcgggccgaggaagaagtcggtgaccaagtccatcaaggctgggctccagttccccgtcggccgcatcgggcgctacctcaagaagggccgctacgcccagcgcgtcggctccggcgcccccgtctacctcgccgccgtcctcgagtacctcgcagccgaggtgctggagctggccgggaacgccgccaaggacaacaagaagacccggatcgtgcccaggcacctgctgctggccatccgcaacgaccaggagctcgggaggctgctgagcggcgtcaccatcgcccacggcggcgtcatccccaacatcaacccggtgctgctccccaagaaggccgctganaaggctganaangccggcgccgcccccaantcgcccaaagaagacaacaaantccccaaagaaggcacaaaggctaatttcggccgtnccggttaactgatgngnccggaaaccncnngtgccaaagncccgggttaatttactangggtttcaaaaatttnaactntctt

SEQ ID NO: 82569 - DNA, 519 bp, Triticum aestivum
  Clone ID: PAT_TA_82569
agctacacagcacacgaaccgatccatccatccagaaaaaaaagaaagagtgcccgtcgaaaatgccggtgagcaggatcgccatcggcgccccgggggagctgtcccacccggacaccttccgcgccggcgtcgccgagttcatctccatgctcatcttcgtcttcgccggctcaggctccggcatggccttcggcaagctgactgacggcggcgcgacgaacgccggcggggcttatcgcggcggcgctggcgcacgcgttcgcgctcttcgtggccgtctccgtgggcgccaacatctccggcgggcacgtgaacccggccgtcacattcggcgccttcgtgggcggcaacatcagcctgctcaaggccgtggtgtactgggtggcgcagctgctcggctccgtcgtggcctgcctcctcctcaagattgccatcgccgccctcgtctacgacatctgctcatcggcagcgccccaacgagcaactcccaacgccgactatgaaaactcatctaac

SEQ ID NO: 82570 - DNA, 543 bp, Triticum aestivum
  unsure (1)..(543): unsure at all n locations
  Clone ID: PAT_TA_82570
agatgatccatcctccagcgaatcgagtgtgtcatcaaactcaagctcgaaggaatctacagacggcagcgaggtggctgtaaagaagatcttgaaagagacaagaggaggaaatctagacttctttgccgagatgaacaccattagtgaagccaaacacaagaatctcgtaaagttgaaaggatggtgctgcagggaaaacaaccggaacctgctcgatttcatgtgctggtgctgcaagaagaaggaggatgacgagctcttccttgtctatgaactgggtgcctaacggcaatctgcactaccacctgtgcaagagtgatcaagtaataccatgggccaacaaggtaccaaatcgtgaaagacattgggtcggtcttggtttactccaccatgagtgtgaccctttacattttgcatagagatacaaacaagcaacatacccctgggcaacaactcaatgccaaacttgctgacttngnccgtccaggtttnggaaccaggataagggacgttgatgacaacccccnagggacggaaggn

SEQ ID NO: 82571 - DNA, 159 bp, Triticum aestivum
  unsure (1)..(159): unsure at all n locations
  Clone ID: PAT_TA_82571
atcgccaaaaggataaccagtataaacatgcagcttgattgttcgtgtaaatagatattttgatggctgtggngggcantccggnaacctacttgagtttttgtttgganccggcgaaataacagggtgactgagtttcagggcggaccaaanaaaaan

SEQ ID NO: 82572 - DNA, 180 bp, Triticum aestivum
  Clone ID: PAT_TA_82572
tattagaaccttgtgtgttatttgtgtgaaacatcaagagatggtatgagtgctactatgcgttcttgtgtcagctggtcagcacattgtaaaattgcctgatgaattctgttagatatgctctagtgttgttgtcagagtgaataagcttatttcagatggcgatttaaaaaaaaaaaa

SEQ ID NO: 82573 - DNA, 571 bp, Triticum aestivum
  unsure (1)..(571): unsure at all n locations
  Clone ID: PAT_TA_82573
gtgatctcagcaactgaaaaacagctgatccagggttcctgccaaaaccgcatgaaattaccatccccaatttctcaattaggacattggttgcagcgagtaagatagcaacatctgcaccagcaactagaggaaggattctccatgaccttgtcatgtcagtgcgctgtagcgattaaccaggcactgatggtctttggcagtgtccgcgccctttttgcaagaaacttctttcacaacttcttggtcttgataatcttttcacttaataaatcaatttcatagacaaaccaatagaaatgagatctttttcgcttctttaaaaatagttttttgttttgaacaaatatatttaggaccagacaaacaatgtactttcatagccgagccgatataaatgacatctccttccaattcattaataacaatttttccagttgaacaaaaacatgtaggncatgacaaataaagggaccccnannttagaaaaaggatttgcaatcctanaaaggccggtcggcaataantgaacaanagccggtgccaanaatncgggtttcctgaacnannc

SEQ ID NO: 82574 - DNA, 381 bp, Triticum aestivum
  unsure (1)..(381): unsure at all n locations
  Clone ID: PAT_TA_82574
tgacgccattgatgagtatgccattggtcagctcaaggagtttgaggggaaaaagcttgtctctgccaccaaggagggtctgaagcttgatgagagcgaggacgaanaagaagaagcangaggagctcaaggagaaattcgagggtctgtgcaaggtcatcaaagaggtgctgggtgacaaagtggagaaagtcatcgtctctgaccgtgttgtggactcnccttgctgtctggggactggtgaagtatnggtggactgccaacatggnnaagatcatnnanggccaaagccntttgggantccagcaaggctggntacaanttcatcaanaagaccatggggatnanccccagaaanccatcatggggnancnttccaaa

SEQ ID NO: 82575 - DNA, 586 bp, Triticum aestivum
  unsure (1)..(586): unsure at all n locations
  Clone ID: PAT_TA_82575
cccaaacgctcgaactgaccaacactcctatctggggcggatatggggatgcccgaatgcgcccgagcacggctgccacgtatgactgaccgcaaggtcccacgtgctcacacgtcaaaaaaaattggtcctgttagaagggagagagggatttggtggaaatagttcgttgtgttgcttgagcctcgtgggcatatatataggagtacatgacctacttggagtacaagacaagccagaatacttcctaagtttatcctatgtttcctaatacaatcatgttactcaacatccccccgcagtcacaacggtagcgatgcanacggtaagactggagaagaatccnagggcaanccgatngacaccccccaacagtcgtaacggtcgatgcatcacngnatcatggncggagtgggaaacaacnaggttctcaancaaggggtancccttntgtcaatntncaagtnacccnnaaccganggtggtgtttccttgtccaagtaaccnttccaaaangtncttggcaaaattatctgggaaaccgtttntaagaatntcccttnnccccgncccaagggggggcnct

SEQ ID NO: 82576 - DNA, 568 bp, Triticum aestivum
  unsure (1)..(568): unsure at all n locations
  Clone ID: PAT_TA_82576
actaaccgcccaaactaatgagcagcagtttcaatctgcacaagatgcaaatggtaatgcaaccattggaagatcatattactatcaggtttttccaactcctatgcaaccaaaccagatcttcatgcatccgaatacaatgcctgtttgtgcaccacaggatttgtcagcatatgccgtggtgcgtcctaattcaaatttcggtggcgcgaagaacatctaaaggacacaagggtctgctagatgtgtttctttacaaattttccttggagatggctgctaccaagttaccaaccgccgggcgtggatcttttgtcaaccgttatagagggatcatgggtccagtgatgctgctcntgagaggagtgggtaatcngtcctctggcatttcttttctaccgagggggggagtccaaggctaaataagcaanccaattgaatgtgancctttgggcgtnaggcnatntntttagcnagttaagttnttaacancagagttacccattaatnaccatttanaanggcccccngggggganncangaaaccttggccnnaaaaccggtnng

SEQ ID NO: 82577 - DNA, 270 bp, Triticum aestivum
  Clone ID: PAT_TA_82577
tgaggccgcaagatgtgtttcctcgatcaccgccgccgtgaccgggtgaggccgcaagatgtgtttcctcgatcgccgccgccgccgccgccgacgtcgtctcgttccttcttccccgattttcccctcgcttttcgatcaaatattcgatctttcattgtttggggcctgtgatgtgaacaatttgtccgtaccatctgacatctctgatgatccacatttgctaatgtatctctgaggtccccctttgtgtttcttaaaaaaaaaaaa

SEQ ID NO: 82578 - DNA, 566 bp, Triticum aestivum
  unsure (1)..(566): unsure at all n locations
  Clone ID: PAT_TA_82578
ctcgagttttttttttttttttttcaaacaacaatagtcgtcgtcatgatggtggtgcgatggccaagagtagggaaccaaccctcctgcagaagctacttaactctgatatcaagagggacaggcataggcttctgcacacgttcaaattcatggccttgaacaatttcttcaaggactggcctgccaagccgctggagttccctagtgtcaaggtggaccagatagagcttgaaagtgatattgacgaggaagactcagatgatgacttgccggatgccgagacggccaaggactgcacctcggttttgaaagggaaacggcgattaaccagaatccactcccaacgatgaggangatgaaagttgaggacgacgacgaagctgacgacaangggtgctgatactgaaatnaccgaaaggttcaaatgagattcccgacgcaagacaatgcaagaagttcccaaattcncaacctgatttcctngactaaacaattatggacgtgtttgccttgtaaatcncanatattgcaancnctcanaactnaccgttgcggagcaagat

SEQ ID NO: 82579 - DNA, 538 bp, Triticum aestivum
  unsure (1)..(538): unsure at all n locations
  Clone ID: PAT_TA_82579
cggcggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaatgcaatctatccttatgcagcgtcatatcatggttgatggaaaggtccgcactgacaagacctaccctgctgggttcatggacacatttccattccccaagacnggtgagaactacaggttcttttatgacaccaagggcgcttccgccttcatctgtcaaggatgaggatctnattcaantctcaagncaagtctntcaattcggcaagaaggcacccctactnaacactatnatggcgcacatcgctaccanaccatcataaggcaat

SEQ ID NO: 82580 - DNA, 546 bp, Triticum aestivum
  unsure (1)..(546): unsure at all n locations
  Clone ID: PAT_TA_82580
gttttttttttttttttttgatcagccaaattcaggttgacaacgaaagttccaaattacaccagtgactatcgaaaatcatctcgatcgaagggaagcacatgggaaacttaaccagataaattagtcaccaatagcgaaccacacgtaggagccgatcgagttgccgccgggtcctcactcctcaccgagcgccacaccagattcagcagcctaaacagcgacgacgggaagaagcgcctccgtgccgaattcggcacgagctcggtctctgtcccaacgtcctgtcccaagagcgcaagatattgcctcccaagagcaagcacaaggagaagntactgatacaccaacagaattngttgcggctccgatgaacaatgaacgtggnccncaacaatgcttggncaaggngcacncaggaggcaccaaantcnttcngttggccgcttcggtggggtcaaccaacaggntgacaacanctgcannggggttcaaagntgnnatcattnaagggaccccacnangtgggnagttaccggncaaaaa

SEQ ID NO: 82581 - DNA, 521 bp, Triticum aestivum
  unsure (1)..(521): unsure at all n locations
  Clone ID: PAT_TA_82581
gatttgtgcaaatactcctatcagtcaagttgagaactaataagctgcatcgaggtccatttagctggtgagctgtgctggctcgatcgcatagtcagggatgagctatggcgacgccccaagatgcctcgccgtagaggacgagaagaagacgtcatggccggagttggtggggaagtccattgaggaggctagggagatcatcctcaaggacatgcccgaggctgacatcgtcgtcctccctaccggctcggcagtgaccatggacttaaggagcaaccgtgtccgcatcttcgtcgacactgtcgcgacaagctcctancattggctaactagatttcctcgctaggagcgatgtgcaattgggaaggcatcccgtgtgctgatgancaaagttataantcaataatgggtgaataantacatgctggaccgccaacaatgtttttttggggttaaagggncnttttttgtttgggggtataaaaaaaatttgnccccctgggtanaaaaaaaaaaaa

SEQ ID NO: 82582 - DNA, 640 bp, Triticum aestivum
  unsure (1)..(640): unsure at all n locations
  Clone ID: PAT_TA_82582
ctgggattagatttgctatgtcgacccacgcaaagaatctagcttttgatttggcgccaccgtccaatcttctgaaatatggggatcattacagattcccatttgagcttttagacaacaaaagtgtatcctgtctagcgtgtcttcaacttagctttgtgtgtttcaaaccacctcctgccgatttcataggtttcccaaacctaagaaagcttgatctccatgcgctgaagaccactaggcaggatctcgagagtatcttgtgcagttgcattactcttgagtggctaagcatagtcagatgccatctcaaggatgaaatgaaggtggttctgcagccattatcccaactgcagtacttgaaagtcatgcactgtgaggtaaccaagatagagttcgatgctgcaaatcatcaacctttgttatgatggaccatacatacctatnaccctcatcatgctacgaaactggngaatgcaaaattttggttccgcggngcggnttttcagcgtgcggccacgtcantcctcaatgggctaccagntgttcaaancctgacattgcaanttggaatgcaacncctaaaaaaccggtggaattaaaaaccccccggggtttttccacccaggaagtnaaattg

SEQ ID NO: 82583 - DNA, 473 bp, Triticum aestivum
  unsure (1)..(473): unsure at all n locations
  Clone ID: PAT_TA_82583
gtcggcgaccatgtccgggcgcggcaagggaggcaaggggctcggcaagggcggcgccaagcgccacaggaaggtgctgcgcgacaacatccagggcatcaccaagccggcgatccggaggctcgctcggaggggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtcgtctacgccctcaagcgccanggccgcaccctctacggnttcggcggctaagctcgtcctcgccccccctcctgcaaattcccaaagtttgatgataccgcgaattttccanttccccgtaagcnccgttanttccaactgaatccttggaacaaaagttnttcccnaaangtttgctggnaatcaaancccctgttctttg

SEQ ID NO: 82584 - DNA, 480 bp, Triticum aestivum
  unsure (1)..(480): unsure at all n locations
  Clone ID: PAT_TA_82584
cctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccaagtgcaagtgcggcaccaagctgcggctgctcctgctgcagctgctagatcattgatcatcgatcatgcatgcaccgcgcgcatgcatcatatctatgatcgattcatccatccatctagtaccatgtaacgctaccttgatcgaaggtctttgtatggtatgttagcacctgccagcatgaagcagaagcaggtgcactccatgcatgtaaaccgacccctaaataaaaatcncccgttgttaacctaaaaaaaaaaaa

SEQ ID NO: 82585 - DNA, 522 bp, Triticum aestivum
  unsure (1)..(522): unsure at all n locations
  Clone ID: PAT_TA_82585
gcgaagcatccacacccaaaccctagcctccggctccgatggcccgcacgaagcagacggcgcgcaaatccaccggcggcaaggcgccccgcaagcagctggctaccaaggcggcgcgcaagtcggccccggccaccggcggcgtgaagaagccccaccgcttccgcccggggaccgtcgcgctccgggagatccgcaagtaccagaagagcacggagctgctcatccgcaagctccccttccaagcgccttgtgaaggagattcgcgcaagacttcaagaccgactcangtccaaantctgccgtctccgccctgcangaagccgcccgaggcgtactggtgggctgttcnaaggacacaacctgtgcgccatccacgccaangctcacatcatcccaaggcatcantcgcccgccgatccgttgggaaccccctagntttccgtttccgacgtgaaatggtatactntctncngggnctaagncgntgggttnaatattgccttatgcctattaccggaa

SEQ ID NO: 82586 - DNA, 462 bp, Triticum aestivum
  unsure (1)..(462): unsure at all n locations
  Clone ID: PAT_TA_82586
gcaggtcgtaaccaacggggtgctgaagagcatagagcaccgggtgatgactaactcggtgacgccacgaatgtcggtggcggttttcatcgagccggatgcggactgcctcatcgggccctcggaggagttcattggtgaaggaaaccccatgcgctaccgttccctcacataccgtgagttcttgcgcgtcnacaatgttgtaaagctgggctcaccgctcatccttacaaccatnctcagnactncncacnaacnacagnncaaaattncangagaagcnaaagccgataanccttaanggtaagnttggtggcaanttcccnaacacgcatgccgtgggtatatcagttacatcaagctaccttcccggtgttgtnagggtatacattcatgttcngttatgatacaagtaancttacccgtggnccgggcgacttgttacagaaaaaaaaggggggg

SEQ ID NO: 82587 - DNA, 584 bp, Triticum aestivum
  unsure (1)..(584): unsure at all n locations
  Clone ID: PAT_TA_82587
gagtttttttttttttttttttttttttttttttttttttttttttttttgatgaacacatcaattatctcnccctctgtttgttgcaaaaaaaattatctcaccgttgcaacgcacgggcatatatgctagttcaagagaaaagcatataccttttatcagtgcgcgcacacacatacacactttcattacaaagttcacacaagttcaaagcctcctcttccaagttgatcacaatccacactgatacaggaggtataaatacgtggcacatatacaacgccacggagggctcaagatcttgcggataagaagttgagcaccatattggggttggagggtcatcaccatcattggtgcatgaacataggatggcgagacatcaaacgcaaaccgctgggagcaccattgcanagcaccaaactttgcctcgaacatccgcgagattccgggcaacaacanattggcaggggccaaacccaaaggggaaatttgcnncgacggtgataacccctgncaaccggaaaaccccannggttaaacncccncggaatagcccccaaaantcaaaacaagggggagnn

SEQ ID NO: 82588 - DNA, 496 bp, Triticum aestivum
  unsure (1)..(496): unsure at all n locations
  Clone ID: PAT_TA_82588
gaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccgggcggcatggaaaaggcggcggagaacggcggctgcggctgcacccagtgcaagtgcggcaccagctgcggctgctcctgctgcagctgctagattcattatcgaccatatcatgcaccgttgccgttgcgttgcatcatcgattatatcgattctactactaccataccatgttaaccgcaaccctgattcaagggcctttancaatgcacctgaccttgcatcagcaattcaggttgccatgccatgatnntaaaaaggcccccctaaataaaatttcccctgattaactttaa

SEQ ID NO: 82589 - DNA, 463 bp, Triticum aestivum
  unsure (1)..(463): unsure at all n locations
  Clone ID: PAT_TA_82589
caaccctgacaaggttccctttgttcccatctctgggtttgagggtgacaacatgattgagaggtccaccaaccttgactggtacaagggccctacccttcttgaggctcttgaccagatnaacgagcccaagaggccctcanacaagcccctgcgtcttccccttcaggacgtttacaagattggtggcattggaactgtgcctgttggccgtgttgaaactggtgtcatcaancctggtaaggntggtaactttgggcccantgggccgacaactgaaggcaaatccgttgagaagcaacaacgagtccctcctggaaggggcttcctggtganaaatgttgggttcaacntnaaaaaactttncctttaanggntntgaaanccttggggtttngttgcaaccaaantccaagggttgacccctgccaaaggnggnaaccaaantttaaccnccaaggtt

SEQ ID NO: 82590 - DNA, 494 bp, Triticum aestivum
  unsure (1)..(494): unsure at all n locations
  Clone ID: PAT_TA_82590
tcccggcctctctctgtttgctctcgcgtccgccgcgcccatcctcgtccgcgcctgcgcccggcccgtgctcgctcgctcgccgcctccctcgcctcgatncancgcgccggcggcatggcggatcagctcaccgacgaccaaatcgccgagttcaaggaggncttcaacctcttcgacaaaggacggagatggttgcatcaacaacaaaggactgggaaaaattatgccttcccttggggaaaaaccaaacggaggttaactcaagaaaatgtnaatngaatccaatctaatggnaacggaacaattganttccaanagttcncnaactgatgggccccaaattnanggaaattgaccnaangggggatncaaagggggccttaaggggntttcnaaagggccaaaangggttnaancccggggggnanacccccncattttaatnnaaaaccccgggnaaaaaactcacccccnangggngggggnnaaaa

SEQ ID NO: 82591 - DNA, 320 bp, Triticum aestivum
  Clone ID: PAT_TA_82591
tgaaagcagtggtcaggtcgacgaaggcgtccatgtcgaaacactccatcagctcaggcttggccatcatagcgtccagctccttctgtgggtgtgttttcgcaagacaaatatttaaattatccgcgttggcattttagatgcgggcgtgccagtatacgagtgtatacgaattaaaacaagataaaataaagcacataaaattatgtggagaaacttgtagtctttattattcaagatgtacaaatctcattttacatactcttggtgtagcatctgacatataaaagataattgtacagttctcgaaaaaaaaaaaa

SEQ ID NO: 82592 - DNA, 522 bp, Triticum aestivum
  unsure (1)..(522): unsure at all n locations
  Clone ID: PAT_TA_82592
attccaagcagcactggtgccgcaaaggctgttggcaaggtgctcccagagcttaacggaaagttgactggaatggccttccgtgttcccactgttgatgtttctgttgttgatctgactgttagacttgcgaagccagcaacctatgatcagattaaggctgctatcaaggaggagtctgagggaaacctcaagggcattttgggttacgttgatgaggaccttgtttccactgactttcagggtgacaacaggtccagcatcttcgatgccaaggccgggattgctctgaacgacaactttgtcaagcttgtctcctgggtacgacaacgagtggggatacagcacccgccgtgggtcgacctcatccgtcacatgcacagcaccaagtaaatgagaagcatgaagatacaggggagagtggttgccccaagaggagtgttcaaacctcctcttcctgagaataattttgtaanggattattcagctaaaacttttatggtgtacctgaggtgggcacan

SEQ ID NO: 82593 - DNA, 543 bp, Triticum aestivum
  unsure (1)..(543): unsure at all n locations
  Clone ID: PAT_TA_82593
accatcaccaacgacaagggcaggctgagcaaggacgacattgagaagatggtccaggacgcagagaagtacaagtctgaggacgaggagcacaagaagaaggttgacgccaagaactccctggagaactacgcctacaacatgaggaacaccatccaggacgagaagatcgcctccaagctgcctgctgatgacaagaagaagttcgaggacgccgtttacgccgcgatccaatggctttgacgccaaccagtcggttagggttgacgantttgaggacaagtgnaaggagctnngagggctcctgcaacccatcatcgccaagattttcnaaggcgcccgtgcttacatnccccgaggatgtgccnaaggaccccccggctgcgaaccggggtgcttgccccaanattntaggaggnccactaattatcccntttttatagngngaatacnctatcacantttttcannccggggngccancaatcacctgggctggntttttttggatttttnggccggtncacacaaatgtgntntcct

SEQ ID NO: 82594 - DNA, 518 bp, Triticum aestivum
  unsure (1)..(518): unsure at all n locations
  Clone ID: PAT_TA_82594
gcggcctactcgtcggcgaagcccaggctgtgcaaggttgagggcgaggacgccgagttcgcgtacaaggacggcgtggtcaccgtggccgtgccgtggtccggctcgtcgtccaagccgtctcgtgtccactatgtctattgattgacgtctcgggcttagcacgtttcgcgtccaaataattttattttaggcggagcttcgaatttgtacagctcttatcttatggttttttgtttgatttaccttttttccgtgatgaggattcatctatctaaaccgaatcaataaaactctggttttgttacgagtgagtatctattccnggttttgcttattcagcgttgtgtttaatcctggcctcaaactccgtttgacccccccgggaccgggtgggggttgctgtcgctgtcccgggaggaacgtagcatcacananccaagggggggcccggtaccaattcccctatatgancctataccgcctcaacggctcctttanactctgaacgggaaaac

SEQ ID NO: 82595 - DNA, 538 bp, Triticum aestivum
  unsure (1)..(538): unsure at all n locations
  Clone ID: PAT_TA_82595
ctggaacgtcaccaagcgcgccatcggcgtcgagatcaacaagcaggttggcaacaggatcatcaagaagaggatccatgtgcgtgtggagcacgtgcagccatccaggtgcaacgaggagttcctccagaggaagctcaacaacgacaagctgaaggcggaggccaaggcgcgtggtgaggtcatcaagcaccaagaggcagccagcaggccccaagcctgggttcatggtggagggcaccaccatcgagacggtcacccccatcccgtacgacgtcgtcaacgantctcaangggtggntactaaagcgcctggttgtttcctgaagcagaaaccttgagccaatttcttagnaccnatgcttgttcccaangttttggaactgagtaantntccctttttgccccccgganntttaaactttcccgggggtaanattaaanatttncnggggggnntttcattcccnaaangcnccnggaaaaatntnctttgggnaatnggcaattttntgcncnaaatttccntcaaaaaaaa

SEQ ID NO: 82596 - DNA, 600 bp, Triticum aestivum
  unsure (1)..(600): unsure at all n locations
  Clone ID: PAT_TA_82596
ccgaggtacacttccttgctgttactttccgaaccagattaatcatcagttatccgattacaaactttattgcaacacgtacagaaactaaaacatttgttgttcaagacaaaatagattatttatgtcacccattagccaggacatgttcttgctcaaaagtttgttcaaaacaaagaggactattgcataatttttaattcatttatgatagttatccaatagatgctaataaccctgcacaattatttcctgatggtttatccagtagtttctctgttgtgttgaatcagtctttcactgctctcacctagcagtgactcttataggacatttcatgtaactcttataattacattttgggttaagggccatgtactcgtgtctgtcttgctcggttattacagtaacacagtactccgaattgtgtaataacgggtccgttcagggtcaagtttgtagcccccaaaaatcaatttcattagnttaaacctgttcgggtacttcctggggaaagagactcacatcaaagtnctaggntaacgggctgtgtcctccgaatttactggaaactcacttagnagaaaaaccttgnccagn

SEQ ID NO: 82597 - DNA, 527 bp, Triticum aestivum
  unsure (1)..(527): unsure at all n locations
  Clone ID: PAT_TA_82597
cgcgcccgcaccccaggaaggtaagctcaagaggctgtcctgagaagctcaaatggctcccaaagttgctgttgccaagaagggcgatncccaggcccaggctgccaaggttgccaaggctgtgaagtccgggtcaatcaagaagaccgcanagaagattcgcaagtctgtgacatttcancgccccnngacctttccaaggcaagggaccccaagtaccccngaatnagnacccctggcaggaanagttgacaantncaaaanccncagntaccccctaacaattaagncgncaataaaaaaaatgganaacaacaacaccctntnctccacctncaactttaaggcgaacaaaaaaaaantaaaggcnccctttaaaaaaatttgaactcccggccaanaaggtanaacctattnaggcttaaagggcnaaaaagggtaanttaanctaancccaacaaaacttttactngccanaaaattgggccaaaatttaaagaagtttcnttnggctgtccggntccttn

SEQ ID NO: 82598 - DNA, 526 bp, Triticum aestivum
  unsure (1)..(526): unsure at all n locations
  Clone ID: PAT_TA_82598
atgaaattgagcattttccagtgccttctagaattattgtgagcaggacagcacatggtgatgagatggagcacggagaatcatccagcatgcatgggaatttaaagcgacaaagatcttctgttgatgatgatcttgatgagcatccgaggcattctcgtgtagaagatatggggcaagtatagtgaagaagactattctgattgatcgattagatatggaagtatccgtcatttccttgcaccatcgaatttcaatgagcacatatnaacctttgaagatccaatantcantttgcctttggngccnccaaaagtannaatanggtgcaaggtttttaaagaacangcttgaccacntttgggcatancaaantttgaatncaaatnggcaaagcaaaggaaattntaccgggccttaaaccggcncaaaagngngatanaaggccaaccccngtttaaaaancccggaattttggaatgntcccacggcngttttgngaattgggacngtatcccattgttgg

SEQ ID NO: 82599 - DNA, 552 bp, Triticum aestivum
  unsure (1)..(552): unsure at all n locations
  Clone ID: PAT_TA_82599
ggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactggagccggcgcccaaggaggccggccggcaagaggcgacacagnatgagaaggagaagcaagcaatcatcatcaccatcaccaccacccagcgtacaataccactaaccgccgcatgcgctcgcgcgcgcgctaaataaaataaaacctcatgtgttccttaattctgttaccctcgcgtgtantgttcgacaatgtccctcctcatcctcacttctaatgaatatatggngcctcaacttttaaaaaagggggggcccgtaccaattcncctatangatcntattcncgcctcaatggcgtcttt

SEQ ID NO: 82600 - DNA, 167 bp, Triticum aestivum
  unsure (1)..(167): unsure at all n locations
  Clone ID: PAT_TA_82600
nacacacacacacacacatagagcctacgcccactcttctcagagcangagcctcncccttcaccttcgtcttccttcgtctcggnagttcgccctttgcatnncagnagtggntagctccanggggcggntgatcgctgggagcctcgtcgcgcgcgtcctcgccg

SEQ ID NO: 82601 - DNA, 481 bp, Triticum aestivum
  unsure (1)..(481): unsure at all n locations
  Clone ID: PAT_TA_82601
ctgttccagaacctcgtggaccgctcgggcggcggcgtgggcggcgacggcgccggcggcaccatcatcggctgcgaggtggtgctgttcgagcacctcctctggatgctggagaacgcggacccgcagcccgagtcgctggacgagctcgtcgagtactacgcgtgttgaccggccggccggccggccaaccgcccacatcatccgcagctggcggcgccaagctcgccagagttggtggcctggcctctatagggggcaatttggtaattctttctttaagctaggggtagagttgtaatataatacgcctgtcaagcgtgcaccgagggcgacgtgagtgggtaattaagttgtgtgtggagatttatttaaccttgangcgttcgtggtaattcggggattaacttcgcaattaccgcgcgccaagaatgatgctgttctggggctaataatcaatttccctaatgattggtgtggt

SEQ ID NO: 82602 - DNA, 471 bp, Triticum aestivum
  unsure (1)..(471): unsure at all n locations
  Clone ID: PAT_TA_82602
gtcgtggatcaaactgctgcgccccggggctggtgcttgtgatgagcgacgaggagaagcagggacctgggagcgcatggatgatggatgcgcgaaggatgagcgccttggacctagatgatggattcgcctggggcctgggagcgacggaggatggacgcctgggagtgccgaggagaagcgatttgaaatcctaggagcaaagggggaaagacgacgatggggatagcgattcaaaacaggggtagcgttgtaaattccttcatttcaaaacaggcctcgaatttctcttcnaacccatatatttccaaaacggtgggagcatttccatgcctatattgacacattgtgtcncctcccatcacattgatatttcnccattggtattgttancgtatatgaatacacatgataaacctggatttacaaccgatcttcnaaacattttggccgcacccatccataaaaaat

SEQ ID NO: 82603 - DNA, 563 bp, Triticum aestivum
  unsure (1)..(563): unsure at all n locations
  Clone ID: PAT_TA_82603
tgcacctcgtctgcctgctcctccaactaggcagacaagacttccagctccaccaccacaagctcctgttcccactcccaataatggcctctgctacaagtgtggtcagccaggtcaccgtgctagggattgcaatcaaaaccagaatcaactggccctcccagcaactggccgtggaagcaaccagcctcgcaacaacagtgccaagtcttatggtcgtgttcatgacaaccatgttgatctcaatgaattctagaccagcctgctaccatgatgggtacactcctccgtaaactcagtacctgcatctgttttattccgattcaggggcatcacattcattcatgtcagaagattttgcatacaagcatgacgttaaatgtgaggagatgaacacttcggtattggtaaaaacccgtgggacaatgtcaaagtcacgggttggcatcgatgtccccgtggnaacaaagggatgggattctagcctctcccattatcccgaatcgtctaaattgactcatctgggaatggttggtngaaaccatacgctcnaagttgcgcac

SEQ ID NO: 82604 - DNA, 567 bp, Triticum aestivum
  unsure (1)..(567): unsure at all n locations
  Clone ID: PAT_TA_82604
ggcgaacatgtgcgcacctctattgagccggcccatgaacggggctggatgcgaaagtttttgcatttttccttttattttttttcttcttccaattaattcttaattttaaaaaagtttcaaattttaaaaactgattttttgaattttttaccagcaatcataagatgttcatggtttataaaatgttcatgattttgaaaaacatgttcacatattgaaaaaatattcataaattttaaaaaatgttaattgattcaaaaaatgttcgtgatttccaagactgcatgttgatcttcaaaatttaaattcaattaatatttttttaatttcatgaacattttttgaattcgagaacatttttccaagattgatgaacacttttggaatatgatgaatttcttccgaaaatcgtgaactttttttgagttcngatgaacaaatgttgaatttggaaagatttttggattcgataaacaaaatggattcaagaaatgtcancgattgaattttccanatgcacaaagccncaaattggaaatagaataatntcaataantggaangn

SEQ ID NO: 82605 - DNA, 545 bp, Triticum aestivum
  unsure (1)..(545): unsure at all n locations
  Clone ID: PAT_TA_82605
ccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttgggccaggtgccagctttgcaggatggtgactttgtactcttccgaatcactgctatttgcaattatgcgtgccgcaaagaacaancagagtgtttgaaggagggcgacatcaaggattcaanaatgggtggatgtnttggtccaggttggaggccatccattacaccgccgtcctgaccccattctcttccnangccttatccaccctatgctttggggaaccactgacaagaagnccatngacgaaacttgtttagatttaagaacnnctggattgttcnaagcnacctgacattcaatnactggctggagacctanatctgccggnctaacaagtg

SEQ ID NO: 82606 - DNA, 396 bp, Triticum aestivum
  unsure (1)..(396): unsure at all n locations
  Clone ID: PAT_TA_82606
atgatgtgtgccccataccaggaaccacaaaggtcgacaacttcaaccagaatgtggcggcgctgtccgtgaagctcgccccagaggagatggccgagcttgagtcctacgcgtcggcggatgttgcgggtgatcgctaccatgatttcctgaacacttggaaggattctgagacccctcccatgtcatcctggaaggccgagtgacaacttccgtgggaactgggaataaaagagttgcttgtttcttaatttctccgtgccaatggaagggtgtgtgtgtgtgtgtgtgtgtgtgtgtttgtgtgnttgggctttgattactcatgttgtatccccgagaanactgtgattccggtgtaagaatggctcctggaaataatgtacggagttacca

SEQ ID NO: 82607 - DNA, 543 bp, Triticum aestivum
  unsure (1)..(543): unsure at all n locations
  Clone ID: PAT_TA_82607
ccgggacactattcccggtcaagaggttgggcagtggcacggggcgagcgatgttcttgggaatgtattgctctttcacattgtctccagatgtttttccccctggctcctttagcgctgacaccatctacccgagctttgactttgccgagagaaggctgttaaaagttgaagcgtatcatctcaccgatggactgttaaaagctgaagcctatcatctcgccgatggccgcgtcgaacaaccatctagcttggtgcagcggcacatactctcattgaccatctatccttgtcaattacgttgatccttaatttacacatttcttttggatatttcgcatgccaatatgcacctgttgtcccaatttggaagctatacntcttccgnaattgggtnaggtanggatacnggccaataatttcanatcgatccgccagcangcatgaanttctaagntttaccangaaaanaaaggatacatgcaatancttaacgatacgggtttgtggagngagcganaanaacatgcgcatgcttctgaa

SEQ ID NO: 82608 - DNA, 353 bp, Triticum aestivum
  unsure (1)..(353): unsure at all n locations
  Clone ID: PAT_TA_82608
tatatctagatgtattttagttctaaataatgcgatgaataattacggactgagggagtacttgggtgctaaaaaatcccgatgcctacccaatcacgagagtacggacgtacgcctgtgatgtgcccacacgtccttccacaacccatgcacgtctgccgtgaggcgaccgctcgatcgaacaatacgcaacaccgtacgtgatcgaccaagacagaacagacacccgttgtcccttgcattttgggaccgtgtgctttgttggggggcaaattaacaaatttgacctgtgggacaaaatttaaatcacaagaataaactgtcaaagnaactatttcacgcgggttatcttg

SEQ ID NO: 82609 - DNA, 285 bp, Triticum aestivum
  Clone ID: PAT_TA_82609
ggcgtgctcaagatcttcctcgagaacgtcatccgcgacgccgtcacctacaccgagcacgctcgccgcaagaccgtcaccgccatggacgtcgtctacgcgctcaagcgccagggccgcaccctctacggcttcggcggctaggctcgtcctcgccctcctgcatatcccaaaaagtttgatatgaatgcgacttgtttaagttccgtacttcctctgtagttcgaagtgaatccgtgaaacaaagctattcgcatccggagttgggaaatcaaaaaaaaaaaa

SEQ ID NO: 82610 - DNA, 309 bp, Triticum aestivum
  unsure (1)..(309): unsure at all n locations
  Clone ID: PAT_TA_82610
tcgagttttttttttttttttttttttttttttatgacctcttccaccatgatgcaaagtcgcacactcctaatattattcagatgataaccaataggtcctaaaaagacaacaagcgcccttgcttggtaaaagtacactttctttgatctgaatcgcttaattcaccggattgctcggccaactgaagctacactatctattctggcccacttcagttctccgagtcatcagagcactcctctcaggctcagttcttcgccatttgcagcagntcttgagcgtctggntgggggcaagggggggggg

SEQ ID NO: 82611 - DNA, 562 bp, Triticum aestivum
  unsure (1)..(562): unsure at all n locations
  Clone ID: PAT_TA_82611
cccgcaccgcgtctcccttcctttctcctcctcgctaagcaactcatcagctcaactcacatcatcatccggtccggggtcggagccgagcactagtgccacccacaccaccactagttaaaccagcagccttcttcagccggtgggagggaagccaactagccaagcgagtgagtgcgcggccacaaggtacgaggaagcgggcacaagggacaagaagagctcgatcgaccacacggccggagcggcgatggcagggccgagcatgccgcagcctctgcttgctgctctcctcctcctgggggtcttgctgctcgtccatgtcccgttatgctgggtatggcttcggtccgtcggttacgcctgcatccggtctttgctttcttcttcggntaactgaatcggtctgttctcggttctcgccgttgangtgtcctggactttggaacttcttctcgctttctttacattatacgtacctctttgagattgagcaatcaacaattcanatattgatcctacttctcccgcacgggaatatataccaagggatatataatan

SEQ ID NO: 82612 - DNA, 431 bp, Triticum aestivum
  Clone ID: PAT_TA_82612
atgaaatcatgtaaatttcacgtctgctatgtaggttcataccattgtctttgtgcatggatgtaagttccagatctggatgtaaatttcagatatgtgatacctggagggcggatcttgtacgccgttgaagctggcgccacgtcctggacctgtccagcgtcaggtccagaaggggatccgcgccggcgcaatggataccggcggttttgatccgcgccggatcctcgaagcgctcaacggggagtccgtgccgcggaccagcgccggagcaatggagggatggcggtgaaggaccgatgggcggcggcgggcgaaggagggactcccaaatccagacgaacctcgctcgaaggcacgagtacccttccagaccaatgcctttttttttcgctgattaatcttcgacgtctgtgggcaaaaaaaaaaaa

SEQ ID NO: 82613 - DNA, 573 bp, Triticum aestivum
  unsure (1)..(573): unsure at all n locations
  Clone ID: PAT_TA_82613
tttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccaggtgccagctttgcangatggtgactgtactcttccaatcactgctatttgcaantatgcctgccgcaaagaacaancaaagctgtttgaaggagggcgacatcaaggagtcaacaatggtggtgtgttngtccnaggtgggaggccatcnattacaccgccgtcctgacccattctcttccnantgccttatccacctatgccttnggggagccactgacagaagnccatngacgacacttggttagnttnagaactgctggantgtncgaagnnactgacatccattctggctggggaccnaantgcnggnctaacaattcgtnncttgctgngggtanactncactcgttg

SEQ ID NO: 82614 - DNA, 392 bp, Triticum aestivum
  unsure (1)..(392): unsure at all n locations
  Clone ID: PAT_TA_82614
gaggcccggcctactgcggaggagggtgcggctcgtgcggcggcggcggcgggtacggggcgtggccgccgccgatgccgacgccgctgcagatgatgcagcctcccccgatgggctgcggcgggccggcgtcgtcgtgcagagggtgcaagggctgccggttgcaaggangggaaggttcatctacgaggagtacccgcccagtgcgtgcaccgtcatgtgattctcaggccaacgaccgttcgtgcatgcatgcatgcgctgttcgactctccgcaagctntttttcctgggttcgaccgatgttcaaaatttgcnattnttttccntgcacantactgnattttttaattcaanatccccaacaaaaaggtttactgcaacnttcaaaa

SEQ ID NO: 82615 - DNA, 484 bp, Triticum aestivum
  unsure (1)..(484): unsure at all n locations
  Clone ID: PAT_TA_82615
accgatgcgtgtgacacgggcataggagcagtcttagtacaagatggtcacccagttgcttatcttagcaaagccctgggtgttcgcaatcaacgtctgtccatctacgagaaagaatttctcgctgtgatgatggccgtggagaagtggcgtccatatctccagctcgccccattcgtcattgtcactgatcacaaaagcttgtatcacctcggtgatcagcaacttgaaacagagatccaacgcaaggcgatgtctaaaatggtggggctcagttttcattccaaatataggcgcggccccgaacaatggcgccgcggatgcgctatcccganccgncacctgctctcaataaatgcnttgacagttttgccaacacatggcttcaagaanttcaattcccnacnaactgacatggncatcaaatttgctccaactttngnattgaacatccaaatgntcaggggtataaccgttacaagga

SEQ ID NO: 82616 - DNA, 517 bp, Triticum aestivum
  unsure (1)..(517): unsure at all n locations
  Clone ID: PAT_TA_82616
actatgcaaagtcagaataagattgggttcagcgattctcaagctgggaaaaagggcccagatggttttgtgagacgtgataattgtcattcgtaccaacccaccatgcgcttaatgggcaagacagtctcactttgtaaaggtagcatggagcaggaggtaccaactacagggaagtggattgacaaaaatgttattggagaccgtccctcatcatttcatgccagttgcccccaaagaaggtgttcccttatcaagattctgtgataccaagactcgtgttcatgatccttcaaatactttgccaagnttcccaacatacttttgcaaaagcaaaggcctattgccaatgangccccaaatccatagntgccacaactatattccttcancagtttnagattcacttggatttngnatcaattttggccggaagtccanggaacaaantngtcctaggacncaaggccaanatatggtttcccaaacacccattttaggatcancggnacaatan

SEQ ID NO: 82617 - DNA, 424 bp, Triticum aestivum
  unsure (1)..(424): unsure at all n locations
  Clone ID: PAT_TA_82617
ggtgcgtgcgtgcgtggcgcaagtccatgaccgagtttgttagctagccatgcgtttgcatgccagccaagtcagatgcatgctgggccaggtcgttgcagttgagtggatggctggacgtgcatgcatgtaggaattagttagtggggttaagtagcgccgagtgtggcggctggccaatgtgtgcgtggctgcgtgttgttaagtggccgggcatagcggccgggttaagtgcgtgcgtgattgcttgtactgggtatttataaggtgagtaaatgaatggagaaaagcggcggttganggtggaaagaaaccttgntgaaggnanttccacgaatgggtcaagnncaaaaggnggganncccanaaancaaccccnagaagttggattcccggtgnctaagccctnggttcaaaccaccgg

SEQ ID NO: 82618 - DNA, 543 bp, Triticum aestivum
  unsure (1)..(543): unsure at all n locations
  Clone ID: PAT_TA_82618
cagagaagtttttattttttgtgacctaaaagttaaaagaaatcaccaaaaacctgtaagtatttatttctaagtagaactaaaaaaataatggcactagtaaagttaatcacaaacttcaaattcacacaaatttcaaagaattcaatttaactattcacacaaatttcaaagaattaaaaaataaagcaaaaaaccaaaagaaaataattaatgcagaaaacaaaacaaaaaaactgggaaaaaactaaaaatagcaacaataagtattttattgtaagtagaaacaaaataaaatggaataaagcaacaaagaaaacaaaaaaaganttcccaaatttgaaaactaatgggactaacagaaagttataatttttccnaaaactaaaagaaaaaagaattnnnaaataaagcanaaaacaagaaaaataatgcagaaaacagaacaaaaactggaaaaaataanatacatataanatttgttggtaagttgaacaaattaataataaanacaaggacaaaaagtttcaanattggaaacaa

SEQ ID NO: 82619 - DNA, 509 bp, Triticum aestivum
  unsure (1)..(509): unsure at all n locations
  Clone ID: PAT_TA_82619
aaacaagtgaagtggtattatgttgttatagcctatgtcgttgcccccatgcttggattcgccaattcctatggtacggggcttaccgacatcaacatgggctataactatggcaagatcgctctctttgtctttgcgggatgggccggcaaggataatggtgtcattgcaggccttgttgctggcaccctagtcaagcagctggtgcttatctccgccgatttgatgcaagacttcaagacgggtatctcactcaaacatcaccaaaacgatgatgattgcacaantatttgggacancatgggttgcattacgccccctcacttcatgctcttctacaagcatttgatattgggaaccatatgnacttggggaggaccttatnacncatataccgcaatatnganacttgggtnggagggttccaatgttaccgaataatgcctncaaanccggngttttccattngcgnanttcantttncaagaattcaagcccacaatttcnan

SEQ ID NO: 82620 - DNA, 424 bp, Triticum aestivum
  unsure (1)..(424): unsure at all n locations
  Clone ID: PAT_TA_82620
tacgctgcagcagccgcctcctgctacccgccgccgagatgacaaagcgcaccaagaaggccggaatcgtcgggaagtatggtaccaggtacggtgccagtttgcgtaagcagatcaagaagatggaggtgtctcagcactccaagtacttctgtgaattctgtgggaagtttgctgtgaagaggaaagctgttggaatttggggatgcaaggactgtggcaaggtcaaggcaggcggcgcctataccatgaacactgctagtgcagtcaccgtcaagacacattcgtcgcttgagggagcaaaccgaacatattgcactacngtaacttgagtanncaaggntcngtatggagttgaaaacttacatcnccgtatttggtaccagcatgtatcggtagaatttngtccgatttagatctttgn

SEQ ID NO: 82621 - DNA, 331 bp, Triticum aestivum
  unsure (1)..(331): unsure at all n locations
  Clone ID: PAT_TA_82621
ccgtctactacgccgtcgtcgtctgatcatcgacgagtgagcgaggaagcgagcgacctcgtagccgtaatagcttaattttagcgtgatcttgttccgtttcttgaggggtggtggccggtgcagggttgtgtgcatgtgtttgtgctgttcggtggttgtgcttgtctctcgacgggagggctgaggcttctagctcgactccatttgggactcggttcttcttcatttcttggaactttncncccctttttccgggaaaatannaggtagtaatttgtaaaaaaaaanccccccaggggggggggcccggtanccaattncncctaaa

SEQ ID NO: 82622 - DNA, 496 bp, Triticum aestivum
  unsure (1)..(496): unsure at all n locations
  Clone ID: PAT_TA_82622
ggcaggtggacacccacaagacatccctgctgtcgcagctgatcgtcaactgggggctgtgcaccgtcagctacccgctgctggccgtcctggtgctcctggccgtgaaggacgaggactactccgtgtccaatgtcgacgacggcggcaaggagaaagagaccaagatggccgcgccatcaagcttccactgagaagaggatacatttcagttattcatccgcgtgttcgcctgccgcaacatctctcgagcacaatggtttagaccgcggtgtaggcgtgagtgctcgctgctcgaccgtggctgagcaatcttcgtgttgtgtcagattgttactccaatgtgtgtgtggttcaaggtggtggtggtgtttactggtaacatcatgtgttaacttttctctgttttaatgtctcaattcaattgagctgcaatatacagtatacaatttcaatgcttggtcaatcaaaaaaaanggggggncccgtaccaatt

SEQ ID NO: 82623 - DNA, 427 bp, Triticum aestivum
  unsure (1)..(427): unsure at all n locations
  Clone ID: PAT_TA_82623
ccatggcgcccctacaagtccatgccaatgtggagcacactgcaaccaccggccccatgaacctgaactcaagctccgcaggcttcaccatggtcggctggcctgttggcgcacaacccatgggtcanaggccttcccctgatancaacctcngcttgacnccccaggagtagaancngctgccgtttggtttgggccccccaccagggacacattttgcaggggcnttgacnggttcaacccaaccagctnacaacnatccattgggggaaaacctaggctanaggngggnanttacccaancgganaagnganaggngatttctaanggtcctaattgggaaaanttcaanttgtcgggggttaatggnnttcncaatgggggnanggttantggaaactttaacaggggtanctccaacccatt

SEQ ID NO: 82624 - DNA, 367 bp, Triticum aestivum
  Clone ID: PAT_TA_82624
gcaacatcaccggcaacccagaagtcagggtcaacaagatggggagggcagcgggagtgcttgagaaccatgaggagggcaggcgctacgccgagcacggcctcagagcctatgtgcaggacaagacccccgagatcatgccaggaatcaacaagttcttcaccagcccaaaatgaagcactttagtctgtctgtgactcgcaattagtaactgttgtggtcaagtgcaaacctatttcaagcattcagtaatgttgttgcgtccataattcagaggacatcgtcaattacctcttattgaaagaaccatgtgatgtttgatggcttgctatatatgtgatggttgatggcttctaaaaaaaaaaaa

SEQ ID NO: 82625 - DNA, 504 bp, Triticum aestivum
  Clone ID: PAT_TA_82625
cttcaatctcatccccccccacacaccacagcacctctccccgccgaagcgtccgcatccgcatccatggccccgaaggcagccgagaagaagccggtggagaagaccccggcgggcaagaagcccaaggcggagaagaaggtgccggcgtccaaggagggcggggacaagaagggcaagaagaaggccaagaagagcgtggagacctacaagatctacatcttcaaggtgctgaagcaggtgcacccggacatcggcatctcctccaaggccatgtccatcatgaactccttcatcaacgacatcttcgagaagctggccggcgagtccgccaagctggcgcgctacaacaagaagcccaccatcacgtcccgggagatccagacctccgtccgcctcgtcctccccggcgagctcgccaagcacgccgtctccgagggcacaagggcgtcacaagttcactccgcctgattccgccgtcacgtgtcttcttgatgtaccatc

SEQ ID NO: 82626 - DNA, 522 bp, Triticum aestivum
  unsure (1)..(522): unsure at all n locations
  Clone ID: PAT_TA_82626
agaacatttaaggatctctcctggccatggatccaagtactgaaataggggtcttctctcctcttaagtagagtaagtactccattactctactcctagataaacatatcaacatgatgcaaattgttggagtaaaaagcaacatggtactgcaatttcagtacatttaattatttcaatcatattcagtgtactccaagtcagtggtacaacatatctacagttgatcatttcagtagaaacttgctaaactgaaacatttctggagtagctgctaatttttgctgctgtcaatcaagataaacttgaaacttgctatcctattctgaaggaggtgatttcatactagatgtcagacattcttgcagtagctctaggaggagctgcaggaggtttgggcattagttggtgccatcacactcantgtagtgatatgcctaccgcaccgcggaagaattcagatctcaagagagtaattctccggcaactcttcaaacatcaagganaacattttgacacggg

SEQ ID NO: 82627 - DNA, 432 bp, Triticum aestivum
  Clone ID: PAT_TA_82627
cttcagcgcataagttatggaacaaataacgtctcctgccactgaccttcaacacatgtaacatctaaccaagacacaaccgcagacaggaagatagttttggctgaatcttgtctagaaatgagcaggtgcagcagcttcacgttactttccatgctagaatcttgacagttgcactggcatgtcgcacttacaaaatactttggccaggaattctttgtgtaagtgtgtacagaagttgtttcctgagcagcattatgccaaacagttttttaagtttgcaaagctaaatgttgtgtgatgcattgtttgcgttctgtggtttaccgggaggaacttgcctcacactggtagagaatctgacgctggcactgtcacatgaaacatttgtatcaagtgtattccttcgtttaagctgttaaaaaaaaaaaa

SEQ ID NO: 82628 - DNA, 461 bp, Triticum aestivum
  unsure (1)..(461): unsure at all n locations
  Clone ID: PAT_TA_82628
tgtggctttgttcagtatgctaacaggccttctgctgagcaagctctgcaattgctgcaagggaccttggttggtggtcagaatgtgaggctttcatggggacgaagcccttcaaacaaacaaactcaggtttaattcttgcatgctaaacttctatcctgtcttgagttgtatgtatactagatgtaaagtgggtaatatataacacatgaacattttcagcctcaggaagccagccagtggggtgcaggtgctgctgctggtgctgctggtggttactatgctggatatggacaaggctacgaggcttatgggacaagggtatgcacagcctcaagaccctaacatgtatggttatggagcctatgctggttatcccaactaccaacaaccagcagcggcaccgcanccaccgccaccgcaacagtgagccctcctcgtgggtcgtccaaacagatgag

SEQ ID NO: 82629 - DNA, 442 bp, Triticum aestivum
  Clone ID: PAT_TA_82629
gtgggacgtgcgacttcagcggcgctgcttctatcgtctaccagcaacctgccggcatttgcgacccgaagacggcaggcagctggtgcgtagccaatgcggcggtcggggacacacgactccagacggcactagactacgcgtgtggccacggcgcagactgcagtgctatccagcgcggcgcgcgttgcttcgatcccgacaccaaggtcgcgcacgcgtcctacgccttcaacgactactaccagcacaacggccgctctgccaattcctgcaactttaacggcgctggttccatcgtctaccagcaaccaaagataggcaactgcgtgctaccgtcaacaggctgaactgggagaaatgccagctccgtttaagagacttaacaacaaaccatgtaatgatgtaatcatccttatcggcgcaaaataatgtactaatc

SEQ ID NO: 82630 - DNA, 517 bp, Triticum aestivum
  unsure (1)..(517): unsure at all n locations
  Clone ID: PAT_TA_82630
cacaatatcaagcagctcgaccgctcctcgcagggaagccaagtgagcaaagctagacagagctgtattagccatgaagctagtgatgtgcttgtgcatcttcatcgttctcgtcatcaccgcgtcgcctatcgcggtctccggtgaccgtccgctgatgctgggccgacggtgcctgcaggacgccgtggtcatcggcggcagcccaaccccaacaggggcgagcaccacagggacgttgccgcgtgacgcggagccggacatatcggttgataggtcgaagaggctcagccccgggggatctaacccccagcatcactnatctcatcatcgagatcagctncatgcatgcctatctgatggtgtcatttgtcaacattctctctcgacttcccaaactagatncctaacaacggttaatgctgtccggagattaattctctctttctctctcctatnttgttcctaataaattgatttcgcgtggtgcanaggtcctaacactancacttccgat

SEQ ID NO: 82631 - DNA, 524 bp, Triticum aestivum
  unsure (1)..(524): unsure at all n locations
  Clone ID: PAT_TA_82631
cctcgtcggaggcgcgatcgtcggcgccgccgtcgtcgcgtggcggcgccgcggcgacggcaagggcgccaagaaggaccgccgcggcaaggaggacgacgttctggatggcggggttgtggagaacgagcagaagtctgatcaatctgatgagaatctgagcatggaggttagagaggttgaagctgatgggttggatggtaaggaagcagaggagcttcatgagattcaggagcaggtggatgaaatcgttgctgatgaattggacagtgaacctacagataattttgatccaaacgcaagcaaggagcgtgccgagatcgttaatgatacggacagtgaagatgagaagaatcctgaccaaaattcagtgaacagctgcgtcgagaatgagatcgcaccaaatgccaaccaaggtgtgaagaacctgatgaaagcactcttacatcaacagcccggaggtcgccatgaagaacatatcgggcaagncatgacgatatnaagagacgcatcaacacagatnn

SEQ ID NO: 82632 - DNA, 546 bp, Triticum aestivum
  unsure (1)..(546): unsure at all n locations
  Clone ID: PAT_TA_82632
ttttttttttttttgctacttatccatcagtctggcattcaattatttcagcagttggaggaaatcttcctcaaaacagcctccgattcaatcttcggttccccaaaaaaaagcaacaaaaaataaacagcacaaatcaagctaagatcagacactaaaataaaacatggagaagtcttctataacatgctcgctaccaaggaagcctgctcagtcattcctgccgctcaccattttatttcttcctcttcttcaattttcgccttgatgacattttcctatgaatgaaagcaagatacagtgggtagtaggatgttaggatcctatctgacaggcccaaccgaaaaggaatgataccatccttgtttgccttttcaggcatatgcatcaaaaattttctcttaaagttgagctgaatcgtgcctttattgccgtcttttcgcctcttctgcctcttctttacaccttgctagcttgcctcattttgtgctcttttggcttcctttttaatgcaattgcatctcttcnnatcctcatacatcaact

SEQ ID NO: 82633 - DNA, 478 bp, Triticum aestivum
  unsure (1)..(478): unsure at all n locations
  Clone ID: PAT_TA_82633
gcggctccatcccggcgcaggtggcgacgctggctggcctccagcagttcaacgtgagcttcaacaggctgtgcggcgccgtgcccaccggcggcaacatgtccaggttcgaccgctacagctacctccacaacaagtgcctttgcggcacgccgctcaccgcctgccgccagcggcccgtcggctacctccattagagcgtcttccatccaacggttcaatcaaagcctccaaaattaagccatgatgatgagatgtgatatgatgtgagatgagcacgtatgtaccaatggagtgattagtacggtaaccaccgcagtgtaatgatnagtaccagtactcgtatatcagtggtaattaaactgaccactgattaattatggccctgatgtttggagcttcacggagcttacgaatgaatgtactcgatattgcaacttatatatgcataataatggatattggatataaaaaaaan

SEQ ID NO: 82634 - DNA, 541 bp, Triticum aestivum
  unsure (1)..(541): unsure at all n locations
  Clone ID: PAT_TA_82634
cgcgcccgcaccccaggaaggtaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccncaagaccctgtccaaggccagggaccccaagtaccccaggatcagcacccctnggaggaacaagctcgatnaatatcagatcctcaagtacccgcttaccacttagtctgcaatgaanaanatcgaggacaacaacacactcgtcttcatcgtccacctgaangccgacnagaagaanattaaggccgctttccagaagattacgacatttaggccaagaagttaacaacctcatcaagcctgattgcnagaaaaggcgtacgttaagcttacaccanacnacnatcttttgattggccacaagattgnatcatanaattagagggaggtctcaataggcctgttctggttctgtg

SEQ ID NO: 82635 - DNA, 533 bp, Triticum aestivum
  unsure (1)..(533): unsure at all n locations
  Clone ID: PAT_TA_82635
gaaattccaacttcaatcgtttataattccaagatctcgtatcatcacatagcctataccatgtcaatgcatctcccttcaaagataaagggaagaccttccttttaacaacatcaccgggaatagctgcaagcttaaataatccacaaacttcatccacaaagataaggtgtaaatcgggatgcaatgttccatctcctgcaaatggattagctagcagtttctctatcatacccgaaggaatctcaaagtaaatattttcaaaaagttcagtaggttgaggagaaactctttgctcttctggttagggtgaagataccccgaacaagcccctcaaaggattagtttccatagtgacaagtaacaagaaaatttcaagcacactatataaatgttcccttaccaaagttcactcaacaaaagcgctacactccccggcaatggcgctngaaaagagtcctgatgaccacaagtgtaggggatcnacgtatcctttcgatagtaagaggtcaaaccaacgaggagcanagtnn

SEQ ID NO: 82636 - DNA, 510 bp, Triticum aestivum
  unsure (1)..(510): unsure at all n locations
  Clone ID: PAT_TA_82636
cagcgcctcatctttgccggcaagcagcttgaggacggccgcaccctcgctgactacaacatccagaaggagtccaccctccacctggtgctccgtctcaggggtggtatgcagatcttcgttaagaccctcaccggcaagaccatcacgctcgaggtcgagtcatctgacaccattgacaatgtgaaggcgaagatccaggacaaggagggcatcccaccggaccagcagcgcctcatctttgctgggtaagcagctcgaggacggccgcaccctcgctgactacaacatccagaaggatccaccctccacctgggtgctccgtctccgttggtggccaataaangcctggccatggagttgcttatgtctgtggggtcacaancgggttgcctttcctgtgtcctccgattggattgtcagtgttcctcgtcnggcctggtgctttgttgctaccgtgctgtgggctaatgttattacttaagtttggtngttccgtgaatttccgac

SEQ ID NO: 82637 - DNA, 517 bp, Triticum aestivum
  unsure (1)..(517): unsure at all n locations
  Clone ID: PAT_TA_82637
gctacgaccgtgttcgtagtctcgttgatcagctccggccatggctccagtgaaataacgtgctctgctaattctgcattttttgactaaaaagcatatactgtgtgtgactcatattttgtggggttgcagattctcagtgaggaagccagcaggaagtatatcactctgcttttgtgaatgcagtgagccgttgtgccatttcctggccgccgagccttcagattcggcgcttcgacgaaagaacggggggactccgcccatctacttcgccaactccggtaacacgcgcgagaggatcacacgaacggacaatgccaagggcaagaccggcgtgcagtacatcctccttgacatgggtgcaancatcaacagcatcgtcaggaggggatgctggacgactcaagaaacctggacaggaggggattcaacaaacgtgggaaaaatttatatccattagcaaatgggaattatatccagatatatggctactcaaacaaggagaaatttagagtgn

SEQ ID NO: 82638 - DNA, 339 bp, Triticum aestivum
  unsure (1)..(339): unsure at all n locations
  Clone ID: PAT_TA_82638
cataaaatgtttaaatactctaagtggataaaacagcagcaaaaacaattaataaaatgccttttgtattttataaaatattaaactaatttattttggagtaaaactttttgtggcggtgccattccatgcaatttgagttatgaggcaagttacactttttacaaaaatcaattgatggctctacttaatgcgaaacaatgtataaaaaaactaaaagaaaaatagaaaaaaaaacaaaagataaataaaacatgggggaaaacccccgtggcccaactgggccttggcccagccggccggccgttctacccccgtggcacntttaccaactacccc

SEQ ID NO: 82639 - DNA, 504 bp, Triticum aestivum
  unsure (1)..(504): unsure at all n locations
  Clone ID: PAT_TA_82639
ccccgcgcaccgcactcctccttccccaacgcccgccacctacctccatcgtgcactcccgacttactcgttcatcccgctgtcatatctcgggcgccgccctcaggcaaccggtgatgctcctcccgccaccactctgcctccttcccgatggagctacgccgccgccgcatgcaggaagtccatcgcctccaccccaggccgttcaatgccatcgtcgtggacgtgccccgctttaacaccatggattgcgattgagcggcaaacaatgggagcctgcagaaggagcgcgggtcgaggactccattcgccagtccaacaaaaggttgtagaaagttgagactagttgcattaagggtcaacgacgtcgccgtcctcgacctatcccgttcgtcaccantcaacanccactcggtgcagcatcattgtccgcctggatctgcatgttgtggtggcgctnatccaagcanccncccttggntacaactctctcaagatggaata

SEQ ID NO: 82640 - DNA, 340 bp, Triticum aestivum
  Clone ID: PAT_TA_82640
ctcctccgcaacatcaccggcaacccagaagtcagggtcaacaagatggggagggcagcgggagtgcttgagaaccatgaggagggcaggcgctacgccgagcatggcctcagagcctatgtgcaggacaagacccccgagatcatgccaggaatcaacaagttcttcaccagcccgaaatgaagcactttagcctgtcagtggctcgctattagtaactgttgtggtcaagtgcaaacctatttcaagcattcagtaatgttgtcgcgtccataattcaagaggatatcatcaagtgcctcttattgaaagaaccatgtgatgtttgatggcttgctat

SEQ ID NO: 82641 - DNA, 468 bp, Triticum aestivum
  unsure (1)..(468): unsure at all n locations
  Clone ID: PAT_TA_82641
ctcgtacgatccccaccaggctgctgagtcctcatcctcgtttgccatttcttccgatttgccgccggcgaaggaagatgtcaccgttggccatcagaaaattaatacccaggttatcccagatctacatgtcgtttcttttctctgagttttgcttccatggggtggtggcgcatgcggctgggtgagtgcacggatctcggcaacctcctcgagcctggagacatgtccacggagattgccaaggagaatttgggttgtgctgttatacttgccatcgccgggtgctttggatgttggtggcgcggaggtagtgagggaactcacgaagcaaggatgtgaaagcaacttgtgcgggcggcttcctacttgttgtcctgttaattgtttgtgttgtttggagtcctaacaaatgtaagtgttactgcaatcatataattttgggtaangggaaagatctagaatcaa

SEQ ID NO: 82642 - DNA, 279 bp, Triticum aestivum
  Clone ID: PAT_TA_82642
gtcgtttccgagcttgtaatgcattcggaagtcgaaaattacgatggagtcggcaaataaccaggcagagccttcctaacctgaagcatgcaggggttgtctgaacaatgagcagcaactactgagtgactaatattaccatacagtaggagtactagtgcgttgcacgtatgaccacaaaaataaagttctttgtacatctagttatgagacacagttgctaagtggatcatacctacaagcatcttcttaactcgtcttttttttgatagattttgc

SEQ ID NO: 82643 - DNA, 490 bp, Triticum aestivum
  unsure (1)..(490): unsure at all n locations
  Clone ID: PAT_TA_82643
aaaacatcatgcatgcaaacgaaaccaacaaaaatggatagatcttacctttgtctatcttttcttcaacttcaacatattcaaaatccaactctaaatcgccctaaatcacgagtgaaagtgcttagtgagtttttctttctctatgttcttacacacttagagggtagaagaggaggccagtgtgcttgcgcacggagcagaaacatactacataaaaggaagaggatccctgtagtgtcggcacaaaaggttcccgcagcgagtgagtgattcctgcagtgccatcacatccgctgaagcaatagccagagtgattcccgcagtgtcgtcgtgtccgctgaggcaaaagaagcaaaagctggagtgattcccaggcagcagcagggcatcagcattgtcactcattatattcccgcccgtgaaatttgtcgtcctccgcgcatgggaatcaaccagtctgcaacaagccgggccgtgaaatcatcan

SEQ ID NO: 82644 - DNA, 482 bp, Triticum aestivum
  unsure (1)..(482): unsure at all n locations
  Clone ID: PAT_TA_82644
gcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgggagatngccaagacttnaaagaacgancttcggcttcaagagtccgcctctccgccctgcaggaggccgccaaggcctaactggnggggntcttccagganacaaactctgtgcatcaaagccaaaggggtcacataatgccaagggattcagtttgaaanccgaaccttggnaaangggctaaactctaaggtctcnncttaaccaatttnttccccggggnaattncctgcaaagtttgtcttncan

SEQ ID NO: 82645 - DNA, 536 bp, Triticum aestivum
  unsure (1)..(536): unsure at all n locations
  Clone ID: PAT_TA_82645
gctcgaggagttaaaaggcggccttgagtggccattatctgtgtatggtgtggttgccgctcgagactctgtggatcacagccgcaacctcctcttctcttgcgataggtggaggtcgcaaaagctcagtcaggacgatcctttcttgcgcttaattggcccgtctccgtgccattgtgtttaccgatgatgtttactttgaaaccgagctaagagtaaaaggcaaaacattgtctcaaagatatagcattgattaagtggggaaggcgccattacagcggaggacgtaccatttcccttccagcaactgcttcctgcaagaatagagttatgcatgggagcgaattccatgaaactgttcaaggcaactatattgggtgtcccgttttcaaaaatggacaaggctttcnattacggcggtaaagtgcttgctctcaacaaccgnggcatataaggcactgangaaagcttttanacaccaaancccanccatggnattgtnatctgctcaagcggtaaacaagcctaaggtcata

SEQ ID NO: 82646 - DNA, 522 bp, Triticum aestivum
  unsure (1)..(522): unsure at all n locations
  Clone ID: PAT_TA_82646
tgaggtgccaccgcttcctaaggtagaactgccaccgtttccggaagtgcacctaccgcctaagcctgagcttcccaaggtggagttgccgccggtcccggaggtgcacttgccacctaagcctaagttgcccaaggtggagttgcctccggtcccggaagtgcacatgccacccaagccggagctgcccaaagtggagctgccgtcggtccctgaggtacacctgccacccaagccggagttgcccaaggtagagctgccaacattccccggaggtcacatgccacccaagccggagatgcccaaggtggagctgccgccgaagccgaaatccactgttcccgttttccaagttcccnggagtccgganccaagcccttnanattggcttaaccataatggtgccttggttanactcctccngccccccntanatgtaccaatgncctgttgtgtccannatccgatgttnaatggggtttcaacnangttgtaangatcctaaaaatggggaaaaaggga

SEQ ID NO: 82647 - DNA, 175 bp, Triticum aestivum
  Clone ID: PAT_TA_82647
gacagttgacgaattattaatccagaagctttaggcctgggcgtccttactgtttctgtaagcttgctatttcaaattgagggtacgctctttgtgtatctgtgtcgcgcgttctgtcatgctgttgcctttatgtgtgtctgagtacggaatttctggacttaaaaaaaaaaaa

SEQ ID NO: 82648 - DNA, 550 bp, Triticum aestivum
  unsure (1)..(550): unsure at all n locations
  Clone ID: PAT_TA_82648
cgcaaaaagataagaatataaatgttcatgactacaactgaccgacctgatttacataattgtaacgactgacaaaatccaaaaaaggggaaacaactctcccacattttactcccctttggtaccaagaatgaatttcaactatgtgcctccctcacctaacctaacagaccacaccacttcctgtcccataccctatatcctacaacaagcatcttctcgaataatatgctacaacaagcacggcgactcgacacaaaanaaaagtgtcaacaacttgtttaacaaaaaattgggggaactctgaccttaaggaccaaagaaacaaatagccgtacaaccgatgatcaacctgggcctaacacagaaagcaatgacctacactcctacagcaactttgtaacctccttggggcctaagaaagctgacaccaactccagcagtactttgcaactagctgggacatcaactccaagaacagtcttccagaagncatcctttacacctctcaacatcctaccggcctctcgagtatctgcaaatctggcat

SEQ ID NO: 82649 - DNA, 536 bp, Triticum aestivum
  unsure (1)..(536): unsure at all n locations
  Clone ID: PAT_TA_82649
gccagagaggttcgccaatgggatctccaaggcaggggcgtcggccgacgcgccggccttctttccattcgggtggggccagcggacctgcgtcggccagagcttcgcgatgctagaggccaagatggggatcgccatgattctgcagcgcttctccttcgagctctcgccgtcctacacacacgcgccgttccccatcggcctgctgcacccaagagcacggtgcgcaactcatgctcacaaggcttccgtgagttgcatattgcaaaatccattggttaacctgcatgttgtgttccaaataaatgggtccgggcaataaattatgaattccaagaaaatatcaaatgctcatgtttgacaataagtggggtgctaatttgggcacaaggtggnaacttanagcatctccaccggngctcccactaagagcgtccggcaantataccngacaggcggtgcccgcaccggggncccagttggtttaacttcaagtttttgaatgatgatttaaatgaacggtgaaaaaaaaaaaa

SEQ ID NO: 82650 - DNA, 520 bp, Triticum aestivum
  unsure (1)..(520): unsure at all n locations
  Clone ID: PAT_TA_82650
cggagatggtggtggccatgatgccggaggcagtgccgccgctgaaggccgtgctgaaggatacaggcgtggacgccaatgatgacatgatgatgatcggcgccgtgaagccgcccaaggagcacgcctttgtcgccgcgcaccagttccggtggctgttgtcccaggttaattaccccaagcttggcgatctgtgctggttagtcattccatgtgctttgatcattgggtcaccggacgttaaggaacaaggaatgattagcttcatgcacatagcaaagaatgtgaaagtaacagaataatttgtatgaaagatgcaatacttgatgcgtgttgccaaaaatccctgcagatgatgattanggaacncgtttttgangnacaatgctgctcttgacttgcananagaattaccacttaccctgggaacaacgcttcttcctgaatgttgggaaccggaacggaacactaaacaaagactcctggngcatggntancctaacgggacaattcggatcta

SEQ ID NO: 82651 - DNA, 546 bp, Triticum aestivum
  unsure (1)..(546): unsure at all n locations
  Clone ID: PAT_TA_82651
tttttttttttttttttaaaagttgggcagattatttcggaaagctcatccatccataccaatacgtgcacacaaggacagcaacagcactagcgaacgagtttattagtcacgcaggcacagtaaaaagtaccaaaatggacaggcactgttctatgcgttggacattaccccgcctctatgcgatgtacagaaggtcccgacagtggaatagtgcccacttttattactgcatatacaaagatccaacagcgggaaactcaagagcgagcgaagtactgtctgtctactcggacaaatcatgcaagcacttctcataccttctccggcatattccagttcaccaccttccagatgttggtcaagtatccggctcacttcttgtactgcaagtagtaccaagccccaagacatcaattcccaacaaaggatgcagtttgacctttgggcacaaganggcctggataagagtantcaactgaaanctttgggcnctttatcaaagctancacaccatccagttctggtnaacacactctgatcatc

SEQ ID NO: 82652 - DNA, 393 bp, Triticum aestivum
  Clone ID: PAT_TA_82652
caacaacgcagcagcggcgtccctgcagagcgcggggggcgagaaggagcggctgctggcgaacgagaggtacctgtcggagatcatgaaggagaaggcgtcgacggccagggaccggcggcgcgggcgcgtggccgtgtggcggccgcacctggagagcatcaccgaggatgacttgtaatcagacaagctggtacaggcagcgcaatccacgtcccgattttgttcaaacaccttccagaggaaaagacgtgcaaatcgcaccaacagatggatggatcatggacgcatcaccccctaccttttctcccacacttgctatgctcacacttgctactaataagaatccattaaaactgtttttccttccatttttccaagaaaaaaaaaaaa

SEQ ID NO: 82653 - DNA, 560 bp, Triticum aestivum
  unsure (1)..(560): unsure at all n locations
  Clone ID: PAT_TA_82653
gatccatccatccgcccctcgctgccgctgcatctcgtctccaccaccccacttgcccccggacccaggaggatcgtcggagatgtcggacaccgattagcaccacttcgagtccaaggccgactccggcgcctccaagacctaccctcaagcaggccggcgccatccgcaagggtgggacacatcgtcntcaaggnccgtccctncaaggtttgtttaaggtctccacctnccaagactgggaagcaaggtnacgcaaagtgtcactttttttcccttgacatccctttatggaaaagaancttgaggatatcgtttcttcanccccanaacttttaactcccccaantttaccgccccagattataaacttattacataacttatnatgggatttncgcctcctaattanaagtggnacactaggagacttaactccccacttataattttncttggcnatttaanacnggattcttattgcaagactntcttccgtaattccgccccgggtgaaaaaaaatttccttntaagaanccgtggtgnaattaacncnttt

SEQ ID NO: 82654 - DNA, 395 bp, Triticum aestivum
  unsure (1)..(395): unsure at all n locations
  Clone ID: PAT_TA_82654
ggacagccgagctggacccagccgaggctgaggtcgcgcggggcggactgagactgctatggacgttcagagcgcgacgacgaaggacccgtcagcggaggcacaccggagcgaatgggcggccgctgcaccagtgctagcgaggcagagcctgtgctcggggcggcgtgcgaacgccggaggaacaaagggaggcctgggaaaggcacgcgggcgcagcggcggctgcacgccagcagcagcaggacgcataagcgggcttacgaaaaggcggccggtgtatgctccttgtacaagcaagnaatgtttgtgtttacattatccggtagtgtacaagtttatctacatttatgaaatgtataccgtatatgcatatctgactaattaaaaaaaaa

SEQ ID NO: 82655 - DNA, 490 bp, Triticum aestivum
  unsure (1)..(490): unsure at all n locations
  Clone ID: PAT_TA_82655
agaaggccgagaagacgacggcagccaagaagaccaaggccgagaagcggccgccggcgtccaaggagggcggcgagaagaaggggaagaagaagtccaagaagagcgtggagacgtacaagatctacatcttcaaggtgctgaagcaggtgcacccggacatcggcatctcctccaaggccatgtccatcatgaactccttcatcaacgacattttcgagaagctcgccggcgagtcggccaagcttgcgaggtacaacaagaagcccaccatcacgtcccgggagatccagacctccgtccgcctcgtcctccccggcgagtccccaagcatcctctccgagggaccaagctgtcacaattcactcctcctangctagatggtttctgttatatcactttcaaacattctcctgtnacttgtttggtctttgggaaacctgtttcattactcatgaatattatggnttccttggtcaaaaaaaaaaaa

SEQ ID NO: 82656 - DNA, 418 bp, Triticum aestivum
  unsure (1)..(418): unsure at all n locations
  Clone ID: PAT_TA_82656
aagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagctcgcccgccgcatccgtnggagagagggcctaagtctgtgcgtcgtcctctgttancctcgtcttaaccagtgtgttcagcggtgaattgtcgtgtttgagtgtcgttcgtgcaaggtgatgtatgttccgatctgattcactccttggcgtcacaattactgaatgaaatgttgtanccgttcaaaanaaaaaaaaa

SEQ ID NO: 82657 - DNA, 567 bp, Triticum aestivum
  unsure (1)..(567): unsure at all n locations
  Clone ID: PAT_TA_82657
agctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcatttatctctcacatgaagcgctacatcaaagaacctctctgccaagcttngaaggggatgacctaagatgcttttcaaagaaaatgtttgancccncacaaanatcttccttaacaantcnaagacttcattccttggtttggcgaaagcatgcatgatgatggcgcttgtgtccgcctacacaaaggaggaactgctgattcacttccctgnacttngcacatgggctgaaagagnccaangctaacccacgtanctaaancnaanctgtctaatatttgccctaaccaaggtgcaatcnacctcaatgttggntnataacgcanatt

SEQ ID NO: 82658 - DNA, 518 bp, Triticum aestivum
  unsure (1)..(518): unsure at all n locations
  Clone ID: PAT_TA_82658
atcttctggaagaacctcaagcctattagcgagggtggtggtgagccacctcatggcaaacttggctgggccattgatgaggattttggttctattgagaaacttataaagaagatgaatgcagagggtgctgctttacaaggatctggatgggtgtggctagctttggataaagaggccaaaaagctttcagttgaaactactcctaatcaggaccctcttgtgaccaaagggtcaaacctgtacctttggttggggaattgatgtctggggagcatgcgtactacctgcaattacaagaacgtnnaggccggactacctgaccaacatctggaaggtgggtgaactgggaatatcccggagaagagtatgaaaaangcttgcctgatttgtcctgatgagtaaacaacggactttgctcctccttgatttggtanatgcagtataaaanngnacatccactgccggattnccgtcatngcataaagnggcacgtctaatgccacanaatgccgtcc

SEQ ID NO: 82659 - DNA, 520 bp, Triticum aestivum
  unsure (1)..(520): unsure at all n locations
  Clone ID: PAT_TA_82659
gaggacttggacgcctggctcgctgacaaactcccccaaatcctacaggaggttcagccagagtgttcatgggagcctttggcgggctgattggcctccccagcccatgtccatgagttgactccatcagcctctgccccgatcaccggcctcgaccaggagcatcttctacgttgcaagcaaagatgatgaaacacctggaccatcttgcacgcgcttgcagtctttgcgacgcggtggcatagaaatcaaggtcctatgcatactaaatgtgcagcttggcatggctcttgggcacacacacagtccatcagatgaacagagcactcttggagtactcctgtatttcctacaacaatattacttacatttagtttggtgccgtcgtggaaattcagatnggcgttccacagcgtgttcagaataatactttgcaagggacagcaactcgacgtcnagcaacancagcangttctgcaacttcgacnaccccataatccgcgtcgtgctcaactcctgg

SEQ ID NO: 82660 - DNA, 402 bp, Triticum aestivum
  unsure (1)..(402): unsure at all n locations
  Clone ID: PAT_TA_82660
tgtatacagatgcattttaagtgtagattcattcattttgttccgtatgtagtggaatctctacaaagacttatctactagtaatagctagcccccactactaggaattctctatcctctccttgagccacatcatcaaaattgatgtagccgttagatgaagtaaatcagtccataatagccgtttgntctagacgtcnagaggntccgcactaagccacatgcaagcatgcagaaataccgtggcacatgcatgtgagtgggttttcaatcacatcaacatgtctgcatgcaaagcatgcaccggttagcatgcangtaattgagnttttaagtccaattacnagtncaaaaggaaaatnttaccccatttgcacattagngattgggggaaatttccct

SEQ ID NO: 82661 - DNA, 529 bp, Triticum aestivum
  unsure (1)..(529): unsure at all n locations
  Clone ID: PAT_TA_82661
tcgagtttttttttttttttttttttttttttttttgtaacagttatatcatatcattttagtttgattaatagatgatgccccggctgcatcctgaaaatcatctcacattttgaagacaccgaagctctgaagatcataaatggactgaactctctgcacctgactacggtacttggactgtctaaatgatgcaagcccacacgcttagcttcgtttagatcacaatgaatgcgaaacatagaaagataagaatgcagaaaggattccatatgcaggaaaaccacctccggctccttccacagatgtggcgcatcatttgcggcaccagaagatttgtgcaactcttccactcatggggtcaggttacacaactaaacgccactcgtgtcattgtgtgactcgcgttggctgatagaagtgagcgctcccctcctgatgactcggtcangcagctacagatattgccacgttcctacagtaccaactacaacacaaagcctcacaaatgccctccttctaggtaaca

SEQ ID NO: 82662 - DNA, 426 bp, Triticum aestivum
  unsure (1)..(426): unsure at all n locations
  Clone ID: PAT_TA_82662
ttttttttttttttttttttagcaagcacagaacgatatcatgacgtgcacaggtatacactagaggcgagaccgcgagatggccaccacaagctcgtcagtcggcatgatggccggcacggagtcgcccatgacacaggcacacaccacactggaagaagaaagaccacggctgccgctatgcatgcatctcaacgtggccaaagtagacgacaaacaccagacgccgaggattaagtgcgtcgcgtgagacgtgccgaaaggggcttcttcatcgccttgatgaaggtgttgagctccgtcatgtcgacgccggcgaagccctccgtccccggaggcgcccactcgaactcatgcacaagggcagccaagaagcacttgatgttatcatggccagaccacgcccgggcactcgaangggggggg

SEQ ID NO: 82663 - DNA, 522 bp, Triticum aestivum
  unsure (1)..(522): unsure at all n locations
  Clone ID: PAT_TA_82663
gtttcatccaagtgagtaattcttttcttccggagattgttcatgatgaagtaattctccgttctagtgtttcatcttttctttccggagttccaagttctctcggttatatcatcgcaaagctccatctaaatcattgcaaggcttcaccttgtgtttccaacttctctttctttctatcatctttttattaccggagttcttcatggaagatctacatgatggntcatcaaggattcttttcantcttcaattgttcttcaagatttctcttgaagctaagatccgccaagctatactcaaaattaaacatggtgctcaacacatgttttggntttgaggagttcaagtattcttcaacntgcattccgaagtgcaatcctttctaccttancttttgagatggngttgtttcaaccaagtgagtaantcttttcttccggagaatgtccaagatggtaanaactcaatatgacgttaaaacaatctcnaaaatccccgggtgtatgaaaaaatgtgtga

SEQ ID NO: 82664 - DNA, 515 bp, Triticum aestivum
  unsure (1)..(515): unsure at all n locations
  Clone ID: PAT_TA_82664
ctcccgttcgacatcacatataaaccacggcgagccattaagtcgcaagtactggctgacttcgtcgccgaatggatagaagccgaactccctaaagagtactgcacatactccaattggatcatgcactttaacggctctaaaatgctggttggtctgggagcgggcgttgtcctgacatcccccataggagatacagtccaatacgtacttcaaatactatatacagactccaacaatgcagccgaatacgaggctctgttgcatggtctttggatggcagtctccatgggcattcaacgtctagaggtgcatggagattcaaacctcgcaatatctcaaataaatggagactttgatgccaaggacccgaaaatggcggcttatcgtaatgtcgtcctcaagatgtcagctcggtttgaggggctcgaatttcaccatgtggtcagagaaaacaatcaagcagcggatatccttgcccgcattggcggtaagcgcgattccgtccacctaan

SEQ ID NO: 82665 - DNA, 161 bp, Triticum aestivum
  unsure (1)..(161): unsure at all n locations
  Clone ID: PAT_TA_82665
gtaatttgcagcaacaacagtgggtccagcatgagattcgtaaacttatccttctgtaaatgaatgagtttgtctaagtcgtatctagatgtgacataatagatacttcaatcgtttttaaatataagtttattttagataanaaaaaaaaaaaaaaaaaa

SEQ ID NO: 82666 - DNA, 515 bp, Triticum aestivum
  unsure (1)..(515): unsure at all n locations
  Clone ID: PAT_TA_82666
ccgcagcctgtcgaatgctacaagtttggagctgatagctgatgccgaagaggtgattctgaatagggaattggagatgtgcccagtttttagcaacctgaaggtgttatcccttggtgaatggtgtatggctgctgacttgcatccattagttttgttcctgcagcatgctccaaatctcgagaggctttttcttaaactcaaaacggaacatgaggaaatagatgacgatatcaaacccgagggtacatcatttgcttgcaaaaaccttacaatggtcaatataaaatgtcccatggatgatgaaagagttcctgtgttagaacagttcttcgtggctaatggcatagcgatggaaaagatatctgtctatcaccgaccgactcaccaacctcgcctttccttggccataagacgctgatgggctgccgtgtangagctgcagacttggcgatgattctctcatgcgggcacaagatcatggcacaagagcttctgatatgcctcatttgagg

SEQ ID NO: 82667 - DNA, 635 bp, Triticum aestivum
  Clone ID: PAT_TA_82667
gcacttgcagcagatcggccggcggaagccagcaggatggaggtggcgtcgctgtaccggcgggtgctgccgtcgccgccggcggtggagttcgcgtcggcggaggggaagcgcctcttcgcggaggcgctgcagggtgggaccatggagggcttcttcaacctcatctcctacttccagacgcagtcggagccggccttctgcggcctcgcctccctctccgtcgtcctcaacgcgctcgccatcgaccagggtccagtccttccgcgccgaccagaccaccatccacgacttccgcgcccacctcacgcgctgcgcctcctcgcaggactgccatctcatctcctcctaccacaggagccccttcaagcagactggaactggccatttctcaccgatcggcggctatcacgccgaaaaagacatggcgctcatcttggatgtcgcgcgcttcaaataccctcctcattgggttccattgacgcttctctgggatgccatgaacacgactgatgaagcaactggacttctcagggggttcatgcttgtatcaaggcgcagttcagctccttcattgctctacacagtgagttgcggccatggaagttggaaaagcatggcaaagtattgtgtgg

SEQ ID NO: 82668 - DNA, 528 bp, Triticum aestivum
  unsure (1)..(528): unsure at all n locations
  Clone ID: PAT_TA_82668
tgggaggacgttcgagacgtacgtcttctcgctgttcgacgagaaccagaagcccgggccggtcgcggangaacttcggcatcttcaacacggatctcacacccaaatacgacctggggctgctccgccaaggaccgcagtctggatctccaaccccatctccggagccctcgccgtcggtcggcggaggcaagtggtgcgtggccaagtccggcgcgaggcaaccgacctgcagaacaacattaactacgcctgtgcctacgtcgactgtaggccgatccagagcggcggcgcgtgcttggaccccaacaacatccactcacatgcctcgtacgtcatgaacgcgtactaccaggccaatggcatgcacgactatgactgcgacttcaagggcacgggcgtggtcacctccagtgacccagttacgggagctcaaatacaangctctctgacggcgcgaaagtccagctggactactgaanagctcagtcagatgtctcagctcaggtcagcatggcacgtgggaag

SEQ ID NO: 82669 - DNA, 468 bp, Triticum aestivum
  unsure (1)..(468): unsure at all n locations
  Clone ID: PAT_TA_82669
gtgagatcgtcgncagcgagcccagcagatacgagagagagggatggcggacatcgcgttgctggtggcggacagttcgagaagacggcaaggcgaggcgcccccggcggggacagcggcagcagcagcnggagcggcggcgagacaaggaacttcngggccgtggccaangtgtggagctcgtgggtggagtccgcctccgccgccgcgtccggtgtcanattcaccgtcncggtgcagctggagcccaagaccgggctcgcnctggccgctgccgacggcctcttntccgnctagcttcctgnntgcttccatgtctttctcctgagcagtgccagtnatcgagctagtcctgcncctgnacnccgtactatgntgtacgacctgtacatnncgttcgtcgttgcncgttngnctgcgnctaatccggaanaaaatactattcgtagnacagnaganaaangggaa

SEQ ID NO: 82670 - DNA, 325 bp, Triticum aestivum
  unsure (1)..(325): unsure at all n locations
  Clone ID: PAT_TA_82670
cacgctcacctcacacacgcagctaagtagctaacgccgtagnaagngacaagaannggctcgacatgnccgaggagaagaagcagggcctgcanctgcnggacttctgggtgagcccattcgngcagcnctgccgnatcgcgctggacgagaagggcctggcctacgaatacctngagcaggacctgaggaacaanancgagctgctcctccncnccnacccggtncacaggaaganccccgtgntgcngcagacgccnccccgtctgcaagtccctcntcatcgnncagtacctcgacggaggngttcccngagcnggccggc

SEQ ID NO: 82671 - DNA, 198 bp, Triticum aestivum
  unsure (1)..(198): unsure at all n locations
  Clone ID: PAT_TA_82671
cggcangctaccacgccgccgccgccttgcggcccactcatttgtctgggtgctcagcagcnccnatcccagcgccggcgagcnaggcctaggcggctacanactgccancanccatggagncgccgccggancaggcntcagcngcgtcgcgncaggaccaggagcntcgttactacatactcancncaaaaaccgt

SEQ ID NO: 82672 - DNA, 177 bp, Triticum aestivum
  unsure (1)..(177): unsure at all n locations
  Clone ID: PAT_TA_82672
cgaggcctanatagttnattactatcattgcagtcctgtttatttaatcngtagcattagtagctgngcttgcaacagtngcngacgctacatgttgcgnttnantcatcncaagtnaggccacgcgnttnacaacgacgtcggtctctgcatctgcntncctgcatncatggatgc

SEQ ID NO: 82673 - DNA, 528 bp, Triticum aestivum
  unsure (1)..(528): unsure at all n locations
  Clone ID: PAT_TA_82673
cccgccttctccgcccctctcctcgccagcggtggcgtcgaccggcagcggcgttcaactgcgccccacgagcaggtttcttggccccgtcgacttccagtgagttcagtttagctcactaagcatctgatcaacttcgaggtgccagacagatcctatgctgccttactgggatgaaaggtggctgtctgcataggctccttgtccacaagctatgctttggcctgagtgttctcactgtgccgattattgttctgttactggaaggagccccagtactcactatcttcagcccaacaccagggcaattaaaagatctctctcaaggttttctacatcagcaggagcaggaacatcttggagatgatggagcaaccctagttggatctccaggtccacttccaggagccgcttgcaaaaaagtaggggcgaaggatgaaaaattgcactacgcaaggggaagtggatgaagatatagcggctctgtacnctggtatgagtcaacaatgctgtcaaantgtggctgtc

SEQ ID NO: 82674 - DNA, 539 bp, Triticum aestivum
  unsure (1)..(539): unsure at all n locations
  Clone ID: PAT_TA_82674
aaagcacttgcatctcgtaatagtcataccatatcgtccctagcttgatcggtcgaccatggcagcatcagcagcagcagccacgagactcagcggcggcggcgtcgccctcttgctcctggcgctgctggccgccggcacctccacctcgtcggcgcantctccaccggattctactcgcactcgtgccccggcgtgcacgacgccgtcaggtcggtgctgcaggccgccatcgccagggagcagcgcatgggagcctccatcctccgcctcttcttccacgactgcttcgtccagggctgcgacgcgtcgttgctgctggacgacacgcccagttccagggcgagaagatggccaagctaacaacggtccgtcagaggttcgaggnatcgacgccatcaagtccgccgtcgacaaggctgnccngggtcgtctctgngccgaatcctcgnatgccgcaggacagcgttgnacctggagtcgaactggactaacttgccgaggatcaggacggagctnacggngcanaaaaatccgcg

SEQ ID NO: 82675 - DNA, 286 bp, Triticum aestivum
  unsure (1)..(286): unsure at all n locations
  Clone ID: PAT_TA_82675
acaacaaggagaataccctgatcaccatttgcnggactagcagtccatccangggacgggatactncaagccatatcgcacgtgantgcgctgttccttctcccgatncacttcaggangcacattgctctccnattcagagangcggngtggacggcaaacatccacgactgcatccacggcaaganctggccggttangggcnccggcgaccacaccagccaccacacgacgtaccggcacaactaggnccantacaccgtgtggatngactggcngtntggca

SEQ ID NO: 82676 - DNA, 516 bp, Triticum aestivum
  unsure (1)..(516): unsure at all n locations
  Clone ID: PAT_TA_82676
cttttgtctcctcatataagttttgtacttgttcggctatcagggaaacggaaagtgggtagacgaatccgatgggctgtgcatctgnatggagtcctctgagtttggctactatctgttctacataaggcgcagaaagtctgggcttaaaaatgacggcaggcaggcaggcgagcgcgcacggatcccgcgggaagggaataaggaaaagcgatgttgacaaagctggatgggaatcctgcgcttttttggaggcgaagatgagaaggaatatatcgcgtgtgtcgacctcgccggcctgnttcttctgttccgtggcttggttgtnctcccgctggatcgtgccagccgccagcaggatgntgagcacgtgtgaaccctggcgtgggtatgttgttgtttgctctgggagtttttgctagtagncgntcttngtatttgnanaaactcatcattttgtcggtcagaaatacgnaaacacntcaatggtanaaaatgggggncggtaccaattcg

SEQ ID NO: 82677 - DNA, 430 bp, Triticum aestivum
  unsure (1)..(430): unsure at all n locations
  Clone ID: PAT_TA_82677
ctggctttaactggtgctagactgaatgcgaaggaaatgatttctgctggtctngctactcattttgtcagttctgaaaaattggaagaacttgaaaaacgtctactggatttggacacaggtnctgagtctgcagtccgagctgttattgaagaattttcaacagatgttcaaactgatgaagatagtatattgaataagctttcaactatcaacaaatgcttctctgcagagactgttgaggatntcataaaagcattngaatcagaagcgagcatagncggaaaccaatggatagctccagtcctaaagggtctnagaagtcatctccaactgcactgaagatcaccctgagatgatcagagaaggtcgnaacagagtttgcctgaangtgtgactaaggatttaggnttacaatgaantactgcgg

SEQ ID NO: 82678 - DNA, 417 bp, Triticum aestivum
  unsure (1)..(417): unsure at all n locations
  Clone ID: PAT_TA_82678
caaggctgtagtctgggaagaagacactttgtatgagtacctgcttaaccctaaaaagtacattcctggaaccaagatggtcttccctgggctgaanaagccgcaggagcgtgctgatctcatcgcgtacctgaaggaagcaactgcatagttcattgacatgccttttgccatgaagagaaaaattgttttgcagtttaataaaaaacattttagacaatttgggtcaccctgtttgaacagggtgcaacacgtctcattattttcgttcttatggtgtccgtatggaatgcctaggtgtttagctgtgcacaantaacagttnaactttgacggctcctatttcaagtgctggagaaatncagtgccctatttttgccaccagngtgtggaatgnnatcggtaatgaccattttg

SEQ ID NO: 82679 - DNA, 537 bp, Triticum aestivum
  unsure (1)..(537): unsure at all n locations
  Clone ID: PAT_TA_82679
agaccagcagcagcccatccgaaccccgcctcctcctcctcctcccgggttcgcgtgaggctgtgtgctgctgggaggcggcgccggacgccggcgccatggaggcggagaagaagccgccggcgtgtccgacgtgggcgcgtgggcgatgaacgtcgtcagctccgtcagcctcatcatggccaacaagcagctcatgtcctcctccggctacnccttcgccttcgccaccacgctcaccgggttccacttcaccgtcacggcgctcgtcgggtggatctccaacgccaccggctactccgtctccaagcacgtcccgctctgggactcgtctggttctcgctcgtcgccaacacctccatcancgggatgaacctcagcctcatgntcaactccgtcgntttaccagatctcanacngagatgnttcggtggttgctatgaatggtgtaacagaagnactanacactaaggnatatcgngtatgtcgtggngccgtntcggnttgatggacgnttcgngtatccanggtattgcg

SEQ ID NO: 82680 - DNA, 524 bp, Triticum aestivum
  unsure (1)..(524): unsure at all n locations
  Clone ID: PAT_TA_82680
ggagagcaccctccacttggtgctgcgtcttaggggtggtatgcagatctttgtgaaaacccttactggcaagaccatcactcttgaggtggagtcttcagataccattgacaatgtcaaggccaagatccaggacaaggagggcatcccgccggaccagcagcgtcttatctttgccggcaagcagctggaggatggacgcacccttgcggattacaacattcagaaggagagcaccctccacctggtgctgcgcctcaggggaggaatgcagatcttcgtgaagacattgactggcaagaccatcaccttggaggttgagagtccgacaccattgataatgtgaaggccaagatccaggacaaggagggtatccccccggancagcagcggtgatttcgccgcaagagctggangatggtcgacttggctgactacacatcagagggagcacctccatctgtntccgctaggggcggtatcagtcttgtnngaccttantggaanccatanctggaggtaaa

SEQ ID NO: 82681 - DNA, 499 bp, Triticum aestivum
  unsure (1)..(499): unsure at all n locations
  Clone ID: PAT_TA_82681
tggtagtgctttcagggttaataccaaacctgccgnagagactantcatagtggtcttgttaataaaatctaaagctttctcccctctagcctttgcttcaagccttcttcggtagatatcattcacaaaatccttgaatagtgattccattatgtcaaacagatagccgcagattgggtagaccttgtaancgatacttncagcatnctttagctcctcagaaaaatagacacctatanacctaccagttggaaatatgagcgtaccgtcnctcttaagcnacatctcatcgatatgncnttctcnactgctgtgctttagtgtgcgtgacatggtantgatggctccaggatgtcaatggnctgagnttttaagcaatgnngcatcncagntttcccaaggacatgnacaggactgcaagcctgtcantctantngctcatatttgantttcattnagtcgatccgctgtngggtagnggccacngagataattgaa

SEQ ID NO: 82682 - DNA, 288 bp, Triticum aestivum
  unsure (1)..(288): unsure at all n locations
  Clone ID: PAT_TA_82682
gcaagttgagcntccatccatccatggcgggaggcaagtccaccggcaatgccgcgcgcacagggnngcgcgtcgangcaaccgtcctcaagcgctccagngacgggagcgccttcaccanatgcgaggcctncaacaaggatgtncccgtcgtcctcatcgacatgcacagntgcagcctcgacgagaagatcnggatgacgctcgaggcgcaggtcgtcnagaatancgtcggnggtcgncagtgcagaccgnaanaagtcctcaggcagggggngtggtaccaag

SEQ ID NO: 82683 - DNA, 327 bp, Triticum aestivum
  unsure (1)..(327): unsure at all n locations
  Clone ID: PAT_TA_82683
agactntggantggctcgaatcgaggtaaaaaccganggaatgacnccagagacaggaacctaccggnggattgcgccgganatgatccagcacaggccttatgatcataaggtcnacnagtatagctttgggatagtnctntgggagcncatgaccgncatgcnccccttcacaaacatnacancggatcaggcancttttgctgtgntnaacaanaacgcncgtccagcgatcccacaanattgccngcccgctctaanccatatcatgacccgtngctgggatgcnaaccctgaancntcccatcattcaacnatgttgtacca

SEQ ID NO: 82684 - DNA, 441 bp, Triticum aestivum
  unsure (1)..(441): unsure at all n locations
  Clone ID: PAT_TA_82684
gttgaaacctcatcnggagttgtgataccagcaacctttgatatggattcaaggtgcccagatgaagttgtcaggagaattcgtgtgagcgttactcntatgatccaacttggcaaggaaggttgctggagacttacgatactcaggacgatgttttccaaattgcaccngcctgctggatgccagattgggccgatatagcgtcctcactcaaccagctctcggactccgaagtncctgntgcggtgtccactctccagcgcagaacagctcanttcgtggaanacgaaagnaggattggaaatacctnatcgatnacccggnctggaagagacgttcccaaancacaagcccgggtgtcanaaggcaacnacggaagctggcaaggnctcgngtcaancaagggcntcatgnctgtgtatcgtggtctccagacatgac

SEQ ID NO: 82685 - DNA, 518 bp, Triticum aestivum
  unsure (1)..(518): unsure at all n locations
  Clone ID: PAT_TA_82685
actcactttgcataaattatttattatgcaacgaattttttaattattattactattatctccgatttgcactattttttgtgcacaggaacatgatccggggacttcggcatcattctgccggtccgcattgaccgtgctagggcaccacttcggcgtgtcgagctctccgctccgccacctttgaccggcttgggggatggaacctcgtcccgcatcaagctcggaccgcgtcatcaatgccgaacacattaaccagctaagttgctttcatgctcaaagttttaatttttaacctgtgttcggttcgaccaagcattatactttttttggaaaaaagttgcttgtaaaaaatttccttgtccaaactttgtttgtgacacacatattcaaataccccgtttatttgagggcttcctttatgaagattttcctcttgcatatgattatnacttgtaacggcttcgttccttgttcgtgtattacgccacaatatgcaccatattgacttgagcgan

SEQ ID NO: 82686 - DNA, 510 bp, Triticum aestivum
  Clone ID: PAT_TA_82686
actttgcgacgacccaacggttctctaccttagttaaaaccttccgatcccccctttctagacgcaacagcgattaaaacgaccaggacaggtccccatacttcaaaatggccggaaactttgaggaagttgccaagcagtttgttgagttctactacaacaccttcgacagtgatcgcaagggtctcgctgctctctaccgagaccactctatgctgactttcgagtctgcttccgtccttggcacccaagccattaccgagaagcttgctggcctcccctttgagaaggtcaagcaccaagtctctaccctcgatgcccagccctccaacgaccagggcggtgtcattatcctcattaccggtgctctccttgtcgatgaggagcagcgccccatgaacttcagccagtctttccagctcgcccgcgatgcgaatggccagtacttcgtctacaacgacatcttcaagcttgtcttcggttaaacgaaagcagttacactgccggccg

SEQ ID NO: 82687 - DNA, 471 bp, Triticum aestivum
  Clone ID: PAT_TA_82687
agaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctcttccaacagctacgccatcaagaagaaggacgagattgagcgtgttgccaaggccaaccgttgagtggagcttgtatcctggtgcacttgcactagaactacgtttctggcagtcgtatttttttcttgtgtttttacccatgtttagactttgagacctatatctaaggttttggttctcagtgaacaatgaaaattactgtgaaatgcagttgttttggtgcagaaatgcgcactgagatattctgcttgtgaatttgtgagtgctgttggcgtcgccgctggcttgccgatgtagtatttcttgtctaaaaaaaaaaaa

SEQ ID NO: 82688 - DNA, 296 bp, Triticum aestivum
  Clone ID: PAT_TA_82688
cagcatttgatgtgccttcatgatgtgctatagagacattttagttggatgtgttttgtgcatctttccttgatttccatttccctatttagagatatcatcttttacactgtcttttctcaataagttacgacatgaaccatctttcttttctttcctccaggcacactaccaaaataactgcatatgccgagggcctcatctatgtcgacggctcccgtcggcatagatagacctatcctgacggcctaggacatgacgtaggcatagaaaagccgttggcatacgtctatcta

SEQ ID NO: 82689 - DNA, 515 bp, Triticum aestivum
  unsure (1)..(515): unsure at all n locations
  Clone ID: PAT_TA_82689
ctgcaagagtcgttccagtatattttgtgttttggaagataaaaaccggtagcaacgacctctaaagatcgacgaggaacacagtaacaacaaggggcacagcaaaagatggcgatgcaagcatatactcgtagtagcctgtagagtgtagccattacatgtcagttgcatgctggactacctacctacccgaactacaatcacgaagcccattattcctgactaataattcttgcaacaaagaaagcgaaaaccagcatctcctcaaggaaaactcaggtacacgaaccgactccaaaatggactgacactaacgccgagcgctccatccagctgcatgccgcaaggaaactcagtggattccaccgctgccggatccggacccagagccaccgccaccaccagagccgccttgcgattngccgccaccgccgncggccaccgccggcaccgatttccngccgcgtaactgaanccccaggacccgtngctgccgggcttgnccttnncttcng

SEQ ID NO: 82690 - DNA, 518 bp, Triticum aestivum
  unsure (1)..(518): unsure at all n locations
  Clone ID: PAT_TA_82690
ctcgtgcnccgagtttttttttttttttttttaaacaagtatgaccagaagctttattctattccgaattcagctcatcatttcacacacaaaaaatgaagaaaagcaagcgcctagcaggcggggttcgatttatccgggcgcacacagcacagatcgaggaacccttggatccgttcggatcaagcaaagatgtgcaaacgagatcaggttacggagggcgcggcgccggcggactcggcctcgaggtaccggcagatccgctcgacgacctccctccccttggcgctattctgcagaaacctctcggcgcaccgggnctcgaccttctcagcgacggcggcgagggccgcgagcgggcggcaccggatcgtggtctcctgcctgaactgcgtccagtcgtcgggccggtcccgatgtggtctgtangaagcgcgctcctcgaacctcgatnaggccccggaagcttaacgtttgcgcacgacgacgtccattgcgcggcgcttggnttcaanaan

SEQ ID NO: 82691 - DNA, 212 bp, Triticum aestivum
  unsure (1)..(212): unsure at all n locations
  Clone ID: PAT_TA_82691
gttttttttttttttttttggnntctaaaactnatgtcctatggtgtgtctgaaccaccgctcagcataggttcagacacaccataggacatcagttttagactccaacaaaaaacaaacatacataacataataggacacggcggtcctggggcagcagcagcactctagcagcacagcacttctctcccttcttcaatgcatgttctagg

SEQ ID NO: 82692 - DNA, 504 bp, Triticum aestivum
  unsure (1)..(504): unsure at all n locations
  Clone ID: PAT_TA_82692
accgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggcctacctcgtggggctctttgaggacactaacctgtgcgccatccacgccaagcgcgtcaccatcatgcccaaggacatccagctcgcgcgccgcatcangggagagagggcctgagcgaggcgagctcctctcaccgcaggcggcgtcgttgttgcttcgggcctgcntgtagganttgtgcttctnttggtttcctttctggtggcagtggcatcttcgtaccattgtgcttgtncttagaatcttagggatagagagttgttcagttgctgggtaacctgattgtntatcttgattcctgcctctgtaatggttgtctgctgtcttaatggaaatganatt

SEQ ID NO: 82693 - DNA, 524 bp, Triticum aestivum
  unsure (1)..(524): unsure at all n locations
  Clone ID: PAT_TA_82693
gctaactgaatgttcttttctatcttcaccaacaccgtcgcaagtgccttcaccaccaaaattaccaaatcatgagaagaaggctggcaatggcttggtaatcgtggctgttgctgggagctttgtcatatttctgctagctgctgtgatgttcactatgtgcatttcaaagaggaaggagaagaaagacgaagcgggttacaacggtaaggttactgatggtggaagggttgagaagcgcaaagaggatctcagcagcggcgtccaaatggcgcataagaacaagttagttttcttggagggatgcagttacaactttgacttggaggacttgctgagagcttctgctgaagttctcgggaaagggagctatggaactgcctacaaggctatactcgaggatggctctactgtggtagtcaagaggctaaaggatgtcgtggcagggaagaaagaatttgagcagcagatggagccatagggagggtaggtaaacatgcaaacatcgcgcctattcgtgcttn

SEQ ID NO: 82694 - DNA, 244 bp, Triticum aestivum
  unsure (1)..(244): unsure at all n locations
  Clone ID: PAT_TA_82694
gaattcaccgaccagcnttagagcngaattcaccggatcagcctagagccaaattcacagatcagngtagagncggaattcacagatcagngtagagnngaattcacngatcagctagagccgaattcaccgatcaggnctagagcgaatacaccgatcagcctagagcngaattcaccgatcagntagagngaattcaangattagctagagcgaatcaccgatnagnctagagcngaattca

SEQ ID NO: 82695 - DNA, 529 bp, Triticum aestivum
  unsure (1)..(529): unsure at all n locations
  Clone ID: PAT_TA_82695
ctgcgaccggcttgcttcggtggggttcacgacgaacctgatctcgtacctcaccctgcagctgcacctgccgctcgtggaggcctccaacatcatcaccaactacaatggcactgctaacctcactccgctcatcggcggtctcatcgccgactcctttgccggccgcttctggaccatcacattcggctccatcatctaccagctcggcatggtctgccttaccctctccgccgcgctcccctcgctgcacccgccatcctgcgccaagcacgctgcagactgccagcgcgcgtcctcctaccagatttccgtgctgtacctgtctctgctctgcacgtcgatcggcaccgggggcacgcgcccctgcaccatggcgtttggcgccgaaccagcttgagctgaaacgcgcacagggnaccggggcgcaagccaaagtggagtttctttaacctctacttcttcgccgtcgagcttcgcgaagttcgcgggccgtcaccgccgtggtgtacatccaggacaaagtcng

SEQ ID NO: 82696 - DNA, 535 bp, Triticum aestivum
  unsure (1)..(535): unsure at all n locations
  Clone ID: PAT_TA_82696
cgcancaaaccctctccagcagccgtcgtcgccaccgctgcagcgcggaggcgacccccatcgccgccaagatgcagatcttcgtgaagaccctgacggggaaaaccatcacgttggaggtggagtcctcggacaccatcgacaacgtgaaggccaagatacaggacaaggagggcatcccgccggaccagcagcggctcatcttcgccggcaagcagctcgaggacggccgcaccctcgccgactacaacatccagaaggagtccaccctccacctggtgctccgcctccgaggtggcgccaagaagcgcaagaagaagacgtacaccaagcccaagaagatcaagcacaagcacaagaaggtgaagttcgcagtgctgcagttctacaaggtggacgacgccaccggcaaggtgacccgccttccgcaaagagttgccccaacaccgagtgcggtgcgggtgtcttcattggccaaccacttcgaccgccactactgcggcaagttgcggcttaacttantctacaattaaaa

SEQ ID NO: 82697 - DNA, 527 bp, Triticum aestivum
  unsure (1)..(527): unsure at all n locations
  Clone ID: PAT_TA_82697
gctgctgctcctctcctcccatctcaccacacaccgcagccccagcaagatcgcgcggaggccatggcgaaccaagccttcctccgccggcgccaagcnaaccgcggctgcgccaccggttacagtgcactcggcgctggtcacctacacctccatgctcgcgctcctctccctctgcccgcccttcgtcatcctcctgtggtacacgatggtgcacgcggacggatcggtggtgcggacttacgagcacctcagggatcacggcgtgctcgaggggctcaaggccatctggcccatgcccaccctcgtcgcgtggaagatcatcttcggcttcgggctcttcgaggccgtcctacagctgctgctccctgggaagcgcttcgaagggcccatctcgcctgccgggaacgtgccggtctacaaggcaaatggcttacaagcatatgcagtgaaccttgataacttaccttggtttgtggtggttcggtatatttaancctgcaatagtgtatgatcactttggggag

SEQ ID NO: 82698 - DNA, 507 bp, Triticum aestivum
  unsure (1)..(507): unsure at all n locations
  Clone ID: PAT_TA_82698
ccctcccccaaaactacttccccacaaacccagaccagagcagcttgcgttgcgtctctcgtttcttttcttgttggccttctccttgccttgcttttgcttgctcgttgcttcttgagttcgagcccgccccttgtgcgccttgcccaagtctctgtgtgttttttataggcttgagagcttggaatagcggggggtggaggaagcggaagaggagcttcgttttgtgttctagagggagtcatgttccatggcggcaggcctctgtccctccgggggtctctcaaggcgcttgaagctgatatccaccatgccaacaccctggngcatgtatacacagggcgtatgggggtgcctgcgtgcagatgaagctgtcctanagctccatggctccaatctttctcaaccttatccaatngatggactgcagctgctccctgtcataaaagctcccaggtaactttggctgctcnangttttcgtctanaaaggttatntcgatgaaaa

SEQ ID NO: 82699 - DNA, 567 bp, Triticum aestivum
  unsure (1)..(567): unsure at all n locations
  Clone ID: PAT_TA_82699
cttcatcatgcttggcagcaaggcttccctgttattatcatgcttggctctcctaagccctgcatcatgcagagccattgaggagcgggccgtggcggatcatgccgttacgttccagaccatttacaagcctccctccaactacaacactcccaagaccttgtatgggcgaaacgtccagcttgctgatggaactatcctagctacttgggagaactatagccctgaaccaccaatggtgtacttccccatctaccagagcaaagataagggatcaacctgggcgcctctctccaacgtgacagacaccaagaacggctggggtctccgtaccagccttcctatacgtcctgccccaggccatcggaactcgcaagggaactatctccttgtggaaatagtatcctaccgattcanaagacaagttattttacgtttacgnagggaagacgtgaagtnattcaatattgcaacgagaaagcgtccaaaatgcgaactcttctggagcttctatgtncacaacaantgttgtatattgttaggnaccttattgnagattgtcacant

SEQ ID NO: 82700 - DNA, 249 bp, Triticum aestivum
  Clone ID: PAT_TA_82700
aagagctactacagtaccgattaaaaaaacggtcgtagctactgggcggcgaaatggattttgaaatttattgacattctctagaaaaggtactgtcaataagcctgttggcacagaaaccattaagagaacgcccaataacttattgggtaccgtacggagtatttgaaacacgggaaagaagtaccactcgggtaatatttccagaggagttgcaaacggatctgccggttcaccaatcattgatgg

SEQ ID NO: 82701 - DNA, 562 bp, Triticum aestivum
  unsure (1)..(562): unsure at all n locations
  Clone ID: PAT_TA_82701
cttgaatccaaggtggatcgtctccgtagagggggcgcgctctctctcgtggagtagatccgatatggatgagcaaagctctatctctaaatgagctaatcctttgctaaccctagaaagatggtggagaaagagtatatatagtctanggggtcgaaggggtacacgggcctcagcccttactgtgcgcagacaggggtggccggatgtccgggcgacgngccggatgtccggggcttcaggaggngccggatgtccgggctgggggctggatgtcagggttggagggtaaaacttctggatgtcttctgtcgtcgatgccggatttccgagggaagggccggatgtccgggtttggtgagcnccggatgtccngggtggccgggatgtccggtcntatntgttggcgtccgttntgnaantcctttgcggctcaaagcgccgattcggctttgccggattcaccnctgnanttacagtcgttttttgngtgttcagctacnctgatgttatttacttggttcatctctntgtcgaggtcgaaaactatnatnaacaggng

SEQ ID NO: 82702 - DNA, 373 bp, Triticum aestivum
  Clone ID: PAT_TA_82702
aacgtgcgctatgcaggggaggcattcaggtctccatgagaaatacagacttcagagtctcagtaaagcctaaagtatgtgtactgcccagtagaagaaataaaagaactagatcatgaccagtcatgctttcatccttgttaccacgagttatcccaattttttgcggattttttttcttgatacatcttattatctgcgagcaattgaagacagtcatcatccggaaagatgcttcctgtgcacccgcgcgagtctgagaaagtgacagctttatatggacatgaccattaacatttaacaatcatgcttgtaatggtgcgttatggtcatacaataaattaagggacatttacattccaaaaaaaaaaaa

SEQ ID NO: 82703 - DNA, 564 bp, Triticum aestivum
  unsure (1)..(564): unsure at all n locations
  Clone ID: PAT_TA_82703
gtttagacctttctgtgaaggataattctgccaaacccccacggaggcactcaatacaaaccaagccaggagctagcccaaggccaacaccttctggaactgtgactccggtgtctggggttcggtcaaagaggtcggaaagccaggggaggtttgataccccgacatcagaagtgtccatgtccatctcaaggcgcaagttcagcacgctttcttcaatctcgtactggatgacacagatcaggctggcagaggctgcttccaagcactcggtttctctgggcttctttaagcttgctcttgaatcagaatgtgagcctttggaccggatgagggaagaactcaagtcctacgtagcacggcatggctggcgacagaattggaggaccagttaaggcattctccaggtttatgatattttggatgatttgagactgaatttgagagcctacagaacaaaagttacaggtgctgtatgcacaatggtacgatgtaactnagcaagnatgacttatcactnaacagaacttaagaaggannnagaataatctgtnaganangcct

SEQ ID NO: 82704 - DNA, 304 bp, Triticum aestivum
  unsure (1)..(304): unsure at all n locations
  Clone ID: PAT_TA_82704
agtcactcctataacaatttgtaaaggtacaatttctacaaaaaataacttcacacatgagcaggaatgcccacagcaacaagaccccaaaaattagctttcacgcgatgcacacaacttctggtctatgtatgacagaggattttatactgatctgtcacactggtacagaaatagaagctctataagcttatgctgtccgctttcctgttcctggcctttgctgtaccaactgatcatatgtttgctccacttccctgtgttgatgcttttgtnncccgccccgncccggggnccggggggg

SEQ ID NO: 82705 - DNA, 560 bp, Triticum aestivum
  unsure (1)..(560): unsure at all n locations
  Clone ID: PAT_TA_82705
catatccaatccaattatattgctacaatacaggcctacaccctcagctcaacgtcgacgttggcgatgtgtctgccgttctcctgttgccaccgcggtgaccatgacacaaaggagtctgaagtggaaagccaaccttattatcattatccgtctcctgtgaaagaagcacatgatggtcaccgtgcgagtgcgaccaacgacatgcctcccgtcgtcgaggacaacagcaagaacggaggagggcacacgacgggtttcagcagccactcagacgacggcgttgtccgaggtggagagacgacgataactaccgagaagatcgtggcgccgccaccactactccagcaccgaantgttctagggatctggtgtnanncaactcctcagggtacgtatgtctctgtagtcgtctcgcacaacatggcgtggtgtcgcagatgctccagnagccgtgtacaaagtgnctacgttctgtgtgtgtaancnctaatgtacctntnatntgggcaagaagcgcttttccacaatttgtccgtcnnntagcatcgtnncgnaat

SEQ ID NO: 82706 - DNA, 473 bp, Triticum aestivum
  unsure (1)..(473): unsure at all n locations
  Clone ID: PAT_TA_82706
cctccgttcaccccgtccatttgatttgcgttcactgcgttgcgtttccttggaggggattgttctctcctctcctttggattggaggtccctccttcttctcctctctctctcagaggaaggcctgaggatccaggaagaggacagcaatgggggaaggtgcaggtgaccgtgtcctgagccgcctccacagcgtcagggagcgcattggcgactcactctctgcccaccccaatgagcttgtcgccgtcttcaccaggctgaaaaaccttggaaagggtatgctgcagccccaccagatnattgccgagtacaacaatgcgatccctgaggctaacgcgagaanctcaaggatgtnttttgaggatgtcctgagggagtcaggaggcnttgtatcccccatggttnattgcatcgcctaggctggtgttggatatgnagggnaacgtatagccgtgttagagctnngtcct

SEQ ID NO: 82707 - DNA, 528 bp, Triticum aestivum
  unsure (1)..(528): unsure at all n locations
  Clone ID: PAT_TA_82707
tggtggttcgtttctgatctctgagagtccgcccccctaaacaccgcttgggctatcccgaaccctaaccccgaccgccgcgccagtactcccgtttcgtcctcgcggcattcgcggcgttttctccctctgctcgaaccgcgccgacgagcgacgacaagaactgctctattcttcaaaacaaatggcgaccgttccagttaacccaaaaccttttctgaacaacctgacaggaaagcctgttattgtcaaactcaagtggggtatggagtacaagggttatcttgctttgtggactcatatatgaatctccagttgccaacactgaggagtacattgatggtcaattctctggaaacctgggagagattctgatcangtgnanaacgtcatgtattcgaggcgttcagaggatgcagagtagngacgcaagtgagagatgcgatcatgtagatgataatgtatatgtttaatctangtcaattgccgnacagtgttatcgatgcttgtccttgnggatgaacatna

SEQ ID NO: 82708 - DNA, 172 bp, Triticum aestivum
  unsure (1)..(172): unsure at all n locations
  Clone ID: PAT_TA_82708
tcttgctgcatctcatccnagatgattgtaatccgaacaatgtgtagttaataaaaatgtcgctttgccctgaaaatgttttacgctgtaacatcgctctgtacgtgattggatttcctacatgacaactggctaatggagtctaaataatttccttgtcaaaaaaaaaaaa

SEQ ID NO: 82709 - DNA, 538 bp, Triticum aestivum
  unsure (1)..(538): unsure at all n locations
  Clone ID: PAT_TA_82709
tgtcgatggtgacaccgccgattggcgccataaacccgatgagtttacacgcagcggtgaatgctatcgtcgagttccagcttcgacggatgccttgcccatcttctaaaccatttcccgatggcttcaagcacctttgaatcanatatacaaagcgtcttggtgtgattcacaaattatctttatacttgtttgacctcgctggttactctccttcattcgaagcatctgcctgctagcgttataccccttttgttctggcttatcatatcatgataagttgagaaattaccattggccattcacagcacatcactttctatataggcggagatggtttacaatatgaagacacaaactacacaagtacacaaaccctcgtacaaantattaatcattncttctttcttttccttatcacgacatcattatcttggggtcaaggctagccggtcacttgttggagactaagatatnagtatcaggacagtgcgacggggnttcattctcggnatggnacacaatcagtgacttcgag

SEQ ID NO: 82710 - DNA, 228 bp, Triticum aestivum
  unsure (1)..(228): unsure at all n locations
  Clone ID: PAT_TA_82710
ncnancgcccccggngttacgangnaccccttgcacaaacnacagcagcttcangtggttctgcgnaaaaagcgcggtttctgcatnatgatgacatcatgtgcgcancgctacaangatcagccaacgatttanccggggatagatctacaanaantcttcgatctttcaatccacactgacattnaccttcnaaccctacatgngnggntgttcttcgtaataatt

SEQ ID NO: 82711 - DNA, 393 bp, Triticum aestivum
  unsure (1)..(393): unsure at all n locations
  Clone ID: PAT_TA_82711
naagaatcggaagaaacgaggtcgtnactnancagtaggagctcctctngntcctcgctcgtatctngcgcganaagcaagctctcggtcgtncgcnacctcttcgtctcaaagaagacaggcaatgggaaggcgtgatgcgccatgccctgaaangcttttattcggtgctgtaaagatgctagcntaggtgatgcgcaatanaagaaggaacttgttcagtgtagagtagctgtngtattgatgttacaaaangggaaanttgnagtgcagcttttgcaagcnatgtattgctcgcagctcctttctttactgaagtngcataaaaaaananaanaaaactcganggggggccggtcccnnttngcctttgtggtcgtttnacgcgtcact

SEQ ID NO: 82712 - DNA, 389 bp, Triticum aestivum
  unsure (1)..(389): unsure at all n locations
  Clone ID: PAT_TA_82712
ctcgtgccggtccaaacaagagcggcgctgctcacggcggcctaacgagctaggccggatattccttaacccgctgactagatagatcgatccatcagctggcagccatgaatatgatcagggcagtacggcgccggttcaccgtcggccacctggctacggccaaggaccccgccacgctgcgccangcggccgccgaactcctcgccaccgccatcntcgtcttcgccgcgaaggtgcangtctctctcgggaggatgcaccaccatgacaaggatggcggcggctggtggccgtngcntcgcgangnctcgcgtngcngccccgttgggtncgcgcaacantncgggggcangtaaaccggcgtnacttngggcgttattncnggc

SEQ ID NO: 82713 - DNA, 530 bp, Triticum aestivum
  unsure (1)..(530): unsure at all n locations
  Clone ID: PAT_TA_82713
ctacatcccccaaatccataccaacgaacaaaaattgtacaaatcgcagtcggtcactgtgaattcgctgctgaatcagcattcctgatccgaatggacaggtttcagtcgagcattcaattcaccacggcaacaccaaaaatcagcgatcttgtgccccgtcggtcaagctagcggaaagccgaaagacaagaccaaaaccactgccgcacatgcatattgcattggcacggcgtgcagaaagagggacggcacccgccgttggtacgcaggtacgtgcttgccctcggttggcccacacaccacagactacacgcccagtttcgtcctaaacccggacaaacgtcgggcgggcgggtttaagctgggttgtaaaagccgacctttattttcaagtccgagccggctaaagccgaaatctcctgttttgagccgagccggctgaataagccgagccgaagccggccgatgccggcgatgtgtttttanaggacgttactgnccgaaccgaagccggccgaattanaaan

SEQ ID NO: 82714 - DNA, 499 bp, Triticum aestivum
  unsure (1)..(499): unsure at all n locations
  Clone ID: PAT_TA_82714
caacgatcatgccatcccatgacctgcttgtgttgtagctcaacgtaccggctccttccaagggattttgtgaaaatgtctgcaacttggtctccggttctgacatggacgatatccactcgccccagctcaacacactctttgctatagtgatacctgaggtcaatgtgtttactcctctcatgatgcaccggatttttgctcagttcgattgcagatctgttgtnaacatgcagcttgaccttctgaacttttgtacccagcatttcagcaagcaacctgctcanccacacagcctgacttgctgctgtcgtgntntatgtactcggcctcgatgaagttttgaaccacctctactttgggaggccaagtaatagcnctgaccggggaaaacaaataccgggnnttttccngcataaattcccacggggcctatnangaaccaanggaatagttccctttgcncgtgaaaccaagttnggggcctnatgaccccaaa

SEQ ID NO: 82715 - DNA, 527 bp, Triticum aestivum
  unsure (1)..(527): unsure at all n locations
  Clone ID: PAT_TA_82715
cacgactgccacccctcctcttccttgtgatctccgaatacccatctcagattccaagggccgcgccgtgtaatccccggctctccccacccaccatatatctagtatccgcgcctcaaatccctcgcgaaacgccccgccgtaagcagttgttgtctgccgtgatttgagccgggcggacggattgatcccgggacgaggtgtctcagctcttgatcttgatcctgatcctgggaggcgttcctggtttattggtgggagcgaagaagccatgataccttccgtgangctctctcctggtcctgcagccttctcaggtccagctacgtcaaaattaccgtcaattccatccatctccagnatcccccaaaaaatnngnggctctcgannaaccanctactagcacgnagatggtcggcatgcgagttaagtctggaanagcattagtccgttgtttgttctctctatanangagtaaaactaggtgtgcagttagtcgaagcgacgagttgaaattcattattgca

SEQ ID NO: 82716 - DNA, 540 bp, Triticum aestivum
  unsure (1)..(540): unsure at all n locations
  Clone ID: PAT_TA_82716
gaaattaggaatcaagcagaaacagcttcaaagcagccgaactgttttccacggcattgtacctggcctttcctgctccccaatcggcaagatccagatagacgtcctctttggagacaaagatcattttcgccgggagccagtctggtttgaagtggtggaccttgaaagcccataccaagcgttgcttggccgacctgctttagccaagttcatggcggtcccccactatgcctacctcaagatgaagatgccgagttcaaaggggatttgaccatggctggcgactacaggaagtcgtccgcctgcgcggccgagaacagtcggctggccaagtccctggtgatcgcactgagagcggtccttgaccgggttgtggcatggcggcaacagcagaatgtcgcccaccccaagagtcgaactganggttttaagccggcnaagaacaagagganctttgacacggagacccgagagccgtgtcataggtcaactgacacaataggagngagcncgtgattccccgtanaacgaacatnt

SEQ ID NO: 82717 - DNA, 537 bp, Triticum aestivum
  unsure (1)..(537): unsure at all n locations
  Clone ID: PAT_TA_82717
tcgtggtagcagttggggctaggacaaatacattcaatactcctggtgtggtagagaattgccacttcttgaaggaagtagaggatgctcaaaagatcagacggagtgtgatggactgctttgagagagcaagcctcccctttcttaatgaagaagagaggaagaagaatcttcattttgttgttgtgggtggtggacctactggagtggaatttgcagcatctttgcatgattttgttaccgaagatttatccaagctttacccctcgattcagcaccttgtcaagatatcgttgattgaagctgcagatcatatactgaccatgtttgacaagaggtaactaattttgctgagntaagtttggaagggatggtattgatgtgaaactggatataaagttgtgaaggttctaaggatgatttaccatgcaaaatnctgccaccggggatatttcagtcctatggatgctgctgtcgactggtattggaccgtcatcgtgtgaattatgaacaattggcagctatcgcgntnttgcn

SEQ ID NO: 82718 - DNA, 346 bp, Triticum aestivum
  unsure (1)..(346): unsure at all n locations
  Clone ID: PAT_TA_82718
gaaaggcggaaacccatcgcaactaatccccaaccccaaacctccaatccacccatcccctcctcatccactccgggcggccatggcctgctccttcgccgccgcgaccgtcgtctcttccgcccccaccccggccgccagcccttcgccgttgccccgcagtccgtctctgtctcccgctccgcggtcgccaccgccgccagncgctccgcctcgtcgcctccagatccgcgcgggccaccagactcgtcgcccgcgccggcgggtcgatganttgccgctggtcgggaacaaggcgcaaacttngaagccgaggnngtnttgacaaaagttataaaggtgagct

SEQ ID NO: 82719 - DNA, 478 bp, Triticum aestivum
  unsure (1)..(478): unsure at all n locations
  Clone ID: PAT_TA_82719
cgaaatccaaggttgttccacgaggacagaagagggtgttgcgaangcanacaagaggaagagcgacgtaggggcattgctgcgctacattgttgtgtactaatatatgttgacggcccagaagggcaacatgatccctaggttaactagagctagcgccgactggtcgtttccacgtacgatgcactgcgcatcagcctgtatccatgttgtattatcgtagggcttgtaatgaccacatgccctggttagagttgatcattaggaccagtagctgcttgatttgtgtctcggtgatctagctttgggtagtttgtgcagttggaaggagacagtttgttggttgtattgtattgcagcgcacactagcaagtgttgttgtagccatcaggtacgtgttgtgtagtgaatcaggtccagggacagagctgttcctctgtatgtgacctgacctttgttttgtgccaaaaaaaaaaaa

SEQ ID NO: 82720 - DNA, 533 bp, Triticum aestivum
  unsure (1)..(533): unsure at all n locations
  Clone ID: PAT_TA_82720
atcgacaccccctccgctntccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgaannagttcctccggcnacccagaccgagctgcacgagctcctcggcaagctcaaggaggaggatgtgagcacattgacaattctggtgatggggaaaggcggagtggggaagtcatctactgttaatccatcgtcggggagaggatcgccactgtcagcgtttccagtctgagggttgagaccgatgatgtggtcgcgacaaggganggttcacttgaacattatcgcactcctggcttattgaagtgatcattaatgagcaggctttacatattaagagattttctggcagactattatgtctctgatgtgatctttgatcgacagatgatacattgatganagtaaaagncnncca

SEQ ID NO: 82721 - DNA, 362 bp, Triticum aestivum
  unsure (1)..(362): unsure at all n locations
  Clone ID: PAT_TA_82721
gganctcgacaaggacgaccgacgacgcacgcggagatncggcgtactncaaattttgaaaactnaactntaagatggcatcancaganctttcccgtgangnaaangtgtacatngcgaactcgctnagcaagcggagangtacnaggagatngttgaattcatgggaaaggtanccaaaatttttactnggngggttcactttggngggngaaaacccttttttntggaaanaaaaaancttttttggccccncggccttaagggngatatttccncctttggaaaaaaaagnaggggccgcnaataatggncncgataaacccccncaggttttnggnggaaanttaaactgnccccaa

SEQ ID NO: 82722 - DNA, 199 bp, Triticum aestivum
  unsure (1)..(199): unsure at all n locations
  Clone ID: PAT_TA_82722
ggaattaccagattancgtnaaccgatgaggncaaanctgcatatnagaaaangngtgaacaactnaacaagcaaggnctngaagaagaggaaatnagcaagggacatgacctattgaagggatcttttaccatattatcaaccgnggaagagagaagattntatgantggngcnttgcgangaatnggcanccttaac

SEQ ID NO: 82723 - DNA, 522 bp, Triticum aestivum
  unsure (1)..(522): unsure at all n locations
  Clone ID: PAT_TA_82723
tccgaccccgctgcggggncctggcgcgcggtgccggaagcggaggccattgacgcgctgccctacatcgacggcgactacggcgatgcggcggtgaagcgggaggtcgatcgcctcgtcgaggaggagatgcgccgagggaagcgcaagcctgcagacttcctccgggacctgccccctgttcccaccgccggattcgagaatcatcctatgcttgctaaagaatatgaacgtgttagggctggcaaacctccttttatgctagatatgtctcgcnatggtttggagccacctccaatgaacaagaggaatgatgttggcgcttggaggcagntctacggaatgtcagagccagttgcagcatcaaattataaggtagagaatctcgacttatctgaaatatggctgatgtttgaactcagaacagacaaatggaatcagttctgttagatcaaagatgctgngatacatgaaagatagaaatgcatcgaagaggantccccacaaatctggagncantgc

SEQ ID NO: 82724 - DNA, 523 bp, Triticum aestivum
  unsure (1)..(523): unsure at all n locations
  Clone ID: PAT_TA_82724
ccacaccangagaattacacagcacancaccgacaacaactnttaagtaacccaagcaaggaaccattggccggcggcgtggccccttntccttcttgctaattgccaaaggaccttgattggcggnttcggngggttcccggcggcgagaagaagcacgaacatcaagttgtactggnacgacgtggtgagcggggccgagcccgacggcggttgccggtggcgnaggcggcggtgaccaacacctccaagaccgccttcggnatggtggtggtgatcgangacccgntgaccgagggccccgacctcaagtcctcaaagccgttcggcngcgcgaagggnacttacgtcggcgccggnaaggacgagctctccctgatgatgaanatgaacttcgtgttcaaggncggngantaaaaggaagcaccgtggcaataatggggcngaaanccnttttnacgccgtcgcaaaatgcnttttggnggaacgggctttaaatgccngggtacnaggcccccacana

SEQ ID NO: 82725 - DNA, 236 bp, Triticum aestivum
  Clone ID: PAT_TA_82725
ctttgtcgtcacacatcaatttctcccccattctcgtcgggttttgttttaatgccttgatgtcgtttgtaagcttacttggattagtagaggaagtgtttcctgtaggctctgatctggtactaacctgtttagctgaggacatgcacattgggtgggctgcttggggcccaaaactatgatgagatgagacattatcttacctcgcttgacattttcaatttaaaaaaaaaaaa

SEQ ID NO: 82726 - DNA, 508 bp, Triticum aestivum
  unsure (1)..(508): unsure at all n locations
  Clone ID: PAT_TA_82726
gcaagatgttgcggattcgtgcagaactggtgctgccactaatgtcatttttggtcttgctcttggatacaagtctgttatcatcccgattttcgctattgctgttagcatctatgtcagtttctccattgctgcgatgtacggcattgcagttgccgctcttggtatgctgagcacaatcgcaactggtcttgctattgatgcttatggtcccatcagtgacaatgctggtggtattgctgagatggctggaatgagccacagaatccgtgagagaatgatgctcttgatgctgctggcaacacaacccctttccaatagcagcagttgtgttgcaagcagtcttgtgtccctggcgtttttggtgcctttgtcagcagaactggagtgaaggtcgtcgacgtctctccccaaggttttcatggttgatnttggagcatgctccgnactggtctctgcatgacataagatnttgaacgtncctaanatgtgagagtcnagcantcaa

SEQ ID NO: 82727 - DNA, 508 bp, Triticum aestivum
  unsure (1)..(508): unsure at all n locations
  Clone ID: PAT_TA_82727
gaacaatcgagctactaataaggtcgtatacatatcttctatatactcctctgaaagttgtgaactccggtcgagcttaaaaacagcagcaatggcgaactttggacattgctgctggctgcagtggtggtcctctcactcctagtgagccccattgcttgnacccgaaagctcaacaaacccaagccgaagccgggcagctacaggcggccggtnaagccgaagccaaaaccggtcacgggcagctacaagccggcgcctgtggccgccagaagaaaccacacagctacacccacgccatcgccgactgtctacggcaagactaccgtccttggtcaactacccctgaaaagagaataccgacaagtggatggcgtgtttgtnctccgggtgtncagtggcgcggtnnatactggtgtggaaaacagaagagattaaagaggagttnaagaaaaataatgtcttcttcctccctgagggttntgagncccaaaagtatgttgcggtt

SEQ ID NO: 82728 - DNA, 218 bp, Triticum aestivum
  unsure (1)..(218): unsure at all n locations
  Clone ID: PAT_TA_82728
nccgggcntccagttctccaactnangctcggctcactttnggagaatggggcanctcancccagggaacagtcacacaccctcctccattatttgantcaatttcacnattcactgatgatctgatgtaccantngctattactantagantgtattctctangncttaataaaaaaaagngtatcttctctnatttananaagccnttcttganaa

SEQ ID NO: 82729 - DNA, 575 bp, Triticum aestivum
  unsure (1)..(575): unsure at all n locations
  Clone ID: PAT_TA_82729
ctcgcgtggcactggtccccgtgttcgccgtgctcgcggcactggcggtggcggagatggcgtccggggcggtgacctgcggcgacgtgacgtccgccgtcgcgccgtgcatgtcctacgcgacggggaaggcgtcggcaccctcgggtgcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaagtgcggcgtctccgtctctttccccatcagaacaaaaccaactgaataacttcactaagttatgtgcanatcatcatcacaacaggtactagccactcggtgttactgttntgccgtctctgatgtgttcttgttgttttctcattgttaaactcattgttcctttanaatgagaatatgatgatataataaaaattntanctaantttatagggggccgtacaattccctaantatgtatagggtntgctnnttaaagtgtatggaaactggtacaattatctnanaatcc

SEQ ID NO: 82730 - DNA, 417 bp, Triticum aestivum
  unsure (1)..(417): unsure at all n locations
  Clone ID: PAT_TA_82730
ccacacacggcaagcaacgcccagggctcgtgctcgccccgcgacccgcgaaagatctgtgctggttcgctcgctcgcgccgcgccgccgcgtgggggtgccgatgagctgcgcggggcaggccggcgggtggctgctcgactacgcgctggtggagnaggagatccanggctccgagttcatctacatggtcgacgacccggccgtctccagcgtgatactggggtttgatgctcccaggaaagaggacggcgtcaggacaaccccggngccaagaagagatcccngccggagtctagcgcgccacccggcaccaangttnngtgagaaactccgggagacaggcnaacgaaagttcaacgagtctgtgcatttgaaccggaaccaccaangcgaaaaatgntatttaaggagtgc

SEQ ID NO: 82731 - DNA, 582 bp, Triticum aestivum
  unsure (1)..(582): unsure at all n locations
  Clone ID: PAT_TA_82731
gccgtgcccagcaccttcggacgccaattcacaacttcgttgttccttccgcagctccgagctccggaatcgagcaaagcacccgagcctgcgccgcgtcaagccgtcaaagctcccccgcttcataccattccctcccccgatccctcgcctcagccctcagctccgcccctcggtttccgaagcgccaccgccgacgtggcctccctcggctccaatggcgttgccctacctggaggccgngctttgctttatgattttcatgtacatatttgagacatatcttgacatccgtcagcatagagcctcaagtgccaactttgccaaaacccctgctgggagtaattagtgacgaaaagttgaacgtctaganttatagctcgacaaaagtatttcattttgttatgagctgtgactatttaatgatactacatactatactaagagtcttcctggtttggaagaattgagagtagtacagtgttggcgatctagatagtataaanccttgttcttagtgtcatgttggngaataagattgcgttcctcatcantttgtaaagtgaatgttananaacaatg

SEQ ID NO: 82732 - DNA, 359 bp, Triticum aestivum
  unsure (1)..(359): unsure at all n locations
  Clone ID: PAT_TA_82732
cgcancagcacgctggangnccggaacgaacgaacgcgcggcgccaccacccacatcactgccctgccgncgtagcccagncccanccacccagngccgnccgcccangncancacgcggaccggagccgngccggagctgcttananacacagggnaacagangcctcctncatncccangngagcggacgagacgangcggccatngccgnacgttgagattccctccgctcctcctctngatggtntcgcannggcgccgcggcgcgnaggcantccgacgnggccgggtnggggaagnagcagnagaagtgcngaagcgtaaacattacaagttcggaaagtggacgagangaga

SEQ ID NO: 82733 - DNA, 496 bp, Triticum aestivum
  unsure (1)..(496): unsure at all n locations
  Clone ID: PAT_TA_82733
gacgcgctggccaaatacttcataggtagcgtgctgagcggcggaggcagcgtgcctgctcctcaggcgtctgctcaggcttgggccgccatggtgaccgagatgcagaagggcgctctttctacgcgtctgggtataccgatcatctacggtatcgatgcagtgcatgggcacaacaacgtctacaaagctactattttccctcacaacgtcgggcttggagctaccagggaccctgacctcgttaagagaattggagaagcaactgctcttgaagttagagctactggaattccttacgcctttgctccctgtatagcggtctgtagaatccaagatggggacgttctatgaagctacagtgagntccaaangttgtcagcactgattcatcattctggctgaagtaacgctctgcgattcncggaangcgtttttggggaanaaaagttttcatccaaactatttggtatggtgaccatacgataaganaaaa

SEQ ID NO: 82734 - DNA, 567 bp, Triticum aestivum
  unsure (1)..(567): unsure at all n locations
  Clone ID: PAT_TA_82734
gtccttcttcgtaagccttcaaaccgacgaatttgagcaactgcacccagagcgcgatccattgccggggaagaagcaacttgttgcgagcctcctctatggcganctccgaccatggttccaacaacggccccaangacgtgccgggcanctacggcctgccgctggtgggcgccgtgcggancgnctcganttctantantttcangggcangacaagtattcgantcccgcgtggaggtanggctccancgtggtgcgcatgaangtnccgccggggcccttnatngcgcgcgaaccgcggttgtggcgttctggacgcaanantttcccgtgtttcnnattgacaagtggagaagaagactnttacngggactaatgcgtcacttcttacggnggtaacggtctctcgaactgaaccttcgagncaacanacaaagtnanantgctttttctctgtttccgaagannagnattcacttcgtcaaatttctgtcttcaacntgagngattgcaaagggaagcanttaaaaataaaaanactcttaattttggagtaattggtgc

SEQ ID NO: 82735 - DNA, 575 bp, Triticum aestivum
  unsure (1)..(575): unsure at all n locations
  Clone ID: PAT_TA_82735
aaatccttcaccatacatagtgccagaggacatgtcgttggcgaaggtgtacaatctcttccgtcaacttggattgagacatatatttgttgttcctaggccttctcgtgttgtaggattgataaccagaaaagatttattacttgaggaggataacaacaatgtgatgccggagctccaatcgacgagtgtaaggggcttgctgaacggcaaaatgctcgggggtaatatacatctggaacgtcctcttcttgacaacctagttattgaatagacacgtagcagcatgtatgtcaaaataattttgatactagcagttaaccttgcactgcatgttgggacatggccatgggtattatacttcacatgaatgatgaagcagcagtgacngataatncanatggtttggatctgcgctgtgccatgatttgcgtgcganattttgctcgcancagtgcnaggagcgtccccgtncgttgttaatagngatgtacttcaaagcgtcatcatcacacatcatgttccacgtaattcgagctgatgatagncatattgtancgatggaagcaaacttt

SEQ ID NO: 82736 - DNA, 484 bp, Triticum aestivum
  unsure (1)..(484): unsure at all n locations
  Clone ID: PAT_TA_82736
gattgctggcattgaggctcagatgggcgtgctgcactacattttgggcaactatggcgagtcctacgactccttcaagagcgcaattgcaaagctccgcacttgtggcgagaagaagtctgccttcttcgggattgccctgaaccagatggggctggcatgtgttcagaggtattcgataaacgaagcagcagaattgttcgaggaagctagaactgttctggaacaagaatacgggccataccatccggatactttaggagtctacagtaatcttgctggaacttatgacgcgatgggaaggctggatgaggccatcgagatcttggaatatgtggttggaatgcgcgaggagaactaggtacggcaaacccagacgttgacgcgagaacggagctttgggactattaaggagctggccggtncaaagaaaggcaaatcctggananttctcgnaccanccgttttcccccaanaaatccgt

SEQ ID NO: 82737 - DNA, 501 bp, Triticum aestivum
  unsure (1)..(501): unsure at all n locations
  Clone ID: PAT_TA_82737
cctggaggccgggaagaaggcggacgtggtgccggactgcgcgacatatagttgcgtggtgggcgcactttgtggcgcagggcggtggtcggaggcggaggacgtgttctacgcgggagtgaagcgccggaaggtggccgaccttggaacggtgcgtgtgctggtgcgcggtcttaaggacgctggcaaggggcgagcggcaaggcgggtggttgtcggtttgtgcaagaagttccccgagatgttcgacgggccgtggagggacttgaggtggcggccgggctgaactcctccgggaaggaggatggtgatgttgaagacggagccgacgagaacttcgatgacaagggcaccgtggcgtgacgttcgtggaactggcgaatcggttttgaatgcacgttcatcatattaaataagcaattcacagtacacaatacatttagtttactcttgtcatctattgtgtctttgaattaccgttnactgtttaaaaaaaaaaaa

SEQ ID NO: 82738 - DNA, 462 bp, Triticum aestivum
  unsure (1)..(462): unsure at all n locations
  Clone ID: PAT_TA_82738
agccagccagccatcactgatcatagcatcagcagcttagtataccgtaccgctccacatccccgagctagaagaagaagcncggccagtacctacatctgcctagcggcgcgagcgaantagcagagatggcgagannctgcngtggtgctcgcggcgtccgtnctgctggnggccgccgcgctgctgctggncgcngcgcnggcgccggnggccgcggtcganttcggcgcggaggacctggcgtcggaggaggcgctgtgggcgctgtacgancgctggcgcggccgccacgnctggcgcgggaactgggcgacaaggcgcgccnttcaacgtcttcaaggcaacgngcgctcatcacgagttcaacngccggacgaacctacaaantcgntnaacncttcgngaatgacgcnacagttctanggcactacggagtcaangtgngacaacgatttcgcg

SEQ ID NO: 82739 - DNA, 619 bp, Triticum aestivum
  unsure (1)..(619): unsure at all n locations
  Clone ID: PAT_TA_82739
aatggctggggccataaggctgcactggaaggtgaggacaaggagatctactcagaaaaaggtgtgggcaaagttcagtggaaacctgccgagaacggccgggcagccacttggtataaggtaagttgaaccaggaatacgagcactataggttttggaaacatcaaacatccatttcaattttggttgcaaccctggcccttggtgtcactatgttcactgccatgctagagatacttcgatgagccagatggagatgatcccgttgtacttgacatgagctcaatggacaaaggaatgatttttgtgaatggtgaaggcgtgggtagatactgggtctcataccgaactcttgctggaactccttctcaagcactataccatattccgcgtctttcttgaatccaaggacaacttttgttgtcttcgaggaggagatggcagccggatgcatcctcgtgcagacgtacgagagacgacatatgntgtcantcggagacaaccggacagtaagacgtggancgatgtacaaataactcatncagagatacacagcgggacttattcccctagagcatcagaagngtttncacttgnaccanggctgtnganttattag

SEQ ID NO: 82740 - DNA, 253 bp, Triticum aestivum
  unsure (1)..(253): unsure at all n locations
  Clone ID: PAT_TA_82740
ttttttttttttttgatcggaaccagctctgttcattcacatgccccggtatcatctgcatcgagacgggtacacgaggaggaatggaggtacatctcagagcccgccggagggatggacgacgatacatactagatacaatacaatacaagcagcgggaaccagagaagaagaagaaaccgaaaaagacagaagaaattaagtggaagcgctatatctatcccgcagcaacagcagcggantgactacgcac

SEQ ID NO: 82741 - DNA, 460 bp, Triticum aestivum
  unsure (1)..(460): unsure at all n locations
  Clone ID: PAT_TA_82741
gccgtctcccttttgcgtgacaaagaaagagagcgagaagagcagtcgccatgtctggcatcatccacaagatcgaggagaagctccacatggggggcgaccacaagaataaggaggaggagcaccacaagaaggccgaggagcaccacaagaaggaggagggggagcaccacaagaaggacggcggggagcacaaggaaggcatcgtggagaagatcaaggacaagatcaccggcgagcacggcgacaagtccggcgaccacaaggaaaagaaggacaagaaaaagaagaagcacggcgagggccacgaccacgacggcggccacagtagcagcagcagcgacacgactgaatttgtgtcnacacaggtnaacacatgtatctttctggtggaggttataccagctgtctgtgtatgttactgtgtatgcatgatctgctttatatcaaaaaaaaaaaa

SEQ ID NO: 82742 - DNA, 449 bp, Triticum aestivum
  unsure (1)..(449): unsure at all n locations
  Clone ID: PAT_TA_82742
tcaagatatgatcaagcacggtgtacattagtacattcatgtaaattttccagcaatcggtttttttgttttcggtcggagaggagtaacgatcataaaactaaactagctagagacaggacaagggactaggcaggcactagtagtagctagctcctttcccccattttgcctttattacgtgctatttcacggagacgggagatcatgacgaattcttcggttgcttggcggcaatctaccatgattcacttgtgccgcctgcatgcacgcagctcaacatggaattaagcaggtgatcctaccaaggatcgaacattactacatttccaagaatgatgtggccatgcgtactaccgtgttacacacacagcatggccagtaattgacactaatcattatttaatcataaaggcactcctcgacgttgtncacacaaaaaaaaaaaa

SEQ ID NO: 82743 - DNA, 544 bp, Triticum aestivum
  unsure (1)..(544): unsure at all n locations
  Clone ID: PAT_TA_82743
gtctcgcccgagtcctccagtccaaggccgctacctaccagagcacccactccgctcagtggatggagcgatcccttgatgattccgcctgccgacgaattgacatccccgagatgttcctcctcgccgacggcgtngccaatcaccctccagaacgtcacagagggtctcgtcgtcttccccctcaagatccactccaacatcatggccgagctgcccttcatgatcaccgagaacatcatcatgcgcctcgtcgcaatgggtgtgtcccgacaagaggctcacgagcaaatccgcgtcctctccttcgaagcatcccaccaggtccagagcctcggaaagttaacgatctcgttgagcgaatcaagaagaccgaattttcaaacccatctgggtgattcgatggatgatgaagcggagtgtaattggtcaagtgcgngttggtganaagtttgtggacgggtggtagttgagagagttcgcttaacaggagttatcagaagctagntgtgactgaatgttaggagtntaaaggaaanaaagg

SEQ ID NO: 82744 - DNA, 489 bp, Triticum aestivum
  unsure (1)..(489): unsure at all n locations
  Clone ID: PAT_TA_82744
cttcgagtggttccgcggcgtgatggacgaggtggcggagacggacaggaagggcgtcatcgagctgcacaactactgcaccagcgtgtacgaggaaggggacgcccggtccgcgctcatcgccatgctccagtcgctcaaccacgccaagcacggcgtcgacgtggtgtccggcacccgcgtcaagacccacttcgccaggcctaactggcgcaacgtctacaagcgcatcgntcaaccaccagaaccagcgcgtcggagtgttctactgcggcgccccggtgctgaccaaggagctgcgcaactggcnaggacttctcgcggaagaccaacaccaagttcgagttccacaaggagaactttagtctctctctctctatatatatgtaaggtatgaatggttanaaagggatcgannaccaantaggatttncttaacaattggttgggggtnaaacccaaannttttttttaanatatatatctttn

SEQ ID NO: 82745 - DNA, 287 bp, Triticum aestivum
  Clone ID: PAT_TA_82745
cccaagggctgctgtcattccttggcggacccggatctggggtttgaggcggcggagggcaagatctggtagggttcttgggctcgacagatctactggcttagtggtggtttcgattgatgcaccggcttctgcgaagattagcaaattcatcgagattttaccatatggctgagtttagtgccaagtgtcgagtaatatgagtttgtggtgtcagactttcgatatggactgtatcttcattcgcacgcagtaatgatacgttgatatgcttcaaaaaaaaaaaa

SEQ ID NO: 82746 - DNA, 531 bp, Triticum aestivum
  unsure (1)..(531): unsure at all n locations
  Clone ID: PAT_TA_82746
agccagggcggagtttcaggctataatcaatgacccttttatgcttaacagtgtgttattggtgtttgctaacaagcaagacatgaggggagcaatgactccgatggaagtgtgtgagggccttgggctgtatgacctgacgaaccgcatctggcacatccagggcacctgtgctctaaaaggcgatggcctgtatgaagggttggactggctagcgactactctggacgaaatgcgtgcctctggacggttaacctcagcatcatcatcggcatcctgaatcacgtgtaacaggagggacaaacgatttgatcctcgtgatacgcccattgaaggatcatcttgtgattcagctttgcgcgtttgtttcttttgtgtttcccaattgtgttgntatacatgtgtgcatgaactggtgtcantggnaagcaagtagtcagagtacagacgcggtccgtgtacatgtagacgtgtggtgcgaccgtctctgtcgaacagnatnanatcatccgncctgttgngganatgaaa

SEQ ID NO: 82747 - DNA, 530 bp, Triticum aestivum
  unsure (1)..(530): unsure at all n locations
  Clone ID: PAT_TA_82747
gggactcttatcgacagcctcttgagggcgcacagatataatgatgccttgacattgttccaggacatattacacagtggtggcactcctagtatgccgatctacaatagcatgatgagatcgctttgtaggatgcagaaattgtcacaagcaatcaacctctggtttgatcacctgccccgaaagtacaatctcttagcccaagatgaagtaatttctagtgcccgaaaaaagtttgaagagggttgcctgcatgaagcagttagggagctaatcaagattgatcaagaatatggttcagtaaattcatgtccttacaccatttggctcataggctaattcaagcagggagaatagaagatgcctcaagatttttcatatacttgaggatcaggcattgtatcacaccanttgctgtgtcacttagcaatactttgttgaaggaatcagggcgnggttatgtatcnctancattgagaaggatcncatgcgagatantagcaccggtacttgagcttgatcacnagngg

SEQ ID NO: 82748 - DNA, 562 bp, Triticum aestivum
  unsure (1)..(562): unsure at all n locations
  Clone ID: PAT_TA_82748
ttacattaccagagttccggttgatagacgtccctctttgagggatgattattcaccccggggatcaggttattcagacctcggtcctcgtagtgctccccgtctttctgataggcgagcttatgctgatgatagttatggggagaagtttgaccggcctttagtggcctatagggagggtcgcggccgtgattatgacaccatttctggatcaaagcgtccgtatgcagatatggatgatgtgcctcggtaccaagaaatcggtgtccgtcagtctaaggcacgtttagactacgacattggtggcagcagtgctcggtatggagatacatatagtgagagtctggacgaccacatgcgggatatagtagcagccgtctatccctgttcangattcancatattgaacagcgtcatggatgattatgaggttctgctacantgctatctgtggatgnccaccgagtaantggagcatggtccgtgattatgttgtggagtcanatctnacttactcngtcgaanttggacacatgtgcacatgagtaacgtcatnaataca

SEQ ID NO: 82749 - DNA, 567 bp, Triticum aestivum
  unsure (1)..(567): unsure at all n locations
  Clone ID: PAT_TA_82749
ttttttttttttttgcagttacatatatatattataaacgttgccacacgtcaaagttttatacacctgcaccaacagagacgatttcaagcgctagggagtgcaatgccttgtccagcgatatcaaaactctgagcacaatacagagagcaaggtcatttctagcgagatcagatatcaaaacagggggcaatagcaccatcgatgcgaatgatgacttgctgctttaataatttaatgtaacaaaaaaaggaggatcacaaaaccatgtcaagccacggcaacagctcggtaaaccaaaatctcattgtcctcaaaagttcaaagatcaacaaacatgtgcctatcctttgaattttcccgttaagttgtagtcactccatggaagtccactggcaccaaaancntgcgcacacggcaaagcaggttgctaccctaaagtngctggaatcgcagagcactaccttctacaccaaatacccattgactcgtgactcttgtaacatcctatcccaaactagntgtttcccaaggaggggacctgggggnaccgtggcaagcaaggag

SEQ ID NO: 82750 - DNA, 560 bp, Triticum aestivum
  unsure (1)..(560): unsure at all n locations
  Clone ID: PAT_TA_82750
ttttttttttttttttttgccgcaagaccacgatcgttgcaagagtagctttaccgggccatcaggaaaagaatccaaccatcacaactcattcgtacaagatgctccgctatgctttcttgttcctcctgctcttgatggagtcgcgtcaaccagccacacggcatgcaaatcggtccaagcctacagggacgagctggacctggcgttggtgtggctgatggtgaaggactccagcttggacaaatccggcacccagcaggacagctccgacgttcctgtcacgaacatcaaggatcctggagaccaccttacccgcggcggtttcacatctgtgctttcccagcatgaacctttccgtctcaacgttccaagatagcactaccatcaccggagcagatacgtatgtttcctcggacagaacgatgctcagtgtcgaattggtaatattggcttgcgcgaaacgatgaatgtgttgcttaaaagattagcacatgacacgccagtttagtgtacagatcgctgcatacgtgaatgtcgaatggttcgananagncgaa

SEQ ID NO: 82751 - DNA, 552 bp, Triticum aestivum
  unsure (1)..(552): unsure at all n locations
  Clone ID: PAT_TA_82751
cgagcactcgccgccacncaccagcaaattcccaagccgccccttcccccatctctttcgcgccccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaactcgccgccgagnagcaagctcgccgctacaacaagaagccancatcacttccgggagattcagactcgtngctgtctnccgggagtcgcaagacgcgtttcgaggancaaagcgtacagttaatctttaggtgcgcgcgcgacgttctaattctatttagattctagtgtcgncanatgtgattgtatattctnataanagtacctttagttcta

SEQ ID NO: 82752 - DNA, 551 bp, Triticum aestivum
  unsure (1)..(551): unsure at all n locations
  Clone ID: PAT_TA_82752
cggcaggcagcacagcatggacctcgccctcctagagaaggccctgctgggcctgttcgccgcggctgtggtggccatcgccgtggccaagctgaccggcaagcggtaccgcctcccaccggggcccccgggcgcccccgtggtgggaaactggctgcaggtgggcgacgacctgaaccaccgcaacctgatggccatggcgaacggttcggcgacatcttcctgctgcgcatgggcgtgcgcaacctggtggtggtgtcgaccccggagctggccaaggaggtgctccacacgcagggcgtggagttcggtcccgcacccgcaacgtggtgttcgacatttcacgggaaggggaggacatggtttcacggttacggcgacactggcnaaatgcggcnatatgacgtcccttttaacaaaagtgtngcagaacgcgccgggtggagagacgccggctgtgtgagacttagaagacccgagccgcggcgcgggtnttctcgcgcgctcanctgatattaaagaatttcgatatttnacgcgntnaagaaaaa

SEQ ID NO: 82753 - DNA, 472 bp, Triticum aestivum
  unsure (1)..(472): unsure at all n locations
  Clone ID: PAT_TA_82753
cactcacccaacgcgaggccatggcgacgtggttggtgttagcaccaganggggaggaagaaggaaagcaagcaagtggtgggaggagtcatggactgctgcatctgcagccccacggcgtccgtgtacaggcttccgaggaactccatctgtgctccatgccacgagggcgccaaggcagtcatcgcttttctgaacaaggatggtgagcggcaggaggaagacgccggtggccaccaccaccatggctctgccctcaagtccagagggtccacgacgcagcctcatagcgcancaaggggatganggacgcgtgggagcaggtgaangagatgagangcaggnaggangaggccaccggagagccgccttctcgcgatggcgccgtggaaagagcgctccacaccgacatcncgtcaaaccgggcactgggtctcaatatggccacaagcatctggtagcncntggctta

SEQ ID NO: 82754 - DNA, 386 bp, Triticum aestivum
  Clone ID: PAT_TA_82754
cgagttttttttttttttttttttaacttaaacatcgatctgcttgtattgcgtggcgagacatgaaatttccataaccacaactaacattagatgtagttgtacttctataactttttcgcttcttttgtttgttgtcatacagttgcaacagctgctttcagttcataattttaggaacatcatagcagacttcaaggactacattgtggagagcaatacacgatactatgaaattggaggatgaacaaccaaatgcagtgcagctccttcaatatttgctgaggaatgtgcagcaggcaagcacggactacaactcacgcctgctccagaatcgccaatgcatgcatcactacaattggaggcagagtgactccgaggggggg

SEQ ID NO: 82755 - DNA, 442 bp, Triticum aestivum
  unsure (1)..(442): unsure at all n locations
  Clone ID: PAT_TA_82755
gtcaccagcgccgtcatctccatgaccttcctgtccctctcgaaaggcatcacaatcggcggcagcttcttcctctacgccggcatcgccgccgtcgcgtgggtcttcttcttcacgtgccttccggagacccgcggccggacgctggaggagatgggcaagctgttcggcatgccggacacggacgacatggctgaagcagaggacgctacagcaggcaaggagaaggtggcggaagtggaaatgtacatgccaagtaagatgtaaagcgcggctgcggctacagcgtcttcgtncccgggcaangtcaactggaatagacggacaagattttttttttttgagcaaantgtaccagattggcaggaataaattngctatgagtcggtactcgtncgtcgtcaaccgggatttttgtcgttttatctggaaaaaaaaaaaa

SEQ ID NO: 82756 - DNA, 426 bp, Triticum aestivum
  unsure (1)..(426): unsure at all n locations
  Clone ID: PAT_TA_82756
agtcacttggtgctcagtactttnccctgcncctccgcntctnctcgcatctcggcgccttcttcggcaactgcaagcnagatggaggngcaagacgactgcaagtggcggcagatcccggcgttcggcgactggaacgtgtgggacggcgacacncccgtcacccagtacttccaggcaggggccttcttcttcgnggcnccggcngagaagggcgacncngatctcttcaaggtgccccagttgcctgccaagccctacggctacaagaagtgcgttgttcgagtgaagggggagaaagaaccgtgtgccnccgggggaaagaanggccaggangcgctgcgtgacgacaacacantggaagccaanggactgtggcnangctntcagttcccgagttcntgcagananctgctangatttctt

SEQ ID NO: 82757 - DNA, 404 bp, Triticum aestivum
  unsure (1)..(404): unsure at all n locations
  Clone ID: PAT_TA_82757
tttttttttgtcgaccaaaggaagcatcacagaaacaatatcaataatgtgatgagcacaacactaggatgcccatgtaaagacagaacgtaaattttagggcaagtcactgggatcggccagtgccacaacgtagaagtttgtccaccgattcagcagaattaacttgacgatacaactagtttagatcatgtcggaagcatcttcaactgctctgagccgactcagtcttggcttccgccgactcagtcttctcggcctcagcagcatgtccggcagcttgaggtttcgatacttcttcttcatcactatcatcctcaaaatcatccattcccataccacccattccaccaagacacccaagcagcatatacccatgcaccatnccccatccgnaattgggg

SEQ ID NO: 82758 - DNA, 545 bp, Triticum aestivum
  unsure (1)..(545): unsure at all n locations
  Clone ID: PAT_TA_82758
cgccacctacccctccctccttcctttcatttttctggaagacttcttcggcctcacgcatctcctcctccaatccaattcacaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagaggagggaagtcaccggccgtcggggggaggaatgtcggacggcgcgggctccggacgggcgtcntggcgcctgggcttcgtcactcgtcgtggcatcgtatctnaacaagtactcatanatctagcttttttggacgacgtgagactggactatgtacttttacntgagtgcgaggctggttttgagcaaagcgtgagggacgtattctcggctgtaaggattcattgctctaacttgtcggtaattgtgntcacaatacag

SEQ ID NO: 82759 - DNA, 523 bp, Triticum aestivum
  unsure (1)..(523): unsure at all n locations
  Clone ID: PAT_TA_82759
cgaacaccgcccagagcggcgaggaagtcgtggcggacagccacctgctcccggcggttgccgtcggcgctaagagcggggacgccataaggaggtacgtggagtcggacgccaacccggaggtggcgttaacctttgccggcaccgcgctcgacgtgcggccggcgccggtagtagccgcgttcagctcccgtggacccaacagggttgtgccgcagctactcaagccggacgtgatcggcccgggcgtgaacatccttgccgggtggacggggtcatcgggccgactgggtagcgccgacgagcggggtcagatttaacatcttgtcagggacatccatgtcgtgccgacatcagggctggcgggttcgtnaaggggcnaccggatggagccacgcataagtcggtataaaatgctaacacgaaaaacggtgcctctcaagcggacaanacaggcagctggcttgctggcactgaccgtagggttnccggatcttcagctctgaaatagtnctnttnactg

SEQ ID NO: 82760 - DNA, 531 bp, Triticum aestivum
  unsure (1)..(531): unsure at all n locations
  Clone ID: PAT_TA_82760
gttttttttttttttttttaatgcaaatcgattgctctctccaatctgaataaataggacatatcaggcattcagacaaccctagcgagccgaagaacacaccctttctacctaaccgaatcatctactcaagttccttcacagatgccatgctacaactgaatacaagaaccaacggtggaaacgatggaataaatctctgcccagcccctgacaatcacccaactccacttgccacctaataataagaagaatggttcttcaagcgccaccaacctttgaaattttggaacatccacgggaagttgnaatctcatccatccaggggtcttctcttggcgggtcaccgtcngagtgcttcagacgggntgttgacttgaatcagacaaatggattgcagatctgtgngttctgatctaccttgctagtgncgcagtgtacagatagtgctatgtgtgcaactganaggtatctgatgctcattgcagnagtagncagttttcagtatcagaaggggcgctnggatnaaat

SEQ ID NO: 82761 - DNA, 544 bp, Triticum aestivum
  unsure (1)..(544): unsure at all n locations
  Clone ID: PAT_TA_82761
ccgccttccccgccgttggggttcatcagcagttcgcagggtaaagaaagggcggccgcgatgtgggtggaaatcctgtgcggcctggtggtctacaagatcatccaacgcgtcttcttcgccggcggnacgacgcttcctacctcgccgacctcgactcctcccactccgatctctgcttcgccgtcgcctccaggctcgagaagctctacgccggtcgatgcttcgtcggtctccgcatccccgaccccgacgccggcgagcgccanatatcgacgttgtcctcgttaccaagagggaggtgatggtggtacgatcaaaaacttatctggttttgttaagctgcaaggatggaaattgtttgtccactgacaagaanataacatgaatatttcaaaccggtttagagcacanctagtgtatttaatatattgagaaaggggaaatgctatggatatatcggaantttctcaaancaatgagcttctaatatacccaacagagnatctttatatgaggttagaagcnaanatgctcactgata

SEQ ID NO: 82762 - DNA, 561 bp, Triticum aestivum
  unsure (1)..(561): unsure at all n locations
  Clone ID: PAT_TA_82762
tacgcccccgaactcacatagacatcatgcaccctaattttccaagcgatcatggcaacggacgaggggtgggcggcggcggcggccatagcaggcgcaagcganttcatcagcttctcggtggagggcgagccgcggacatcttgctgtggaaggacaggaatttgtctgcaggcctgctcgctggggccacgttggtatggtacctgttcgaggtagttgagtacagcattgtaccgctcgtttgccagatagccatcctggccatgctcgtcgtcttcatctggtcgaatgctgcgccctcttgaacatactcctccaaggatcccagaagtgatcatctctgagcatgcttccgacaaatanacagtcatccattacaaactggacacaccgtgtctctctttatacattcatcggaagatctaagaattctcctgtaattnctttgctacgttatagaatatgtgcattgtncagtcgagtgagacatcaaattnacatggtatcttgattagtaattgacatccaanatgangttcatattgatnntcacatcna

SEQ ID NO: 82763 - DNA, 520 bp, Triticum aestivum
  unsure (1)..(520): unsure at all n locations
  Clone ID: PAT_TA_82763
gttttttttttttttttttgaaaagaccaatcaactattcatcagagtacaaaacttcaacccatgaaacattgaactgcggtaattgcaacgggattccacattacagcatccattacactccacattcaaaagaacaaaagttaaccaatggcaggtttttcccatcaaactattattcttcatcaaatccgtaacataaaagggtatggcagaggcgcacaagcttgaccgagccaggggaatgaaggaaggctcacagcgtcgaaagccgcaccttgccattcgtcgcggcaggccattacgggatgtccacggcttaggtcggggacagcgacgacatgccatgcagtccggcgtgaggacgacctgcagccaggcgccgtnttgttgactcnggttctggacngccgtanacgtacgctctcgtagacgtggggcacttgtgagcatctgcggattgactgactcgcganacgcgtgattctgagggggccggnccattgccttagtatgtata

SEQ ID NO: 82764 - DNA, 491 bp, Triticum aestivum
  unsure (1)..(491): unsure at all n locations
  Clone ID: PAT_TA_82764
cccaatcgcnacccccgccngcagcacgcgtcacgccacgccacctctccccagggtccggcgangtcggcgccctccgacgccgcggtggcagccgcagcgcccgcatccacgaccaccgccgccgcctccagcggtgggctcaccttcaagctccacccgctcgtcatcgtgaacgtctccgancaccanacccgcgtcaaggcccaggccgcctgctccggggacagctcttccccctcctcgtccgccccgggggccgggcaaccgccgagggtgttcgggtncgtgatcggggtgcagcgcggccggaccgtngagatttcaacagttcgagntcgtgttcgaccccgtctccggaacctcgacngggcttctcgacaagaagagganttataagaagnttcccgatttacgtgctcgttgnatcactgaaggatgnnagaancgaatnnaatcacaaatattangatntacgaagcctgtttctc

SEQ ID NO: 82765 - DNA, 587 bp, Triticum aestivum
  unsure (1)..(587): unsure at all n locations
  Clone ID: PAT_TA_82765
gaaaaaataggacatcactatctcctgaaacacttgaagctttagtctgtgctaaagactggttgattggattcaatgacgaagaagaaggtgaaccaatgactggaaagcgaatgtttgattcagatgatgaggaatatgattgggaaatttgaagcaggctaaggagttccttggtgcttccggtgacaagcgaaaggaagtcaattaactctgaatcagtggttctgctgcaaggttacacacaacattttattgaatggaaagaggacactcggtgaccacaagatcatcagatgatcatttgatgaactaattctcatcaagcatcaatgtcaccaactgtgtagaatactgaattttagcatggagcgctttgtaaacattttagcatggagcagtttctcatcgtcatgctgtcagtctattctcnacacagttgcacttgtgtgttccatcattgttgtgagccatgattacnattatactgtgtggctgctgaaataagcctggattgccgngatttaaagatcagcgatagattcggnttaaaacgatattggtgncaacattgatagaaaaaaaaa

SEQ ID NO: 82766 - DNA, 237 bp, Triticum aestivum
  Clone ID: PAT_TA_82766
ttgaggtgggcaatgcggacaagatattcgaaagtacatcgaaggatcagctgacgcggagatctgcatgaacagtgaactctagatctgcatatgaccccgtgaactctctagatctgcaaacaacccagtgtgcctcttggaagtgtgttggtgactgtgaaatgattgtacctacttgggtgaaataaagcatgggagtcaataaaaagtaactgtttctttaaaaaaaaaaaa

SEQ ID NO: 82767 - DNA, 566 bp, Triticum aestivum
  unsure (1)..(566): unsure at all n locations
  Clone ID: PAT_TA_82767
cttttttanattacaangcggncttttttagnttacaacgggtntngtttctganttgattcactangtngctanacctgatttcaanaaagctttgtaccganacctactaagttntttntcaacaacaagtccaaatattctggtgtttttntccttntgttttactttgtttatatntctttcatcctgacttggttagcaaccggtcaatgtggccaaatcatgaatgggtgtttgancttctganaggtatctatctgaatttttttaaattaggatggtcatttccaactctaccccngctttctgcttncaggggttgttctatgggaattctggactngattcnaatngatctcagtngacataactactatcaagcaagcnggttggatggggacatttgctcnggcagggancaagatgaacgtgnnccataaaggggcgcnggcttcaatgcaancacganaagcgtatacgcntgnagnccaagagaatgggttagacgaggtttcatctgccctnaataggacagnctcttttctncncaggggcnggtanaa

SEQ ID NO: 82768 - DNA, 288 bp, Triticum aestivum
  unsure (1)..(288): unsure at all n locations
  Clone ID: PAT_TA_82768
gccatctccatcttggtccnctcccttgcctcccagttctcatggtgtgcagaagcagctgagggaagcgccggaatttccacagagcctgatctccaggtgcaagaacaagtgcacggcgatatgaaaaaccgcctggaaatgcagggtcgcaaccggaagcttggccatgaggtgaccacagtggagttgaagcatcacaggaggattaccagtgggcacaagggtggcagcncnggtggaggcgcggcgcggtgccgcgggcgcaggnacgggtgggcataacgt

SEQ ID NO: 82769 - DNA, 563 bp, Triticum aestivum
  unsure (1)..(563): unsure at all n locations
  Clone ID: PAT_TA_82769
gggtcaacgttctcccgtccccccgagcgcagtctcgcgtggttctcccgtcccccgaggcccgagcgtagtctctctcttttgccgtggttctccagtcctccctcatccgctctctttctttctctcgtggcgagtggtaacgacgtcaggtgctcaggtcttgttcaggcccttcgccggcgacgagcacacagcaaatggatacaggagctcaagctatgttcatcatcagtcttgtgctctggtgtactacaagctttgccttggatgatgctgctgctacaaggattccaattgtgggacattactctgtcaatgaagaaatccgaattatgcaactttgtgangagttgcatagaagcctcttctatttaaatgaaatgagaccagctgaatcattgtacactacacaagttgttcaagttgctctttagtggatcacaagttggtgatatatgncnctttttacaaaatgtnattagcctgagattgganananttttggggganatatcgcttcaaaataaaactgaccttncatagtncatagttaanactta

SEQ ID NO: 82770 - DNA, 375 bp, Triticum aestivum
  Clone ID: PAT_TA_82770
aggagacgagcctcaaggacaagtaccctcgggagcacctggtgttcagcgaccccaaggcgctgcacaagcaggggtggcaggcgctcgccgagaccatcatgaagcaggacgtgaaggtgaacctcaccaggttccggcccttcctgctccaggccatcgacaagctgcaggagtagccgcggcgccggcgccggcgtctccgttgtcatcgcaggttggtaatggaaggtataccactcacggtcacaatcacataaacatacacaggcaaacacggcggcgagaaacattgtaatactggaaagggtcattgtctgatgaacataggaggcttcgaattggtttgttggttggttttgtaaaaaaaaaaaa

SEQ ID NO: 82771 - DNA, 741 bp, Triticum aestivum
  unsure (1)..(741): unsure at all n locations
  Clone ID: PAT_TA_82771
taagtgggattccccggggcttgcaaggaatttccgggcacngaagcttcaacccccgaacggccccaancttcccccccgaagttcggcaaccggcaattcttccccttcaaggggtgaacgttccgccggttaacnggggaaacaagcattgcaacttaacggcnggaagaaacgttggcaagttccggggccaactttccgcctttcaacgggcnggcgggaaaggccnggcggaacttaaccttgggccttgctttcttggggcttcccccgaaccaacaaagcccgcccggtcaancaatccgggnttccgaagtttccgaacttggaaggaagccggcggtttcccgncaaagggaactatncccaagcggtccgncaaagaaangggcnaanggtccgattatgatggnaattggaagcttgaaagaagctagagggaaacttataaaaaatatacatgaagagatgctttatctgcgtgaaaagggaagaaggaaatgcaggaacgtgaaacaggcgaaacgaaacttcaagggatggctttggctaaggggttncctctncccttngggcgtctgcttaatcagtggcangttttgcaagcttgtgggcacctgaaagancttttcttttgaaaanggaagaaantttgtttgtaagaacttgtaagttnggcccattggtttcacggtaagancttccagcgcangtgtnaacncaattttttngggtgaa

SEQ ID NO: 82772 - DNA, 533 bp, Triticum aestivum
  unsure (1)..(533): unsure at all n locations
  Clone ID: PAT_TA_82772
tcttaatgccgttcttatttaactgcaatttgtacagtctggttgccccttgatggtttcctataacctgttgctttatgttagtttgtagtgtctgttatttacttccccttttggtttctaacatgaattcttgtacagacattttcaaagcatacaaatcagtctggcggatatggtccacaaggttaccgacctcagggtcatggtgccgcttctcagttggggccangctctnagaatcatggctatggatacccacctagaggtatgcntcnacctcaaaactacaacgcaccctacggtggctacccaccgcaggacccgtcaagaggtggcatgggctggnaccanaggccgggccnaccaacccatccttcgtaccagggtggtggttctgnctactacaagcagggatctcagccatatgatagccagccacccagntaccctcctgggccagggaattacaacagtttgggnaatccagggncctaactatgggcaacctcagtatcgnaanatgcacctaa

SEQ ID NO: 82773 - DNA, 545 bp, Triticum aestivum
  Clone ID: PAT_TA_82773
gtccaacccaggtgttgttccaggtgcaggatctggtgctcttgatgccttgcgacacttccacagtttcaagcactccttcagttagtccaggctaatcctcaaatcttgcagccaatgcttcaagagctaggtaaacaaaacccacaaattctgcggttgattcaggaaaatcaagctgagtttctccgcttggtgaatgaatctcctgagggtggtcctggagggaacatactaggtcaactggcagctgctgtgccacaaacgctgacagttaccccagaggaacgggaggctatccagcggctcgagggaatggggttcaaccgtgagcttgtgctagaagttttctttgcatgcaacaaggacgaagagcttacagccaactacctcctggatcatggccatgagtttgacgagcagcagcaatagacgtggggtggatggaggaaaccgaggcagttgcagaacagcgagtgtcgttcttatgccctctgcctgacgagagatactcggtcgtctatgctatgctgctgactatcttt

SEQ ID NO: 82774 - DNA, 558 bp, Triticum aestivum
  Clone ID: PAT_TA_82774
agctcgtggatttatcagattacacgactctacaagaacaaggagcatgctgaagttgaatacacgattgggccaatccctgttgacgatgacgtaggaaaggaggttatcacacagttgacagcaaatatgagtacaaacagtacattttatacagattccaatggaagggatttcctcaaaagggtgagaaactacagggaggattggaaccttcaagtgactcaaccagttgcaggaaattactacccggttaatctcggagtgtacatagtagatgagaaatatgaactatctgtccttgtggaccgtgctgccggagcatccagcattcaggatggtcagctagagattatgctacacaggcgtttgcttaaagatgatggcagaggtgtcgcggagccacttgatgaagtggtttgtgtggatcaagattgccaagggctaacggccaggggcacttactatatcaatgtcgagaagctaggccatggagctcattggcgccgtacatatggcccagcaagtctactctccctttctccttgcttttactca

SEQ ID NO: 82775 - DNA, 548 bp, Triticum aestivum
  unsure (1)..(548): unsure at all n locations
  Clone ID: PAT_TA_82775
gtccccaatcgcgttctcttcctcggcgacatggcggccgccaccggctacagcgacgccccaaccgacgagcaactgctggcgtacgctgagctgcccagacatggccgctacatggcggaggtgttcgccgtgcgcatcctcgccaccgccggaggagacccgccgccccatggcaccatcactttctacggcggccactgctgcagcgatttcatttacagctggagtccactggaagagggagaagacacctcgaagcaaacctgcgacancagggtaacctcgtgctaactgggccatcatgggccacctcggcatacagtccaattgccttcaccctctacctccatgatggcagcccgcaagccggagaagccgctgaggacgacgaggacatcgggaggataatctgcgactgcatcgacggtgacttctccaactacaacagggccatagtcgagactgtccaaacgggctatggccccgctgaagtgatctatgcgtctgagcaacgggttcaaggcgggtcgcatcaaantgtcgct

SEQ ID NO: 82776 - DNA, 543 bp, Triticum aestivum
  unsure (1)..(543): unsure at all n locations
  Clone ID: PAT_TA_82776
ttttttttttttttttggaagaagagcagntggcagagtagataggcagagcgacagtctgtccagaattcttattacaagtctgatgccttttccctaatcaatattcccttatatctcaattacaactcacacaaactccctaagccgagtactaggccggcgcactggatccccttcgtgggcctgcattggatggttcttctgtcggacttgttacagcagtagtaacacaggccgtggcttttatcatcatcaatcacaagtaacaacagtatcgcaagtagtaaacatgaagcgcgaaggggttcgatggaagcacgggggagccagctaaaccagtccatacaacaccacctctcaagtgacaagagtatcgcaagaacacagcaacagtggggactgcncnagcacaaacgcacgcgcaccgcgcttccacaagttaacttgaatcgtcactacatagaaataggtcactcagcctagacggcagcngcagcagaaggaaacnctcagaagaggtagcagcagtataggcgagca

SEQ ID NO: 82777 - DNA, 545 bp, Triticum aestivum
  unsure (1)..(545): unsure at all n locations
  Clone ID: PAT_TA_82777
ctgcaaaccgatcatgacaaaaccaaaggtagctttgaagccgcagactctgtctccacaacctgaagcccaagcacctcatgatcctcaaacaccagagcaacaacaaagcgggactggtgtaggcgtgtagctggtgagccgggtagtgaaggaggtgtgtaccaggcctccagtgagcaaatgggcatggtgccggatgcatctgcggccggtggcaggaaggtcgagctggatggggacatgcgatggacatcacaggttggcccctccagtgatccatctcaaacactagccaggtttcctcctttgccaccctcctttggcagttctcttcctaacgtcgccgtagttcccttccctgctgtttttgtctcccatagctcttaaaattttaagttccctgtttgcataaagggcataggaaaaacgttgaatcaaagcaaacttgatgcttaccgaaagcatgttcatgagttactcagattcatggnccaggaattgaatctacacggttaataactanttgcatggcctaaatgctn

SEQ ID NO: 82778 - DNA, 507 bp, Triticum aestivum
  unsure (1)..(507): unsure at all n locations
  Clone ID: PAT_TA_82778
gttcttggcaccctacaaaaccaagatcattgatgttatcgagaagggagagaagcagcccaacatcactattggcattctggtctccgttgtcgtcgtgttcgttaccgttctcttcaagatcctgtttggaggcaagaagccggtggcacctgtgaaacctgcagctgaggcgaagaagcccaaggccacagtgaccgacggtgctggaagcagtggcgacaaggatgagaaagaggacgaaaaggaggagacagcaggcccacgtcggaggacccgaagangacatagagacctatttttgatgtgtttggatgttctggcgcctgcttattttgaggactcttaatatttctgagtgtataataggaacttgtgtcacctctgcgggcttccctgctgcttatttgtttttacatggttagaccaggaaccttcacgagctgtagaatttagttcttgttggtcatttgtgtgtgtgcctgacgggtataatcccttgttcaa

SEQ ID NO: 82779 - DNA, 342 bp, Triticum aestivum
  unsure (1)..(342): unsure at all n locations
  Clone ID: PAT_TA_82779
ctcagtcctcgctggtcctttctccatcacaaacgctagtcttttcctaaagctcggagaccgccggaagcgagcgatggcgtgcaagacgaagagcctgctgttggcgctcagcgtggcggcgctgctcgcggcgcggtcggagtcccacggcctgggggacttcacgagcgggagcancgaggcgacgacgacgccggagatgcagaccttcttcaagccccaggccgccgcggcgctcccggaggccctcgacgcctccatgcncgcnaagccggangncacggcgcnnccggccaccaccaccgnngcnggacgcgaacaacggccggnacnggcagt

SEQ ID NO: 82780 - DNA, 176 bp, Triticum aestivum
  unsure (1)..(176): unsure at all n locations
  Clone ID: PAT_TA_82780
gcgggcacgcngcggcgctgtacgcgctcgccgtggtgcagttcaacggcagtggcggcgacaaggcggacaaggacccccgcacgggcgtggcgctgtgccncnggcngcgtggctcggccantnccctgcactccgcnancncggccactgcctccaggacggctacngcgcgc

SEQ ID NO: 82781 - DNA, 288 bp, Triticum aestivum
  Clone ID: PAT_TA_82781
cagaagtggtggcagaggtggctcattacgtggagctgatgttggctaccagagggttgaccatgctggatatgctggtggtcgtggtagccgcacagcagctgctggcgcaccttcaaaatgaggggcaccatagctgttgcgcgtcttttgggagtgttgttcggtggctctaagattattttgaagttggcatagaggctcatcaattggttcagtgcgggattacaagagaagcctggatacaaattatgagggttcctgtccttgatcattaaaaaaaaaaaa

SEQ ID NO: 82782 - DNA, 157 bp, Triticum aestivum
  unsure (1)..(157): unsure at all n locations
  Clone ID: PAT_TA_82782
ctcgtgcnnngaagaaggccgcgcatgntctcaccnatgaagaccatgatggagactggatgatngttggggatgtaccgtgggggctctttctcggaagcgtaaagaagctgaggattgcgagaacagacagatgntagatagcaaactttttcat

SEQ ID NO: 82783 - DNA, 452 bp, Triticum aestivum
  unsure (1)..(452): unsure at all n locations
  Clone ID: PAT_TA_82783
ggagggcttctactacgtcacggtgaaggtgtactcggaccttagcttcagggttagggtcgtccgccgccatgacttcaagagcaagatcacctgcgtgctgcggctgcccgtgcccgctgccggcggcaacgcaactccacggcgatgacgacgctcgggacgaggtgcgacgtggacttctgatcatccttgccgactgtgcaaagggcgccgtgcatgcatcctttggtattatttggccggccgggccggggcccgggataacgctgtcgtcgatgtctataattgtttgaccggtacactgtgaatgttcattatttccttctttcatatgcatgcatataattgaataaacataagtgagtgtttggtttctaaaaactaatttgtaatctcttgatttaattacattttagtcattaaattgctaaataccnaaaaaaaaaaaa

SEQ ID NO: 82784 - DNA, 524 bp, Triticum aestivum
  unsure (1)..(524): unsure at all n locations
  Clone ID: PAT_TA_82784
gctgcttgaggcagtanagcgtgagaggaatataagaactaatcaaactcggaacacaactatatttcatcatcctgctcttggggattttgagctgcagcatctgcctgttggtaatgatgctgagcttgaagagcgtatactgcagcatctagctgctgctgctgcaatgggaagggcacaccatcttggaagaagggangggcacaggggacgatctggctctcatggtcgtccacatttcctagttttctctacacaaccaaattcaccttctgctggcacaatctcttcatcttctgctcatatggagggagaaaatgattcaaatncttgccacacctagagctagcgagtcatcttccacgagctattcgcatttgagagtggggaaaccaantccctnggatgcttacctacgatgctgaanaggatgctgtcgnttcnttccgggaatagacccccgtattcgagtcccagggttttttnanaggngaaantccnctggganattaactncngaa

SEQ ID NO: 82785 - DNA, 518 bp, Triticum aestivum
  unsure (1)..(518): unsure at all n locations
  Clone ID: PAT_TA_82785
ccaaggagcattgtatcagatagaggaacacaattcacctcaaatttctagaatcagttgcatgaaactttggataagatcagaccagctcaaaggactgacaaagagatcgcttctattaaggagaaaatgagcaaaggaaaaactaagggatttcgtgaggatgagcacgataccttatggtttgaagaccgtgtttatgtgcctaatgattcggagatcgggaagttaattctgcaagaggcccatgattcaccatattcgattcacccaggaaataccaagatgtatttgggtttgaagggtactttctggtggaccggaatgaagaaggatattgcgaaatatgtagcagtttgtgatgtatgccagagagtaaanggcagagcatcagaagcccagcaggattgctacagccattgccgatacccgaatggaagtnggataagttaggcatggatttatcacagatttnccagaactcgttcaggctatgactcgattngggttgtaatcca

SEQ ID NO: 82786 - DNA, 253 bp, Triticum aestivum
  Clone ID: PAT_TA_82786
ttttttttttttttcagtatatcttcttttcactgatgaacagtttagattccactgggtagtcaacataacaagtagatccctgaatcgtttgactgacaacaaacaaggggctgtgacttgtagaatccaacaaccttcacaggcaggatggagactagccagtaaacacaactgtccgatatcgacaaacatgaggcaaacaaatttctgaaaccgcaacactacaagatcagtgccttcagaagctgag

SEQ ID NO: 82787 - DNA, 524 bp, Triticum aestivum
  unsure (1)..(524): unsure at all n locations
  Clone ID: PAT_TA_82787
gtctcgagtttttttttttttttttttttttttggagaaacttttaaattcagaaaatctccatacaagtattttttttcagtcttacattatcattattattgcgctgcttataggcattctatagagccacccatacggtggaaaggttactgcaatacaggcagtccaacgaatctatacaaatacaacttctggtaccacgggtaatactaatgcacggttacactacaatagcaatgtagtgcagaactacagattcctgaagacactcaggcgttcaatccagtctcaggagaagatgtagacctcctcaaacgatttcgattttttcccggtaaatgtcggactgtagttgtaaattaagttatccagcactttgtcggcaggaggcctgtttggagacttgcgtgcttggctgataaaatgattggcnaaatgttgagtanccggnncggaatctccccgtgggggacnatgggttnccnccctccaaaanngncttctcaaggtgccatgcgggc

SEQ ID NO: 82788 - DNA, 498 bp, Triticum aestivum
  unsure (1)..(498): unsure at all n locations
  Clone ID: PAT_TA_82788
nctgaagggtgctcttnnctcacgatatattcctnattcacanaattctnacaaggtactgtnggctcancattccnttgaagacatgcgtaccatgccaatctacattcaaggnaaaactaaaaacctcatggnacgcnctatttggcacgacacatctttcctaagtnacatgaatgtcatggattactccttgcttgtnggagttgacaaagagaaganagagcttgtatttngcattatagattatntcacacaatatacctgggacaaacagctggaatcttgggtgaagacatctcttgttgttcnaaagaatntattcngaactgtaattttacctagggagtanaaaatgagattcangggtttatgtcaaatatttctattagttnnagatgttgagtttgagggnaatattttctggtattggtgaaggaaatattttgagttaaggatttggagattatgttgagatggtaatttnntatnaggggn

SEQ ID NO: 82789 - DNA, 156 bp, Triticum aestivum
  unsure (1)..(156): unsure at all n locations
  Clone ID: PAT_TA_82789
gttctccatccaaacaaaccgcgtgatccgtctgancgctcgctcgctctcgcngggggtccggagcnccccacctccagcgacccagtccatccgcgcgtgcaggccgcggcgccgatggagtacgacttcngcagnggcngctcgancncgggc

SEQ ID NO: 82790 - DNA, 281 bp, Triticum aestivum
  unsure (1)..(281): unsure at all n locations
  Clone ID: PAT_TA_82790
nganaanagcagtgaaaatatnacaccaaangggcnagaaacnggaacaccccgaaacgaagatacagaacaaaccacagtagaccggccaacnagacacacaaccgaccacggccgncacatcaaagcatcagaaggggaggcggcccagccgcnatagccggagagcgtgcggccctggcgcttgancgcgtagacgacanccanggcggtgacggtctttcggcgggcgnncncggggtaggtgacggcgtcgcgggatgacgttcccgatggggggg

SEQ ID NO: 82791 - DNA, 472 bp, Triticum aestivum
  unsure (1)..(472): unsure at all n locations
  Clone ID: PAT_TA_82791
cggcacgagcgaccgtcnatatgctccattccaccggatcaccgtcgctggggacgtccccagatactccgcgatgctgttctcggtccccagcttccaggttcaggtggcagacgagctcgtggacgacgaacaccctccccgtttcaagccccatgacaacaacgacttcgtctgcttctgcgtttccgaagaaggcgctctccatcaagataaactcaaggccttctgtggagtgtaacnngcagcagaacatatcagccgtccggcatctgtgttattatacttttacctcagccttgcatgcagcagaggccaggccacccctgtagactagtacgtacaatttttagaacacgcgtgagatgataactcgtctgcatttcttatattctgaacatgaacaacaaagcattctggtagccatgaaaagagcacgcgtgagaagataactcagctcaaaaaaaaaaaa

SEQ ID NO: 82792 - DNA, 520 bp, Triticum aestivum
  unsure (1)..(520): unsure at all n locations
  Clone ID: PAT_TA_82792
ccgacgccgacgccctanctcacgtcttcgtcggtcccttcccagccttcgtcgcgtccttcgccgtcgacgagaacaaacgaggaattcaaggaaacacttgcaggactgaagaatagagaaacatgtcgtctggtggtgtgaaagatttttaccggcagaaaaagaaaggaggcgtggcgaagacagcttcatcctcaaagaacaagacacggcattacactggtggggcttctgttggtgcctcagatgcagctcagacatcagctctagtgtctcatggctcctgggatctcaaagatgactttggtgatgaagaagagcagctgcgacagtttgacgtggacatgaagtttggtccttgcatcggtgttactcggcttcagcgctgggagcgagcctctgccatggggcctccagccaccagctcatctccgggacctcctactgcacgcggcatcgacaaagaatcgcggtgaacggtagcccctctgtcgagtgctttgggagggtaaantct

SEQ ID NO: 82793 - DNA, 290 bp, Triticum aestivum
  unsure (1)..(290): unsure at all n locations
  Clone ID: PAT_TA_82793
gcaggatgccggcgacgccgacgatcatcggcgccctcctgggactgggcactcagatgtactccaacgccctccgcaagcttccctacatgcgccatccttgggagcatgtgttggggatgggtctcggtgcagtatttgtgaaccagctggtaaaatttgacgagaagctcaagnaggacctcgacaagatgctttagcgcgccaggctagccaacgngcaacgctacattgatgatgatnaatacctttcanatttntttcaaaggnccctgtnttttttccaaaat

SEQ ID NO: 82794 - DNA, 272 bp, Triticum aestivum
  unsure (1)..(272): unsure at all n locations
  Clone ID: PAT_TA_82794
gggcggcgccggaggtgtagaggaagacattatcaccctggggccctctgagtacatagcccaggtcgcctggtcggtgggcccgttccagttcaaggagatcgaggactgcgtcacctcgctcaagtttgtgaccaaccggggggccactacggcccttcggccgaagggacggcgcccacaaaagcttnccgtgctcaagggggnaactcgttggganattntacgngcttgagantacttcaaggcaatgggtttaantccgaccttgg

SEQ ID NO: 82795 - DNA, 296 bp, Triticum aestivum
  unsure (1)..(296): unsure at all n locations
  Clone ID: PAT_TA_82795
ggaaatgccccacttcctgggcgaatggagattatcacctcaaaaccagcgtttttagcagcaatggcttcttggaagacatcggtgatgaataagatttgagatggactgtccacgcccagtgactgngagatctcaaaataactcctggttcccctttggttccanttgtggatcaaaataccccacaggaantttcnaaggtccccgnatgttgtattnccaaatagaacctttggggttcccnaattccncttgggtatgtngaccttttatncnactagnatccaattntt

SEQ ID NO: 82796 - DNA, 249 bp, Triticum aestivum
  Clone ID: PAT_TA_82796
gttcctgatttccacaagtttgtgtcccctactcccctaccctaccttcccactgatggggagttgtgacgtcgttgtcgtgtggctggttgcagtgtcaaccaaaacagttctcacacacgtgagttgttgggaggtaggtagcctgtactatcacgtacctaccccatcaagaatagtgcgtcatctgtcatcttgtgatgtcatcttgtaatgaaataaaaatagttgcattttaaaaaaaaaaaa

SEQ ID NO: 82797 - DNA, 573 bp, Triticum aestivum
  unsure (1)..(573): unsure at all n locations
  Clone ID: PAT_TA_82797
gtccacagccctagaggctgcagctgcacacttctcttctctgttttcgccggttaaaacttttcccaattgttgctgggctttcgaaatctgtgggtttgtttgagcttagcangggaaagcgaagaacaggggaagcaaggacatggatgctttcagtgcagtgatggacaaggtaaagagccacccagaaatgattgagaangtaagtgcagtgattgacaaagtnaagaagagcnacccagaaccgtggaaaaagtcaangaccaagtnaanagcttgtgacgtctccacctgcggggacattgatccaaagataaagaacctgagtcttaaaaaaaggccctaaaaagcgaggcancccaaaaccttcaagaagagganggtactctnctanaanacttcagaaccaatnttttgaacaagccntaaagggattaagtntcccncaattttnagcagaagactnaaatnnaatnaattccattganatnctgtgtgtgtcctnaanttgcttagggaaancttaaaanaaaaggtttgnnaancgcccaaaangttcatttcccgttt

SEQ ID NO: 82798 - DNA, 435 bp, Triticum aestivum
  unsure (1)..(435): unsure at all n locations
  Clone ID: PAT_TA_82798
gcggtacgaccccagctacacctactggtatccgccaggctattcctggcaatagaccaacttaggccaaaagcctaagcttgggggagtacgtatttcccactgacattacattcatgctcacacacacactcattactagatgtcggtgctcatactctttcactgtaatatcaagctagtttaatttccctttttcctaatttcttcctggggggttaanaancttnggaaaaccaaaccaaattgtaannnttattgtcccgcggancangaanaatttggaagatttccccaaaaatttnccggtnctntttggnttnnggggtttcccggnaaaagntttancnctttcccttttttgggggaaaaaantttnaaaaaattgggggnccccaaanaatttttttaaaaaaanncccaaaatttttttcc

SEQ ID NO: 82799 - DNA, 389 bp, Triticum aestivum
  unsure (1)..(389): unsure at all n locations
  Clone ID: PAT_TA_82799
gaggttgataggccaggttgtggggctaaaattctccgaggggatggtgcattggaccagtacataacaagaaccaatgtgatgaatttacaggaaactaacgatggtttggccggggagctcgaggaagcgtacatgctgtctagaattgttagcttgtaatttgaaaggctggggaggaacctatatcctgagtctgaccaaattcgtacatcgngtaacatgtctaccccaacacaggccggcnactttttgctcanaaaatcacctgnactctgtcnccattcctgttangcttancggcagatatnccggggcaccttttccatgnaacagggtcccttttnattgaacaacccnctgggaaaaattgcccccattcccccgct

SEQ ID NO: 82800 - DNA, 570 bp, Triticum aestivum
  unsure (1)..(570): unsure at all n locations
  Clone ID: PAT_TA_82800
cgccggcctccccgtcagccgccgctccaacggcgctagcttcggcagcgtcacaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtacctgacgcgtattccnatcatcggattcgacaaatgcncagtgcagtcgtanttcatcgcttcaagcaccgggttccaggagtccgcaaggctaaaagtcannacgacaggcattataagtgcattnagttttntaacctanattctttggntccttcncattancttctattgtccnaaanttttncattcattccaaatgctcnnaanatccctn

SEQ ID NO: 82801 - DNA, 468 bp, Triticum aestivum
  unsure (1)..(468): unsure at all n locations
  Clone ID: PAT_TA_82801
gtgatattttggtgtagagcttgaccaggttcagtgtttctttggacagtgcatgtgagccagcaaagtatatgtgcatgggagccacgttgagttgctcctgcagtgctgctgtgctggcatgccccagaattcatgttcaccaagttgtggtcgagttccatatgcctacctacataatcagtgatgcctgcccatatatatacaaccctttggttgggttcagtgaaggtttctccctgctcacgaattctgtccaaagataactgaagggtgttgtggcgcatgtgtcctgctagtattaatcttctccccagtccctagatcgatttgcttaactggatgtgcaacccctgtgtggtgacacgcggcagttttccactcgcatggtcggacgccttagagtnctggccgataagcttgtccgaatatntagngcccaaaatannggagntcaaataagggttc

SEQ ID NO: 82802 - DNA, 198 bp, Triticum aestivum
  unsure (1)..(198): unsure at all n locations
  Clone ID: PAT_TA_82802
ctggcttctcctccccctcttaccaagtcctcctcgggttagggttccttagggttttntngaggnggatggcggcggctnatgtggagtaccgntgcttcgtcgggcgggnttgcctggggcaacancaacnagtcgctggagatgccctcncctcctacggcgaganncctcgactccaangncatcaccgaccgg

SEQ ID NO: 82803 - DNA, 316 bp, Triticum aestivum
  unsure (1)..(316): unsure at all n locations
  Clone ID: PAT_TA_82803
ccgtcttcctcgccctcgtctacctcgcgctcgtcggaaaaaacagctcagagacgtgctcggcttgaagtatacaaagaacagctcttgctagaaaccaagcaaaaaacgggacaggactgaagaatatgatgacttgatttgcatcgtaccgaagacattgctggccggaaattgatgagtccatggatgagtccatgatggacttggagaatgaggcagtgctacggaacgactgcgagaaggaagccgtgctgcngaatgaattctgcaaattgtatcattatangggggtttgtatctaaattaaaaactt

SEQ ID NO: 82804 - DNA, 467 bp, Triticum aestivum
  unsure (1)..(467): unsure at all n locations
  Clone ID: PAT_TA_82804
gaccccgacatccccgacccgatggcgcccaaggcggagaagaagccagcggagaagaagccggcggccgaggagaaggcggagaagacgaccgcaggaagaagcccaaggccgagaagcggctgcccgcgtccaagtcctccggcaaggagggcggcgagaagaangggaagaagaaggccaagaagaacgttgagactacaagatctacatcttcaaagtgctnaagcangtgcaccccgacatcggcatatcttccaaggcatgtcatcatgaactcttataacgaatntttaaaactgccgnnaggcccnaattggngtnaaaaaacccnccttagtcccgaatnnaactcgnggntatctcccggaanncnaaaaccntttccgggaaaaaggcntncaattccaaatnagnctgggatcngatttaaagttttngntnttccatcccactaccgctatata

SEQ ID NO: 82805 - DNA, 534 bp, Triticum aestivum
  unsure (1)..(534): unsure at all n locations
  Clone ID: PAT_TA_82805
ccaaagagggatatggctcccgcagtgggtgtgtccgccggtacaacacattctcctgggtgcacaatgcacatctcaaggccatgcttaagaagctccgggctaagcatcccaatgtgaggatcatatatggcgattactacactccagttgtccagttcatgcttcagcctgagaagtttggttttgccaaacaactgcctagggcatgttgtggggctccatcgactcctgagaaagcagcttacaacttcaatgtcacggccaaatgcggtgagnctggtgcgactgctgtgctgatccgacaacccattggagcttggatggattcactgacggagctgcgtaccgcatatcgctaaaggtggttatacgggcttttgcggacaaccaatcatcaatctcatgatacgcatctgtgtagagttcatcaaagtaggcactggaaaaaatggagcggggaatagtcttcancagttaatgttgataatgtaatcncatttgatgaatcattacttggngnnaaaggggaaa

SEQ ID NO: 82806 - DNA, 237 bp, Triticum aestivum
  unsure (1)..(237): unsure at all n locations
  Clone ID: PAT_TA_82806
gccagttctagttttacggtggcaatgaagcttgctcctaatagagagaaatttatggaggtcattagtggaaccggtgacatcaatgcagatattgagaaattttgcacgaccttctctcctttccncaaagaaaaccacaantttctggcgagcgtcggtcttgatgatctgaaggcttcatagatnaatcnccatgntgattacaacaaaataagcatntcttangaaacccaa

SEQ ID NO: 82807 - DNA, 553 bp, Triticum aestivum
  unsure (1)..(553): unsure at all n locations
  Clone ID: PAT_TA_82807
gttgactctgaggaccttcccctcaatatctctcgtgagactcttcagcagaacaagatcctgaaggtgatcaggaagaaccttgtgaagaagtgtgttgagctcttctttgagattgctgagaacaaggaggactacaacaagttttacgaggctttctccaagaacctcaagcttggcatccacgaggactcgcagaacaggaccaagatcgccgagcttctgagataccactccaccaagagtggtgatgagctgaccagcctcaaggactacgtgaccaggatgaaggagggacagaatgacatatactatatcactggtgagagcaagaaggcagtggagaatccccttccttgagaactgaagaagaggggtatgangtttgtacatggttgatgcattgacggtatctgttggcactcaangagttnaggnaanaanttgttctgcacaangngggntaaacttatagactnaggccagagaaaggaagngantaagggaantttagggntgtcaagtntcaagaggtctggnanaaattaaaagg

SEQ ID NO: 82808 - DNA, 478 bp, Triticum aestivum
  unsure (1)..(478): unsure at all n locations
  Clone ID: PAT_TA_82808
gcacctcgtccgcctctacggcttctgcttcgacgcgaacaccaaggcactagtctacgagtatttggagaaggggtcgctggagaagtacctttactacggcgacgtggagtgcagcacgagcacgggcaaaaggcttgagtggggaacgctgcacggcatcgcctcggcacggcgaaagggatcaagtacctgcacgaggagtgccaacagcggatcgtgcactacgacatcaagccggccaacatcctgctcacggccgatgacaccccgaagtgggcgacttcgggctngcacgactnggcgaacgcgaggacacgcacatntcgctgaccggcggggcncgggacncccggtaacgggccggactntgatgngctnccgcntcgaaaattcnacntnaaaanttcggatgngctttcaaancttgggagccnggaatanaaccctnccgggganaaaaaaattntnccaatgg

SEQ ID NO: 82809 - DNA, 385 bp, Triticum aestivum
  unsure (1)..(385): unsure at all n locations
  Clone ID: PAT_TA_82809
tttttttttttttttttttttttaatcaaaacggcacgaggttccattacttctcaaaatagctgtggcctgtagcttctttcattgtttcaaagcattacaacataagcagcaaaaccagaaacagtcctcataagcaccacttattagggcagtacaacacaaacgataagcgcggtgcagatcaagaaagaaccacaacatgtagaagccatataaaagcatgattaagcacagcagaccaccaaaagttcttactgaaaaaaaaggccgcttaggcagaaggtttctccgacttgagtggttcaccactcccaggtgaagtcanggtcgtcccttccgaagtggccgtagtgccgtcttgaggtacgccgttgccggcttt

SEQ ID NO: 82810 - DNA, 356 bp, Triticum aestivum
  unsure (1)..(356): unsure at all n locations
  Clone ID: PAT_TA_82810
aaagaagaaaacatatgtgtgtgtacataatataatattaggtctgtaagcaaatcaattgcgcttggtcttgcagaccgtagcttgtatttttcattgtgtacagtattactcctccccagtaagttttcgagtaaacagcagtgatgtaaatccccagtacttgtgtgtactgtttatgaacttgtgctggtagaatattcctgtttgccaatgttgagtatcgtgattattaggaaagacgagatagactaagattgttctagcttgtcttgtacttcnaatagatcattggacncnatatatatgcccacgaggtcaaacaatatgatgaacaattcctcaaaaaaaaaaaa

SEQ ID NO: 82811 - DNA, 572 bp, Triticum aestivum
  unsure (1)..(572): unsure at all n locations
  Clone ID: PAT_TA_82811
ttttgatcgtgaggaggaaggatgcccgatcagtgaagatcaagaggagcaaggatgttgtcaaattcaaggtctgctgatccaagtatttgtacaccctctacgtctttgatgctgagaaaacaaacaanttgaagcaatctcttcccctaggtagcttagctttaattcacatccatcggcccctctcagccatacacagtgntccnaacnatccacgnaaagtccgcgaaaaanccgnaaactnggagnaaaatccgccnttccatcttcagcgtctcccttccttatgccgcgacatgaacaggatcccctaccatcgagaaaccccctatgcatcctccatacacggcgcataaaccctatataccacaccagcgtgatctcctcgcgtttgtaagttctgggagtgaacggattaggataggtgataggcgcaacaaggcactgaggtgtacacatcgtggagttctctcttactgctactcctctgggaatanaaactgtagcgtggtgcaanaattgtagcgttnactanagcttttttgatcaatcatnttggaganacactc

SEQ ID NO: 82812 - DNA, 445 bp, Triticum aestivum
  unsure (1)..(445): unsure at all n locations
  Clone ID: PAT_TA_82812
tctttgagccattcgcgtctgcgtccgctcccccatatccgatcgatccactgcacctcgcgagcgatagggcaactcccctgcacgaatccactgctcctcgtccctgcgccgccgccgctcgacggagtnggcctcatcgccgctcggaatcaagtctcccccccaacgcacacacatgctcgccagatcccctccgtctccaccgccgtggtcgagcaagtgggtcaagtcgctggtggccctcaaggtggccganaaggcggcgggacataaggggtggnataggtaccatctcaggtggagctagccggtcttgtcanggcgagcgtagnnggnaattcnctngcttcaangntttngggttggcttaatcgtattttttaaaaaacgnagcagcnctnttagggtttancnggntgggaagtcantggagtttttcctc

SEQ ID NO: 82813 - DNA, 515 bp, Triticum aestivum
  unsure (1)..(515): unsure at all n locations
  Clone ID: PAT_TA_82813
ccccaatccagcagccctcgagtctggtcccccacccctcagcgcgacgaaggtaagatgttcctgcggaggatcctgaccggcgggggcggcctggcggccctnagggcggcgcgcgccgtttaaggagacgacggggatcgtnggccttnangtggtgcctaacgcgcganaagttctngtaaggctctacgagcgcacgctcaaanagatnaaaggcgttccccaaaaanaaggctaccncaaagccgttnaatcttnacngttaacgcttcanatttttcaagaggaggaggattnaancgcatttaggancgaatccgatncnggnagtttaagagtcatttangaggccangacgagtnaagtcatcgctaaaatnattaatngattcattgggtgttnccatgactacaatttaagtatttaaaagaaaacccaatttttaagaagttcttaaaaacttnctgttgttnttctttaagagttntttaaaggattaaatctntnaaaat

SEQ ID NO: 82814 - DNA, 232 bp, Triticum aestivum
  unsure (1)..(232): unsure at all n locations
  Clone ID: PAT_TA_82814
gtttttttttttttttttttttgagattggcacaacatattcctctttgacttaggccattcatcaagttataaggttgttcacgatctgacaagcatttntcctgtaccacaatntgaaaggcacagctaataggtagccaagtaatagttatctagcaaanattanctatnaacnattttttancngctaactattactctcttagnttcctcccaaantgcnanctgtt

SEQ ID NO: 82815 - DNA, 261 bp, Triticum aestivum
  unsure (1)..(261): unsure at all n locations
  Clone ID: PAT_TA_82815
cgtcaccaacacccccaacttcctcaccgacgacgtcgccggcctcggcatttccgtgccaaggaagaccacgcaggctgaccgctacgtgcgcgccggcttgtggaaggcaagagggactacgtagtcaccacgcgggtttgtatccgatgctttttcgttgacttccattcatatttttctatccagtgcatctttaatataaatgaaacacnaatacngtatatctaaatcgatattttagtggntaaaaaaaaaaaa

SEQ ID NO: 82816 - DNA, 530 bp, Triticum aestivum
  unsure (1)..(530): unsure at all n locations
  Clone ID: PAT_TA_82816
ctctctctcgctgtttgaggagaactacctgctcctgctccctcttccgctcctccgcgctcccgctcgccatccccaggcttcatttcggacggggatggacgactacgcccgggagatgatggagctgaagacgctcgtcacccgcaccctcgagaagaagggcgttctcgccaagattagggctgagctaagagcaagcgtgtttgaagccattgaagaggaggatcgggtgatggagaatgatgatggcggtaatcctgctttgcttggtagctgtaatgaccgggctaagcaactgcatgcttcaccttcaggtaggttactaactgcacttttttgcgaatactttgagtgggcgcaattaagtcacacaatgaaagtttacttnccagagtgtaactgcccaangacttcttgagaatgaacttaaagacttctcttaanaaaattgagcttaaaggagcaagantncttaaatnggncactgcnttaanatgttctccaagggtatcttaaaaaataaaaaa

SEQ ID NO: 82817 - DNA, 527 bp, Triticum aestivum
  unsure (1)..(527): unsure at all n locations
  Clone ID: PAT_TA_82817
gggcgaggggagtgggtgtacgacgacgcggcgcgccgtggtaccaggaggaggagtgcccctacatccagccgcagctcacgtgccaggcgcacggccgccccgaccgggcgtaccagcactggcggtggcagccgcgcgggtgctcgctgcccagcttcaatgcaactctaatgctagagatgttgcggggtaaacgaatgttgtttgttggagattctctgaaccgtgggcaatatgtatctttggtttgcctcctgcaccgaatcatccctgagagctccaagtcaatggagacagttgattcccttacagttttcaaagcaaaggactacaatgccaccattgagttctattggggtccctttctgggcgagtcgaattcggatgatgctgttgtgcnccggattcgcngatccgattntaanagggacatccattnagaagcatgccaatttttgaaaggggctaaattttggattcaaaaactacctattggggattactggacaaaaaatnaaaatttt

SEQ ID NO: 82818 - DNA, 298 bp, Triticum aestivum
  Clone ID: PAT_TA_82818
tttggatcttgtgtacacccacagctagttcaactaagatgtagcactagttcgtccatggaggaagcagaatggacgatgaagtgtggtcagcctgtcgaccatgaggtgttttcttccaatggagtctagggtatgtttgagttctacaacggcttgtgccgtacgaagtgtcagcagtgtacgaggaggaggatatcgttgtcagtacacattttgcctgtctagaaaattatgagtactttctccgatcacaagtacatgtacatccatgtttgtcttaaaaaaaaaggggggg

SEQ ID NO: 82819 - DNA, 480 bp, Triticum aestivum
  unsure (1)..(480): unsure at all n locations
  Clone ID: PAT_TA_82819
ctcgcttctcgtctcccgtctcctccgcgttcccgctttccacccgccgccgccgccgccgcccaccttaccgtcccctgccccttgcccagcatgtggggtagcaccgacggcggaacggaaggttcaccctcgagacctccatgggcgctgtctctgttgagatgtactacaggcacgcgcccaagacttgccggaacttcgtcgagctcgcgcgacgtggctactacgacaacgttatcttccaccgnatcatcaaagatttcattgtgcaaggtggggatcctacaggaaccggcanaggtggcgagtccatctatggagcaaagtttgaggatgagataaagactgagttaaagcacactgggggtgaattctgtccatgggaaatgntggcccaaaaaacaatggnagccagtttttaanaaatcttgccccctgtnaatcacttnatgggaaaaataaaattttttgggaggg

SEQ ID NO: 82820 - DNA, 502 bp, Triticum aestivum
  unsure (1)..(502): unsure at all n locations
  Clone ID: PAT_TA_82820
ctgatccgtgagcgaaaacatgtcggctttgcgccattctctaccgatcatcctcctgcagctgtacatcctctccggccgacccgcggcggctaaggtccctgcgctgttcgtgttcggcgactcgacggtcgacacgggcaacaacaactacatctccacgctcatgaagagcgacttcgcgccctacggccgggacctctggccgggaagcggcggcggcagtactagtagtggccagtccaccggccggttctccaacggccgccttcgccgtcgacttcatctccgaggcttttggcctcccgcaattcgtgccgcatacctggacccgacgcaaacatgagcagctagcgaaccggcgctgttcggtctgaagagccggctacgacaacgcacatctgatctgtttgtaagaaataaatataaggcgcaattctgcaagaaaatatgctgctcttctttgtaattacgacaatgaatgaaacgcgccgngacaaac

SEQ ID NO: 82821 - DNA, 540 bp, Triticum aestivum
  unsure (1)..(540): unsure at all n locations
  Clone ID: PAT_TA_82821
agacgacagagatgaaggacggaacgtcgtcngggggaggggcgttcgctgcgggcagcgatccaaggcagccgtcgacggcgaacattacgcgccgccgaagctgtcgccccaggacctacccatcgactatgcaggcttcctcgccgtcgccttcgggtcctcggcgtcatgctccgctacaaggtgtgctcgtggatcgcaatcatcttctgcgctcagtcgttggcaaacatgaagaactttgagaacgatctgaagcagctttctatggccttcatgtttgcngttatgggtctggtgacgaactattttagccccgctcgtccaggcagtacaaagcgctaaactgcggaagaacatgtgctacattcttcataggactttttggtgcttccgatagctttgccatcggtgctgacattatgtatgtccaatttgagcaaaacgtcataggtatgggcatcaattaattggaccgtacatgtatgatgctcaataatttatttgtgcaatactagtaaacgcatagactgtttn

SEQ ID NO: 82822 - DNA, 530 bp, Triticum aestivum
  unsure (1)..(530): unsure at all n locations
  Clone ID: PAT_TA_82822
ggaggttgaagttcctattgactaaaaaccaaataagtatcatctagttgtatcgtgatgtgttgccgagagccccagacctgtatgttcatttgtgttgaattaagtctatggtgtatttatatccttgtaaatcaaatcatgatcatagatgtaattaaggaaacaaatgtacctgttatttggaggattagttgacttgcgctgatactccttaaggcttgtttggaagtaaggatattggaggagattgagagctgatttggtgaccagagaattggaaggattcatagggaggaatccttcgcaattcaaaattaaatagcaagaagattcctctctcatggtcctctctaaatccctagtcctaaaccagtcctgagggagctagaatcacttactatttaaaattgaatagtagngattctagatctctcaatcccctacttgtggctcttnaaaaagnccnaatactgttataccncatgtgatanntccggaaatcatattgatgtatgggtcaccncnan

SEQ ID NO: 82823 - DNA, 530 bp, Triticum aestivum
  unsure (1)..(530): unsure at all n locations
  Clone ID: PAT_TA_82823
gtcgtgcagttggatgactgggtgctgtgccggctgtacaacaagaagaacgagtgggagaagatgcagctggggaagaccgccgtcgccggcgtcggcgccaccaaggaggaggcgatggacatggccacctcgcacacgcactcccactcccaatcacactcgcactcgtggggcgagacgcgcacgccagagtcggagatcgtggacaacgacccgttcccggagctggactcgttcccggcgttccaggacccggcgatgatgatgacggtgcccaaggaggagcaggtggacggcttcaacgccaagagcggcaacctgttcgtggacctcagctacgacgacatccagggcatgtacaacgggctcganatgctgccgccgcccggggaagacttntactcctcgnttttgggttttccaaggttaaagggaaacaaccccccggaaccnccgggttgganaattntaactnaagcaangattgagcattgattangagattaanacgnttcnaattctttaaa

SEQ ID NO: 82824 - DNA, 321 bp, Triticum aestivum
  Clone ID: PAT_TA_82824
ttttttttttgatctcaatgtgttcaattcatcatttatcttcaaagatagtgctatagatacacactactaaggcgtacaaggatttcttttcgaaccatgcattcaacatctgggcgaaaaggccactgaagcttattctggctattagacactgaagcacctacaacggttgcttcgtagcaggcaaggcaactgaaattcagttgtaaaacagtcgtaaagttaccatggcagcactttcagcccacaattttactcgctttcactctcttcctcgctttcttcatcttcgtcgaggttcaggtggttcatattctt

SEQ ID NO: 82825 - DNA, 537 bp, Triticum aestivum
  unsure (1)..(537): unsure at all n locations
  Clone ID: PAT_TA_82825
cgtgatcttcgacgccggcagcacagggacccgtgtacacgtcttcaggttcgacaggaagctcgagctcctcgagatcggcgacgacggcatcgaggtgttcgccaaggtgaagcccgggctgagctcatacgctggacatccccaagaggctgcaaattccatgctgcctcttcttgacaagggcaagagcgccgtccctaaacagctgacgaaaaggaccccgcttagactcggagcgactgctgggttgagacttatcggagaggagcaatcagagcagattctcgaagcagtcaggaaccttatccacactaagagcaaatttcagtacaagcccgagtngatcaatgttattganggtctcaagaangatcatactatngggtgctctgaattatctgttngataaatttggangggactactcacagacagtagctgtgcttnanatggggcgtggatcagtgcaaatggcctatgccgtttctgnaatgccgtgnaaatgctccggggccganttattggggaanancc

SEQ ID NO: 82826 - DNA, 472 bp, Triticum aestivum
  unsure (1)..(472): unsure at all n locations
  Clone ID: PAT_TA_82826
gaaacctctgttgtcagatagatggggacctctccagattatcataaggatgcccaatagtatgttttctgtgcgtttatgagtgacgatcgaccatgtctttgtatacctacttaaactgctgaaattgggaaaatgccacttaggtcgatcggccctgcatctgtagaaaaagttgtaattgtttatttctttttcgttttctggtgactagatgaccagtagcgctaaatggtaaggtcatggtttgagctgaaatttgcttccgtgggatttcaacttttcgtaatgctgacgtctaagataatttgaatggattgttagcgtactaatgggtagtggaaaagcgtggagcacacagaggatgaagggactctacancgagtcttcttgtaaacagnctctcagctgataatgctgagctgttagtgttnaacagagagctnccaattttcccnccaaaaaaaaaaaa

SEQ ID NO: 82827 - DNA, 528 bp, Triticum aestivum
  unsure (1)..(528): unsure at all n locations
  Clone ID: PAT_TA_82827
cacacgcttccttctctacctcgttagctagcttagcccggccgagggagagaagcagaagcagtagaggcgaccttttttttctgttctctgatcgagctctgaagaccggggatggcgtcctgggcggctctcctggcgctgctgctctcggcgttctcggcggcggcgcantggacgagaggttctacggccagtcgtgccccagcgtggaggacgtcgtgcggaaggagatggtgcgcgcgctctccgtcgcgcccagcctcgccgggccgctcctcaagatgcacttccaacgactgcttcgtcanggggtgcgaaggctcggtgctcctcgacttcaacggcgaacaacancgcggagaangaacgcgaancgaaacctgaagctgcggngctttcggttcattcaaaaggttaaagncnccgttgaaaaaggcttgcctnanaacgtttcttgggccaagtgtggctctaatggcaaggaaccatnttggctaaaaaanggccntttttggggttccaatt

SEQ ID NO: 82828 - DNA, 502 bp, Triticum aestivum
  unsure (1)..(502): unsure at all n locations
  Clone ID: PAT_TA_82828
cgcatccttccccgctctcgctctctcagccgcagagccactcgtgtcggtgacggcggcgaaggcaatgtcatccctccgcccgtccctcctgctcgtggtgtcgctgctcgcggcggctctgcttgcagcggcgccgtcctccgcgtctcgcgacctccgcncgctccaggcgagcttcgtcgtgcgcggccgcgtctggtgcgacaactgcngcgcgggcttcgagacccccgcatccacctacattgccggagctaaggtgagagtcgactgcaaatcgaagaccaccggggcaaatacatgcagcttcgaggggatactgaccgcaccggcactacaacatccttgtcattgatgagcatgagcatgagtctgcagtcgtcttgtgagagcccggaaaagggtntgcaatgttgtggctggttgtaaaagggccccgtntttcttaacagcaaaaaggtttgatcaaagtnntttggaaatgcttggggttcaaaan

SEQ ID NO: 82829 - DNA, 528 bp, Triticum aestivum
  unsure (1)..(528): unsure at all n locations
  Clone ID: PAT_TA_82829
cgtcggcagcatacagtcacaggttgccaagatcgaggatgacatgaaggttcgagcatcggaatataataatgtaaggagccagcttagtgcgatcaacaggaagcaaagtgggagcttagcgttcgtgatctttccaatctggtaaaaccggaggatatgatcacctcggaacatctcgtgacacttcttgcaattgttcccaagtactcccaaaaagactggttgtcaagctatgagaaaattgacacattcgtggtacctaggtcatctaaaaagctctatgaagacaatgaatatgctctctacactgtaacactgtttgctaaggttgttgacaattttaaggtccgtgctcgcnagaagggntttcangtccgtgattttnagttcagtcctgaagcacaggaaagtcggaancggngatggngaagctacttcaanaccaagaagccattngggccacccttttcaatggggtttgccagctanancgngggttttanttnccggntngcctttttttnn

SEQ ID NO: 82830 - DNA, 426 bp, Triticum aestivum
  unsure (1)..(426): unsure at all n locations
  Clone ID: PAT_TA_82830
gacgcttcagtcatggcaggaatggcacccgagggttctcagtttgatgctaagcactatgattctaaaatgcaggagctgctgagcactggtgagactgaggagttcttcacttcatatgatgaagtttttgaaanttttgangacattgggcttcaagagaatcttctgagaagcanttatgcatatggtttnagaaaccatctgcaantcagcagagaggaattttnccctctgcaagggcttnatgtcattcagcaagcacaatctggtacaggnaagacagcaaccttctgttctngggtcttncagcaactttaactaatggcccggttaaatccaagnccngggtttttntncccacccgggagntttncnaaccaaanttggaaaatttttcnnnccctttgggacnancttggggtt

SEQ ID NO: 82831 - DNA, 510 bp, Triticum aestivum
  unsure (1)..(510): unsure at all n locations
  Clone ID: PAT_TA_82831
cccgcttcggggtttccggggnaccaaagaagccgaagaaagggaagnntgaaagggaagctcaaagcttccaagggagattcaaagaaacgggccggccttggncaatggcttcggcctttccttcgggcaatgttcccttgcaaggccaatctttcaacgggcgttcgggggccctttccaagaaaccttccttcggaccaaacttcctnagaacccccgttcaaacaaacaaacattccttcaaccaagccttcaaagtttccaactaaggcgaaaatcgattnccgattccgatttccgaggcattcgttcgttcctgttgcattggtaacccgttcgttcgttgggaaaacttnaagcgttgcgaagaaggtattattattgcgaagggttgggtgttaaaattgtaaaattttgtaacggcgttgctggnttggaatgccttgtnaaaatttaataattcggggcnaacngaaaantaagtggcanttgccnaaaaaaaaaaaa

SEQ ID NO: 82832 - DNA, 526 bp, Triticum aestivum
  unsure (1)..(526): unsure at all n locations
  Clone ID: PAT_TA_82832
gngangcgccgttcgcccgcaagttccacgaggacgacccggtgctggacaggatagacgaggagatcctgggccgnggngnggacgtgcngactcccgggggctggtgcgctgggacgcgggagaacgggagcgacccttgctcggtggtcggagacaccgggcttgttgtgcctggcngtggagccgngnggctgcagcggctggtcacgtcgttgctgtcggaggagaagttccacccaagngnantgcaagtaaacctgtgcttctacgttgctgttgtactaccacaacccacantagtcgtctgnctgtagagcctncctcctncgaatanatgtacttnatcgtncggcnatgttgngataatattttaagcttagtttgnctgncatttgaaatggcncgtcnagcttnaaggaatnntgagaattatttcaacattnaaattnaatctgatttcagatagaantggaantgganaaacaaaatttgaatgaagnataatnatgggaaaaaaaaaaaa

SEQ ID NO: 82833 - DNA, 571 bp, Triticum aestivum
  unsure (1)..(571): unsure at all n locations
  Clone ID: PAT_TA_82833
cctcatcgaggcggccacgatggaggacagcaaagccccggtgtcggagcacggcggggagacctccaaggccgcggtgctcgtgggggtggccgccggcagcgggggacgcaggggcagggcggctacccgcgttctggccgtggtcgacctcatcctccgctccgtcgcggtggtcgccaccgtcggcagcgccatcgccatgggcaccaccaaccagacgctgcccttcttcacgcagttcctccggttcaaggcgcagtacagcgatctcccgacccttacgttcttcgtggtggtgaactcgatcgtcgccgcgtacctggtgctgtccatacccctgtccatcgtgcacatcatggcgagcagcgcaaagtacagtaggctggtcttggttttctttgatcggcaatgctgtggcgtggttanggngcggcgtggcggcgggcgatgtgnactggcgacaagggaacgcagggcaactgtcgcatttncanagttcnctcttttngangatttcggtcctatggtattgggcatgnttntcttttntaaatcntcgcgcgattgg

SEQ ID NO: 82834 - DNA, 301 bp, Triticum aestivum
  unsure (1)..(301): unsure at all n locations
  Clone ID: PAT_TA_82834
nccannctgaccctatactcaggatnngttgtgccttctggtggtganaccgtctctttangacaactgaactgctttaagtatancagaagagctcagtgatttaccctttagaaaatcctctaccttgctagctctgntggcatggtcagcnccataagcaccgtnncaccaagcatatatcctccatgatgttcttccctgaagctgcatcngttgaagtccttgccaagagagcagtattgacatgtgaagcngcattgccaantggccgaggcgctgcncggaatgtctcanaggt

SEQ ID NO: 82835 - DNA, 498 bp, Triticum aestivum
  unsure (1)..(498): unsure at all n locations
  Clone ID: PAT_TA_82835
cctcttccgttgctctcctgcctccagctctccacggtctctgacccgcacaactgaacccgcgatggcgcgccgcctcctcgtcgccctcctcgccgcgtcgctcctgctcccgctcgcccgcccggactcctcctcgtccccgcccgccgccaccgcgtacgacgagctccgcctccggggcttcccgcgcggcctgctcccggcnaagtgcgggcctacacgctcgactccggctccggggattcgccgtcgactccgctccagctgccggatcgtgctgcccgcggggagctaacctcgncgctttaaggaacgantcaagggccggctngaagaacgcgatttcggggctngaggatcngggtnaggcttnttccgctggtggnnatanggggatngcgcngatggganaagttggtttnnaggtggttcgtntngaaaatttccgggggggattaaagnancttnattcccggcaagggggntcnaataaag

SEQ ID NO: 82836 - DNA, 556 bp, Triticum aestivum
  unsure (1)..(556): unsure at all n locations
  Clone ID: PAT_TA_82836
ctcgtgccgctcgtgccgcgagtgcggggaccggcccagaggggccagcggggaggggccgccgccgtcggactcgtgggcgtggcgcaagtatgggcagaagcccatcaagggctccccctacccacggggttactaccgctgcagcagctccaaggggtgcccagcgaggaagcaggtggagcgcaccacgcggaccccaccgcgctgctcgtcacctacaccttcgagcacaatcacgaggcgccgcagcccaagaccagcggcggcagtgctgccaccagcaaggcaagccgtccgcgcggccgccggcgccgaagcctgagccgtccgtggtcctggtccagcgggatgagtcggcccggagcacgagtggtagaaacagaggtgccggagcaggagcaggagacggagccagaagaggagcacgagccggcggaaaagggtccatgntggccggtccggaagcggcanaaccttaacggtgncncggcgccgaggagacgaaanttcnctttggtgtttacagncccacgttgacggttgnggtntagcc

SEQ ID NO: 82837 - DNA, 542 bp, Triticum aestivum
  unsure (1)..(542): unsure at all n locations
  Clone ID: PAT_TA_82837
gccggcggcaccggcatgttcgtgccggcggcgacggctggcacggtgctctgctgcatgtgcggcgtgtccatgcagcccaacccggccaacatgtgcgcgcgctgcctgcgcgcngcgntcgacatcaccgagggcgtcccgcgccacgccgccgtggtttactgccccgactgctcctcctacctccagccgccgcggtcctggctccgcgccgcacccgagtcgcccgagctcatgcagatcctgctccgccgaatcaancgcccgctcgcgcggctccggtctccctctccggcgccgagttcgtcttctccgagccccaatccaagcgncttcgnctnaagtncgnctccgccgcgagtgctccanggnattgtcctcgagcaaagcaaccagtgattcgtcgtccangaanggttgtgcantcctgttccggggnaggcaacccgaacagtggtttcgtngtcantggcanacgtgcccaaagggagtttctnnactgagagtctctaaganggaaggttctggnttgattgggg

SEQ ID NO: 82838 - DNA, 570 bp, Triticum aestivum
  unsure (1)..(570): unsure at all n locations
  Clone ID: PAT_TA_82838
cgagcgtgcgcgtcaacgagcgactaactccaatcgacgtcagctctttccgcaaccaactcaggtatatcgaaccccaattcagaatttggcagctgcagcccgcatagcagagtcaattcagccctctcagtcagaggctggaagaggcttgatgcagatcagagatttgctccgggcagaaggagatcagaattcagctgtgacagtcacgtaacaggattcacagtcgatctgtcgctgcgaatactgttcagtcggctcacagtccaaggtcgcctccgaggcgcatgggacgtgcaggccggcgggaccactatgatgatcgatttgatcgtgatgacaggcgtcgagtgcccactcctcctccgagaagtgggtctaacgcccatcggcagcaagatgacagacgccagctcagtgttgggcggagagtccaatcgaccccagagagccaggctttgacgcgagatccatcatcgtgaaggttgngacgaacagagcnataaggtgnatncagaatgnccacaaaagcgagtcacgttaggccagaatgtttaganacgntta

SEQ ID NO: 82839 - DNA, 525 bp, Triticum aestivum
  unsure (1)..(525): unsure at all n locations
  Clone ID: PAT_TA_82839
caaggccaagagcgaggggtacctgtgggggaacaggactgcagctgtggactccgacaagaagcagcagcttcttgccgtcattggagtttacactgggtttggctcccgtctcaagaggaacgtcttccgtggctcctggatgccaagaggtgatgctctgaagaagcttgaggaaaagggtgtagctattcgttttgttattggtcggagtgcaaatcgaggtgatagcttggaccgtaatattgatgatgaaaatcggcagacaaaggacttcttgattcttgaaagtcatgaagaggctgcagaagaattaccgagcaaagcaaaaattttcttcagtgctgcagttgaagcctgggatgcagaattttatgtcaaagttgaagataacattaacttgacttagctgggtaattgagatctcgaagncgtcgaggagccaagattgacatgggtgatgaatcagggtggcataagtnagaggccacatggataacctagtggggaattgggntcaaaacg

SEQ ID NO: 82840 - DNA, 531 bp, Triticum aestivum
  unsure (1)..(531): unsure at all n locations
  Clone ID: PAT_TA_82840
ctcgtgccgcgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacgggccagtttgcattcaccacttcagaagctggaaactaccttgcatgtttctggatagacagcgtggagaaaggatcaggaacatctctaaaatcttgattgaagatagggattgctgcaaaggactggnaactattctaagaaagagaaatttgaggcgtaaactagagcttaggaactttaacttcagtcgagncatccatanaacttgnn

SEQ ID NO: 82841 - DNA, 530 bp, Triticum aestivum
  unsure (1)..(530): unsure at all n locations
  Clone ID: PAT_TA_82841
gcgaactgcgcttgtgaaatccctccgaccacagcccctgccctcaaagatggtagccattgcactactggggatggcagcaaacatccctcttggggtgtggcgggagcacaccaagaagttctctcctcagtggtttgcagctgtccatgccgctgttccgttcattgcaatgctgaggaagtctgttgtgatgcccaggactgcgatggcattcaccatagcagcctccattgttggccagacaattgggtcaagggctgagcgcatccgtctaaggaatcaggcggcaaatggtactggtgattcttcaacgcacactgctatgtatccaaacaagaatgggcattgcagcgacactgaaggcaaggcatgggaccctcttgcgacgaagataacaggctcaactgctaggggttctcctgcaccaaccccaagcgtgtgttctgattgtgtaagcatgtgattacgcacacctgtgaagagatatacatgaaccagtttatctatagtgcangnattgcttgtgt

SEQ ID NO: 82842 - DNA, 342 bp, Triticum aestivum
  Clone ID: PAT_TA_82842
agccgcaccgcgccgccggagcagcgcgagaccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgcgcggtcggcctccctgagctcctccccgaggagcagccccccgaggaggagatcttcgccgacgggccgccgacgtcgagggaagcgccatccgccgcatccaccacgcgct

SEQ ID NO: 82843 - DNA, 386 bp, Triticum aestivum
  unsure (1)..(386): unsure at all n locations
  Clone ID: PAT_TA_82843
tttttgttttttggaagatgaaataaaaactgactttataaatgcttgctaggaattaaagttctgcgctagttgctgggccgcttctgccgcagtagaaccctaaccggaactaaagctaaacctgacctgacctgacctaatcgagactcctaaactctaattaataacccagccgggggattacgacgacgatactagcaagagaaagggagggtagttcaggtacggtacaaggctattacgtccggggggggggaaaaatgtacagccaccgctgcgtggccagcctccatgccgcngcctccttgcggctcatttctgacagggtgggcacaagttagaacgangccanggccggcgccgcggtggcgacatgcggcctc

SEQ ID NO: 82844 - DNA, 243 bp, Triticum aestivum
  unsure (1)..(243): unsure at all n locations
  Clone ID: PAT_TA_82844
cggagagattgaaagcccatgaagttctaaagcatccatggatatgtgataatggagtggctactcatcaaactctggatccaactgttctttctcgtaccaataaattatctgcagtgaataaatcaaagaaattggctctacaggttattgctaagcatctttcanaagaggagattnctangttaagnggantgttnnaaggcaatggacaaanggaancaatnttgtgattcctttgtc

SEQ ID NO: 82845 - DNA, 345 bp, Triticum aestivum
  unsure (1)..(345): unsure at all n locations
  Clone ID: PAT_TA_82845
ctcgtgccgcgggggttgggccaatcccttccccggcagacggcagtcgcatcgcatcccctccgcctcgttccttgctcggctcgccccaacttcgctgccggcngccgccgccgcattcccctcggctactcgctcctcgtcgctccccggtgatgtctggcggtaacgcatggtcgccactgccttcgcacggatttggatccgagtctagcggcatggcgaatcgcgccggcgagcctgtggcgaggaccaacagcgatgccggcggcggcggcannaaggactnngggcancttngagngcaaatcngcctgnacctggagnangaccccntggncacct

SEQ ID NO: 82846 - DNA, 290 bp, Triticum aestivum
  unsure (1)..(290): unsure at all n locations
  Clone ID: PAT_TA_82846
cccgattgcatctcagacatggaaggcttactttgggctaatgcgaagtgaaacaccaaaggatgatagcagacaagctgcttcaattttgttccctgacaaagatcagtccttgaagttgaaaaaacaccatgggcgagcagaggctcttctgttagcagcctatgggaaaggccttgtgctgccatcggggaagttcagcaaaacctcagtttnatgtctatggnnatttcagatgacttgcnatttttttgggggtaaacanaggcnctgctgtnancacctntggg

SEQ ID NO: 82847 - DNA, 438 bp, Triticum aestivum
  unsure (1)..(438): unsure at all n locations
  Clone ID: PAT_TA_82847
agacgctgacagggaagaccatcaccctcgaggtcgagagcagcgacaccatcgacaatgtcaaggccaagatccaggacaaggaagggatcccgccggaccagcagcggctgatctttgccgggaagcagctggaggatggccgcacccttgcggactataacatccaaaaggagtctacgctccacctcgtgctcaggctccgcggtggcatcattgagccctcgctgcagggctcgctcgcaagtacaaccaggacangatgatctgccgcaaatgctatgcacggctgcaccctagggctgtcaactgcgcaagaagaagtttggtcacagcaaccagtgagggcaagaagaggtcagaactgaggngtgctgctatcagttcatggacaatttgtttggttgttnacnggtttgttacganctgntttttgtt

SEQ ID NO: 82848 - DNA, 670 bp, Triticum aestivum
  unsure (1)..(670): unsure at all n locations
  Clone ID: PAT_TA_82848
caacaaaccaagctcgacaagcagaagatgttggaattgactactttgattcccttcttaaagtggggttccttcaaatttggtccacatggggtgaagtaacatgcaaaatgcatgacctggttcatgatctcgctagacaaattctacgggatgaatttgtgtctgagatagaaacaaacaagcaaataaagagatgcagatacctatctttgacttcatgtactgggaagcttgacaacaaattatgtggcaaggtccgtgcactctatgtttgtggccgtgaactcgaatttgacaagacaangaacaagcagngttgtgccgtaccattatatgaagtatataactgctgactcattgccctgttgtgtcaaaatttgaatactggggtacntgaaatatccagtgttaactgtgaanactcccagaagtctctcgcgttgttggacttgaagcccttcatgattaaatgctcaagcttgcagtgtactgaagntcggcagcttagagcttagaactctgaactgatgtgtttcagtatcaggttnncacagtcattgggatgtgananctcgagatttnccngaagttgcatggatcgagtttaccaatcctggaaatggnantagggcctanatggnccgcttggttgcaaactcnncccnat

SEQ ID NO: 82849 - DNA, 454 bp, Triticum aestivum
  unsure (1)..(454): unsure at all n locations
  Clone ID: PAT_TA_82849
ctcggtgagcgcttcaacaagcttcgtgctaagatcatttccttaagatgcggcccaggcgcanaatcctgcccccagaggtgaccagaatacatatggactttgcaacgagcttcaagaacggtcatatgggcgccaaaaagttctggcgtgagaacctcccccgactaaaataccataatccctcagttcctatgattgtcaatcgtcacagccggaacaacaagaagcctacaatctctatctatctccgcaaacccgacgcttcaactcccgcacccgctactcgttcccagccctcctcatcacgcaataacatgtccaaggccacaccgcggatgtgacgagaagatcgtcaccgtcgatatgactgagaaacattttctcacattcttgatacgtacttgccgagacccgtgtgtcccatcaacccaccaaggngngttcngaattg

SEQ ID NO: 82850 - DNA, 529 bp, Triticum aestivum
  unsure (1)..(529): unsure at all n locations
  Clone ID: PAT_TA_82850
cgatgtctgggcgcggcaagggcggcaaggggctgggcaagggcggcgcgaaacgccaccgtaagttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggctgccggtggcgtttcctcagttcctctgcttcttggcttgatgtagagagttanagattaaaatatctctgatgtgcttcgtattgggtggatcatgtgtccagcagtgctggnaatcaagatcaagatgtactttctttcagtatgaaatgtaaatnggtcaaaaaanaaaaaaaanaaaaacccnn

SEQ ID NO: 82851 - DNA, 274 bp, Triticum aestivum
  unsure (1)..(274): unsure at all n locations
  Clone ID: PAT_TA_82851
nancagatcagcntcagcttgcgagcgcgcatgccaggcagctangggtgctntcaganattgaantcggaacaggcagcagcngnntcagatctcacgggcgggcggctttnggngncccgntcatgtgcagtgtgcagccgtcgtggtgcgtggtggtacntgcagttgcacccagatcagctagtgcctggtcctnctnctncagcanttgggactgggggctcaggcactcagctcgngantgcctgtaatngggacngaaggacgccta

SEQ ID NO: 82852 - DNA, 482 bp, Triticum aestivum
  unsure (1)..(482): unsure at all n locations
  Clone ID: PAT_TA_82852
gcgaaccgagggagaggaaggatcggcgcgttccggccggagatgaggggcggatccagaccggccccggtcgtcctgtttctcctcgctgcgtccgggatctgcgcccagttcaccgcagtgctagctggtgatccccaaacatccaacgatgataagaaggctgaagctcagccaaagggccataccggcaaaacagttttgttcgtcctcctaggagtgggggctgtcattctgttgtcatttgttattttcaagtattggcagaagaagaaaaggcaggaacagcatgcacgtctgctaaagctatttgaagaggatgacgacattgaggttgacttggtcttcganattgatgatcttcaattgtacagcaagagtatttggtnacaaggttttgctggcttgcttcanagnantttcatgtnatgtaaagaattngttgtattnaacttgaaagcctcncagaaagtctgtngtac

SEQ ID NO: 82853 - DNA, 230 bp, Triticum aestivum
  unsure (1)..(230): unsure at all n locations
  Clone ID: PAT_TA_82853
cggcggacgacatcgtcgacttcatcaagaagagcaaggagaccgcagccgccgccaccaccaccaccacccaggcgccaccggcatccgagaaggcagccgccgccgagcccgtcaaggacgagctgtgagcatccaaggtgtggacggctgtggctgcgtaacatgggaggaaaacctggcgctaacgtgcctccaacgcctagtttttgcgggaccaganggagaga

SEQ ID NO: 82854 - DNA, 478 bp, Triticum aestivum
  unsure (1)..(478): unsure at all n locations
  Clone ID: PAT_TA_82854
gggantaagtnacaccatggatcaacctttctaataaatcttgcaaactaagtgagtgttgtgatgcatgggttcgtggcgaatcatgaacacttgaggtgttcatgagtgattggtttcaggtgtgacccaggtatggcaccgtttggttatgaggtaaccgtctggtaagtgagtccctgggactcgttncatgaacatttgttttccttcggtagtacttttgcattgttttaatctgatnaatancangatattgtttgtcatcgtgcttatgtttgnttngagcntgcaagtgcattcantgtactaacctggcatgttatgccagttttcaggcaagtcagtcgcaccggagcgcatctcaggtcnaggccgtgttcangttggtgnncctgtgtntngagttcacttcgncggtcttccgctggngcgtnctcgtgtgatnnagggagcgtatggtnattaaatantgaca

SEQ ID NO: 82855 - DNA, 488 bp, Triticum aestivum
  unsure (1)..(488): unsure at all n locations
  Clone ID: PAT_TA_82855
tcccgatacatgatcttgacctgtcgaagtatatcggtcacagatgccaagatgttcctcacaattatcgactgtatgctactagcaaccactatggaagcttgggaggtggtcactatacggcttatgtttatcatgaagggaaaaagggttggtatgatttcgatgaccgtcatgtgggccccataaccgaggacagtataaagacatcggcagcttatgttcttttttaccggcggatacaggaggatagcttagatacnnttacagacatggatctgatattccaaacctgaggangcngtggaggcaatttttgagcccaagtcccggacagtgtatagtttcattggtttanggggacanttgtgcggcaatgcnaacggaagtgagaatagganaggtggggaagagtttntgcggcnangtggttcagagggggagataatttgtcgcggtccttcgttgcagantcnttgttttttcgt

SEQ ID NO: 82856 - DNA, 434 bp, Triticum aestivum
  unsure (1)..(434): unsure at all n locations
  Clone ID: PAT_TA_82856
gctgagcacgccgcccccgccgcctcgtccctgtctcgncgtcgccggctcgttcccgtcctgccatcatcgtctcgtccctgcttctcgatcgtacgccgtgagcaataggagttccgnccggcgctggagctgagcctggagattgtccctactcttgtgagagtcgcgaggacaagtttccncctcttgagatccggngnctaatccatttttcaagataagangtttagaggttctcctaagatagtagctttacctaaagcngctcaaaagnaggnttctcctaaagntgcaaaatcanagaaatgtgnccgtngtgttgagagagctgcatggaatgttgattagagagagcttgttgacttgtggttngacacantatgcctccnantagggtnaaaatgganggngtcangtgnttgnagaaatag

SEQ ID NO: 82857 - DNA, 190 bp, Triticum aestivum
  unsure (1)..(190): unsure at all n locations
  Clone ID: PAT_TA_82857
atgatnttcgncctcgtctactgcancgccngcatctccgangggcanatcaacccngcggtgaccttcgggntgtnccttgngaggaagttgtccctcancagngcggtgttttacatcatcatgcagtgcctnngcgccatctncggcgcgggcgtcgtcaaggggttccagcaggggctgtacatgg

SEQ ID NO: 82858 - DNA, 320 bp, Triticum aestivum
  unsure (1)..(320): unsure at all n locations
  Clone ID: PAT_TA_82858
ctcgtgcnacttgtatggttcctggaaggcttctccaaccccacaccatccatggatgccctgaccatgaggtgctaccgctactcacctagtgtcgccatggttccgatgaggaagacctcgaggacgacgatgacgagagcctccatctccacagatggctgctcgagttctgagcccaagaagaaatcccactctgtcagcttcgctggcaaggccaacaaggtttacgaggacaaggacttgggaatctctggctaaaccgacganaancggtgaacntggttttcccaagggnctaanacgaaggccccaaggtt

SEQ ID NO: 82859 - DNA, 329 bp, Triticum aestivum
  unsure (1)..(329): unsure at all n locations
  Clone ID: PAT_TA_82859
ctcgtgcgcggcaaccaaacgacgaggatcctctgaaccacgaanatgcagttgtccttcgcgacaatccaaagatgtttgaggcaaatgtgagaagagccatggctggaggctacgtcggccaacactatttccaaagatgtgcttgacttgatgtggtggtggcttgaaaacgatcaacagagcccctccccctgtatcagcaccagcgcgcccagctttgtgtgcggaaagtgcttctggaagcaaaatccaaaccgttcatggtgtgacatctgtttgccccgcctttgtgatgtgtggnatagtggtggtgcnnaatgacaggg

SEQ ID NO: 82860 - DNA, 231 bp, Triticum aestivum
  unsure (1)..(231): unsure at all n locations
  Clone ID: PAT_TA_82860
gtgcgatacgttacacaagccaactcctacgtagctcgtctatgaggaatcagcatctgtactcttgtttccagtccattttttttgggtgtaatatttgagcgttatcatggacatagtggcgtgtattgtgtaactgtatattgaggttcgcataccgctcagctcctgtagtaacaattgtttttcgtcgtgcaatgtgcagatgaataattcatgtnctaatgctgc

SEQ ID NO: 82861 - DNA, 531 bp, Triticum aestivum
  unsure (1)..(531): unsure at all n locations
  Clone ID: PAT_TA_82861
ggcgcacaggcggcgccaaccgtccggcgtggctgcagcagtacgaactgattggcaagattggggaggggacctatggcctcgtcttcctcgcgcgccttaagccgccccacccggcacctggccgacgcggcccccctatcgccataaagaagtttaagcagtcaaaggagggggacggagtatcacccaccgcaattagagagatcatgctcctgcgcgagatcaaccacgagaatgtcgtcaagctcgtcaatgtgcacatcaaccacgctgacatgtccctatacctcgcattcgattacgcagagcaacgacctcctatgagattatcaggcatcacagggagaagctgagttcctccattaacccatacactgtcaaattccttgctgtggcaactggctcaaacgggcctcaactatcttcacagtaactggattatacattcnagattctaaaggcttccaacatactgggtcatggggaagaaggatattaaacntggaattttaaangatagccgatttt

SEQ ID NO: 82862 - DNA, 336 bp, Triticum aestivum
  unsure (1)..(336): unsure at all n locations
  Clone ID: PAT_TA_82862
tgaccatgaggatctggaggccaaacatgatggctcgtgacctcttcagtttagatatctatcggcttggcttgcgtgtgggttttctgtatgtaaggttttggtattcgttttttctcttagcatgaattagtgtctcattctgtatattctccgcgtgttaaatatgccagtagtgccttgcctgactgtgcctagagctttcgatggatgctagagcggcattttgggttcttcaggcacataatctggatttgaagaaacagtgagcaagtgtttggaaatctgacgggntctggatgcccantcnaatatccaacaatgtnttaagccctg

SEQ ID NO: 82863 - DNA, 257 bp, Triticum aestivum
  unsure (1)..(257): unsure at all n locations
  Clone ID: PAT_TA_82863
caacgatgtcgacctggtcgccctttcaggggggcacacgttcagccgggtccaatgcaagttcatcacggaccggctctacaacttcagcgggacgaacatgcccgacccgacgctggacgcctcctaccgagccttcctgacacagagatgccccaggaacggcgaccccacagccctgaacgacctggacccgacgaccccggacaccttcgacaacaaactactanaaccaanatcgggntgaacccgggcaa

SEQ ID NO: 82864 - DNA, 525 bp, Triticum aestivum
  unsure (1)..(525): unsure at all n locations
  Clone ID: PAT_TA_82864
agnaaggcgaaaatgatctaccgcnantggtcgctgctctcgtcnacagtcgtcatttgnggcggcgtcgccaccncnggcctcgccgttatcttcctcttgngcggcaaggagaaattcaatggttatctgtgccgcgaaggctataggtttangcagcaggatagngccncgnttggccgaagntangcnttanttctttggnntntcaagggagtaatatcccttngaaatttcacaagattcctgtgtncctaccagancaagtccctatcnatgatggaatccatccttctgcaggctttcactttcctgataatnacagtaacaataaattganaatggtntntgttcttctgcaacctttttggntccctngtttcgcaagggttccgtgctttgttttgaagtctataaaaaaannaaaaggtggggggccccggtacccaatttcgccctatangtgngtggattntcgngcnctcancttgtcgtacgnnttatcaancgtcttgaacngntaaa

SEQ ID NO: 82865 - DNA, 371 bp, Triticum aestivum
  unsure (1)..(371): unsure at all n locations
  Clone ID: PAT_TA_82865
tggcaatggttcttcagctccgcctgatcccgcgcctggctgccgcagccaggttgacgcccgcgacttcctgcgctccccggctgctcctgcggcgcgcgccgttaccaccggccctcgcgatggcgtcggcgtacagcgccggttacgggntgacaggaggctgctattcaggcagctgttcgagaaggagagctccacgtacacctacctcctcgccgacgtcgccgaccccgancagggcccgccgtgctgattgaccctgtcgacagaacagttgacagagatcttaatcttatcaaggaattgggcttaaagctcgtgtttgctatgaatactcatgtacatgctgattcacgntnacctggaac

SEQ ID NO: 82866 - DNA, 422 bp, Triticum aestivum
  unsure (1)..(422): unsure at all n locations
  Clone ID: PAT_TA_82866
gccaggncctcagatccaccacgcccacgcaaacagaacttggcgctgcgccctccgcaatcaccggtgatctcgccccacgcctaggtttctcggccattcgtgcctttagcctataagacctgaccccacaaacccctatgcccattgctcccctttaatctagcaaccacgacgagaaattggaggcttgggcttggactgcggccaggaacatccgccagcactgcacccgtctgcagccactgccgggaggtccgcgccgtcttggtgtgctttgtagtgctgcctgaaggggactcgtggcctggngggggagantnnactcgggggngnccggaatttntnaanggaccnttacctcngccgntngtggaanaantcacacntgnaaacannaagacangtgnncagatncgatt

SEQ ID NO: 82867 - DNA, 219 bp, Triticum aestivum
  unsure (1)..(219): unsure at all n locations
  Clone ID: PAT_TA_82867
cccacaacctttagtccataccactccattgttgaacttatctgaaacatgctagatagaaatgttantccaacaagagatatgttgtcatcaattatcaaaactacctagggancacttntgctttcanctcctcttttctttcttgacgtanggtccaagtctcccgggncttgtttgttgagaaaatcctgttcccgaagtttcatnctgtttgtg

SEQ ID NO: 82868 - DNA, 329 bp, Triticum aestivum
  unsure (1)..(329): unsure at all n locations
  Clone ID: PAT_TA_82868
gcgacgcgcccaacaagaactacttcgaccccaggtacctgctgtccatgtacggcaacgcgtggggggacctcttcaagggcgccttcctgtgggccaaggagggcaaggactaccgcgagggcgccgtctcgctgctctaccgcgccaccggcctgctcgtgcccggcatcgcgtcgcacagccccagggactacgtcaacgccgtccgcctcggcagcgtcgcctcggcgtanttttggattgcatgttcgtttccatgcatgtgtatcattgcatgcaataattggatgaaataaacagcaataagcttcatcaaaaaaaaaaaa

SEQ ID NO: 82869 - DNA, 554 bp, Triticum aestivum
  unsure (1)..(554): unsure at all n locations
  Clone ID: PAT_TA_82869
gtgataacagtcacatgcagctgtgcaccaacccctcctttgcacaagcaagcagatctatgcggactcggagcgatcaaaccaaaccattttaaaaaaactggtggcaaacatattttgctcgtctcccagcccagggaccacggccatgaatgaagtggacggcaccgataattacgccacactgttttgcagccacgacatgccaactgaaaatcgggggatgcaacaggtacttgcacccgatgccgatgggctaaagtgcggacaaagccaccggcaagtgccgcgacaacgatgttgcaggtagactgggacttcgaacggtaaatggatgggtaaaatgttttgagacgttcgggacgggtcggagggataggaccgatgaaatnctgactgggcatcaaccaacctggaaatttttcactaaccggaaaaccgtatttncncggcgcanaagcggnagaatcaactggnagcaganagattccnggatgtcnctgtaactntaccaattgaaaantggggagacgnctcaaatccccngactcccc

SEQ ID NO: 82870 - DNA, 453 bp, Triticum aestivum
  unsure (1)..(453): unsure at all n locations
  Clone ID: PAT_TA_82870
cttccttccttccccgccactgcgcangcgagtacngcgacagnagtnacacactcacactccctcgancgcnctnggccccgtcngcatngcngcaggngaggaggcaatggnggngggngggaatagngcnggcngggacaccagggcggccttngcgnggatctacaagangctcaaggaggagntgctcacnganccggccttcgagttcaccgangantcacgccagtgaatcgaccgcatggttgactanaatgtactcggangcaagtgtancgtnggctctctgtggncgacagctacaagctgctcaanggcgctgatnnctgggngaagaggaaacgttcttgntgcaccctnggntggtgtttgatgcttaagttttttttgtnttgatatatcatggatgactctcaannctcgggnagcttatgttnagggtgctcaggt

SEQ ID NO: 82871 - DNA, 576 bp, Triticum aestivum
  unsure (1)..(576): unsure at all n locations
  Clone ID: PAT_TA_82871
ccatcgcgcaccagcgctgntggaccaccgcccgtctgacgcaaacccagccgtccagaaccgtcgtcgccgccgcagcccgtccntccaccacgctcgcgccgttgcgcgctcttagggttccgcagggtcgggatcgccggagatggactggagcgcggtgacggcggaggacctggtggacgcgctgcgggangtggactggtccacgccgccgcggactgtctcggagttcttctcccggttcaccgtcccacgctcctattccaagtggaccagccgcctcaagtgcaactctactactacaggacaaactatttcatcttgatcatgttcatccttgggatgggttcctttngaagcaagttgtatccttgtgtttnatgactggacttagcancgcatttctcaatgatagttttgcagtcactttcaatagaaagtcacaaggacatagacagttttacacatttagtgcaagatgaggcaccaanacactgttcttcgtgtcaccaactcgagagatcattcattttgtggcacgcncaggtgtttgcaaatctttcncntnactga

SEQ ID NO: 82872 - DNA, 204 bp, Triticum aestivum
  unsure (1)..(204): unsure at all n locations
  Clone ID: PAT_TA_82872
tttttttttttttttttttntttaacaatagcaacggataaagggcacagtatgatttcattgttccatctgcccattttaggtggcacataatcgagttttaaatcgctaagcaagtcctatgatggcaccatagggaaaaactgctcatttgtaaagaaagctataggattatacatatagccaacaaattccggcctcgtc

SEQ ID NO: 82873 - DNA, 374 bp, Triticum aestivum
  Clone ID: PAT_TA_82873
gtctcatcaaggtccccttcaagactgtcggtctctctgagctcaacgaggtctacaagctcatgaaggctggacaaattgtcggtcgctacgtcgtcgacaccagccgataagcgcgcggctgtcgcttgggcagtgcgccaaaaagcaaaagcacgcccccaaaaagataaacagggctacccatcgcgcaaaggggtttaccctctaaagaggagttcaggcgggagttgatttgggttttcaggcgggtgttgtcgaagtagccagatggatgatcttggttacactttgtgtatagccctagtttatgagttttatgatttcccttagcatcaaataacagaacgaacgtttcgatcaaaaaaaaaaaa

SEQ ID NO: 82874 - DNA, 521 bp, Triticum aestivum
  unsure (1)..(521): unsure at all n locations
  Clone ID: PAT_TA_82874
gagctcctgtcagcaggtgaaatctctggagaagagaaaggtgtttcaaatcaaatatggcggctatattggtccagtcatcagcgtttcttcaggcatatgtgcatgtctgcgaaggtccctgctgttgtgaagttggctaaggaggctttggctgagaacaaatgtgtggtgattggtcttcagagtactggagaggctcgaacagaggaagctgtcacaaaatatggtgttgaaatggaagactttgtttctggtccccgggagcttcttctgaagctggtggaagaaaattaccctttacctccaaaacctgatacttttcagcaaggtgaagaaaaagtcacggagatccagcgtaacggncattctgcacaagatgtatcttttaaagggcgagttaggaaagtagcaaaaatggaagatgtgagcgatgatgatagtggtgactattctccatctgtcaatatacttgctgggaacatcgtggcaacttttggaaattngcnaaaaaaaaaaaa

SEQ ID NO: 82875 - DNA, 205 bp, Triticum aestivum
  unsure (1)..(205): unsure at all n locations
  Clone ID: PAT_TA_82875
cacacacatccgnatccctctctcctcggtttcntctnccaccaccaacccccagatcgcagcgatctccgccgccgccctctctgggattccgcgcgacaaagtcaggcgtagaggctccaggaggaggagggaagcgcacagggcggntggggganatgttcctctnggactggttctanngngtgctggnctcnctcggcct

SEQ ID NO: 82876 - DNA, 570 bp, Triticum aestivum
  unsure (1)..(570): unsure at all n locations
  Clone ID: PAT_TA_82876
ctgtcgtccatctctggcccgccgcaagatagccgccacctcacccctagctcctcgcccgcctcgcctcgctaacgacgcccgaagccgcacgccatgaaaccttgctccgcatcggctgtcacgctccaagccaaccacaagcacccccgcctcgcttacgacgcccgaaggcgcccgccatgtcggacaggaagtcgtacacgtgcaccgatgttgtcggcacccacgtctcaaggtcccacccgcccagcaccaacagcaaaaccgtcgggcctctcgctggacgtggcgagatggcagaagagcgggaggtggtcgtcgccacgccctcgcgcactaggaggaccgagcacgggcaacagcgaccacgagctagcagccgggtcgtgcaacccgaggcgaaaggagtagccggcaaccggagtnncgtactgnangtcggggcagagcggntagcgagtccncgactgcgcgagaacgagtagtgcgtgganttgacaggacagganggaacgacttncaaacagcaaacgttactagccaactctgntatttaaagttatatgc

SEQ ID NO: 82877 - DNA, 319 bp, Triticum aestivum
  Clone ID: PAT_TA_82877
cttggatgctgcagccacatcccgcagttcgtcctcatattgatgatatcataattcatgttgataaacttgtcatgaagtactctaattaaccgctacaccaagccgcttctccaccagaaaaaagaatcattattatgtaagtctacacgattcattagcaaaatgtgatatgtatgttccttgatagctattactgtattaaacgagaaaaggacattctgctgtagtcttcaaccattcgtggactcgccattgttcatgagtatgttatctatagatgttttttttgtatgcccgacagtgttaccgggttaat

SEQ ID NO: 82878 - DNA, 162 bp, Triticum aestivum
  unsure (1)..(162): unsure at all n locations
  Clone ID: PAT_TA_82878
ctgcggcnaagctcagcntggccaccagggtcgccgagntgctcaagggggccgncggcgggagccggacgtggagcccgtgtnggtttcggtgtgaatnaacangggcaccgcgngtnngtcactngtgtggtggnttgtgtggctggtggtgtccgtngt

SEQ ID NO: 82879 - DNA, 376 bp, Triticum aestivum
  Clone ID: PAT_TA_82879
ttatgttgggcagggattgcttggagaaatgaatcttttcacaaggccgcacgaaagaccaggattgcaagtaagcaggcatccaataagttcttcgaccaatgaaacgttcacttttatagtgtttagtgttataaggtcaacaactgagtcatcactagcaagaatatacatcgacctcgcaaccaaagcggcggctgcagctattgacgaggaattgatgtttacagagttatccagatagctatgataaaatctattggagaagtgggaatcaaaatcctccaacacaactccagaagttgacatgttcttccttatgaatgacattaatgaagatggtggaacaccaggatttgatgaagctgcttgtttt

SEQ ID NO: 82880 - DNA, 506 bp, Triticum aestivum
  unsure (1)..(506): unsure at all n locations
  Clone ID: PAT_TA_82880
gaagaatggttcatctccttgtactgtcaaagttgttgcacctagtggactgcatggttcgccgagtgacgatgaagccggcggcccatctcccttgctagatagatggaggtacggtgggggttgcgactgtggcggatgggacatggcttgccccatcgacgttattggcaacacatatgataatagctgggctgagtctatagctaccaatgtgaaacatcccatggagctctttgttcagggtagcaaagaagagctccccgtcctttctatgaaggagaacgggagagggcagtttgtggtggatttccatgggcgactatcagcgttacaggcgttttcagtatgcatctctctgctgcactgttctgaagcttcgattcgccatcagcctcaagaaggggaagcagaagctntattccagctcnatcaagttcctcctcgaggggggggccngtaaccaattccccctatagtgnttntattaccccncccccccctgg

SEQ ID NO: 82881 - DNA, 515 bp, Triticum aestivum
  Clone ID: PAT_TA_82881
acataatcaatgttagtgcccgcctaaaggggaagtactatggggtaaacatttatccaaatgcaaattagagccgacctgaatgttgttgctttagacttcagagttgcaatattgtttacatccttgacatagataaatgattataaatgcagagcccacctgaatgttgttgcttttgacttcagagttgctttattttttacataatcaatcttcaggatttagccagacttatcgagccttaatcatcatccaaccatttagccatcattccttatagcgttataatctactgcaatttgatctagatgtagagaagatgctagtagtaactctcacaagttaactagaacaattgatagcaaattgatagcaacagtagatcagaaattgcttctactctaggtgaggttcaaaaattaaccaaagattcagttaacctttgtcaacattcagttagctgatgaactttggacattgagggacacattcagctaacttctgtggctaac

SEQ ID NO: 82882 - DNA, 270 bp, Triticum aestivum
  Clone ID: PAT_TA_82882
cccccgtgagatcgagcggaggataatgtcgtcggggatattgctggtgctcatggtcagcatgttcctcatcgtgcgcgacacgctcaatctagacttcatcaaacagaatatgtagattctttttcgtccgagagaacattttgcagtaaatctgttcctgtttgtaagacgaagccatgcatgtatgtatgtatctcttgcacaaattcttacaaaaagcaacggagatagtagaaccgatttgcagccatgtaaaaaaaggggggg

SEQ ID NO: 82883 - DNA, 342 bp, Triticum aestivum
  unsure (1)..(342): unsure at all n locations
  Clone ID: PAT_TA_82883
gcctggtgcccgtctccaacacggataacttcgccggccacggccacggccacggcaacggcgccgacctctggtccgtggtggcggggacagggatggggacggcgaaggcggccgtggacaacgagggggctgccggcggaacntgctgcctggtggtggtggtggtgctggtcaccctcgctttacggattatgcgagggtttagggctttcagtaggctggctaatcagtccccgccgtactccgccaccttttgttgaagtaaacttttggggctgctttaattttggtgggaaacaagggcgcagggatccatatttcctctccaaaaaaaaaaaa

SEQ ID NO: 82884 - DNA, 337 bp, Triticum aestivum
  unsure (1)..(337): unsure at all n locations
  Clone ID: PAT_TA_82884
caacaagctcatgctggagtncgccagcggggtatacggggagctagactaggaaggaactgccgtgccaggccacagatgatncgatgcgactagggctgttgtattcttttgtacgtagtatatttgtagttttcgcccccctcacaaaaaaaaaggagggaaatctgtttggttggccaaaatgtgccatacgctcgctgtacatggccaaacacgccacgtgtgttgttgatacagcccctgccagcagcaggggtgggtggggatngggagagcatttcagtgatcgggttncaacgaaatacaatatcatatctaggttcgtgagttaaan

SEQ ID NO: 82885 - DNA, 447 bp, Triticum aestivum
  unsure (1)..(447): unsure at all n locations
  Clone ID: PAT_TA_82885
ctttgtcccgcacagccgtcgccgccgtgaggtccgcagcccgctcagcaccccttaccggccgcgtcccaggtgcgccactgccttcccttgcctcgtcttccgctgcccggtccgcccggatcctccgcaggtcggcggccgcgtcgtcgtcggggctggagacgctcatgccgctgcacagcgcggtggcggccgcgcggcttaggtcctgcatcgccgttgacttctcctgctggagctcgctctcacaaggatacgctttgcctttgtgacagagagaagaaaccaatgaacattaggaatcactatcaagggctgtaataatgtgattcttgtaaactaattttgctttatagttcattggattttgtaacctggaccattcgaagatgtgcaactggcattcgttatgntggatttattttggatcanaaaaaaaaaaaa

SEQ ID NO: 82886 - DNA, 613 bp, Triticum aestivum
  unsure (1)..(613): unsure at all n locations
  Clone ID: PAT_TA_82886
tttttttttttttggaacaaggacagccaaaggcgtcctcgcaaatcgttgttactaatctctcaaacattttgcaagcacagtccgacacgcttgagaaggaccaagtcaaagcaacccagacgatagaattgattatttatcttatttatcggagcacaagcaactcctccgctccgcacaaattagcagtgacaagcgtggtcagcaatgtctcgaagcaaaccaaccgaagacgaacaaatcgaactgcacaccgcggggattgattattgataaaatcaagggaatgcagacgttggatctctacttgggcgcgaagttggccttgatgtggtccacctcgccgctgctgatgcggaaggccttggcgaggatgtcggagggacgggcggcacggcgccgaagacgtcatggcgatggctgcgtgcctgagctggctgttgaagcggcacacgcgcgggcgtgcccctgtttgtgaagtgacaagcncgcggaagacaaacgtgccttgtacgtttgtgaaaaccttgcgtgtataaccactcagcgtgcctgagncnaatattggtgcccggtctntcgcggtctgnccgcgctatntcccncatga

SEQ ID NO: 82887 - DNA, 305 bp, Triticum aestivum
  Clone ID: PAT_TA_82887
caccgctctggtgggctgagcttgagattatgacttctgagagctgagttcggcgcatgccagatgatattgtttctcctagtgtgactgagaattctttgagctactactggctgctgctaatcttgtttgtggaagtggtgattaggtagaatttgttatgtgtgcagaattgcatatagggattggtattgtacttgtacatgtcaagaaggtttaacacacaacatactgatacgcaggcattccagccaggtgagcaatagaaagcatgtgtggcttgtttttgctgcaaaaaaaaaaaa

SEQ ID NO: 82888 - DNA, 398 bp, Triticum aestivum
  unsure (1)..(398): unsure at all n locations
  Clone ID: PAT_TA_82888
tttttttttttttttttagatgtgcaaactgtaagattcatgtnaatgtagcccttgggaagctatgatgatggaacaaggaagaccnaaggagtganaaaaggggagaaagaataaaacctagattcatgttnccagataagaatgattggcgttgcgtttgcgcatcanaaaaacccgctcgttacattacatacatcaacctgtcttgacngtggttcttcatatnaggcnatcagcancatattagccaggcnatatactccatctancacatctgcncacaatgatgancggcaangggggagaggacgagtggacgacccacactagtaatangtacatccagcactngtaaagaccganncctantcgncgcagcatggccacccggagag

SEQ ID NO: 82889 - DNA, 356 bp, Triticum aestivum
  unsure (1)..(356): unsure at all n locations
  Clone ID: PAT_TA_82889
cctccgggcagcggcgcgtgcgtccccccatcccccccattcgacgagagagagtttgccccccacccattcgacgagatctcggaggcagcctcgaggtgaccctgttctgattctcgtggtttcaggggaggatctaggtccagggagattaatctcgaggttggacctcacatttttatggcctttgactgcaacaaggaaagaggagtttcttcgcctgacagttgctcccgcatttgcaccgagggcactctcgtccaggcaaatcccttatctcactactggaagcctaaacgtttggagaattcaacaagttggagaaccagaagtccagttatgaatctntccgagtg

SEQ ID NO: 82890 - DNA, 346 bp, Triticum aestivum
  unsure (1)..(346): unsure at all n locations
  Clone ID: PAT_TA_82890
gggaagaatacgccgtccggcacctcggcaacaagcggcccctccgtcacatgcacgcccgccgttggcggtgcctcgacattagccgagctcgacgccatcacggtaactaagcctctcggccaatgaattcatctccttgcctttgactgggcatccctgacgccctacaagatttcacagggcgccgccgaggttccatgcactctcctgcacttcgtggacggtgagttgatcgatgttgccaaggccagaatcgttcaaccgggcaaccacctgtttcatggtaatccgatgccacccaccatgtatagggttcaactagttgggtntacggggctgcgac

SEQ ID NO: 82891 - DNA, 251 bp, Triticum aestivum
  Clone ID: PAT_TA_82891
gtctaagagctgcttacgtattccccacttggtgtgtcactgtgtggatttcgatgcgctaatgcgctatcacttggggtgtgtgttggatgctgattacactgtggctcagctagtgagcttaggatgtgattagttttccctttcggtttggaccgagctgcgttgatctttagcttgatgcggttgctggcgcattgtaggcctggacattcggtcatctaaggtttgcgagcttggactgttgaaac

SEQ ID NO: 82892 - DNA, 344 bp, Triticum aestivum
  unsure (1)..(344): unsure at all n locations
  Clone ID: PAT_TA_82892
caacggcggcgcgagggcgagagcttcgcggcgcgggacatggnagacgtgctgatgcagctcgccgatgaccccacctccgaggtccagatcggccgggtaggtgtcaaggcgttcacccaggacctcatagtcggtggcacggaacccgtgtcagccaccgtggagtgggccatgtcagagctcctgaggaagccgtccgtcctcgccatggccgccgangagctggaccgggaagtcggccgccggcgctgggtcacgganaaggacgtggcacatctcccctgcctccaggccatcgtcaaggaaaccatgcgcgtgaccacatcgcgctctctaccccc

SEQ ID NO: 82893 - DNA, 356 bp, Triticum aestivum
  unsure (1)..(356): unsure at all n locations
  Clone ID: PAT_TA_82893
cacggacaaagggctgggcgtgcgctcgaagaggnncgntctcctggccgangacctcacggncancgtcgcaancancgaggaaggcgggcagntcacgatctccggcgctgaggagatcctgaaggcgctttagaagctccgtctcctctagaagccgcagcaacgatcggnctatagtttgaactcgcctttgaataacttgtcgtngggcaaggtctagttcggtgttgtgtatggaacggtcgtcactgngtcatgcacganttggnatccgtgttgtttatgttcaccggtttgaggaactctctgatccgccgtgacacaaagttgatcctgagagaacaaaaaaanaa

SEQ ID NO: 82894 - DNA, 358 bp, Triticum aestivum
  unsure (1)..(358): unsure at all n locations
  Clone ID: PAT_TA_82894
acganggaatgagaggtattgcattttgttctcgtcttttatctnacattctagcaactgccctgctgctgcatgaagggttgggtctaactcccttttttttcaggtatgttgatgctgtcatgncaatccccaagggnaccttgttccccatgtgtggcatgaaccttgccttcgacagggatctcattggccctgctatgtactttggtctcatgggtgatgccagcccatcggtcgctacgacnacatgtgggcaggatggtgtgtgaaggtgtgtggttttctgntcntgcttctacagctggttactttgtncccgaaacataatgtacattggcctgatgatcatcttaca

SEQ ID NO: 82895 - DNA, 413 bp, Triticum aestivum
  unsure (1)..(413): unsure at all n locations
  Clone ID: PAT_TA_82895
gagaactagtcttcagtttnnnttgttttttntnatnccaaccttgtaatcaggccataataacataaacagagggtccttcgatacacaatgtcacttnctcatggttcanngntaaaggggaaaaaagcangaagcatgatcgtctattctcgtaggannattagcntgnctctactaccactancaggatccttngcttgcagcanctgaaacctgaanagaacctcctcttccgctttatttctttanactggctggctggcagnctgncatacncacgnnacgtacgtgctagccggcnngtagtncgcctccnctggagncatcgccgtcgtcgtcngcgcatcctgcaccaaatccccccntcgtccttnnanggggccgaagggatttggtanngntagggtata

SEQ ID NO: 82896 - DNA, 341 bp, Triticum aestivum
  Clone ID: PAT_TA_82896
aagcatagcatgctccggccgaggaatgttttgaagtttgtcaaggattctagtattttcagacctggatattacatcggcatcgatccacgtgctaaactggtcatccttgggattcgtggaacccatacggtttatgaccttgtcaccgatttggttgcattgagcgataagaaggtgtcacctaaaggtttctcaacacactttggaacatacgaggccgctcgatggtacctacgccatgagttgagcatcatcagaaaatgtttggaaaaacacaaggactacaagttgcggttggtgggccactcccttggaggagcttcagctgccttgttgcc

SEQ ID NO: 82897 - DNA, 237 bp, Triticum aestivum
  unsure (1)..(237): unsure at all n locations
  Clone ID: PAT_TA_82897
gtccgatctcctcttcctcgccggcggggctcgcctctgagtcgttcctgtctctnacattcttcctttcctagnaattagtnanttctgctaagccccccggacccngacgagttctcaccacgagagtaactgnccgancnaccggcatngagatgaagntgaccatcaggagggtgcccancgtcgtctncaactaccaggaggacgncgacaagcagcgcgcgggntgaggga

SEQ ID NO: 82898 - DNA, 323 bp, Triticum aestivum
  unsure (1)..(323): unsure at all n locations
  Clone ID: PAT_TA_82898
cttcactagcctctgctcctctgaaatngcggcggcgacttcctcttccacctacatcgccatcggncgnaaaancctaaannccgccccctccgnagcnacagccgcnacctccgtctccttcnccgcnacgcagcacccatgcctngtngccgcctccgcggactgccgccgcgncgtggntccgaaggtctcgtcgcngtcggtcatcggcaccgccatgccgtcgctcgacttcnagacctccgtcttcaagaaggaaaaggtgtccctggacggccatgnngagtatattgtgagnggtnggacggatcncttccgtg

SEQ ID NO: 82899 - DNA, 373 bp, Triticum aestivum
  unsure (1)..(373): unsure at all n locations
  Clone ID: PAT_TA_82899
caaagttcacagctccaatcctggtgcaagcgcacagtagcggagcaagatgcggggaggagaccggccatcggcgtcgctccagctcctctcgctgggcctcgtgctcctctacttcttcacctcaggcagcaccgttggtctcgtggagggacagaagacgtggtgcatcgcgaancgtcggcgtcgaacgagatcctngcgcagaacctggactacgcgtgctcccaggtgagctgcgccgtgatccanaagggcgggncgtctactacccggacagncccgtgtcccgcgncgccgtcgccatgaacctctactacgcctacagcggcaggaaccctggaantgtactcaacaactcngnggtcgtcgt

SEQ ID NO: 82900 - DNA, 523 bp, Triticum aestivum
  unsure (1)..(523): unsure at all n locations
  Clone ID: PAT_TA_82900
gttcagcagaaatttcaatagttcatgacatccgactctttgcaggacttcgttatctgttgataactggttgtctggacaagcaactacaatgcttgcacacaaaaggtacagcagataaattcttcagccgcaatcatgaaactctggcaagggatttgctaagggtaacatacatctgcaacacagttcaaattacccaaattttgcactcttttgccatcttttcaaaacacaactactcggtagctcattcagttttgagcttctcagcactaggttaatatggcggcacgagattcctaccgactcaaatagcttgcagganagtggccgtcatggtgactgcgtcccaacgcacctccctaactttgtcggagtcgtcaccaccgatgggcacagttttcacccctggttgtgccatgtctcgacaacgcatggtctcagcagcgaaatctctncttggaccttcaacactcatggggaanctanacttcatgntctcaatcccatgggttanaat

SEQ ID NO: 82901 - DNA, 389 bp, Triticum aestivum
  unsure (1)..(389): unsure at all n locations
  Clone ID: PAT_TA_82901
cgcaacctcaatcagatgattagtccacagatctcccccaagtacccatcagacccaaacagtcatcacagtacgaaacggatcgcgaagaagcacgcagcaggcgggcgggtgataaggtatgggtacgtaggtaggtagcgcacgcacctccgttgagccagagcacgaggggcttggaccccgggtccttctcggcctcaaagaaccagtagaagagcgcannncgcgctgctcgctgacggtcacgtacccggcgtactgcgcgaantggtgttgaaggcctgccccggcacccgcggcacccggtcccgngcctgntcntcccgnactcccgtcccnggcggcggcggacgccacgangacggcgacggccagtaggagggggg

SEQ ID NO: 82902 - DNA, 407 bp, Triticum aestivum
  unsure (1)..(407): unsure at all n locations
  Clone ID: PAT_TA_82902
cagaacctggttgcatgggcaaggccttacctaaatgatcggcgaaggctctatcagcttgtagatcctcgcttggggctgaactactctgtcaaaggggtgcaaaaggtcgctcagatctgccactactgccttacccgtgacagtaagtctcgcccatcgatggatgaagttgtcaagcaactcacaccattacaagatctaaacgacatggcatctgcttcgccaaggcctcgctcaactcagcgcggaaaggtgcatcgatgacaacccggttctgttgtaagaagancagtgtggtcctggttgcttnatgcttgtttggtttaattgtatagcaaaattaggngttccctnccganacctggagatgtaaaaccgcctnangtntccgctcaggtnagtaa

SEQ ID NO: 82903 - DNA, 353 bp, Triticum aestivum
  unsure (1)..(353): unsure at all n locations
  Clone ID: PAT_TA_82903
ggatcaagaagcctcgtggcctaggccagtgtcccacattgcacatggtgggtgcgcaggcttaccatctccccaagtgggagagtggacgtcataatttgtggtagaggggatacgcgttcgcgcggcccctgccaaatcttataaatttcatataagtccccttcagataagggcttgaaatgttatctttatttcgccacattttataaattataatttaatttttctctttctaagaatgtaaatcgtaagtaatcctggattgcatttaantttcccaagnggncggtcccngnagttttaaagtttanctttgtganagangganaagtntttngaaaaaaaaaaaa

SEQ ID NO: 82904 - DNA, 178 bp, Triticum aestivum
  unsure (1)..(178): unsure at all n locations
  Clone ID: PAT_TA_82904
gtttactgccgtgcaatnctttgagaaatgtgtngttgtgaagnagaagactcctanaataagctccgcgttaatgannagtaanaatacgntccttgtaacttgtggtctgtttgccaataataatgtacgaactgtagtgcctatcttgaaaatatgangagcnataatgggtatg

SEQ ID NO: 82905 - DNA, 462 bp, Triticum aestivum
  unsure (1)..(462): unsure at all n locations
  Clone ID: PAT_TA_82905
gcggttagccctgtggcagggggcagcaggacaccaagtggaagcgcaaccgccccaactaccagcaaagagcggttgagtatcgccaatattatataaagagtttggtggggaattatgaaagcgatttttaatgtttattttatgagccttgttttccttgtctagtgctggaagctggctcacctgcaaaagttggaggaacgaggcgcatataaacagcctggttttggtgcattctgtttttgacatggcgtcctgatattttgttgcgtatagcngcttccaggtaatatagnatagtactgcttggggagaatctgcacgaagataccacgcgtgcatgagatnagtatagggtattncatancacagaggcgcatcccgcgttgttggganatgnccctagngctgtntactttcngaacgtanatggancacgattaccgnttngtgtaccaa

SEQ ID NO: 82906 - DNA, 341 bp, Triticum aestivum
  unsure (1)..(341): unsure at all n locations
  Clone ID: PAT_TA_82906
gttttttttttttttttttaattaacacggcacacatatagcattacattcttattcagngatactcacacacacaacacaccagacaactgaaaatacgacacggactcacacggtcanaatacaacgccaggntcactcactgacacttgaacacacacgctcacacattcactctgaactggtcattattctagctgnaaatcancacggagatggancacacagtcacacacacacacanagacatgaccgctaangatcaggaggccagtaagtaacgatcgttgncccctcctccaaacacatngaatngtttagatggacngagggagncctgg

SEQ ID NO: 82907 - DNA, 151 bp, Triticum aestivum
  unsure (1)..(151): unsure at all n locations
  Clone ID: PAT_TA_82907
gtgangtgccctactccnagttcggcagcgtcgtgcagatcttccacaacgtcacccgngtcgtccntncctcggcgctnaancnggctcaaggacgccganctnngggggcttcatcnancnctgcatcggcnagccccgggaaccggcc

SEQ ID NO: 82908 - DNA, 326 bp, Triticum aestivum
  unsure (1)..(326): unsure at all n locations
  Clone ID: PAT_TA_82908
cactcgtagagagaaggaaaaatatccccaaaccctagctcccgatctcgntggcgaaccctcgcgncttcttcgacatgaccgtcggcggcgccccggcgggccggatcgtgatggagctgtacgccaacgangtgcccaagaccgcggagaacttcngcgcgctgtgcacgggcnagaagggcgtgggcaagtccgggaagncgctccantanaaggggtccacnttccnaccggcgtnatccccnagttcatgttccagngccggcgaattcagccgnngcaangcaccgggtgngagttcatntncggcganagttccccca

SEQ ID NO: 82909 - DNA, 205 bp, Triticum aestivum
  unsure (1)..(205): unsure at all n locations
  Clone ID: PAT_TA_82909
ngncggccacacgcacactgccacacggagctagctagctgatcgatcctcctcncggcngcncgcncgttaattaggtagncganagtatctatccagctaggtancnagccagcgaggagccgccgttgcttcctagctgcagntccgcncggtcggccgangaagacgncgacgatgaaggngtcggtgctggcgctgtggt

SEQ ID NO: 82910 - DNA, 591 bp, Triticum aestivum
  unsure (1)..(591): unsure at all n locations
  Clone ID: PAT_TA_82910
gtttattgcttctcatgggttgtaatttttgtgattttgctcgttatgaagaccgtatcagtgggcaggagaaggttcagtgcagagttccagctagtgttccggttgatcaagggtctgatatttataacatttacagccatcgtggtaatcctaatagcgatccctggcatgacggtgctggacatatttgtttgcatccttgctttcatgcccactggatggggtttgctgctgattgcccaagcgatccggcctgtgatccacaagactgggctctggggctcgatcaaggctcttgcccggggctacgagatcctgatgggacttctcctgttcacgcccatcgcttcctcgcctggttcccgttcgtgtcggaattcagacaagatgctgttcaacaaggcgttagagaggtctgagatctccgatctgggagacacagaaanncgaggaccggaanaagatanggctggtgctgctgatcaaggttttgcgcacagnttatgtgtatggtggagatatgctcaagggggccgtaccaattgcctaagtagtcgataccggcnattgcgtctttaangcgtatng

SEQ ID NO: 82911 - DNA, 234 bp, Triticum aestivum
  unsure (1)..(234): unsure at all n locations
  Clone ID: PAT_TA_82911
ccgccgctccggcttggnatngcacccgccgtggtgcagnggccgcaaccccgcagcgtcccggagnaaagcttccgcngcggctccgcgcgctgccgccggagctgagcganatcctctcgcccaanctggtgnccggctngcccgcngatacnggngacgtctcctcgctcatcccgatcagtgcngtcatgctgntcttcnacttcgtgtccaactnggngttcccggcgg

SEQ ID NO: 82912 - DNA, 522 bp, Triticum aestivum
  unsure (1)..(522): unsure at all n locations
  Clone ID: PAT_TA_82912
gtcgtcttgccgccgatcctttttccgaaacctagctcgcccgcccgacctccgaccttctagaaccttgcctccgaggtgccgccctccccgccccgcctgcgccgcttgctcatcgcttctctccccgcggcggcctcccagatccggttggatcgaggggcaaggtcaagagatggggcaggcnttccgaaagctgtttgatgccttcttcggcaacaaggagatgcgggtggtgatgcttgggttggatgcagctgggaaaaccacnatactctanaannttcacatnggtnaagttctctccactgtccctaccataggtttcaatgttgagaaggttcaatacaagaatgtagtgttcaccgtgtgggatgttggtggcaggagaagtcaggcccctgtggaggcactacttaacaacactgatgtctanttacgtggttgattcactgatagagaaaaatcggaanncagggggantnaggcataataatgncctttangctaaagngtgtatgg

SEQ ID NO: 82913 - DNA, 154 bp, Triticum aestivum
  unsure (1)..(154): unsure at all n locations
  Clone ID: PAT_TA_82913
ccaacctccatnccttcctcctttgccaatgnagctctgatctctcctacctgagaatgtcagtgtgagtngcnattccatntgcanaacatcctnctncacgcangnanaacatacaaaaangnagaagcngagtagatgaaggnaatggccg

SEQ ID NO: 82914 - DNA, 544 bp, Triticum aestivum
  unsure (1)..(544): unsure at all n locations
  Clone ID: PAT_TA_82914
cttcaggcagccgctccaggagaagcagaagcacagcaacatgatcgacggcaagcacttccagctccaagggtacgggaacgaccgggtggcgtcggaggaccaggtcctggacnggngcgaccgcctttacctcttggtggagcctcaggaggacaggagccttgacctatggcccgcatgtctaagggacgttctgcacgatttcaccacagagtgcacgagagtgaaggactgcctgcttcgagaaatggcgaacgcgctagatgagctcggcgacgacgacgactacttcatcgaccagttcggcgacagggccgacacccatnccaggntanctactaccctccgtgcgacggcggacctcgtntcggctgaggctcatccgacggcacttccttcgttctatgcnagacgaagcgtngcgggcttaggntttccggacgagctngtacactgcgcacagaactanacctntgtaatcngggacaatcnntatagatggattnaagagccntgcancggnttanaaccgaangcagta

SEQ ID NO: 82915 - DNA, 163 bp, Triticum aestivum
  unsure (1)..(163): unsure at all n locations
  Clone ID: PAT_TA_82915
tttttttattccagatgtcaatatatgcttcacgtcaaaattacatgggatatatcagtcgcagtatatatagagagagcgagatctagcaaagtcgcaaccaaaaccaactgtatcttaggctccacgaaatatatataanctaaaaaanaaaaaaaaaaaa

SEQ ID NO: 82916 - DNA, 417 bp, Triticum aestivum
  unsure (1)..(417): unsure at all n locations
  Clone ID: PAT_TA_82916
ccaacttccggcgagccttcgagcacttcngcgtgcacgccggcgggcgggcggtgctggaggaggtgcagcgcacctgagcctggaggacaaggacatggagccgancaggtncgcgctgcaccggntcggcaacaccagcagcagctcgntgnggnacgagntgggcctacgtcgaggncaagggngggngaagcncggcaaccncntgtggcagatcggnttcgggtncgggttcaantccaagngcgcggngtgggcgcgctccangacgtnncggccgngtcgcccccngggncggaggagaaggcctgcaacccgtgggggantncntcgcaagtagncgccaaggcctacgtctgacgatacnttactangcgccgcggatgactcnacacgaagatanatnttgttctc

SEQ ID NO: 82917 - DNA, 548 bp, Triticum aestivum
  unsure (1)..(548): unsure at all n locations
  Clone ID: PAT_TA_82917
tcgagtttttttttttttttttttttaaccaagttcagtttcattccgttccaaacaaagaggcaacagttctaaaaattctgactagctatttcaatttatttcagttccacggtgtattgtacatggttcatcgcgcgcaaccagaaacattcccttggtggtgactggtgaggacgaccgcgcgcgttgggagggcgcaggctcagtgcttgcttattccaggagctaccgctacggacatggcgccatctatagagcagagtggaacagaatctccgccagttcctgtttgccggacggaacagtgggctcaccccactcaaggaccttcttcttagcgcctcaaagtctcctttcccagcctcgatcaaggancaatctcactatcaaagtctgtaccgttgcgacgagacatctaggaaccatctgntcacttgnggcttgggagcanggcaggntcatncgaganataggnagaacaagtctaantagtgcttccctcgcatttggnaagtgagcncaggtgaagtcacattctacanagn

SEQ ID NO: 82918 - DNA, 540 bp, Triticum aestivum
  unsure (1)..(540): unsure at all n locations
  Clone ID: PAT_TA_82918
attcctcctcagaagctgctcgagtacatgctgcttcagtacccaaanacaatggcgaattcctcgcgagagctaccaaaaaagagaacccctcgcaaatcgaccgcagcagtctggttctcaggctctccagtgcgctaagcaggggggaaactaaacctctcaagcacgaatgttctgcaatggtttcatcactacctcatggactctagggggttccaaaattattcacggctgaatcggttcagtagctgcaggaagatagccttggagatgtactagaagttgggggggatcaagcgatcacgcgccttggggttaacaatgtgagggtgtcaggtgcttcaagcttnagacgtcgaacantccatgatctctggtcagtgattcgngtttgagcggcaancgatngnactcgtcgagatgaagacangnncatttgagcttctaagcacccgacaacaacagttcgtgcntgctctttacatgataagagangtggttcttggntagaactttgaggctcctatttgtatcgga

SEQ ID NO: 82919 - DNA, 384 bp, Triticum aestivum
  unsure (1)..(384): unsure at all n locations
  Clone ID: PAT_TA_82919
cgaaggcgagcaattcggggccaaggtgaaggagctagccaaagtgtttggagacgacgaggtgaatgatcaatgngtgagagantttctcagtcacctgtcggagcacagcaaaaagaaccaaggatagggctgaaactttcaaattncatcaactatctttcagtgaagtgaagcatgctacatgcgatttccaaaaccgatcgccattacaaatttncaaccccataaaccgtgctactcctttgatagganaattgaacaagggggtgtgtantgcgtacaannacaaggtcaaaattagcggggncccttccaggccnaaatttccacntcgcnggaaggngcnctagganngtggcgaaggatanttngccagggcat

SEQ ID NO: 82920 - DNA, 196 bp, Triticum aestivum
  unsure (1)..(196): unsure at all n locations
  Clone ID: PAT_TA_82920
caccttgacttttagtcaatttcactcgttacagcacatctaccaactatacaacttccgagttaccttaatttaatcccaaccccaaaccaaccgacaaaatgaagttcgctactgctctcgctttcgctgctggcgtcgctgcccacgccaagaacgtcacntacaccacggnggtcgtnactgcntanaccag

SEQ ID NO: 82921 - DNA, 300 bp, Triticum aestivum
  unsure (1)..(300): unsure at all n locations
  Clone ID: PAT_TA_82921
acatgttggactgagctgntcagagcaattacttgcgaactgaaaacactggagtgtagcctgtgctcagctgccacaagatagcctgaagcaaactgctgtacaataagcaagtgattgttctgccatcaacggtggcatatcactgtacaaatgagcaccattgactaacgcacataagtcgccttgtctgaaactggtcattttctttgaaattcaccctccagtncangtgntttggnggcagacgtcgtggcatggtatatggtnctganaacattctntgggtggaaangggtt

SEQ ID NO: 82922 - DNA, 165 bp, Triticum aestivum
  unsure (1)..(165): unsure at all n locations
  Clone ID: PAT_TA_82922
gccgccgccgccgccgccgccgcagccgcaacaatgccgtcgcacaagaccttccggatcaagaagangctggcnaagaagatgcgccanaacngccccatcccctactggatccgcatgcgcactgacaataccatcaggnanaacgccnagcgcaggcactgg

SEQ ID NO: 82923 - DNA, 226 bp, Triticum aestivum
  Clone ID: PAT_TA_82923
cgccactacctcaacgacgaggacgcggacgactggttcgccgacttctgaaatctcaagggccgcggcgattcttgccatggcggaggcagcactgtaaataatttgtgaaatgtgactctctgcttctctcccttttttgtggagcagagattgtaatttgaacattcttattttcattgtgaatataagaaaacatagcaggaattaacctaaaaaaaaaaaa

SEQ ID NO: 82924 - DNA, 393 bp, Triticum aestivum
  unsure (1)..(393): unsure at all n locations
  Clone ID: PAT_TA_82924
ctgttgcgacggaggaaaagctaagtgtgcattcaatcacgcttgtgccgccgtcgtgtgtggtgaggaggcgttggcatcccccagtaagggcttgccttgtgacgcctgtgggtttgtttggattgaagagttgctgaagacgatgccaaatatgcaaacatctcatgatgcctgtgggtttctttggttcaaaaattgtcctatgacgctttcttttaaagtagtcaactggatgctacacttgtatatttagaggtgaaagccgcagatctgatttcaatatacngcaataggacatccttcgganattttgcgcttggnatctccananacccnagggaanaagggggccgnnaaaaaaagatcccccaggaaaaggncattagggac

SEQ ID NO: 82925 - DNA, 341 bp, Triticum aestivum
  unsure (1)..(341): unsure at all n locations
  Clone ID: PAT_TA_82925
caaaatcctactgtgaaaacgccctaaaaatctaccaaaagcctattccagggacttctctggaagaaatcgccactggtctaactgacgtctcagccatatatgagacgatgaatgagcacgagcaagcgctcaagctacttcagaaggccttaaaaatgtacaacaactctgccggccagcagagcacgattgctggcattgaggctcagatgggcgtgctgcactacattttgggcaactatggngggtcctangactccttcangagcgcaatgcaaagtcngcacttgtggcgagaagaaggtctgcttcttcgggatgccctgancnaaatgggg

SEQ ID NO: 82926 - DNA, 387 bp, Triticum aestivum
  unsure (1)..(387): unsure at all n locations
  Clone ID: PAT_TA_82926
cgtccccggacctcctcctccccgccgacgccgccaagatgcgccgctactccgcgctgcccaacggcggccgccaggagacgctggccgaccgcgcgcaccgctaccggggcgtcgtgctcgtcatcctcgccccgctcgcgctcgtctctctcgtcctcctcctcatgccacgctcacccgctggcaccatgggcggcgcccggaggtccgggccggccggggaagacaggtacgccgtcatcttcgacgccggtagctccggcagccgcgtccacgtcttcngnttcgangccaacctggatctcgtccgnattggcagcnagatcgagntcttcgtcanataaaaccgggggtttancaantatgnaaagacccngggaggtt

SEQ ID NO: 82927 - DNA, 349 bp, Triticum aestivum
  unsure (1)..(349): unsure at all n locations
  Clone ID: PAT_TA_82927
gtccccaggctcgacaccatcctcacgtccatccccaccgacgtcgtcctgcggaagcagcgcctcctcgccaacccgtccatgaagcaggccatgctgttcccgcagcccgcccaggcgggagangcgttccaccagancctcaacggcctcgcccgcaagcnaccgcacggngacggcgtcttccttaagcccggggacgagagggtcctcaactggaccgctggancgcncggngacctcaagcattggtaacatcgtacgttcgtncgcctataagtaacgtggctgnatgnatataaaatggnngaaaanaagncanttaagtgtncnatttntatggnanatc

SEQ ID NO: 82928 - DNA, 196 bp, Triticum aestivum
  unsure (1)..(196): unsure at all n locations
  Clone ID: PAT_TA_82928
caccaacgggctggaatttaacgacaagctccgccccggtngcccattcaanccgcncggnctcgccgccnaccccnaccagncggcgctgctcaaagtgaaggaagtcaagaacgggcggctggccatgttctccatgctgggcttcttcatccaggcctacntcaccggcngnggcnccttcnagnncctgtgc

SEQ ID NO: 82929 - DNA, 362 bp, Triticum aestivum
  unsure (1)..(362): unsure at all n locations
  Clone ID: PAT_TA_82929
cttctatagagttactgnaagacatgcgaaagaaaacagcacaatcgtgggtacagttgtactccttgaattatttttgcttgtntttntcatctgcatggaaatgtaaatatgtagatgctctaaccttgctctcttctgtgttatttnnncagctccattgcatggatttgcatttnggttcgatgtcgagtttaatggaccagttcgccagaaattcaagaagcaaacaagccaacccttggatgtcaatatgccaaatnacaacccaagcaataaaaagaaaaaggcagntgtctcgattgtactgtcaactgccccngaggacgcccctactcactggcagcagctctcttaacttt

SEQ ID NO: 82930 - DNA, 336 bp, Triticum aestivum
  unsure (1)..(336): unsure at all n locations
  Clone ID: PAT_TA_82930
ctgtagggaccctaggtactgggaagacgccgaggaattcaagccggagcggttcgagaactccaacctagactacaagggaacatactacgagtacctcccgttcgggtctggccgtcgcatgtgcccgggagcaaaccttggagtggccaacttggagcttgcactggccagccttctgtaccatttcgattggaagctaccaagtggacaggagcctaaggatgtcgatgtctgggaggctgcaggactggttgcgaagaaaaacatnggctggttctgcaccctgtcagccatattgctccgntnaatgctaattgangaccattttgcncc

SEQ ID NO: 82931 - DNA, 505 bp, Triticum aestivum
  unsure (1)..(505): unsure at all n locations
  Clone ID: PAT_TA_82931
tagcaggccaggtcagtcatcaggaggtgatcggctgaggagaagctcgtacgtgcggtcgatccatcatggtgtggggactgggaggatgcttcggcggtgtcgccgtcgccgcggtgtcgcctgtngcagcaggccggaagcaatcggcgtcagaaggcggagcagaagccaagcagcagcagcagcagcgggtggcaccacgagaggaggagcagcaggcggcggcntcagtagcaggaggccgtaaggagaggaagaagaaggacggtgagaaggcttccgtagttgtaatgcaccanttccccttccactcgcgccccggcttgcnctgnaatccatcggttgantctnattctccctttcactcgagtatacaagtcacattcgcgcaggaactatntatnacttggctctggtgaaaacggaagnntacgcgttctgttcnttccggctcngtactngancacggtcggngtanttagtngggacagttttatngatg

SEQ ID NO: 82932 - DNA, 293 bp, Triticum aestivum
  unsure (1)..(293): unsure at all n locations
  Clone ID: PAT_TA_82932
gccggttttatctggaggcgtccgaggagcacgacgggcacctgcacgtcaggtgctgccacaacaacaagtactgggtgtcccagcagcgcgtgcatggcgacggcgacggcgacggcgacgcacgctgggtcatcggcaccgccaatgaaccggaggcggacctgtccaagccgtcatgcaccctgtttaagcccaccccggcctcggaggaggacggctccgtnagttcctccactccnagangggaaaanatgtnggcgtttnatcagtggnnatgtcnccanttggaa

SEQ ID NO: 82933 - DNA, 379 bp, Triticum aestivum
  unsure (1)..(379): unsure at all n locations
  Clone ID: PAT_TA_82933
caggttcataagcaaggagtcgcacttggcaggtcggtggacctctctaaatncaccgactacngcgaactccaagcagagctggacaagangtttgaattcgagggtgaattggtatctggnagccaaaactggcaganngtctataccgacgacgagggcgatatgatgcttgtaggagacgacccgtgggaaganttctgcagcatagtgcgcaagaactacatctacacgaaggaggaggtccagaagatgaactcgaaatcagctgcgccaaggaaggaggatctccggcagcaggcggcggaggaggttgcgccgccgccacaacgatagtatggtggtttgctcttggtggcagtngaggcccnggtttact

SEQ ID NO: 82934 - DNA, 521 bp, Triticum aestivum
  unsure (1)..(521): unsure at all n locations
  Clone ID: PAT_TA_82934
cacacgagacagaccctgagaaggtgaagctcgtcaccgtcctgagcatcgacggtggcggcgtcagagggatcatccccgccaccatcctcgccttcctagaagagaagctgcaagaactggatggaccggacgctaggatcgccgactacttcgacgtcgttgccggcacgagcaccggtggtctcctggcggcgatgctcacggcccctggccaggaccatgacggacgtcgacggccactcttcgacgccaaggatctggcgcattctacatcgaccactcgcccaaaatcttcccacagaagaactggatcctgtccaagatcgccggcacgctgaggatggtgagggggcccaagtacgacggcaagtacctccatggcctgcttcgccagcactcggcgacatgaggctggacaagncgtcaccaacgtgtcatcccgacttcgacatcgggtcctgagccacgattttcnaagcttgagtaancgcggcgtgaagaatnactctggggacatt

SEQ ID NO: 82935 - DNA, 326 bp, Triticum aestivum
  unsure (1)..(326): unsure at all n locations
  Clone ID: PAT_TA_82935
cacaactgaaggatcaaccatctacccaccatattccttgaagacctactggggcttctctcactttgaaaacccagcccagggcgctgtgggatcatggtagatttatgcgccgcgcacgccgcatatcatgccatgaacttaggcgaaaccaatctgtgctgctgaaatcgaacacttatgaacgtttgntctgnacatcactggaatcngaatttgcttgaatgaaatgntaagggtccagnggntttaattcnagtttgancaaaaaaaggaaaaagngaaaaaaaaacncngggggggccggaacaaattnncccnaaggg

SEQ ID NO: 82936 - DNA, 529 bp, Triticum aestivum
  unsure (1)..(529): unsure at all n locations
  Clone ID: PAT_TA_82936
cgcggctgctcctgctcgtcgcgacgtcgaatttcagcgccgcccgcgcgatccttggtctcttcgcccgtgaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttccattttgtagcagaatcctattgctctgtttattctttttggttggtattagaatcccgccacctgctattaagtacaccaatacagcaccagacttgttaatgcgtggatcgcctgaagaaaatcacggtgcttctctttccagtgatgtnatatctttgatcatgacagg

SEQ ID NO: 82937 - DNA, 523 bp, Triticum aestivum
  unsure (1)..(523): unsure at all n locations
  Clone ID: PAT_TA_82937
ggcatgtccgaggcggagtaccgctctcacttcagcatctgggcgctcgccaaggctccgcttctgatcgggtgcgacgtgcgggcgatgagccagcagacgatgggcatactcagcaactcggaagtcatcgccgtgaaccaagatagccaaggtgcgcagggaaagaaagtgcagtccagcaatggcttggaggtttgggctgggccgctcagcaacaacaggaaggccgtggttctctggaaccggcaggataccaggcaaccatcaccgcacagtggtcgagcatcgggctcgcttcttccactgctgtcactgctcgcgatctatgggcgcactcgtcgttctcggctcaaggccagctatcagcttcggtgccactcacgactgcaagatgtatgtttgacgccgaactagctcagaagacaagagcggattgttccatggcgcgtgggatgcaacattcgtcagattanggaagaagagttcagtcaggcaaggattaagagaggaattgatanat

SEQ ID NO: 82938 - DNA, 421 bp, Triticum aestivum
  unsure (1)..(421): unsure at all n locations
  Clone ID: PAT_TA_82938
gtctcctccacccctcacctccttctctcaaccagaacaaccaagtgaaaccgcgcaaacccttgctccgatccccctctcctcggtctcctcgacggaagtagtagagcaggggccgaggccatgtggcccggctgcggtgggcggttctactgggcgccggaatcggcgcggccggggcaagcgaggggtgtcgcggtcttgttcgcgtgggtgtggagcgacgaggcgcantgcggccgttcgttgagctgtactcctcgctcgggtggcgctgcctcgtctgcnaccccgacctcgtcgngctatatctctctgagaaagcaacatctctggnaatggtgttattagtgantggttaaggaactgagagtaaaacctgtgccaatgttcttgctncttttctgggggcanaaaaggg

SEQ ID NO: 82939 - DNA, 272 bp, Triticum aestivum
  Clone ID: PAT_TA_82939
aaagaaagacatgccagccacaaactaaatcatgcaaggtactgggcaggccaaaagctgttaggaatctgaggaagcgttgaagaggcggtctagtaggagccatttccctggagaattctcgtctctgacttggttttttgtataaaccctttctgctatatcttcctgtggccctcccttgatcctcgttgattgtaaactaaattgaaatatgtgaaagcatactatattatgtgcacatttgttgtatatgatgttagctgactgtc

SEQ ID NO: 82940 - DNA, 402 bp, Triticum aestivum
  unsure (1)..(402): unsure at all n locations
  Clone ID: PAT_TA_82940
ncncccgacgcnccctctcgccttccgtcctcntccctgcccctgcngccgttccccttcttcctccgtnctcncgcccgangntgacctccgtccgactcccgcnnccgacacnccccganncggcgncctccagnctggcgggggnggggganacggaggagggagactggctctggcgatngtnctaganatagacgggganaactcggagggngaagngctatnngagctgagangcgaaaangggaaaaaggaggagttatgangagatgggaaaacacgatagtcaaaacgtgacatggttaaangtaactgagaaaganaaanagagtaaaaagaatagnttnggtantttnaaattntgtggtaatatggagatgaagttgggaaatggagatc

SEQ ID NO: 82941 - DNA, 382 bp, Triticum aestivum
  unsure (1)..(382): unsure at all n locations
  Clone ID: PAT_TA_82941
ctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctngccggcngaatctngggcnaaagggntnaacgtttnccgtnaagccgntaatgggntcggaattggaattnttgcttccggtgtaagttngttcccaattgcgggcaaggntaactctttggggaaaanaaanatgntntggaataaaacgaantnganagggaaggaagtccttccggtt

SEQ ID NO: 82942 - DNA, 532 bp, Triticum aestivum
  unsure (1)..(532): unsure at all n locations
  Clone ID: PAT_TA_82942
cgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaacgaagaagtcccccgccgccaaggccaaggccaagccgaagaccgtgaagtcccctgcctccaagaaggcacggaagctccgcatgagatggttgctttaggttaagtctgattgtggttggtgtagttaggtctgtacaaataagtgtgtcccaaagtgttcaagcggtgttttgtgttgaagtntattatagagtgtttagttaaaatggttncttgntttgagcaggtttnaaaaaaa

SEQ ID NO: 82943 - DNA, 521 bp, Triticum aestivum
  unsure (1)..(521): unsure at all n locations
  Clone ID: PAT_TA_82943
gcttgccggcgtggacagactggcagatctggagctcggcgcgaccagatccggtgctgctgtgcccgatggcagaggagatctctctggtttactctgctaagagtcaaagaggagctgatgacgacaactaagcttgggttaccgataattgagcctgttctctgcacgagaagaaatttccggcctcacctagtactaataagtatgctggatagtcccccagcacgggagttaattgtatcaagagaagtggagaccaagggcagagtagaactacagagggtatctttgtatatggaggntacatgtgaacaanaaaggngaggagaagactgtatagatctgaagacctaaggnganacaatcngagtactnctggnaacatatatctccntgataaaagtagattcttgttgggnncatacangggtcccaatgttcttccgnctataganattcattggacacatgataaaaacgcgttataanaaattggctnnggnccataagcatatgtn

SEQ ID NO: 82944 - DNA, 306 bp, Triticum aestivum
  unsure (1)..(306): unsure at all n locations
  Clone ID: PAT_TA_82944
cttcctcgcatatcaacttttaaaaaagacaaccccaagaaacaaccttcaagatgaagtactctttcgctattgctgccctcgccaccgccgtctcggctcagtctctcgccgacgtccccaagtgcgctattccttgccttgacgacgccatcaccagcaagaccgactgcaagaccactgatctcacctgtgtctgcaagagcttcgacgangtccgaagngccgctacctcttgtgtgatcaccaagtgtggttcgangttgcatnangaggtcttccngctaatganaanttgtttggggg

SEQ ID NO: 82945 - DNA, 415 bp, Triticum aestivum
  unsure (1)..(415): unsure at all n locations
  Clone ID: PAT_TA_82945
ccacgaccagctccggccgttcaaccacacggagctctcggatgttcaccgctttagcgcccaaagcccagccatccagggatatcagccaaactccacacctcgccgccccctgcatcacctcctctgccctgaagaactgccccgtcctccttcctgctcacagccgtgcgctcggccgccagactgcacccagtcgccaacacgaactgctccgactacttcagctccggaaaattgcctctacgggctccgcctagcgagtgttgattttggaacgcttgatcaaaccaccacggagnaagggtgttttgttactggcaaggaaccatgcagggatctgtcaatcaatcgaacgnaacgngcctggtctggtcgcgtaaanaangngctggnangtgtatgcanangaacg

SEQ ID NO: 82946 - DNA, 430 bp, Triticum aestivum
  unsure (1)..(430): unsure at all n locations
  Clone ID: PAT_TA_82946
gttcctcctgtcatcttctcctcctcagaaacccaccaaccccgtccagccgccggctgtctcggccgccgccgccgccgccgccgccctatcccggtccttcaggcgaaccaggttggtcatggccttcaacaagatcaaggtctccaaccccgtcgtcgagatggacggcgatgagatgaccagggtgttctggaaatctatcaaggacaagcttatattccctttcgtagacctcgacatcaaatattttgacctcgggcttcnacaccgtgatgctaacgacgacaaagtcacagtggaggctgcggaggccacactcaagtanaatgtggctataaagtgtgcaacaattanacagataangcagggtaaatganttggctgaaggtatggggaagagccaaatggaacatnaggatattctaaa

SEQ ID NO: 82947 - DNA, 526 bp, Triticum aestivum
  unsure (1)..(526): unsure at all n locations
  Clone ID: PAT_TA_82947
gccagttcctggctcgatgtcagcgagcacgccagccacccgcccctgaacgagctccctccactactcgttatctgtgcttccaccctgtcgcatccgcccaggccactggacgccggcgtcgcgttcggctggtcgcgctcgtccttgcctctgcatctaccagcgccctacacctgctcatcgctccccatcgcgctcgacatcatccccagcctcacgctgcactcaccggacagcatcctcctcgccgcgtggagctgctgaatgtggctccccaacgtcgctgttgcctactgctcgctctatagcagctcgccggctccctggaaattccccagccatcgtncggnttnttgcctcgccgttcggtgcgtcgtnatccctgctgtctcgtaangtcgcgtcctcaacttatttcctctatgtggtgagcttgctgaaagntgagtanagtttgtgtgcgatgggattaagtgcggnggncggctntataagntaagtaactttnaacttnattgggggg

SEQ ID NO: 82948 - DNA, 311 bp, Triticum aestivum
  unsure (1)..(311): unsure at all n locations
  Clone ID: PAT_TA_82948
ctgcagtctgcagctagcccgtatcgccaatcgccatgctcgcctacctcctccacgccccagccaccgccgtcgccgtcgccgcggcgccctgtgcctcctatctccgctcantcccgccggcgaagancccgttcctcccctcgctcccgcgcccggtntcgccgaagcgcgncggcgaagcttttgcttntcccccggngacgcgggggccccatcggggggtagtgcttcaanggcccttgntggtntgggcggggggtttgaaatttaaaaggggcnncnaagggggttngggggttnnggaaaaa

SEQ ID NO: 82949 - DNA, 304 bp, Triticum aestivum
  unsure (1)..(304): unsure at all n locations
  Clone ID: PAT_TA_82949
aggcagtaaaagatcgcggtaacagcgtgtatgataaccgtgctcctatttttatgtatacaggaaagataacaggaaagataaaagaaagcaaagggaacagcctaaaaccatggctgataggctgatacctagttttgcagaagaaatcacccaccttgtccatgtgtggcagctgctgagctagccctagctcngagggagaaganccagtncctctgngcncactnggagcaacttnctgggtttggaanattttncnactgtaanaattgngaaaagggtcnagngatantagaaattg

SEQ ID NO: 82950 - DNA, 509 bp, Triticum aestivum
  unsure (1)..(509): unsure at all n locations
  Clone ID: PAT_TA_82950
tcagcttcacaaaaaaatagtgaagttggggttaacttcacccttttttataaagcaacgaatagggtgtttcacaaacgctattttgcaataaattaactcgtgaagttagggaataattatccaccgctgccaccgattacacaataaattgcttctttttttctcccataccccatctagcgctcacatttccctttctctgttatctgcatcttcatggatccgcagccctaacgccggcgccggtagcataggaccacgctggtgccgctgggcatagnaatagagcttgtttttccttcttttctttccttccccaangnatctccttctttctcttctcgnatggaaccctccgggcaacagcacccggggtaancggtngttgtgatgcatggcagtcactatgaacgaggtggagcattgacggctgnaaagaggntagtaacccangtaaananggctcaacaaaaggtggnatgnccaggggaaatcccagttattcc

SEQ ID NO: 82951 - DNA, 556 bp, Triticum aestivum
  unsure (1)..(556): unsure at all n locations
  Clone ID: PAT_TA_82951
atgttatggagcacaataaaatcattcctcgatccaaaaactgcttccaagatccatgttcttgggaataagtatcaacataagttgctcgaaataattgacgagtgtgaactgccagaatttcttggtggcaaatgcaattgtattgaaggttgccaaagatctgacaaaggtccttggaaggatcccaacataataaagagagtcctcaatgacgaggcaaactacggcagacaaattgtgaccatatccagcattgatggaaaaataatacgttatgctaggccagatcacccaactagaaaagggagtgatgcatctgccgagtctggatctgaagtggaagatgtaacatctcctactgcatcaaggaacctgattacacatcctattttgacccctgttcacgaagagtcaaaattgtcgccacatggttccacatttgttgctcatgctctattgaagaaacattcctgttgtagacaaggttgtggatgatgatggggaccccagaggagccncaagctcttcaggtcgttncccgagaacacgnngg

SEQ ID NO: 82952 - DNA, 521 bp, Triticum aestivum
  unsure (1)..(521): unsure at all n locations
  Clone ID: PAT_TA_82952
ggaaggagggcacgacgctccggtggcccggctctcgggtcacttgggagggcttcagcgacgcctccgacgccgaccttatcgccgagcacgagatctgggccgccgtggatccgttcgccaagaacgaggccttcaattgcagcaacggggatctcttcaagtggaagcagctgtggccgatactcgccgancatttcggcctggaatgggctggctacgaaggtgaggagaacaggttcaagctcgaggaggccatggccggngaaggaagctgtctgggcagagattgtcagggaaaacgaccttatagccacggagcttgacgagatcacgaattggtggttcntcgatgccatgtntgctgtggagacccagcttctggacagcatgaacaaaagcaaggagcatngcttcctcggcttcaggaacactgtcagntctttaacanatggatnnaaagctgaaggncttaaattgtaccctaataaaatnatccntgcaatncactcnaaactgtg

SEQ ID NO: 82953 - DNA, 553 bp, Triticum aestivum
  unsure (1)..(553): unsure at all n locations
  Clone ID: PAT_TA_82953
ttcccatccctaaattgtttgaaaagataaattatttacattgctcttgagacacttgtccacttgcattgccatgttctcttctccgaatgcatgggttctcaattcctcatgtatacaccgggcagccctcaacaacgatacctttggcagtgggacaagaggcgagagggcacccgtccagatcattgccccaccagttgaggccgacgttctccaagcccaagcacaggtagatgagcacggccatgaacgccaggccagcgtcgagcgcgccagagagcaggtagttgtggcgctcccaccagtgacgccggtacctgtagaccacgtaccccgacaggaacccggcaatgatccacgtggtgtagttgacggcggtggccggcggcatcatgccggtggagccgatgagcacgggcatgttgacgagcaggatcagcttggctcgggaacnccggtgcgcgancacacgaggaggggggacgggcgcccaggaagaccagttaccgccgagnagttccgaggtgcgaaatctgcgcggccatgagcc

SEQ ID NO: 82954 - DNA, 541 bp, Triticum aestivum
  unsure (1)..(541): unsure at all n locations
  Clone ID: PAT_TA_82954
cacacgcccggcactaccatccatccatccgcgcgctcttaatttagcttcctcctcctcacctactagcaggcacagcaggcagcagcatcgatcggatcggagcagcacagcgcgcgtcaccgcaagctcaagtgtcttcttccttgcttgcttgcctgctgcttacctctcagttccccactcacgtcccttgccgtacgtacgtgcgtccaacacaccaggtgaaaatgggctcggagacggagacggtcaacgtggaaggcatcccgttcccggcggagatcaccgtcggcaaccctctctccctcctaggcacaggtatcacggacatcgagatccacttcctgnagatcaagtacaacgccatcggagttacctccacaacgccggcggggcgacagaccacgcccacgtgctgggcaactcggggctngaaaggcaanaggcgaggagcnctagcggagcggcttttggcgcntggtcgggccccgtgaaagttttcgggtgtggtataaagggataaggggtgatagggtgg

SEQ ID NO: 82955 - DNA, 529 bp, Triticum aestivum
  unsure (1)..(529): unsure at all n locations
  Clone ID: PAT_TA_82955
ctagtcttgagtttttttttttttttttttttttactagcaagattaatatattagaaaacttcaacaggggtaactgattcattcagcaattataacaaattctacattgttgcacgaacaacctagcacagtcctaaatatgagaaaatttagcaacgtgcggcggcgagcttggctgcctcggcggcgagcttctcgaagatgtcgttgatgaaggagttcatgatggacatggccttggacgagatgccaatgtccgggtgcacctgcttgagcaccttgaagatgtagatcttgtacgtctcgacgctcttcttcgccttcttctttcccttcttctcgccgccctccttgctcggcacgcgcttctccgcccttggcttcttctcggccttctcctccgccggnttcttctccgcgggcttcttctcggccttgggcgccatcaggaangatcaaatgggggcgaaagaatgggggaaggagaaatagctcganggggggccggaaccaatcgcccatagtgg

SEQ ID NO: 82956 - DNA, 298 bp, Triticum aestivum
  Clone ID: PAT_TA_82956
gacgagctgtctattagccgcacaatgtccagtctaaggttgaaactggtttctcttttgcaagcggcgttggtagcccttccgagccaagagccttagatatatcaagtctgttctgtctggtgtatacatttgttttataactaaacgctgctggaccgttgtaactcgactcgatgtaaaaaactgtagcatggtggtgaatattacaaatgcttaaaactagcggtggcaggatgatgctttaagacaagtaaagagatactgctgcaatgttgtgttaaaaaaaaaggggggg

SEQ ID NO: 82957 - DNA, 282 bp, Triticum aestivum
  Clone ID: PAT_TA_82957
ctgggagctgccattgccatccttggcacattcctgtactctcaggcaaaggcgtgaggcgggccatgatgacgaacgtctgcagaatcagtagcaagcactaaatccaattttgcttgttccagtggcatgtagatatcgggttagttttccgtatgagagtttgtaataatggatgaatggctctgctgtttcgttcttgtttgttggccagactcaaatccataggccatgaactgcggtcgagtgtacctgaataatactgtaacggagaattcgccg

SEQ ID NO: 82958 - DNA, 542 bp, Triticum aestivum
  unsure (1)..(542): unsure at all n locations
  Clone ID: PAT_TA_82958
tcggagagcatctgcatggcggagcaaccctcaaagcatggcgcctcgctgcagccggcgagatgggagccaaagatcttcagcgcagacaccttctactatggccctccctcgtccgctantgtgtgccccattccatggacgatgagtgtctccaatctccggcgtgccancactcccattgtctgttgtgctccgantgcgggtgtgacgangccttctgctttggccatctcacctcaacgtccgtgcatcccactccatcgtgtacctatccggtcctcaattcatccaatcccgcctcgagccggccatgcaccggcgcgcngcaatcgccgtggccagggagttgaaggagggtggattaaatgttgaagcatctgtcacctccacgagctgggcgaggagggagctcgagggcaaaggttgcgaagctgggcggggactaggcggagggttggtnaaaagggcantttgcgaaggttggtgcggcggaaaaggnaaaaggggcgactngtacnaggntgggtccggcccccnaa

SEQ ID NO: 82959 - DNA, 567 bp, Triticum aestivum
  unsure (1)..(567): unsure at all n locations
  Clone ID: PAT_TA_82959
gtcatttcagataacattttgtgttccaatgtgcccttcgagatggggtcagatgaagacagaaagctgtgcacacatcatcacttcaatcgacagtttgataatacagtcttgacttgtgaccaagctctaactcaagatcacaatggtagcttgaggtagatgcaggaacaacgtgaaggatcagcaaggcgggtgggaacacttcgacatcaggctttgaatcggcctcgccgggctgctcctatctcgattccgcctcttttatcgcacggatcagatgggtcatgcggtactggagcttctcgttctccatggtcagcttcttgttcttctccttttcagtcaagcattctgcagtaaccacatctagcttcgactggagatcttcacggcagaggaagttgcctcggatcacgctcggaccatttgttgacagcaaggttcagttcgcatggtatccagcctcggaggttttctggaaggcttaaggcnttcangcgangngtgggcgcgtcgcgcatgtngcgnggcgctgggggccggaccaatcgccnaaggagcgat

SEQ ID NO: 82960 - DNA, 572 bp, Triticum aestivum
  unsure (1)..(572): unsure at all n locations
  Clone ID: PAT_TA_82960
gcaaaacaagcaaagactcataccatacaagacgctccaagcaaaactcatgatatatgacgaataaaaatatagctccaagtaaaatactgatggtcgttagaagaaagaggggatgccgcacggggcatcccaagcttagttgcttgcttctattttagataatagctagggatgccccatggcatccgcaagcttagcctattcttattccttattccttcatccaccgtgatctcacccaaaacttgaaaacttcaatcacacaaaacacaacaaaaccttcgtgaggtccgttagtataacaaagcaaatcactactctaagtacttttgcaaaagaattcatattttatttttgcattatatctactgtattccaactttactatagcttatacccaccaatacaaaccatagattcatcgaaatgagcacacaatgcaaagaaacagaatctgtcaaaacagatagctgtagtaacagggacttcatatctctgtactaaaaatctgataattggcacggggattattacatctgngaaaaatagncaaagatgttctggtntgg

SEQ ID NO: 82961 - DNA, 583 bp, Triticum aestivum
  unsure (1)..(583): unsure at all n locations
  Clone ID: PAT_TA_82961
cagaaagcgaacaccaagcctctgatgccaagccaaagcacacacacctcctccagcctttcttcctctacagccccaattcttccctgcagctctgctntgccttgtttcgatcggtcatggcggcggtggccacagagactccgttccatgtcctggcggtggacgacagcctcccggacaggaagctcatcgagaggctcctcaagacctcttccttccaagtgaccactgtcgactccgggagcaaggcgctgcagttcctgggcctccatgaccaggacagcacggttcctcctgtccacacgcaccagctggatgtggctgccaatcaggatgtggctgtgaacctgatcatcacagactactgcatgcctggcatgacaggatatgacctgctcaagaagatcaaggagtcgtcgttctcagagatatcccggtggtgatatgtctctgagaacattcttaagataataggtgctggaggaaggantgacgagtnttctaaaactgtgggcataacatgaacaannaagcccacatactgaaaanagatgaacaggacagacagcaagtgcagtaa

SEQ ID NO: 82962 - DNA, 548 bp, Triticum aestivum
  unsure (1)..(548): unsure at all n locations
  Clone ID: PAT_TA_82962
gcgccgcggcacagggctccctccgcctccgccgcagctcccacggcgccggcggccgcggccacgtccagccacagcagcaccgtcgagtcgtggagcggcggcgcaccccgcgccgccnncctgccgcggaggccgtgcccatggaggaggacgatgacgaggactgccacagctactgcggatcctcgtcgtccgtcctctgcgacgacgcatgcggcgacgacgcggtggcgtcccgcgcgcccctgccgttcganctgaacctgccgccgcctcttgacgcggccgctgagacccatcagatgggtgcccgctacgacacactactccgcctctagctcccgagaacggccaggaatcagaggaaggatcgacattcgacaccgcttgttttttcggctgctgaancggtggtgcctctcgctaatgggataattttgcttttccctttcttttttttttnttacacacgacgatgtaaattcaatatgtaataatnagtacgtcatgaattgnaggaagnantgagctttaaaaaaaaaaaa

SEQ ID NO: 82963 - DNA, 539 bp, Triticum aestivum
  unsure (1)..(539): unsure at all n locations
  Clone ID: PAT_TA_82963
cattctcacattgacaatcatacatcatgctaccaacaccagacacttcgcacgtcccatatgagcgagtctacgaacctgctgaggactcatacctcctcttggacacgctctcatcagctgcagagaccgagtatctccaaaaagcgtttcccgacatagcgccgctcgtggtggaggtcggcacaggctcaggcgtcgtcctcgcctttgtccacgcacatgcgcaaaagctttttggcacacgtgaggtcctgactgcgggagttgacatgaacgcctttgcatgccgggctacagtcggaacagttgcaaaggcagcctgtgacaaccccgactcacatgcattttatctgggttcatgtatgggagatctcacaactccatggcgcaagggnacatcgacgtcctcatcttcaacccgncatatgtgccacgcctgagatgctgcagacagatcgttnacgcagacgactcgagtagaaaagcntcgttatacgatcgattgngntatttatnagnggctagatggntggaaa

SEQ ID NO: 82964 - DNA, 583 bp, Triticum aestivum
  unsure (1)..(583): unsure at all n locations
  Clone ID: PAT_TA_82964
agtatatggcagctggagctattccaattgcacataaatcggcaggaccgatgatggacatcgtgctagatgaggatgggcatcaaacaggatttctagcctccgagaaggaggaattcactgaagcgattatcaaggtcttgaggatgccagagtcggggaggcaagaaatggcagctgcggctaggaaacgtgcacaaagattttcagatcagagattccaccaagatttcactgagaccgtccgccctattttgtcagcaagggaaggctgactgacaagctgcagtttccacctaacaatctgaattctctgtcaagtttcacacggtacagtgaaagacttgcaaggggcactgaattggcagattattgctgctcccttttcccagactgcttgtgtattgtgctgcatcgtgtacgctactgtgcagaaatagatcacagaaagaaactttcgtcagcgatatagatcaaaatggtgtgtggtcacggntttaacttcttnggnactcagaccaagtcacttgactgagcaaactctnntaantggcactgactggggaccatgncttttaactaa

SEQ ID NO: 82965 - DNA, 568 bp, Triticum aestivum
  unsure (1)..(568): unsure at all n locations
  Clone ID: PAT_TA_82965
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaagttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagttccactgatgatgttctgttggccagataagactggatttntgatggaaggccnatctgctgtatgtcgcatggtaagaagattngtgtaagaangtgtgaannacagtgtngtgtncacnngaacttggacaggntcn

SEQ ID NO: 82966 - DNA, 537 bp, Triticum aestivum
  unsure (1)..(537): unsure at all n locations
  Clone ID: PAT_TA_82966
gaactagtctcgagttttttcgtttttcccattttcacagactgttgcactcgtgggagagagtggcagtggcaagtcaacggtgatctctttgctggaacggttctacaaccctgactctggcaccatctcactggatggggtcgagatcaagagcctgaaagtcaattggttgagggaccagatgggtctggtggggcaagagccaatcctcttcaacgacacgatccgtgccaacatagcctacgggaagcatggggaggtaaccgaggaggagcttgtcaaggtcgcaagggcggccaacgcgcacgagttcatatcgagccttccccaggggtacgacaccactgtcggagagagaggggtccagctatccggtggccagaagcagcgggtggncatagcgagaccatactgaangacctaggattctactccttgacgangcaagagcgcctgacgccgaatctaacgatagtnaggatcctgacaatgtatgtggagncacggcatgtgggacgcttcacanaaaggtaa

SEQ ID NO: 82967 - DNA, 550 bp, Triticum aestivum
  unsure (1)..(550): unsure at all n locations
  Clone ID: PAT_TA_82967
gtggatgcgagggcgatcaaagagatcattgagggggttcatgtgatcaggcttggcaagtacagactcactacctggttatcgtgaaatttctcggatagcacaaagaagctacgtttgatggattagtgcttaatttccatggttattggttgattacacctctgaaaagcttgatttcaacaaatcatcgactttnaaggatctttcaaaatcagttggtgcgttggatgaaaaccgattctaagtttttattacggatctcacaactctagcatggaaatcattctccaatacttgcttaggctcgagccatctacatctctgcatctganttttcagggtttgcctgaagaattcattcacatcaacagagagcccttaaaagtgaatatgtggcctaatctccataactggattgcatcatatttngntcagcagcgtgtagccagtgtgnggcactgtgtattggacacattgaacctgcagagacctcctactcgcaattttgaangggngcatntgnctcgtgtggggcaaaaaaaaaaaa

SEQ ID NO: 82968 - DNA, 318 bp, Triticum aestivum
  unsure (1)..(318): unsure at all n locations
  Clone ID: PAT_TA_82968
ccgcgtcnagcggggcnggngctggcgctggtagacgagcggatgtagacggagggcacgggctgagctggggntgancaacaacctgctggggtggatactctgggcgtcttcggcntcatctggtcctctacaccgtntanactcaggcatcgacgangacgaggagtcnggcggcctctcgctctaagctacanatagtttnctcgtgtcnnatgtaatcccctcgngancatncaatgatnggtgtaatgtaattacagagatngatatttgtatctaagcgtntncattctganaanacaaaacannaacaaa

SEQ ID NO: 82969 - DNA, 556 bp, Triticum aestivum
  unsure (1)..(556): unsure at all n locations
  Clone ID: PAT_TA_82969
gcagggggaggaggaggctagggttgctcggcgatggcgtcggcggcgaagacccttgcacgggttggatcatccctcttcggccgcattctcgcgtctccgtcctcgtccataccccgcgccgggctgccgctagccaggctgcagccacacgtcccgccgccggcaccggcgngggtggacgcttacgaggcggagaccatcgccaggctgagctcgctccccggcgagatatccttcccctgcggacttccctcgctccgcttcttcatcgacgacgtgaggatcctgttcctaatgacccctttcagttgctcccgaaaagaattaccagcccagtacaatcaagcggaaagaacccatggatttttacacgtaaatcgaccaagggtgggcgcaagtgattgcccggagaatgccaaaggaagcacagatcnagttagtagatcngctgtanagccctgatgttntgaaaagattgatgtgtcttcatgtanactcgctaaggnagccccggaaacagagtcatgatgnnttatggaacttttttggggnt

SEQ ID NO: 82970 - DNA, 559 bp, Triticum aestivum
  unsure (1)..(559): unsure at all n locations
  Clone ID: PAT_TA_82970
ttttttttttttttggctcttggaaattttgttagaatgacattcttcatggagatgcacgagtttggaaaattatcataattgacagatggccagccatttctttagctattgccatactattatacatgaagtttgggagttatccagctttctggctactaacttcccattttctacttacacttgacggagatttcttacaactttagcctaggcacacacacagctacttcatacccaccttggtgtaactaggcaggggtttggaaacttatggaacctttgaggcacctagagatcaagcattcatttctgcttgggtgctggtgcagcgaatgttgttgctggcactgcaatactatttttcttgcctcagatgtgtgcttcctagaaacgtgcgacaatgtggagaacgcttggatggnacacgcatagctgcgagtgagggtgcatttgaatttaaccaaaggagggcatgagattcctggaaggagattttggccnccggatggaggcagggatgatgcgtnatggaaaactagagactgntggagag

SEQ ID NO: 82971 - DNA, 191 bp, Triticum aestivum
  Clone ID: PAT_TA_82971
ccgcaagtagaggactcgcgcacagctgagcgtgttctaaagatacacgcgtcctgcaaatcaaaattcgccaaatattagctactcctatccggaagtaatgtaatctgtttgggagcagtgaatctattgtgagtattttctcttctcgtgtgttgagaagaactggtttgctgccagagtcgataaaa

SEQ ID NO: 82972 - DNA, 512 bp, Triticum aestivum
  unsure (1)..(512): unsure at all n locations
  Clone ID: PAT_TA_82972
ggcagggtcggcggcggctatgaaggtggcaggggtggtggtggtcctggtggaaggggatatggtggccgaggaaggggtagaatgggtggcggcggacgagcgaactaagtgcatgcagacttctggcgtttccttcaatgcatgccttatcaatatatcagggaaaatacgagcattttatgttggaagcagttcagttacgtgtgaggtctgttgtttttttccctgggcgcgaggtttggttgtgagcataatgcatatgcaagttttatcatgtaagtcatctttcaattttcctgctgcagaggttgttttccactttttcccatgatcgttgatgctgagcatgctgccctatgttcatgcctgcagattactgatggcaactcttgccctgagtaaaatgtaatctatttgtgcaaaaggggccggtacccattcgcctaagtagcgatacngcgccactgcgtcgttacaacgcgtactggaaacctgcgtaccactaatgc

SEQ ID NO: 82973 - DNA, 548 bp, Triticum aestivum
  unsure (1)..(548): unsure at all n locations
  Clone ID: PAT_TA_82973
gtcgagcattaccgtcagagggcggcggcgcggcgcggcgccgccggcgacggggaccgcgtgaggcaggctcccctcaaggctcgtcctcctcgtcgggaggcgtcgccgttgccccgccctctgggctggcgcggcgtggaggggacagctggagatccgcccgtctctgcttggattgcttccttctcccgcagagggtatgagcaatgtactcaccaaaaccagagtctagttttggcccaaatcccaactcaggtacacaccagcagcaaatggaattaactggggccaacatgggtcctggtaatggagcaaataacaataccaacatggctgggaggcaacgcttacgctggacaaatgaactgcatgaaagatttgttgangctgttactcaacttgggggtntatagggcactccaaaaggagttctagnattatgggtgacaagattaacaatatccatgtaaaagtacttnagaancagctacaagattctgnntnaactgtggacancgtacaaaaccagagttnttcggcttagg

SEQ ID NO: 82974 - DNA, 602 bp, Triticum aestivum
  unsure (1)..(602): unsure at all n locations
  Clone ID: PAT_TA_82974
aagcaatcggcccatttctattctgtggatataactgaaaaacaagctaaaatggggctagtttgtcgtgttcactcaaacgataaaagcaaattcaagttgctatattttgagcttgaagaaaatggcgggcttagtcttgcactacaggaagacagtgtgaaggttgggaaagttactgctgcagggatgtatttccttggttttcctgtgtaccgttttgaacaaaataacctggcagctgctgcaaaagattctgatggtgcattctttaanagattggatagctttcagccatgtgacatacatganctgaaacctggaacacacttctttgctgtctacggtgacaacttcttcaagagcgctagtnatactatagaggttgtatgtggtgaacttttctgccgaaaaggagatctacgaatgtggaggcaagataccacaaaacgactgaacttccaatttgagcagagaaaggagtttgngagtcactgaatnccacannccacagantcacgttntgctttnagaagggtngncatctncancacancacctaangggtcacagaaaagcagcgctngaggcaactgacgaaa

SEQ ID NO: 82975 - DNA, 335 bp, Triticum aestivum
  unsure (1)..(335): unsure at all n locations
  Clone ID: PAT_TA_82975
gcatgaaagactggtttatacttgcatgcccggtagacaccattcttactctgcatttgcctgcctgcacatttacaactgaactgctgtagccctagcttganatttagatcataattatnanaccagtgaggtgtccgtgccaatganaagttgatttgtgcgtatatacacaaaacatttgcctganttaccttaatcaaattatgttactgagacaactatttgantttnggagtagttaattatagcgcaattacatttatgtntggnagantcagttagtacacattcagangtaatataccgcggggtagactcaggatgtaacacta

SEQ ID NO: 82976 - DNA, 321 bp, Triticum aestivum
  Clone ID: PAT_TA_82976
ccggatccctggctaggtcgaactcagcaacccgccctgctgtttgattgtctgtatcttccgttgccgttgagctaggacgacctcatgcaaatagtggtctggagccaggctcaggagggaagactattttggccgtatgaactcagcctggctggacacagaaaccaagatatagttttaattagttttcttgttacatctcttgattaatgcatcaaattaagaaactgattttttgtgtttctgatatttgtatgaacaaaactagatctcacttctctacagcaacaacagctgctctggatcaaaaaaaaaaaa

SEQ ID NO: 82977 - DNA, 604 bp, Triticum aestivum
  unsure (1)..(604): unsure at all n locations
  Clone ID: PAT_TA_82977
ctcatctccatcttcgcaacgaccacgaattccacggccaaccaatctctggtctatcgctctcttctcctcgtctttaaatctgagacttttttttgttcgcgtcctccgccctcaaccgtagccacctcgctgcccctgccgccgacacccctgctcgccgttgctgcagccgcacaggcgatggatcatgaagaagtgaccgaattcctgggccaggtgcccctcctgcagtgcctcccgggttcctctatccgcagaatcgcggaggccgtccaggtcaagaactacgaacctggtgactatgtcgctcgcgaaggtgaacctgtcaatggcctttacatcatagtggatggccaggctgaagtttctgcactgcgaatgagaagaagcaaatcgcccagactatgtgtaaataagncgactactttggtatggaacaatagtctgttataagcaatgttgtgacataaantactntnaattgccaanaaatgncattgtacacaaaaaaatggatnagagaaactgacatcttntgacaatttnactngaacacagagcgnnttccggggtattccggggnaanttaggagtttgggga

SEQ ID NO: 82978 - DNA, 280 bp, Triticum aestivum
  Clone ID: PAT_TA_82978
caaaaacatgctgtacagacctcccccagtccctgtaaacaaaagtggataccgtcagtaggctctaggacattactggatgatatctatccagggtttcacctcttgttttttttccatttttgagggattttgttgacaggcgtattggcctgtctcagatgtaatgtaagagggtttccttctctgctcttagcagagttatctcctatgatcttgtccatgagacattggttcgtgtaaataatagtgatgttgtaaccacttcaaaaaaaaaaaa

SEQ ID NO: 82979 - DNA, 636 bp, Triticum aestivum
  unsure (1)..(636): unsure at all n locations
  Clone ID: PAT_TA_82979
aagtctaactagcttaacatggttagacctttcctcaaacaacctctctggttccattcccatgttccttgaaaatcttaccgacttgactatgctgaacctctccttcaataggctcgaaggcccaataccagagggaggaattttctctaataaccttacgagacaatctttgattgggaatgctgggttatgtggttctccacgtcttggattttcaccctgtcttaaaaagtctcacccttatagcagacctcttctaaaacttctactcccagccatcttggtagcttctggcatccttgctgttttcttatacttaatgtttgaaaagaaacacaagaaggccaaagcttatggtgatatggcagatgtcataggccctcagttactcacctatcatgatctcgtccttgccactgagaatttcagtgatgataacctgttgggatctggaggatttggaaaagtatttaaaggccaacttggcagtggtttggttgttgcataaaagtctagacatgaagctggagcatcgatcagaacttgatgtgagtgcaaaacacgcatggtngcacgcacctgataagnnctaanctgtcgacatggctcaaanatggtctgagtcatgcaatg

SEQ ID NO: 82980 - DNA, 534 bp, Triticum aestivum
  unsure (1)..(534): unsure at all n locations
  Clone ID: PAT_TA_82980
ccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaggagacccgcggcgtgctcaagatctttctcgagaacgtcatccgcgacgccgtcacctacacggagcacgcccggcgcaagaccgtcanagccatggacgtcgttangcgctcaagcgccaggggcgcaccctttaaggcttcggcgntaaggcgctaggctaggccatgctcgaaccgcccccattttcgnttgggtcgtactggttcttgancctgtgcgggtcggtcggtggtntaaggtaacagttgctgtgttgagctcctgnnatcgttcntgtgtaaaggaatcaangtgtggatgatnctgtcnatgtcaaaaaaaaaaaa

SEQ ID NO: 82981 - DNA, 372 bp, Triticum aestivum
  Clone ID: PAT_TA_82981
gacatgcctagctggcttccttctaatgtctcgctacttgctcgcttcatccgggagcctccccctataagatcaacagtcacgaaagctgttgcagaatttaagcgcacccatgctgacacatggagcatccagaaggacgcattcactgaagacgaactggaggttctccgtgatacatcttcctcctcgtcgtacttcgcttagattaaaatttcaaaggccataggatattctctggtactggtgttgtgtatatgaatttataactgttgaagtgtcggtgtttttcataaagtatatccttgtacgtacctagttttatttcatcaacagatgccttcgtacaactgagatgaagtatgcaaaaaa

SEQ ID NO: 82982 - DNA, 352 bp, Triticum aestivum
  Clone ID: PAT_TA_82982
aaggcaccggagaccatgtcatagtggacctgaactacctgccgtcgttcaaagaggttcccaactcggaggcggtgcctgcattctgggacgcggtcaggcaggcgtgcgagtcgacgcgcgggaatgcgaatgtccagggttaacctcaatgatcttcccgaataataagtgaatctacctggagcgtagcagagaggagagccgcagtggtgttcactggttgtaatggtcagctgtagctgtgggaataagtgaaatacaatccgccaagtttagctgtcgatctcgtcgccgtggtgtattctgtcacgatgtcagtttcatgtgaatctgctaactgatggttcac

SEQ ID NO: 82983 - DNA, 542 bp, Triticum aestivum
  unsure (1)..(542): unsure at all n locations
  Clone ID: PAT_TA_82983
cccatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccacttccacaagaccccgaccgcgagtggttcgagaccgacgcggtgctcanggtcagcctcggcaantcctcttctnaacatcctcgccgtatatggccggataaaggacagaagacccgtgacagatcacacggcggtggtggcaaaatctctgcnggtatcatctctcctatgtctcggccaacgggtcgta

SEQ ID NO: 82984 - DNA, 523 bp, Triticum aestivum
  unsure (1)..(523): unsure at all n locations
  Clone ID: PAT_TA_82984
gtcgcttcggaacttgagctctatgatccttgacgcgagtgagctagccgtgttcttcagaagctaccctcctcgcctctactcgcaaccctacagcatgcacctcctgctaggcaactgcatgttcggcttccagttggaaactgagctcgtcatgaacttcctactgcacgcagaaccacctcctggttctgaagcactagacgtcctaccgatcgttggccctatatatgtcaaatgggcgggcctggcacggctgggcacggcacgacatcgtcgtgcctaggcacggcacgccagtgttacgggccgggccgggccgggcgacacgtgggccaaattactgcgtcacggacccnactattaacagtcgggccggccggganacggtacccgttagtgcctgtcggntcggccnantacctaatacacataataatcaatttatagaaaaattaatncacatcaaacgaaatatncanccattancaactantcattattaacatggacaggcantggg

SEQ ID NO: 82985 - DNA, 528 bp, Triticum aestivum
  unsure (1)..(528): unsure at all n locations
  Clone ID: PAT_TA_82985
aaggcaccgganaccangtcataatggacctgaactacntgccgtcgttcaangaggttcccaantcngaggcggtgcctgcattcagggacgccgtcangcaggcgtgcnantcgacgcncgggaatgcnaatgtccanggttaacctcaatgntcttcccgaataataagtgantcnacctggagcgtnacatagaggatagccncaatggtgttcactggttgtaanggtcagctgtanctgtgggaataantgaaatacaatcccccaattttagctgtcgntctcntcnccgtggtgtattctgtcacgatgtcatttcatgtgaatctgcnaatgatggttcacaaagtgnaggtgganaaaaaacccatggggggccggtacnattcgcctagagtganccaattacgnnccncacggcngtcgttttaanctccanancggaaaccctgcnttccatttaancncntgcagaaacccctttgcagntggntatatgaagngccacacgatngccttctnt

SEQ ID NO: 82986 - DNA, 522 bp, Triticum aestivum
  unsure (1)..(522): unsure at all n locations
  Clone ID: PAT_TA_82986
ccggcctactccaggtccccaggtctacgtcggacccttcgccgcggcgaacaccaccagtcctcttgtcagatggcgagcacggggcggtcgatgctgctgtcactgctcctcttcgcagtgacgctgtcgctgctggagatgtacagggccaagttcgcctcgtcggagctcatgaccattgccggtggattcgtctgctccctcctattcctgctactcctcacctttattggaaactatcaagaactagtggagatagaactgggtggggtgcattgttgtagcacaacttgtactcttattgtagccggcactgtccaccgtgtctgtatcacaacatgctcctgntttccgctggatcctttacgagttgacaantctctggatgntcttgcnaggatgatctaaggtgaggcggactaaccacagaacacacagagagagataaccatntttatgttagngacnattgtattcaaacggattttggtcncctggcataagctttctgcaacanaa

SEQ ID NO: 82987 - DNA, 183 bp, Triticum aestivum
  Clone ID: PAT_TA_82987
gcaagcagagagacagggtctgtagaagtagataaggtgtaatctctcgtcaagctgggttccagaatctggattgtcctcaccattcgtatgcattgcattgtatttgctttcctcttgtaacctaatgaaccactgttttggagggtatgatcgcgcaagctgacaaccaaaaaaaaaaaa

SEQ ID NO: 82988 - DNA, 535 bp, Triticum aestivum
  unsure (1)..(535): unsure at all n locations
  Clone ID: PAT_TA_82988
ggcaacccgatcatgcatgacaacaggaggccccggtacctcgccttcttctacagcaactccacctcctttgtggcgtccattgttgtcatcgtcatgttgctgccgcantggctggataagaataaagaatggtcgcttaaggtcatgaacacgacaattgtgctggatttgcttgccctgctagtggcatatgcggctggatccagcagggggtggaagacatctgtgtatgtcatcgcgctgatcatcgccgtcctggcctacgttgcaatccatataatgctggcattgttatgttctcgttctcatancgctgtcattcctcggcaaaggactccaggcgcccangcaattctcaatcanaggagcacgcgaggaatcaggcacaattgctgcatgtcaacaccttgattacagtgtgtttgtggtcgtcatcaagganggtgctttnccngtaaaaaatttccaattgnccctgattgattantgtttangtaataaaataaaagagggatgtgtgtggctcctttat

SEQ ID NO: 82989 - DNA, 526 bp, Triticum aestivum
  unsure (1)..(526): unsure at all n locations
  Clone ID: PAT_TA_82989
agacgtttcagacagcttgctttgtactgttttgaacagtgtctgaatgtctaaaacgtcttataaaaatgaacacaggtagtactctgcttactaattgataaaaatggatgtgtgcaacaatgatgcagagaccgggggtttgaacctcctttctgaaaaaatggttgtgcactgggacgtagaacccattcctgttaaattcatattccagtttgatgagttattctttcaggggtatttcttttaggtgtagaattagaattcaagcatgccaccatgtttgctctaagaatttgaaaattcatatgttcattgaataaaaaaagatagctacattctcggcttgaggtggcataagntgtcataatgcagattaattagaacattatatattgaacccttaatattatacaaagatacatagcggtcatacacacgatggagncagaacaactgttagtctaactgtccaactaatttatagaacctcacagtgacaggtgggctgatcctcngtcgtggg

SEQ ID NO: 82990 - DNA, 581 bp, Triticum aestivum
  unsure (1)..(581): unsure at all n locations
  Clone ID: PAT_TA_82990
ttttttttttacattgtcgaaggcataccagtgtcttctatgattattaaaaactcgccttgattaatgtaaaaaaggacaagccctgatcatggtttcatgtcctcataaaaacaaggcttaattaaggcgatggtactctggtacaaataggcatgtgaaaaactgcatcggcagtttcccattacagatactctggttgacgaggcgccaccgtatttcacttcttttttcctgcttttgcatcaggcaccaaagacctgacacaaaggcgaggtttggtcgagatgagttcggctgggagaacagacaccccagccaccgaagatccaagaggtacccggaaaccgggagcatctcaacgagtaccgcaacctcaggcgatctaagatcaaccactgagttctcagcaacggnttgacagcagcagctacactttgaaacattgctcccatcatcaaatcgctggttgaacctcatacgtctctcgtccacaagccctcatataggaacgcaaacttaangctgctcgttgtctgccctcaggggggccgnaccaatcgccaaaggancnatacccc

SEQ ID NO: 82991 - DNA, 578 bp, Triticum aestivum
  unsure (1)..(578): unsure at all n locations
  Clone ID: PAT_TA_82991
cccaagtctgtcattgaagtccgcaatgggttcacattccttgaccttattgtgattcaaatcgagtccctgaacaagaagtatggatgtaatgtccctttacttctgatgaactctttcaatacccatgatgacacacagaagatcgttgagaagtattccaactccaacattgaaattcatactttcaatcagagccagtatcctcgcattgttaccgaggacttcttgccacttccaagcaaagggaaatctgggaaggatggctggtatcctccaggccatggtgatgtgttcccctctttgaataacagtggaaaactcgacatcttattggctcagggcaaggagtatgtcttcgttgctaactcagacaacttgggtgctatagcgacatcaagatctgaaccatctgataataaccagaatgaatacgcatggaggtactcaaaaacattggctgatgttaaaggcgtaccncatctctacgaaggaaagtcagctttggagatgccantactgatacattgaatgagttaatcacnagaattangatatcacactacactntggtgact

SEQ ID NO: 82992 - DNA, 564 bp, Triticum aestivum
  unsure (1)..(564): unsure at all n locations
  Clone ID: PAT_TA_82992
cgggcacctacaccaccgtcatcatctccttcctccgcggcttcggccacggcgccgcctactactcgctcgacctctcgggccacccgctcgcgggcgtcggcgccgacgtcaagcactgccaggccaagggcatcctcgtgctcctctccatcggcgggccgcccaacaccaacaccggcgccggcgccggctactccctcccgtccgcgcgggcggcggcggacctcgccgcgtacctgtgggacgcctacctgggcggctcgcgcgcggggctgcgccgcccgttcggcgacgcggcgctggacggcgtcgacctgtacatcgaccagggcggcgtcgacggccactacgacgagctggccaggcgcctctacgcctacaacaggagtaccgcggnagctcggggtgacctacggcacggtcggtggcgtaccggaccgcgcgcgcagcggcgctccanggggtcgttccgctcantcgctgtagggactaagtcactggtccacggaggctggaaaatgggccgcgggtaccggcancgcgnttctcggntctgggtcc

SEQ ID NO: 82993 - DNA, 565 bp, Triticum aestivum
  unsure (1)..(565): unsure at all n locations
  Clone ID: PAT_TA_82993
cgagtttttttttttttttttgtatgaacggcatcggtgtgcttattactgttgttcggttcctcagaagacagtcaaacaagacaaccaagtaggaggggggaggggacgggaaagccgcgaggaatcctacggtattgctaagcctgctcctgcacctgcacctcgttcgtcctccagcccaagcccagttcaggagagaacggccatcagatccgacgccctcagcacgatgtagttcgtgccgtcggcgcccttgaactcgctgccggcgtacttggagtacaggacagtgctccccgcggagacggacagcgcgagcctctcgccatcctcgtccagggggcctgggccaaccgctacgaccgttccgataatggttctccttggagtttccgtaagcagtangcctcctggagttttgtcttcagcttcagnaccttgattaaaacggtcgttaaaggttcagtcttacgtcatcanttcaagatactatacgtcaccncttgaaacaaatggtgtatcttnacgcgactcggtcagcgtcttagatnaaactgacnca

SEQ ID NO: 82994 - DNA, 532 bp, Triticum aestivum
  unsure (1)..(532): unsure at all n locations
  Clone ID: PAT_TA_82994
cttccacctttgtccgttgtctctaggcaagtctacacccgccggtctcctgctcttcagatctgcccatcctccatggcacctccaccgcaccgccacctgctgctgctcctccttctactccctctggtcctcctcgccggcacacccgccagcgccgatgaccttgtatcggagctccaatctctccgcgcgcggtccccgtccggcgtgatccacctcaccgacacctccgtcacccgtttcctctccgccccctccgcgcgccgcccctactccgtgctcgtattcttcgacgccgcttcgctccactcaaagcctgacctccacctgccccagctccgcaccgagttcgcgctcctctccggctccttcctcgctcacaacccgattccggcgactctcttcggcgaatcgattcgccgagtcnagatccttcacagttgggtcactcgctgcccatatcggctatcgtccgntangcacctgnggatcgacaattgnantccattnggggctcccgatcatgcga

SEQ ID NO: 82995 - DNA, 579 bp, Triticum aestivum
  unsure (1)..(579): unsure at all n locations
  Clone ID: PAT_TA_82995
ctcagctctgcagttgtgatctccgtctccgtctgctacccacgttaatccccacctgatattatttattccctgcctgtccttgccgggcccttttcttgtcatccatactcaactccaccgctcgtcgtcgcattcataaacaacagcattcatcatgcatcgcacctattctatgcgccagactcgggcgcctactgcctctcagctccagaaccccccgccacctccgtcgtcgacaaaatccggccgcctcttcaagagcagcttcggacatgcccttcgtcgcaatgctggcggtgcctttggccctgacttggccaagaagctgtcccagctggtcaagatggagaaaaatgtgatgcgaagcttagagacgttgcccgcgagcgaatggaattgctcaacaactatccatttggggggaggtggtgacgaagatttccgacgttaccgacaactcggtgtctcttacantnggcgancttgagacatattcaccgtttgacagtcaggtcactataagataccgcacatgaactcgttancaagcgtgacgaananaagtnatgatagtnc

SEQ ID NO: 82996 - DNA, 571 bp, Triticum aestivum
  unsure (1)..(571): unsure at all n locations
  Clone ID: PAT_TA_82996
gccggtttcgcttaggaaccagaccgtctggttccacaatgttctacgacttcttggctcagctcgcgagcagaggaagaccatggccacctccctcttcctcgtcggagagatcggagtcaacgactacttcatcggcctcaacgagaaccgcaccgtgggcgaggtgcggaccttcgtgccccacgtcgtcggtgccatccgttcggtcatcactgacgtgatctccgccggagcaggcacggtggtggtgccggggatgataccgctgggctgcgagccgcagctgctcacgctctacagaggcagcgtcgacgccgccgggtatgacccggagtccggctgcatcacgcgtctcaacgacctcgcccagctgcacaaccgcgagctgcgccgcatgctcgccggctccgacgagcccacccggcacggcatcgtatacgccgactctaccgagcatcaccgacatcgtcgtgtccccgcgcatacggttaagacatccgctggacgntctcgcngcggcgngcataaatacacaccatcttcncgngcgcgggacgggcgtcgnaac

SEQ ID NO: 82997 - DNA, 570 bp, Triticum aestivum
  unsure (1)..(570): unsure at all n locations
  Clone ID: PAT_TA_82997
ccgcgtttggcggcgtcgaatacgcccggggtcctgctgctgctgctgggtcagtgacaagtgaagaagaagtgagctctctacatctttagctaatcggaggttttttacttgttcgcgtgctctgctcgatcgacccctcgatgcggtagggcaggcagcaaccagtagtacatctggagcagcgtagatgaatctatacgtgtgctttctctgtttgtgctcttcacatatattttgtttgcttgttgatgcgcgtgtggtagttgagcggcatggatagggatcagaggcttgaatggctgtggaggaatacccgggagacttacgacgctgcaaagaaaggctgctgacgaactactacggcaccaagcatgtgatcgaagcgttgctgcctctgctccgagcctcctctgacggagaatcttaactctctccgacttgggctgcttaaggtaacttgttctgatacacctgggctcaaactctgatcaaggataactaaatttgcatccgttanagcaattacgcatccaatgaaaccantctcgaaacaggactaacagactc

SEQ ID NO: 82998 - DNA, 572 bp, Triticum aestivum
  unsure (1)..(572): unsure at all n locations
  Clone ID: PAT_TA_82998
ggaaaaaggagaaaacgaaaaggcgcagggaaaacaacgcaccagcaacagcagagagcaggcgcacatcaactcatctaatctcctcatcaagctgggcgatgcgtgtgagcaggcaggcggttagggcgaaaatctgagaagtccgggagaatctccggactgacctccccgtacccgtcaaaaatccaatcttgacgcctccctggtcgagccgagactgttccaaagtttctgtctctgtgatgcgtgattgtttgccgctgctaatgaggcccgctcgcctgatccccgtggtcgtcgtcgcccgttaatccgcttcagctctggttccggttcttggacagattttttcgcccctcttggttgtggattgcgctgtttttgtttgtctggatctgcataagggcgtgggccgattcgccaccaccacaagcagagacgntcctctttttaatgcctccacagtgggatttgcttcgcgttgttcagtatcatctattctgcgatcatctcaaggctccgtttgtcccgcacttancttcgctgcccatctccacacgaatcgccct

SEQ ID NO: 82999 - DNA, 435 bp, Triticum aestivum
  unsure (1)..(435): unsure at all n locations
  Clone ID: PAT_TA_82999
ngcccgctgagaaacanactcaccancaaagtgacctgaaactgggagcaagcaaccgagggcgagagccatggcgaagcctcgcagnggcngcggcggcggcctcntggacttagaggggcactacgccttttacggcgcctaccacagcaaccccgtcaacgtgggcatccacgagctcttcgtgtggcccatcttcctcaccgcgctcatgctcctccacctcaccgcnccctccacncacgccgccggnatcagcgncgcggtctacgcggcctactacntcctcctcgaccgccgcgcgggcgcnctcgccgncctcctcngctacctctgctgggccgccagcggcgccctctctgcccgcctcggtttctctgntggatngaaggttgtantggtggccagttgttctgttggttaagcattcattgg

SEQ ID NO: 83000 - DNA, 567 bp, Triticum aestivum
  unsure (1)..(567): unsure at all n locations
  Clone ID: PAT_TA_83000
gttttcggttccgctcagagtcataagccaggtcagactaggttagggtttacctgtgaggcctgctcccctgccgccgccgccatgggacactccaacgtgtggaactcgcaccccaagaactacggccctggatctagggtttgccgtgtgtgcgctaacccccacggcttgatccgaaagtacgggctcatgtgctgcagacagtgcttccgcagcaacgccaaggacattggcttcatcaagtaccgctgaaacttggggagctccaaagcatggcaataatggaagcatggatggggacctaaaagatagcctgtactcttattcttatgataaaacatgtaatgaattgtttggctttgtgtggacgaagttggtgtattcaaatggtactcctgaatcttgatgctcctgctagcaactgacattcgaacgctatgatcagcatacagtatcatgttacaccaatcttgttaaaaaaaaggggggccggtaccaattcncctanatgatctataccgcccacngcgtcgttaaactctgacggaaacctgntaccaanta

SEQ ID NO: 83001 - DNA, 572 bp, Triticum aestivum
  unsure (1)..(572): unsure at all n locations
  Clone ID: PAT_TA_83001
ggaagcccaagcatcttgatctggttttgtacatggggacagacattaaggaccgaccagctcaccatacgcaaatactactggcaatctacttaaaggaagcatgcatataaatcaccgcctgcatacacagttacactacacacacgccacgttccaacgcttcactcaaagaacagggcaggcagggatgctaccaantaccatcantacnaccaactctcgcaactgcgcttctanatactaagaanntcctgctgcggcggcnantcgtgtggcccttcctgctgctgctgctgcttcttctccgggcccccgtcctcctccttcggctcgatgacanggggcacgtctatggacntcgtggatgtcgagccgggcatgtcggacagtatctgcacgactcgcncatcgtgggccgctccacgctctgctccgncacgcacacatggngacgtaaagactgggtaactctacagagnangtcagagcgtgggtcgtatctcacacgcctccttgtcacccgtcacgtcgcaccagtgacgatgtcacgcgtcgccaaccccgacggn

SEQ ID NO: 83002 - DNA, 577 bp, Triticum aestivum
  unsure (1)..(577): unsure at all n locations
  Clone ID: PAT_TA_83002
gacagctccatcgattcatccaccgctatctctctctctctctctctctctctctctctctctctctttcaactgtaagggaaaccgagctcaaagtggcaaccatcaatggatattatggcgcttaatgcgagagacgaggagcagtacgggaacaaccatctcgggctcgggctgagcctcagcctcggcctcggcgtcgccaccgcggctccggtcgaggtcgagcccccgccaccgccgcggcagcagcagcagcgagctatcagcgtcgcgcccatcacctccctccccgcgccgcagtggtggaagtggaacggcccggtctcttcttcgggacgacaatggatcagcagcagcagccggcggccgcgcgccacggccacganatgccgttcctgcggggggtggacgtgaacgggccctgccggggatacaagaggggtactgcagcaggacacangactggcggccgtctctcgnaaacanacgctctcaaagctcaggggaagcccactcggnaagacggggaaagtggcgacacacccgaaaccgagnggacacacaggatcggggg

SEQ ID NO: 83003 - DNA, 544 bp, Triticum aestivum
  unsure (1)..(544): unsure at all n locations
  Clone ID: PAT_TA_83003
atcgcaaaacccagcgccccaaagcgaccccaccgaagcgtcccagcccgaccggaatggcgatggcaccgtgcgcacccgcctccgtctcctccttccccgcccgcccagtgcgggccccttccgctgtccggccgcgcgccgccgcgatccgcgccactgcggcggcggcggagggtggcaggtggtgggcgccgctgctggggtggtcggggaaggccgactaccttgaggccccggccccggtgccggcggtgctgcaggatgacgacgcggccgcggcgcgcaggcanttcntgggggggctgacggaggaaaaggccgccagctgcgggcgcggntggcgcaaacggantcttccacgacccatgtccactccgnatcgttcaccctcgcncgctccgcctaaacggcggcggcggaattggcgcccttatattagactcnccgnttgttanacngttcccnattcggggattttttcanaccatgtctctctctcttgacagngggcaggattgcggttatagnnccaccnccncca

SEQ ID NO: 83004 - DNA, 551 bp, Triticum aestivum
  unsure (1)..(551): unsure at all n locations
  Clone ID: PAT_TA_83004
ccgactgaaactttcacggacaggcctccaacgtcagatggccctcctgcaccaggtggtcctgctaagggagcatatgttcctccaaccatgagaggaggtgctgataggactggagactcgatgcgccgcaggaacgacgagaattccgtccgtgtgaccaacctctcggaggacacccgcgagcctgacctccttgagctcttccgtgcctttggccctgtcagccgtgtctacgtcgcggtggatcagaagactgggtcgagcagggggtttgggtttgtcaactttgttcacagagaggacgccgagaaggcatcaacaagctcaacgggtatggttatgacaaccttatcctccgantcgagtgggcgacaccaaggccattanttgccgctacctgctaaatccatattcgttaantatacantatgttgttgaaatacgggacctgantcataattatctgttggaaaactgttatttggttggtggacaaaatacataccgctcttanatgagtcnaagcctttgtgtacaaaaaaaaaaaa

SEQ ID NO: 83005 - DNA, 563 bp, Triticum aestivum
  unsure (1)..(563): unsure at all n locations
  Clone ID: PAT_TA_83005
attcagagtgacctgttccaccaggcgtccaagcaacccggccggctgggtggctcgtcgtcgtagaactccttggtggccgggcgcgcggcgaacgatcgcctatttcagctgctgagcgggcggctgatcggcggcgttccacggcttgggttacctaccactaccaacgacggaacggaaccggccgggccggcggcatggcggcgtggatgcggtcgctcttgtcgccgctcaggaagctctggatccgaatgcattcggcgcagaacaagaaggggcggggcatctacatcctgtacgangacgtcaagtcgtgcccctgcgaggacgtgcacatcctctggtcatcctcgtcgactcgtccactcccaccgccgccgctgtctctgcgcctcaagcactgactgactcgtcctcctcctgcctccgacgaacagacgtcggtgtaatgaagatacacagtggcggcagtcacttctctcagcgcgcatacacatgcttcaccgcggaagantccttgttnnataggaatnatactctcttacctgcccgcctctcgg

SEQ ID NO: 83006 - DNA, 365 bp, Triticum aestivum
  unsure (1)..(365): unsure at all n locations
  Clone ID: PAT_TA_83006
ctgcangtggaacangaaaggtccactactctgctgatgacgctctcatactanagcaaanagcccaggatgttctgccttacttggatggccgttgcgtttatcttgttggnatgatggnttcangcaanactacanttggnaacgatactanccganatgttaggttattcgttcttcgacagtgataagttggtaganaaggctgttggtatttcatctgtngctgagatctttcagctccatagcgaancattcttcaganataatgagagtgangtcctgacngatctgtcatcaangcatcngttggttgttgcacccgnacgtggtgcattgatccgaccaatcaattggatgttaca

SEQ ID NO: 83007 - DNA, 495 bp, Triticum aestivum
  unsure (1)..(495): unsure at all n locations
  Clone ID: PAT_TA_83007
ccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtcatgtcatgtacnannatggctcnagggggggcccggtaccaattccccnanaggatcnnttaccgcctangggccgtcttttaaactcgtacnggaaaacctgngtnaccaantancgcttgaanaaatcccttcncac

SEQ ID NO: 83008 - DNA, 581 bp, Triticum aestivum
  unsure (1)..(581): unsure at all n locations
  Clone ID: PAT_TA_83008
cgaaatctcctctcctactctcgcgaccaacgtccaacaccaactaacccgagcagctcagtcaaatcaccaagccgctacaatggttaaccacagagtcacctaccgccgccgcaacggctggaacactcgatccaacaccacgaggaccatccgtacacctggtggtgagctccgtgtgcttcacatcaagaagcgaggcaccgttcccaagtgtngtgactgngggnccaacnctcaagggttcccgcnctccgaccccgcgagtactctcagntctcaagccaaaganaacttcacagcgccctagggtggttcccgatgcggcggtgtgtccgcgaccgtatcgtccgactttcctcattgaggagcagaagtctcaagaagtgctcaaggacangacagancagagaagaataatgatcncaatgcnagttagcttnccttggaaaggaaggatctangancggtcatgcttgggtcataggaaaaaggatgatgataatcggcgtgcaaatggtggcgtcgcgtctagatgcacancccntggacttatggaagactaactgaaaaaaaaaaaa

SEQ ID NO: 83009 - DNA, 470 bp, Triticum aestivum
  unsure (1)..(470): unsure at all n locations
  Clone ID: PAT_TA_83009
gcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcattttgtcaactctgacattgctttggntttccttctccatttatctttcctattgttcctaagaatatgtgtatgtccatgttcatgtaccaacatggctccgagaaacatgctcgtatgagaatgctatcggtggtattatatgaacggccataatatatacaatattcgacatatactttaatggnacaaaagaaaaaaaaaaaa

SEQ ID NO: 83010 - DNA, 342 bp, Triticum aestivum
  unsure (1)..(342): unsure at all n locations
  Clone ID: PAT_TA_83010
cntatcaacatggtggnaaacangctggtcggcatgaactcacntggggtctatgacacccccggtggcactatcatngcagccgcggtangcgagttggattccntgnccctgcanagggagaccatgcagtgaaangacatcattgccctcaagtacgccgagctggtccangcnggccgctggtttgacccgctccggnantcntttgatgccttcatggagaatgttaccgcnangaccantgggttcantgaccctgaacctgtnnaagggntccgttaacatcgcntcncngaagagccctanacctgtncatnaaaatactcctcctntgacaac

SEQ ID NO: 83011 - DNA, 194 bp, Triticum aestivum
  Clone ID: PAT_TA_83011
ttatcttatccctagctaagctacctgtgatagcttaattttcactattgttcgaggtttttggcacgttatcggttgtcctgctggccaggctataagtctggtttatctgttatgtttaccctttttaacagtttgtcgttattattcgtaatggtaaaaatgtagtacatgttttgcccaaaaaaaaaaaa

SEQ ID NO: 83012 - DNA, 221 bp, Triticum aestivum
  unsure (1)..(221): unsure at all n locations
  Clone ID: PAT_TA_83012
gaacttctgagcaaacagtanatnaanagaacttccaagaggacaatgannatggtgangaacaacctttagttatngactcgttctaggcgacttcgaggcanaactattgagccagcagaaactgttcaaagggctgacagcccgccctcaagtccccaacctcatgttcaaattggncatcancgtaatgtggggtttccttcantanagtggggtgg

SEQ ID NO: 83013 - DNA, 576 bp, Triticum aestivum
  unsure (1)..(576): unsure at all n locations
  Clone ID: PAT_TA_83013
ctcgtgtggtgttgaagaatgcgcccattttgctgcttgatgaggccagctccgctatcgaatctgagtcgagtagggtggtccaggaagcccttgacacattgatcatgggaaacaaaacaacgattctgatcgcacacagggcagcgatgatgaagcatgtggatagcatcgttgtgctaaatggtggtaggatcgtcgagcagggaagtcatgattcgctggtgcagttgaatggtttgtacgtgaagctgatgcagcctcattttagcaaagggttcgccagcgtagactaatatagcggctctggttgtagatggtgtacattaacccgcccgtggagctaactaatcactctgcttcactgaccantgccctgtggccatcctttttttttcttcctttttggaatcctaattcttttcaatgtgtgtttggngatcacaggctgggaagggttaccgtcgggtattttgtaactattttcnttggggaaccttaaaattgnnctgcnatcnggttgggtgtattggacngattgtattgaacanncatgtggagagaacccacnttttc

SEQ ID NO: 83014 - DNA, 465 bp, Triticum aestivum
  Clone ID: PAT_TA_83014
catcgattaagcatgtggtgtgaagcagaggaaaacaagatcaagcttgctcatataggacaaatgcgtactgaagacaaagccactccgagagagccaggggagcaagcagagccagcagagccgcaacatagtggccgtatgagattctgagctgtcagtagcaacgccaatgttagcgaaaccgttagtagcttcagcagggtttctagaaagcatgggtcttctcgcgtatatgtatgtatatgaatataatgctgcttgggtgaaaatacaagtgcagcagaatcgacatcctgcatccgcatttcaactgggagctacagttatgtatgtatatgggagactgctgtgttctgcatgaattcaaagtgccgggtttttgtaatacctttggcaataaaatcttgtacccgttactactgccttaacaaagataaagatatgcatcttaaaaaaaaaaaa

SEQ ID NO: 83015 - DNA, 317 bp, Triticum aestivum
  unsure (1)..(317): unsure at all n locations
  Clone ID: PAT_TA_83015
tcaagctctcccgcgccgagctcgtccgcctccgttcgcaggtccccgcgcgcgagggcgcgccgcggttcagcacgtacgctgtgctggcggcgcacgtgtggcggtgcgcgtccctggcgcccggcttgccggccgaccagcccaccaagctgtactgcgccacggacgggcggcagcggctgcagccgccgcttccggagggctacttcggcaacgtgatcttcacggcgacgccgctggncaacgccggcacggtgacggccggggtgaaaagggcctccgttntnaacccnttnngaccggtggnncaaggt

SEQ ID NO: 83016 - DNA, 276 bp, Triticum aestivum
  unsure (1)..(276): unsure at all n locations
  Clone ID: PAT_TA_83016
aagacaagatagatatcaaccatttcttcagcatcttaagtgatattatccgttactgagcccgcatggatcctaggtatccagtgggaggttatttgcacctgtgcttcatcaccccttgtggcatccttacagcgtgttaagagtggtttgatgtgttgtttttgttngngccgcctactagagctgttggatttgaccagaggcgaattccacgatatagcgttttttgtattgtatgacgatgtttctacagttgataataggatccagcta

SEQ ID NO: 83017 - DNA, 200 bp, Triticum aestivum
  unsure (1)..(200): unsure at all n locations
  Clone ID: PAT_TA_83017
atgaatgcgtgaagcattggatcccaaagaactccaaaatgcgataaggccttgaatggactagtatcaggattgggagaccatcctgagaagctccatcaagcatgccttgttcacgcgtttcttaagaggcccttttcctgcactgttgatggttgcccctttagctatagcaggaaaggtnnattngacaacatttc

SEQ ID NO: 83018 - DNA, 350 bp, Triticum aestivum
  unsure (1)..(350): unsure at all n locations
  Clone ID: PAT_TA_83018
cccaagcagaagcatgactaagcttcaaaaagctacaagggatgcacctgatgagatctatggtgcagtggtgaagcagaattagtatagcctatgggactatgggggaagaattcatacataagtacaatctctgtaaacaaacaaaagacattttagagacttgcatcaagtctgtctctaaaacatcccataattgtttacagagggagtaattaataatccgggaantcatattgttaacttaanaatnacananttgttagcttatgattancacgtccatatnttatgatcancnnatccggtttncaatttccaaaaatataaattgtancaatcaaaaaaan

SEQ ID NO: 83019 - DNA, 356 bp, Triticum aestivum
  Clone ID: PAT_TA_83019
tctcagttcaaaagggctgcaaccacagctgctccaccagatgcacagctgtcaaaggacatatgctttgctcttgctgacaaggcctttgaccctcgggtcctcacgaggatctctgataagctgcaactgcacagcatggccgatatcaagaaagaatccctcgccctgcatgagatggtcatctccagcggcggcgaacctgatgcctgcgtcgacgagatgtcctccttgctcaagaagcttaaagactgcgtcgtcactgaagcccccaccacagagacgcccaacgcccagtctacctccataaagcatacatctcctatcatccctgatgaattcagatgcccgatatc

SEQ ID NO: 83020 - DNA, 555 bp, Triticum aestivum
  unsure (1)..(555): unsure at all n locations
  Clone ID: PAT_TA_83020
ctcanttcctcgcccacgctcnccgtgcccgccacaagcgcactttctctgaggatgaccgcatccaggntcangagagcaccaagaacgttgaggaaggcnacnccagcgatganagcgagcctgangatcctatgatgctccagcgtgaggccanngactggnanacccangaccactacaagattctcggnctctccaantaccgatggaangctactgaggaccatatcaagaangctcaccgcangaaggtcctcaagcaccaccccgataagaangcgcccanggccgtaccgaagacgatcattcttcaagtgtatccagaaggcaccgactccttcttganccatcaagctcaccantcnacccgtcgatgacgagctgattccaccccctacaagaanatccagaanacgactactacaagcatggncaaggctccattctgagtcctctcaagaacaccgtccctcatcggatgccanccacaagacagtcaagagtcaaactttggacaactcacagtgaaactcntaccacagnttccganaa

SEQ ID NO: 83021 - DNA, 548 bp, Triticum aestivum
  unsure (1)..(548): unsure at all n locations
  Clone ID: PAT_TA_83021
ccgaaactcgtccatttaaccagggatccagacttacagctttcgagttagttcatgaaaaaatacctgcaacactgatagcagattctgctgctgctgcgttgatgaaacaagggcatgttcaggctgtcattgttggtgctgatcgaatagcagcaaatggtgacacagccaacaagattggcacatacaacctcgccatctccgcgaagcatcatagtgtccagttctatgtgtcagcgccggtaacttccattgatctctccctcccatctggggatgagatatcatagaagaaagatcaccaaaggattgctgaacctgaangtggctgggaaacaattgctgcaccggtatacatctggaacccactttcgatttactccagcaanctgatcactgcancataacagaaaggtgtgntcacaaaaacgagctgagntcttcgacacaaagtccttcgccccaaaaatatctacgtggctccatccgatgacantctggtcacacgtgtatcgttcccattaacacataaaaatattcccang

SEQ ID NO: 83022 - DNA, 528 bp, Triticum aestivum
  unsure (1)..(528): unsure at all n locations
  Clone ID: PAT_TA_83022
ggactgtaaaaaatcaagctcttcttctctcctcgaatttcccagttctcacaacgaacacatataatatccgtgcagtgcacatcatcaagaggtaaaagtacaagtaaagatccgcgaccgagacaacgccatttatctcactttgccggcggccccggccacgtgctgatccgctccttcncgtacttgacgaacagcgcngnggccgcagcgacggtgtacgcctgcaggaacagcgtggccggctggtggtacttcaccagggcctgcccggagcccagctccacnagcagcaccgcggngagccccagcgcggccagcgcgccgttgagccgctcgctgtacgcggtgaanccgagctcgacnggcgcgcngagcgccgaccgnggctcccgcaacggcactggcggnatcgtcacngctctggntgacgcgacgccgcgtcntctctgcgcgcccannttcttgggncgacncngactnatcntagatcgctcncnaatatntcgngtggntctggtggcg

SEQ ID NO: 83023 - DNA, 571 bp, Triticum aestivum
  unsure (1)..(571): unsure at all n locations
  Clone ID: PAT_TA_83023
gtggtttcatttcagacgagttcagttactagtgtatcaggagccataccagtttgtctagacacttccagtggaatgaatggcaatatggcgatgttgaacactacaacttcaacgattgtatccactggttcaccaaacatgagtgctgagttttcttgccagaacctcaagtatactgcaccgttggctgtggagtggtcctatccggagctgcaattgttgaatgatggcctcaacaagtatgcaaatgaaccaggaatcatgaattacataaagatagcagccacgttaccagacaagacantaagaatgttgccatgagatccaatgggatggcagcgagaaaagaactacaagacgacggaacctgaagaacatacttgggaaaaagataaaagatagaaagataaaaggctgacctcatcatggggtacaacccctgtcagactgagatgaagtcccctctagccgctaaccaaacacaaggttctcctgcagatctcaaatgatcatggatgcaaatatatggagaaatcaagcaccatcaatnaataatattacatncagc

SEQ ID NO: 83024 - DNA, 578 bp, Triticum aestivum
  unsure (1)..(578): unsure at all n locations
  Clone ID: PAT_TA_83024
tctcgctccgccgccgccgcctccctccccagtcgatcaccaaacctcagtccaaactccaaacccccgccgcatcagaaaaaaaccctaggccatggacgccgcggcgctggagtcgctcatcctggacctccacgccatcgaggtcgtgaagctgggctccttcacgctcaagtccggcatcaaatcgcccatctacctcgacctccgcgcgctcgtctcccacccgcgcctgctctccgccgtcgcctcgctccttcacgcgctcccggccacgcgcccctacggcctcgtctgcggtgtcccctacaccgcgctccccatcgccgccgtcctctccgtcgaccgctcaatcccatgctcatgcgccgcaaggaggtcaaggccacggcacgccaatccatcgagggtccttcagcccggggacacgtctcatcatcgaggactcgtcacatgggctccgtgctcgagacgcgcccgctcgcgccgagggtctctcccgacgcgtatcgcgtcnacgcagaggtggaaggagactcncgcnatggatanctgancgtataactacgagtgtggcg

SEQ ID NO: 83025 - DNA, 170 bp, Triticum aestivum
  Clone ID: PAT_TA_83025
tctcagttcctcttgtgctgtgcttttgtcgacaagttgtggacctgttgaactgttgcaaatccaaagcacgcgaagaccgagaaaacaaagttgaattgaggctgtgaaaaaagttttcttttattattattattattattattattattattatcaaaaaaaaaaaa

SEQ ID NO: 83026 - DNA, 572 bp, Triticum aestivum
  unsure (1)..(572): unsure at all n locations
  Clone ID: PAT_TA_83026
gttctggctcctgcgcgccgccagccgtcagcccgtcaccgattggagatccttgggacacctgcgcgccgccagcccgtcaccgcttggagacccgcgcagccgcgcttccctgcgcgccgccagccgtcgccgatccgtggccgcgtccgccgccgccagccctaaggtcgcgccgtcagccagcccgtctgccgtcgtgaggaatttttctggtaatcaagcatggcactgtcatcaatgtttaagagaataaatgtgaaagatttgacctccaaggtttcagtctataccagtgctacagagttatctggtggactaaacatgatatttangcgctgggccacgaaaaggactgctggtcaacaaaaaatggtcgcgattccaatccaaagtattgggggtaaagaatttggtggagagaaatactacaaggaacatcaatgtccgccaaaganggaccgcttcatctggaaacatttggatggcaagatataactttctgcctaaagaggattcccttgagcgaaaaatccagcaggaatggtcagttntcaatgctggnanatctc

SEQ ID NO: 83027 - DNA, 559 bp, Triticum aestivum
  unsure (1)..(559): unsure at all n locations
  Clone ID: PAT_TA_83027
cttgagtcgtcgagcgaaacagctagcaaggaactcagcaagcaagcatgagtaagccggctgcggccctagtgatgttgctggcgctcgtcgccgccgggccggcggcgggcgacggggggagcaccagactcggctgcttcgtgggttggtccccgctcaaaaccgtgtcctccctgctctgcctgctccagggctccagcacttttccgagcccgaacctgcgcccacggggcagggcctgagcgtcggttactacaacaaaaccggcagtgccctaaagcggagcactcgtngagggaanccttgacgaacncaccaacggccaaaccgtgncttaacgcggnctcatcctctccattccacgacccttccttcggggtgcgatctccntctcctggacaaacgcttcgggcaacaacgacacggagaagnangccaccaacaaggaaacctgcgcgctcgaatgtcgacccgcaagcgcatgganaagatgcccggcangttctgcgcgaatctggctngcgcgcgcacgctctaatctagaacagaaatnata

SEQ ID NO: 83028 - DNA, 573 bp, Triticum aestivum
  unsure (1)..(573): unsure at all n locations
  Clone ID: PAT_TA_83028
gttctccgtagcgactgcgttgcaatcaggtcgtcgtacgtaggtgttagccacatacgcatcaggaagctaacgagaagatcagatcggaggtaacggcaatggcaatggccaaggccaccatcctcgccaccttcgcggccgtggcagctctggcggcggtgcagctcgccgcggcggcggaccaccccgtgggaggcgacggctcctgggacgccagcggcaccaccggctacgacgcctggtccgccaagcagacgttcaagcagggcgacaccttgtcgttcaagttcgtgccgtcgcacgacgtgacggaggtgagcaaggccggctacgacgcctgctccggcagcaacccgtgaatcctacaccggcggcagcgcctccgtgaacttcggcccaaggaagcgctactcatctgcagcgtgccggcactgcccgcgggtatgaactggagtcacgtcgccgccgccgcngtcgccgccgcccggccccgcaagacacaancccggcacagagacttcccganccggcccggcccgcggtggcntcacgacaatccacgtgtctcgc

SEQ ID NO: 83029 - DNA, 453 bp, Triticum aestivum
  unsure (1)..(453): unsure at all n locations
  Clone ID: PAT_TA_83029
atcnagagctgctcntgctcntctcctcccacancgtgcaattcgtcgggattcnggaacccnaacgcnggatctccgcggnagcngcggnaatggcnaatcccctancggggctgnaggaccacntcaagctcncgcgggactacncgctcgagggcctctacgacacctccatcatcttcttcaacngcgccatcgnccagatcaacaagcatctaactactttggacgatgctctgatcgtacgaaatggatgaactgcaagatagcaatctctgaanaagtggaaattgtgaaacattggntgctcanttaaatcccttananaactcctgggacaangcggtcatcatcactcctatnncgtcantaatcatttgtttccaancgttggatgantaccancatctcaccagcacctttgntgatntgattgtngctcaacaanggatg

SEQ ID NO: 83030 - DNA, 203 bp, Triticum aestivum
  Clone ID: PAT_TA_83030
cagttttcctcttgtgtcggtagttctccgttggctctggctgccatcctctgcttctgagattccaacttgtcttgaccatctctccttttcctctctcatcctctctttcttgcaaaacgtcatccaatggcgatgtcttcagcagattcttgtgtctcttctcctgcctcccctattggctttgagggctatgagaagcg

SEQ ID NO: 83031 - DNA, 338 bp, Triticum aestivum
  unsure (1)..(338): unsure at all n locations
  Clone ID: PAT_TA_83031
cncaagtccgtgctcggnggnaccggntaatcattaatcanncaagcanctctctatgcaatgtcgtcgcttctcgtcntgtcacancatgtcngattacgtgcctaaaggatancaccgcganaaatggttttctaccgctantatgcatgcatgttatatataatagtgtgcatgcatccatcatctatatatctccaattggagattcntgcaacattttctagtttttgtcaaanttgtcntgtcctaattaatgttaatgtttcattgagattttttcntccttcaaaatgtattagatgttttaccgggtaannaanacattnaanacccaa

SEQ ID NO: 83032 - DNA, 317 bp, Triticum aestivum
  Clone ID: PAT_TA_83032
gcacttttcaggtctaaaacatgaagcaacaaggggcaaaaatacttgaatgattgattggcacattcattgaaagggaattcttcttgcaagttaaggatgaggataccatcactcattttcaaagcacaagaaattaaagaccgtgtattcaaattttcagaacatttttatggaagcccatagccttctttttggagcatatgaccgattatagtagcatattgtactagttgtaaaatatataaaagagatccaatagcatattacaatcataaaaatgatcatagcttagaatgttcaaaaaaaaggggggg

SEQ ID NO: 83033 - DNA, 593 bp, Triticum aestivum
  unsure (1)..(593): unsure at all n locations
  Clone ID: PAT_TA_83033
gccatttcgccgcggcttccacttcgtgttcgttcccccaattgcgtctcctccttccaactccacgcgcttcaatcccacaaccgcgtcgccgtcccgatcccctcccctcccctccctttctcttccatataaaaaaccctcaccaggtgcatcaattgaaacccaatccagccccatccgtcgattggaacccagatccgcaggccgcagcacaagagggtgggatcggatcggttcggagcagagggggaccgaccagaatccgccggcgaccaccatgggtccgcnancgtgccgtctcgtgcctgtgctgccctgcaatgcctggcgtgcggntcctgagctgcctgtgcacacctcntctcntcgccgtcntcctcggctctcgccctcacctctactcatcttcaaccgcaatgatcgccgcaccgtggatcggctcctctccaattcgccttcgngtctcaagctctctanactaactcacatgacgtcgaacccaacagcggtgggctcacacgacactcagcgcngccgtcacacaacgctcgntagcccgctcancttcaaaggacaaggtcacagtnncc

SEQ ID NO: 83034 - DNA, 547 bp, Triticum aestivum
  unsure (1)..(547): unsure at all n locations
  Clone ID: PAT_TA_83034
ggcggatacttcccgaaccgcccgaccaccatccggaagagcatgcccgtggaggaggaggcgggccgggacgaagagatgaagaagttcctgaagcagccggagacgaccctgctggacatgctgccgacgcagatgcaggccatcagggtgatgacgacgctggacatcctctcgtcgcactcgcccgacgaggagtacatgggagagttggcggagccgtcgtggctggaggacccatggtgaaagcggcttcgagaattcngcggcaggatgaaggagatcnagggattcatcgacgagtgcaacaacaacccggactcangaaccggtgcggacaggatcntgccntacnaatgctcaacccttctccaaccgggatcaccgggaggnatcccaacacanctccattgaccctcgtctctcatccaatggggttgcctatgctgaccnactactgctgggaataaatattaataaagcctccgtcatgtatgncaaggntaaactnttgttatcaaaaggacttgtncataaaaaaaaaaaa

SEQ ID NO: 83035 - DNA, 257 bp, Triticum aestivum
  Clone ID: PAT_TA_83035
tttcattcccattaactttcttcaccaatcaattagtagtagtacaaacaatcactcacgctgttatttctcaccaacccagcagcagcagaggttaggtgcgagctggttttacatgacactaacacggcgtccatcagggaaaaaaaaagcagacagccatcttttggtttgtttgtttgtttgttgctcgttcgtcgttttcagaaacccacccaactgatgaatgaattcatcgaagaaggaaagaacagaag

SEQ ID NO: 83036 - DNA, 531 bp, Triticum aestivum
  unsure (1)..(531): unsure at all n locations
  Clone ID: PAT_TA_83036
gcgagtgctattggctggtgatcccagtcgcctgaaaggctctctgcctcatgttccatccttgactgaacgtaaaaaggcagatatagacgcattcgctcgcaggttgcaaggaatcacaaagtcgatatctagatatcctacatcaaagcgccgcttcgacgtccttgtgaaggcgctcttgtcagagctggagaggacgatgggccaatctggcaatggatcccagtcccaggcgcagaggctgcgaaactcggtagcccggatgttgaccaagaaactatgggcaagactgccaacattagggatgaagacccagaacgcagatgacgagatgtctcgcacccgtgatcnctgnttgttatttgacgatccgtncacatctatccaccttgtacaaagatgatagatanagctgcggttgaangagccctacactcattagtctgtatatttaagcacatattacgtgtatcattttttgccccgaaaagaanatatcacagagagacataatanaaaaaaaaaaaa

SEQ ID NO: 83037 - DNA, 571 bp, Triticum aestivum
  unsure (1)..(571): unsure at all n locations
  Clone ID: PAT_TA_83037
gccgcggcgactccccgagcagaagaacccgatcgaacgcggccgcggcggcgactccccgatctcagatccctgctgcgagcgaagggttccattcgagcagagatggcggcggcatgggaggtgctggctgtgttgctcgtcgcggcgcaggtggcgtcagcggcgcaggtcacggcgccagcgttcctgtgggcgcccaaaaactacggattcagctctgatgatgctaaggaggtagtccattaccaaacaatctcaccaaagagcttagctaaatctgttctcnaggaaggtggctggcaaacttcatgtgctcaagggaggatactcagaataatgttgatgttccattgtttttattgggctcaaactgcaatcgtcagacatatctaaagaaacaattntccactttacagacacactgaactccctcanacctagatttcaaggatccctagttccacacatcgagaagacaaagncntgcatcacttgcgaaacganatgttngganaaccacccaaaaactnncgtatntgaaatcnantgncacagcngttttaggtcn

SEQ ID NO: 83038 - DNA, 458 bp, Triticum aestivum
  unsure (1)..(458): unsure at all n locations
  Clone ID: PAT_TA_83038
tgcaccccgacatcggcatctcctccaaggccatgtccatcatgaactccttcatcaacgacatattcgagaagctcgccggcgaggccgccaagctcgcgcggtacaacaagaagcccaccatcacctcccgcgagatccagacctccgtgcgcctcgtcctcccaggagagctcgccaaacatgccgtctccgagggaaccaaggccgtcaccaagttcaccagcaattgagcagcctgcagcgtccacggatttgttaggctccccttcttacaagggtcttcgtcgtgtcctctaccctccccgcctatgtatgtgctgtgaaacgttgatttctcgtcgggtgaacaaaggcagtactacttgcctgctcataaacgtgccggatgtaatgggctcttagattgaccccctatttggatatattgtacngtgcctcccgctaaaaaaaaaaaa

SEQ ID NO: 83039 - DNA, 511 bp, Triticum aestivum
  unsure (1)..(511): unsure at all n locations
  Clone ID: PAT_TA_83039
ccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggatccggcaaggcctaaacagtcactcacgacaggcatatataaangccattgcattttgtcaacctgacattgctttgggtttcctctccatttacttccttattgttcctaaagaaatgtgtatnccatgttcatgtacgaacatggtccgagaaacatctcntattgaagctacngtggtattatatcacggacccataatattatacaatattcgacatatactttaatggtaaaaaaaaaaaa

SEQ ID NO: 83040 - DNA, 547 bp, Triticum aestivum
  unsure (1)..(547): unsure at all n locations
  Clone ID: PAT_TA_83040
cggctcccggcgtctctgcgctgcggccgtacggcgatgcggtggctatcgaggctgctctctcaagccgtcgccgccaggagggcctccgcggcggcgaggtccaacactagtctcgtcaagggaggatcccacgggttcgctagtggcggcagggatgggtcaccggaggtgcctcgggagtggttgcggaagctgtgggtagacgagctgaagaagcagaaggaanccgcgaggagatggggcgtcggctcatcattanaggttgcaggagcgaccgangaggcaccgtcaaggactatcagtacgaatacagcggtctaacccgtngaggcaaactggtccgcttcctgcaagagataactcctcattgccaaggatattgagtgggcaaacacatgtttgctttgagcaggagacangtatacataatggaccatcttccacatctccaatagntttatcnanagaaacaacatcatcttagacaactaccanaacaagacgcattgttcanaatacgatcatggtaacaaatattaggtcc

SEQ ID NO: 83041 - DNA, 201 bp, Triticum aestivum
  unsure (1)..(201): unsure at all n locations
  Clone ID: PAT_TA_83041
cacactctccancaccancaggccngcggcatgcatcgcatgcacagcancaaatggntaccatcagcgccgccgcngagaccaccgtcgtcncccgtgccgccatctccaggccgcaggccctangtctgcccnagctgacgacgacgancgagagggtgaggtgcanctactccanggactccaacgnngcnaccccgg

SEQ ID NO: 83042 - DNA, 543 bp, Triticum aestivum
  unsure (1)..(543): unsure at all n locations
  Clone ID: PAT_TA_83042
tagaagcaaggaacaaggacgcggcgaggtccacctccagctctacctgcccggctggcggctgcccccgtcttcgtcttccttaatctcaaattcccaatcctcctccgacgccttgtttctggatcatccagcggggggacgccggtgtattgctcggtcctcctccctggttgcccgaggcagccgtgacggaggcggaggtagcgggggggaccatgtacagatcggcgggggtcgcgatggcgtgagaacgtgttccggttctgcacggctctccgtgggctgggttccatcatgatcctactcgtcctcgccatcgtcggcgttacctactacgctgtcgtcctctgcaactacggcccgcctcctcaccggcggcggcacactctcgccgcctcgctgtcctgctcctcctccatttctgctgctatctttatggattattttctgtggtgctcatgacctggtctttccacaaatggnncctgatttgatccganaggaaaaatgccctctcacaactaaaatnantancaaata

SEQ ID NO: 83043 - DNA, 529 bp, Triticum aestivum
  unsure (1)..(529): unsure at all n locations
  Clone ID: PAT_TA_83043
cctactaatacagctagctanctgccctcttaggtatactgtgatggccacaaccttgtcctccacagtagtagttgcacttggtgcacctctcttcttgctccttgtaacgtgtggctcgtgcgcgaggccggtgagctttaacgcctccgacctcaccgccgatcccggctgggatgctgccagggccacctggtacggtgcgcccaccggcgccggccctgatgacgacggtggtgcctgtggattcaagaacgtgaatctgccgccgttctcggcaatgacgtcgtgcggcaacganccctgttcaaggacggcaanggtgcggtcctgctaccagatacgatgccaaaacaccggctgtccggnaaccaaaacgtgatnncactgacatgaactatacccgtggcaatacactcgactcagcggacgcttcgggcatggcaaccngcgcaanacactccgcacccggatancgacncanttcaaaagggcctgcaacaccggcanaagngacttcagtcaggag

SEQ ID NO: 83044 - DNA, 551 bp, Triticum aestivum
  unsure (1)..(551): unsure at all n locations
  Clone ID: PAT_TA_83044
atcgcctggaaggctccaaaatgacgacaaaacgttttggaggccaaaagttcttacagggattgcaactggcaatagaatcagggaattgtggcaaggacaccattgatatgctgttgaaagatgctgattcctctgataaaataaacaggacgtcctccatcaaatctgccagctaattattatctggtcgatactgattcgatgcccagtcggaatatttatagggttttcattacaagtaaatatgtaaatagctgcagccttttgcttgcaggaagtgcattttgtttaatttgtaagcttcgcaaaatgctagtagttgctactacgtangaacctagtcatgctttaatttgtggttcgctttgtgaaacgagaatgcaacacgttataaacgaaaaacaccggttggctttacaatgtggacttgtaacttaaggcgtttggtctgtcattttaaagaattggaccacgtgtanatattggcttgaattgattccacacttgtaaatcaaatcantcanccatcccataggataaggatggan

SEQ ID NO: 83045 - DNA, 534 bp, Triticum aestivum
  unsure (1)..(534): unsure at all n locations
  Clone ID: PAT_TA_83045
tggtgagcaaggggagttcattgccagtggaagtgatgatggtagatggttcatatgggagaagagaacaggaaggcttattaaaatgcttgcaggggacggagctgttgtgaactgcatacagtctcatcccttcgactgtgccgttgcaacaagcggaatcgataacacaataaagctatggacacccgatgcaaatgctacatcaatggtttctggacctgaacttgatgtattgagtgccatagagaataatcagcagaaggcatacaaagtgacggttccgacataactctgccttctgaattttagaacgatttcagatgcatgattttcagaacgttcgagtgtgcccagactgattactatcgctggactgcttgaggaaaagggaatactgggaagaatgatncaccaactacaacacctagtttgaatantgaanccgaagcttgttccatatagatgtagaccactggtagaaaacagttnccgggctgaaacatgctgagatcataacacggatatttgtgt

SEQ ID NO: 83046 - DNA, 552 bp, Triticum aestivum
  unsure (1)..(552): unsure at all n locations
  Clone ID: PAT_TA_83046
gccgccgcatccactccgccccccgcctcgcagtgcctccccaccgccctccgcgcccggcaggcgacgtcccgttccagatccaggattcaaacaaaccagtacattaccaccatggttcttgattcattatcatcacctcacaggaggtcccaaaacacattcttcgtgtcatctgcaaaaaagcctcagtcatctcgtgacgacagttggtctgcactggttgagcgacaccggtttctcctgacgacactccttgttcttgccttcctgtgcactgtctatctgtactttgcagtaaccttggggggcatcagatgcttgcactgggattgacaggagcagagaggatgatgccaggcaaatcagtgctgcaacatggaaantgaaatcccgatgacttgggagacccattggatgaagacaantatgantttanatcacccgggcacatgacantcctggatacattaccgtatatggtgggtggctgatttatggacacaaaattgctgtacggtanaggaaactaatagtagggtgaactgtgga

SEQ ID NO: 83047 - DNA, 368 bp, Triticum aestivum
  unsure (1)..(368): unsure at all n locations
  Clone ID: PAT_TA_83047
ctcatcaagcatcgttctcgccatttcgatgagcgtttggttcttcctctgaacaactccattttgttgaggtgtgtacgtaaccgagaactcatgtgagatcccttcttcatcaagaaaggtgtccacattgatgttcttgaaccccgttccgttgtcactgcgaaccttcttgatcttcacttcaaattgattttgggccttcctagcaaagtttttgaagatcttctagacctgcgatttatcatcaagaaagaacacccacgtaaatcttgaaaaacatcaacgatgactagtccaaatgattactaccgagaccttgcaggcgttgggaccgaaaagtccatgtgaagtaactcnaggggggg

SEQ ID NO: 83048 - DNA, 449 bp, Triticum aestivum
  unsure (1)..(449): unsure at all n locations
  Clone ID: PAT_TA_83048
tcagtttgtgcttgtgtgccgatcgagagcaaatggcaaatgataaaccgcagccgggcttccgttccagtcggcaaccctcctgccactccagctgctgctacggaggttaagcctccggcggctgctccaggtagcgaccctccagctacgactccaggcagtgattgtccggctgctccaccgcaaggtccgccgggtgaacgaaagcccaagaacgatccatttccaccattccctgatccaatacctcgccagtgatatcggaaccantatttccatgctataatgggatagaaaaacggtcaaacgcatggtctgggatttgggttcggancctaacttttaatggattgggtcttaataataantaaccactcctatgtnaaggtgtagggtgttnaacatatanatttgtgaaattcaaaccantggngaaaaaaaaaaaa

SEQ ID NO: 83049 - DNA, 426 bp, Triticum aestivum
  Clone ID: PAT_TA_83049
ctgcactgcgctctgtcgcctcctctcttccccacctcgctgctccgattcaagcaagagctccatccgcgcgcagggaggtcgtcagatggagttcgtgctcatcatctcgctgccgctgctcatactcatcatcatcgtcgccgtcgtcctctgcatcatctgccgctaggctcgctgaacgtccacagagaagaagaagaaggttcagccccgtccgtctctgcagtctgcactctgctagctgtgatcctaccataccatgtgttagtgctgatttgacattgtactacagcatgacctgataaacctcctctctctctctctctctctccccctctctctcctctctctctctctctctctctctcttgtctgcattgccgtacgttagattaatccgctgtactctctaaaaaaaaaaaa

SEQ ID NO: 83050 - DNA, 459 bp, Triticum aestivum
  unsure (1)..(459): unsure at all n locations
  Clone ID: PAT_TA_83050
gaaggagcaacatcgtttcttttcactgagtaccaatatgttggtaaccttcatgtccatctttgctgttgtgatcttcctcttccttggttcggttganggattcaacacgaagagccanccctgcacctatagcaaggacaagtactgcaagcctgcactgttcactgcactctttaacactgtgtccttcctgcctggagccatcaactctccgggtctccggttccctggcatgaanattgccacatatgcgaatgccaaaactaacctggaaactaagaaaggtgtttgcaaggctttancaacgcttttccnccgggtgctgttaagggctcctgctncancaattggctntggtccgtanacaccataatgtattaattgtattacnggatnatngaagncntttnatccacacgggtanggcttgggggctcnaagtccctttgaaaattg

SEQ ID NO: 83051 - DNA, 539 bp, Triticum aestivum
  unsure (1)..(539): unsure at all n locations
  Clone ID: PAT_TA_83051
ccgcctccgctcctcgcgccgccgccgcgtctcctcctgtacaggttaaggagaggaagagggcgaaatggtgaagcacaacaacgtcatccccaacgggcacttcaagaancactggnagaactatgtnaanacatggntnaancaacccgcccgcaaacaaaagngccgcatcgctcgtcaaaaaaaagntgtnaanatatccccccgcccgaatgctggtcctctaangccccaatgttcaatgccaaactttaaagtncaacatgaatcaaaggctgggaaaggnttacctttaagganttaaggtgctgggatcccaaaaacttgnccaacattggtattccgtnattaccccnaaaaaaaatccttttgggactgangcaattncaaaggntaaaaataaaggcaactgttantccaanggtganaaagttangngggaccacccaaagactncacgtccattcangngataatcatnccctgngaaanttattngtntaagcaaataaataatattncgcanggaacccctt

SEQ ID NO: 83052 - DNA, 571 bp, Triticum aestivum
  unsure (1)..(571): unsure at all n locations
  Clone ID: PAT_TA_83052
ccgccgtcgtcgcctcaacggcgagggagagagggccctggctcgccgtcctcctcctctgaaggagaatttactcccgccgcctgtcgcttgtctcgctgatgcgccatcgcgagctgacgccgacgccctgcgccgtcgggccgttcgacatccgttggctgctgccgaagccgcgcctcaccgacgccatgcgccgtcgcgacgttcgacatccgttgggttgctgccgaaccgtgcctcaccggccccaagcggtccgtggccagggccaccgcgcgggcaagggccgctgcgcacaccatgtacgtgggtgccgccaacgcgactgatgcggggatcatgatctccttgccatggaggctgtgcacgctgcttcatgcccaaanactctagagattcctctcttctgtgatcttggcgtggctcangacntcgtcaacccgacccgaattaacgctgaatctgctcctgctccctggtcgcatgtttgagctgaanatgtacataacgatctctatctcagnaatttcctccangagttcccgacatanatgcaagttctgcccnn

SEQ ID NO: 83053 - DNA, 578 bp, Triticum aestivum
  unsure (1)..(578): unsure at all n locations
  Clone ID: PAT_TA_83053
accacgcggagctgctgctgctcgggtacgcgccgtggtgtgagcgcaaccgcgcaagctcatgccgcggttcgccgaggccgccgccgcgctgcgcgccatgggcagcgccgtcgccttcgcgaagctcgacggggagcgctaccccaaggcggctgccgccgtcggggtcaagggcttccccaccgtgctcctcttcgtcaatggcaccgagcacgcctaccatggcctccacaccaangacgccatagttacttgggtaagaaagaaaactggcgagccaatcattangcttcagtctaaggattcagctgaggattcctcaaaaaggacatgacctttgttattggctatcaagaattttgagggaacagacatgaagattgtgaaggagcaacacagacaacagtacatttgtataaacaatgatacacgtttgcaaattcnattcaagtattacttccagganaattgtggcccnttaaaacgancaagaattgaaaattnntggaaattnnnaaaagaatttcggtntggnccaananttcncaatacgtatcaggacccantcgtaaatt

SEQ ID NO: 83054 - DNA, 481 bp, Triticum aestivum
  unsure (1)..(481): unsure at all n locations
  Clone ID: PAT_TA_83054
cccggttccgcgtgcctttccccacctactctcgcggctctcgccaaccaagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattggggggtcgggtctgaagaaaattgggaaagaaatgagactggcaccntctccaatacctaagaggatgataagcactgtctactgtgttgccctcacaatgtgattgtacangggactccttgtntctgtttcccccatttgcattgntgcttgatccaaaagttcaactcccnctgctactatgatacagngnccctgataatangatgacatattgtgaaaaaaaaaaaa

SEQ ID NO: 83055 - DNA, 408 bp, Triticum aestivum
  unsure (1)..(408): unsure at all n locations
  Clone ID: PAT_TA_83055
cagtctcaccaacaactggcagagcgataggaaggtgttttcaaccaacgggctacaggagaccctctgaacatatcgcagtcgctttacacgaagtacttgagcaacgctgatctacttgggctagtagaaggtacaggctctccttggaagtctgcaagcttataagtaggtgatgcgtgcaatcatgggtcatttcagattcgcaattacttttttttctctaatgtttttcctcaaactcataaatatcgtttgggctgcgacatggttgctacgaacattctgtgtgaactgtgaatactgaatctttcctgtatagcagtagaaggacggnttccttcctttttccagtgttcctgccgtaaattttcattctgtatgtaccccatttccaaaaaaaaaaaa

SEQ ID NO: 83056 - DNA, 288 bp, Triticum aestivum
  unsure (1)..(288): unsure at all n locations
  Clone ID: PAT_TA_83056
gtttaattctgtactgcatgcgtgtgtaatttgatggntcacaataaatgagtccctctccggaccttggtanctgcttgcttgtggtgantgagagtgtgagactganggagaagaggtggtgggcgtggggctacctccaaanaagcgtgttcctgtaancctgtactcgcttcnttttctctgcatncgtcnaaaatgngttcaataataactnaaaaccgtgtgatgtttggctccccctntcnaggtcaagtttaaccgtatgaaccctggaccatgcattga

SEQ ID NO: 83057 - DNA, 558 bp, Triticum aestivum
  unsure (1)..(558): unsure at all n locations
  Clone ID: PAT_TA_83057
tgccgctagccttccccgccgccgcaaaatggccgcctccgcgcgaaccctggttaccgtgagggccctggagggcgacatggccacggactccgccggtgttccgctggcggacgtcctccgcgcaccgatccgcccggacatcgttcgcttcgtccacaagctcctgtcctgcaacagccgccaaccctatgcggtgtcgcgtcgcgccggacaccagacctccgcggagtcctggggcacggggcgtgcggtatcccgtatcccccgcgttcctggcggtggtaccaccgcgccggcaaggagcgttcggaaatgttctngnnggacgcatttcgcgccaacaagattggcccgctggacgtcgcgtcaaatacacttcccgtgtcgcaacgctccgcatctcggcaacgcgttcctccttgtctccacttgcacgcnngatcttgccnactccgctggtnttcgatcccngatcatnagaannaccaagcataatatctcaanactcgtgcaacnatntaaaggcaggatctttgaaccgccgnaaggaaaann

SEQ ID NO: 83058 - DNA, 572 bp, Triticum aestivum
  unsure (1)..(572): unsure at all n locations
  Clone ID: PAT_TA_83058
cggacactgaggacgacgactactacgaccagtgccaagcttgctcgtaccgcgctggccacggccaatgccggacaattgtcagtgacaatgggttccagtgctactgctctgacggcgtctactcgacgacggcctgcggaaccaagagggctaactggaagacaacaattgtagttgaatcgaagcgggaactgaatcaagaatgttctatttatatcggtctcagttgcatggaagcgataactgaatcaagaatctctatttatatcgatctcagccattttgaaggatgaacgagcaccaggagagatccgggaggaggcatatactgttggacgttccaaccagtggagatgcagtggagatggaggagtcacattggcatggagaactgcgaaacccaccgcagcagaacccacctagaggaagaataaaactgtgccgtatgactcctaatgagactgggaataattgcccctgaaaagntccccgactccagtccacattagnataactgcaaganatggatcanaaaagatgttnccatggtgcgcaccatgatcangtat

SEQ ID NO: 83059 - DNA, 526 bp, Triticum aestivum
  unsure (1)..(526): unsure at all n locations
  Clone ID: PAT_TA_83059
cagcagtgaaagctgctggccttcagatggatgatatcgatcttttccgaaatcaatgaggcttttgcatctcagtatgtctactgctgcaagaagttgaaacttgatcctgctaaagtcaatgttaatggcggtgcaatggcccttggacatccgttgggtgctacaggtgcacggtgcgtcagtactcttctcaatgagatgaagcgccgcggcaaggattgccggttcggagtgatttctatgtgcataggtctgggatgggtgctgctgctgtgttcgagcggggagacggcgttgatgactcaccaatgctcggggaactcgaccacaactggtttccaaggacccatgttaantacaccacaaaattgccggactggtacatgttccagttcctgtanggacgaatggggaataaaagatttgtattgtccccctgctggggattaagaagatttacccacgggtattgaactgctactggaaagncctgaataancaaatctgctgcaaaaaaaaaaaa

SEQ ID NO: 83060 - DNA, 343 bp, Triticum aestivum
  unsure (1)..(343): unsure at all n locations
  Clone ID: PAT_TA_83060
actctctggaattgctgttagggagagaattatccgtgctttcntgggttaaggagcagaagattgtcaagaaggtcctgaaaatacagaaaaccaaggacaagacagctgcaaagtagagctccaggaatggaatggaagcctagacactgcgagaagtaattttggtggatggaaaatctgtttgccttgtgtcgagcatttagcctgtgagacatgcctgttgaagtgtttgagtttagagactgggaatccctttctcctttgaatgttgctatgtcgggacatctgctcccccattgctttgttatgaatgagatcatatctgggtaaaaaaaaaaaa

SEQ ID NO: 83061 - DNA, 547 bp, Triticum aestivum
  unsure (1)..(547): unsure at all n locations
  Clone ID: PAT_TA_83061
aaataatgtcagcaatgtggctgcttctgcaagtggaaaactatccggtacatctggcgctgtaactgctgttttccataattccatctaccagggttctttgccagttccatctaaggctaatgctttagagcatctactggtgtattcgccatctggtcatgtcattcaacatgaacttttaccttcttcaggttctgagtcctctggtagcagcccaagattgggtcaggtcctaacttgcaactacaagatgatgagatgcatgttactgctgaaccaatcaaatggtggatgttttccgtangacaaactggccanaaagagatgaaaacatgccaacatgtatgtataaccaaagaacattatgatggtaggngctccgacgtgaagatacgacatccgtccaangcacaaagaggnctctggaaagaatatgaatcnagaaagcaactggactactaagcaaatcaataacctggcggtccactgnaaatcaaattctcagtaaggcnaccgcgaaattggcaacattacatggggggaa

SEQ ID NO: 83062 - DNA, 566 bp, Triticum aestivum
  unsure (1)..(566): unsure at all n locations
  Clone ID: PAT_TA_83062
aacaaatcacacaaactcatcttctacttcgtcacaaacaaattcgcacttcaaaatgaccaactacgagcagatcgccaaggaggccgagatggacctcaacacctaccaggccaagaccggcaacgctcgtcctcaagacatcgagggcgctggtgttaacccccatgctgagaacaagtttgagagtgctcaggttgagtttggcgatgagctgagcacaaacgctggctacaacaagcgcatcccccccagcgagggtggcatcgtcgacgacaagggccgacaacccgtggtcagcactacgagggtgagggcggcctctcgacaactcgccaagncaacgacgagcgcggcggtacaatgacaacgatgttgtcggcgccaactcacaagactccggctcgggccgctgacattcgcctccaagggcaagaactcaggcgcaaacgtagncgcaacctccggcccggtggtctcagtcaagggcangatactacagccgagatttctgaagatccgctaggtaaattgtccacatgtatnatcancgaaactacggcnta

SEQ ID NO: 83063 - DNA, 394 bp, Triticum aestivum
  Clone ID: PAT_TA_83063
ggacgccccctccccctatggcagccatcatccattgcttcctcccccaagatcttcccctacgcagcaaggatcgagaaaaggaggggcacgttgaattgaagaggaagagaggatcaaggagatgttcttccccatctcttcttgaagatttcttggggaaaccctaggtggctacactccagatcatgtctagtacatttcttcttcttcgatgaaggtgcttgttgctcatcaaggggagtgggaagtagcagcacatccaccttcactctcataataatgctgcccagacacagccatgatttaattagaaacttcttgtcaaaggatgtttgtttttaactagtcgtgcgcactgattaatcagttcattgttgttaaaaaaaaaaaa

SEQ ID NO: 83064 - DNA, 501 bp, Triticum aestivum
  unsure (1)..(501): unsure at all n locations
  Clone ID: PAT_TA_83064
cttccatccatgggttcacaacgggcctgaagctggaacagtttatattcgacgccttcacttactccccatccacagagcttttcgaggtcatgcgggaggaggaattcgcgccggtaaagaacgccaacggcgcgacatacgacacccccgatagcgcgaagctcatgctgctccgcctccacagcagatgggtggtcgccgccggtggcttcttgacgcactccgtgcccttgtatatgacaggcgtcgaagtttccccgctttcctcctacgccggagagaacctggaagcgatctgccgcgggcgaacgttccatgcacccagcgagatatcgttttaggatatcgttttgtgtaactgtggactgaacggaaagggttgcaagattgtgcatgtttactcangctgaatgggtgtcgggttgatgtgttgcttgtatcncgatgttgtgatgtacatctcaatcaaatcactcganttctcccaaaaaaaaaaaa

SEQ ID NO: 83065 - DNA, 545 bp, Triticum aestivum
  unsure (1)..(545): unsure at all n locations
  Clone ID: PAT_TA_83065
gcgggctgcctcaccggcgactgcgagggccggctcgcctgtaacgggtccgtgggcgccccgcccgccacgctagtcgaggtgagcctgcacgaggacgccccgaaagggagctcctacgacgtgagcctggtggacgggtacaacctccccgtcgccgtctccgccaagcccgccacgggcggcgcggacccgaacaagtgcgccattgccggctgcgccaagaacgtgaacgcggtgtgcccgccggagctgcaggtgaccgctaccggcagcggcggcggcaagacggtggtggcgttcaagagcgcgtgcctagcgttcgggtcgacgccttctgctgccgcngcgcgtaccgacccggcactnccgaaggacgtgtatcgcgcctctcaangaccctgcccgcatataaactatctacacacgccgccacnacggcaacggttgtaccncangagtaatatactttccgtcanatgggcacaaccnggatntctgccaattaattggntctatctatagcatncatacatgctcacttn

SEQ ID NO: 83066 - DNA, 174 bp, Triticum aestivum
  unsure (1)..(174): unsure at all n locations
  Clone ID: PAT_TA_83066
gccgccgccgccgtcgtcttcgtccgtagatcagagagcggggaggangaaaaagcgatcgatggcgtccaactacgtggacacgacgggcgaggagggacngttccacggtcctcacanccacancaccagcacgaccccgacgggcggcgcngtngntcctnatcntacttg

SEQ ID NO: 83067 - DNA, 562 bp, Triticum aestivum
  unsure (1)..(562): unsure at all n locations
  Clone ID: PAT_TA_83067
gtcgatctgatcatggcaatagtagagcagttcatgtcacatcatagtgataatggtaaaatgacttttcaagatgatgatgaaattgtggaagttgagaagtttgcttctgtttccagcacgtcaaagctggcagttgcaaagctgattgatgaatatcttggtgagattgctaaagaccctaacctgcctgttctgaagttcattgcacttgctgaaatggtgtctgcctcgtcccgacaaatgcatgacgaactataccatgccatcgacatgtatctaaaggagcaccccagcctatcaaagagcgaaaagaagagattatgtggattgatggactgcaagaactgtccaggaggcctgcatgcacgcggtgcagaatgaacggctcctctgcgtgtggttgtgcaattccctcttgagcaatccgagcatcagccgctctgcaagagtgactctggagcgacttcatcgcgtcaccgctctccagaagacggaccntacgnactcaagncagcgcacacacaacgaagagaagnatggatccacatcacactcatnt

SEQ ID NO: 83068 - DNA, 558 bp, Triticum aestivum
  unsure (1)..(558): unsure at all n locations
  Clone ID: PAT_TA_83068
gtttggtgaggcataaaagggataagaagcttcaggtgatggaacggaatgcggaggttggagagacattgcggatggcgcatgttgggcggacacaagcaccggtggcgttggggacacggacacagccggtgattgagaacgattacaccgcatagtggagttttggggtcttctgcatgattctactaacatgaagacatcaccatggtgatggctggagatgagattgtccattggttgcttgacgcggacagttttccatatcagcagagggcaactgcagctgctaattttcaggtccaagttcactccatgagggttcaacacattattttgggtgggtttgttgtgatgccaattttctactgcaagacaatggctattgtttgtcatgtcatattgaggattccttcattccaagcaacagnaatgtttggaaacctatccatcagactggatcccagtatctttgggggtacngtatcatanaaaacaggttggnatggactagtacatcatgccattcataccacatatcagcgntcatgcgtctga

SEQ ID NO: 83069 - DNA, 576 bp, Triticum aestivum
  unsure (1)..(576): unsure at all n locations
  Clone ID: PAT_TA_83069
gtcaccctgggcctggagcccggcgaggccttcaccatccgcaacatcgccaacatggtcccgtcctactgcaagaacaagtacgctggtgttggatcggccatcgaatacgccgtctgtgctctcaaggttgaggtcatcgtggtgattggccacagccgctgcggtggaatcaaggctctcctctcactcaaaggatggcgcaagacgacccttccacttccgtccgaggactgggcaagattggttccccggcaaagaaaangtgcagactgatgcgcctcaatgcctttccgatgacnatgcaccncctccgaaaaggagccgtgacgttccctcccaaactcctgacctaccttcctcaagagtgtgtccaacngacctcaaccctttggggcatacatcttctcccggaattctaagaangggacataatttcccaccggttaccctatatanctgcaataaaaccgtcatattcagatactccacgtcgacgacgatgtnatcatgcaggatgctacnctattncatcnganccggatgcccatnnattccaaacataaacctttttnt

SEQ ID NO: 83070 - DNA, 565 bp, Triticum aestivum
  unsure (1)..(565): unsure at all n locations
  Clone ID: PAT_TA_83070
ctcgtgccgctggtgccgagtacgggagtggaagctctcgggattgggctgcaaagggcccaatgctgcagggagtgaaggctgtgatagcaaagagcttcgagaggattcaccgcagcaatcttgctggcatgggaatcatccctctatgctacaaagcaggggaggatgcagacaccctgggcctaaccggccatgagcgctacacggtccaccttccaaccaatgttgantgagntcaanctgccaagatntaccgtgacaactggataatggaanccttcactgcacactcagatccacactgagtggcttgcttaactacattatggtggatcctacatattccgctagaaaatacggacataantgtaccgtccaaatgttccagcttccgtgancctatgngtnttaacgttttaataatacaaccatttgcgggctactataataacctgatnccaagtgacttctnaattgtaactgcacantctggtcgcataggatggatctttgcttcagtanatagctacttcgaaacaatatcatttggnnaaaaggggcc

SEQ ID NO: 83071 - DNA, 569 bp, Triticum aestivum
  unsure (1)..(569): unsure at all n locations
  Clone ID: PAT_TA_83071
atgacatagcacacttcgctgacttggcggtcatagtacggaagtactgtgcgatggaaagcgcctggaaaacccaaacaaaattttgggataatccgtctctgacaaacccccagtccgaactaaaagggtgcactctcataagtcgcctgactcaattacaaagaagcaaaagcccactacagggtgtggaaccgtattggagggatggcttaacgggccctacaaaatcatagtacagcggtaccataccaacacatancttagacatgttgggtactccggangtggccaagacngtgagnttctcatccaaacacccaattacttccngtgggtaacatacattatgacancctccagactttgcctcaaataatagcttangananccgcaccttacgaatctccactggnacataancatggangacacacattacttcatgccagtgatgaacaattcaacagccaanacagcgntcggtcncatcaatnaggaggnttcgccacaaagnccaggangggaanggntaacccttatagnaacntcaaagggannaccccac

SEQ ID NO: 83072 - DNA, 495 bp, Triticum aestivum
  unsure (1)..(495): unsure at all n locations
  Clone ID: PAT_TA_83072
gtcgggagttctacagcagcgttttacggaagcaaccagccaatgaaccccatacggattacaagggggacaacccggatggctctgctaccagaggtgattggtggcaaggttcactttattactgaataatctgctgggacctctcccttttgtgaacaaggaataaaaggggtagagctgagaatggttgttgtagtgttggaagtgttgacgcgagccgtcaagcatcgttcaatagtaatattgtaatantgaaactgcgtcctgactacaacacctgtttgggtggagcantatttaatccacacaccctggacaattggtncctttgtatcctnttccctgtttanntcanggctgtnctaaaatgatgaaccccattcnataaaacattnccaaaatccaccggnagttactgtctaaancaactatatggntggttggaaccacgtactgaataaatcatatacaaatcctgataaaaaaaaaaaa

SEQ ID NO: 83073 - DNA, 318 bp, Triticum aestivum
  unsure (1)..(318): unsure at all n locations
  Clone ID: PAT_TA_83073
gcactaaagcttcataggaagtatcacaaaaaggaaaagaaatcctaacatcatatggcgagattgcacgcaacacaacactgggacttatatattgcttgtttctgttcctttcattttcccactcactgtatcggaggaagaaggtggtttacatatacagtcgcgggcgagacctcataaatataagtgacttattgtatctacaatatcaatgatccacgtccacagctactcaatgtgaacatcaacctagtacatgataattatccacgatcacaatggacttgggaaatatacccatcanatttgtccatg

SEQ ID NO: 83074 - DNA, 568 bp, Triticum aestivum
  unsure (1)..(568): unsure at all n locations
  Clone ID: PAT_TA_83074
gcgaactcactgtctgaatgactatgaacaaaaactgcagagtgctaacgtccctctaattttgttatttccatcatttgattatgggggtgaatgctcacggttgctccgtgggctgaagttgtggttggcattcaactgccttgagttttggaggcttttggactgccttgccagcatgagcctcctggaagaggcaccctggcatctgcgtgccatttcccatttgttcctgccgtttgggtaggagtatccattgggcttatttagcaggccctgggttgaagaaagaagcggcagctgcaagatggcgggccttgcccttcctcgactacttaactataattaggactatgtatgttatgaatgtatatatgccattaaaccccatgccctggtatgaggccccgattgtatgancaatgttccggaatgttaccttaacacaacaaactgaggttaggtggcaagtgggaaattgttgttcttagnaaatcttgtcaatgatcgtaanantcacgtttaaaacaattttcaaaagggggcccgtaccattcccaaagtatct

SEQ ID NO: 83075 - DNA, 580 bp, Triticum aestivum
  unsure (1)..(580): unsure at all n locations
  Clone ID: PAT_TA_83075
cacatactcgtcggcggagtagtgcatgctgggccgaagcactcctgctcgcgcacgtgtagtcacactactaggaaaaggcctgctagtggcgcacctgttttgcctactaatggcgcactacaggtgcgccactagcaccacgccattagattttattactaatggcgcaccacaggtgcaccattagtataccagatgctaatggcgcaccatgttagtgtgccattaagtagaccatacggtgcgccattagaatgcctcccagggggccatatttaacatgtctctgggcttactaatggcgcactgttgctgatgcccactagtgtgcatttgcaatgcgccactaaattctgggttgtccccactaatatgaatataagatttttcctttccgatattgcacagntacaaaacatntactgcacagatatagacagcacacatatnaacacagatttcgaatacatagaattatcccgaatacaatcacatatagtcccgattcaaagancgacaaantagacatncagtccaaacncagtacgagtttgctanataagcaancattacaana

SEQ ID NO: 83076 - DNA, 572 bp, Triticum aestivum
  unsure (1)..(572): unsure at all n locations
  Clone ID: PAT_TA_83076
tgaactcgtaacttcttcttttctttcgtcgttctactcccatcgaagctactactgaggacgggcgcaggcggagaacgagcggatccgctagcaggggaacagccggcgcggaggaagggtttggaggatgacagaagctgcagttattacaaggtactggtgccatggatgcgagaaggtcatcgaggaggcattgggggangagatcaagtgcccttttgcggtggtggntcatcgaaaattngccggggaagatcccgaggggttggccaccagcattagacgagagtggggaacccgccaagggacagcgaggacgacgatgacgacgatatacccatgattccaaggtttatcaagagcacggacgggatcngtctcnccggngctccacacaccaagacgacttaaaccgacaggaaaggaaancgtctnncaaccctcaacaacctcgctcgcaaagtcggcgctctggatccacaagccaaacgccaagtggtcacacacaacacatgcttctgaatatatntctgggtgctacctatcttaatcngcaacaccaaccgtcg

SEQ ID NO: 83077 - DNA, 533 bp, Triticum aestivum
  unsure (1)..(533): unsure at all n locations
  Clone ID: PAT_TA_83077
ccgaggctgaggctgaggctgaggctgctgctcctgctgatcccgaggagcttcccgcggccgagcagcaggcagccgccgagcccgaggccgctgctcctgctggtgccgaggagcccgcggcggccgaaccggccgctgaggcggaggctgctgctcctgctggtcccgaggagactcctgcggtcgagcaggaggcaccgccgaggaggaggctgctgctgctcctcctgctggtgccgaggacccgccgcggccgacctgtcnccgaggcagagctgctgtcccgaggactcgccgcggacgaccggagtcctntcctgtcctgctgnccccaagaccggccccnaagcggaggtctntctgaaggaccccaaagcacnattagccttcgcaccacggcggcggcaagccancccaaggtttgctcccccttggggtancctccncctaatgcatntacacggatttcttcatccacgtacggctccccccgttttttttctctccgtttctacatattcctgacttct

SEQ ID NO: 83078 - DNA, 271 bp, Triticum aestivum
  Clone ID: PAT_TA_83078
cgacacgctgccctggtcccggcgggtgatacgtttcttgggctggtgctgtagagtggtggctgtgtctttgtagcgtgtacctgtgcaaactacaagatgccctcacctggatgtaaagagagaccctgatgctttgtccaggcaaccatgttcatccataccatgtagtagtaggagtattagggggtgtttgggaacaaatttttctgcattttgggaagaatactgcattatctcaaatactgcattattatataaaaaaaaaaaa

SEQ ID NO: 83079 - DNA, 562 bp, Triticum aestivum
  unsure (1)..(562): unsure at all n locations
  Clone ID: PAT_TA_83079
gtacttgcgtgcgtgcgcacaagaacgcgggtcagagctgctggcggttggaggagcagaggagatcgctgtgcgggcggcgatggagaagccccggcaggtggcgcggaaattcctggcccggccgcagcacgagggcgccggcgccgtcgtccgccgcagcatcggcaggttcgagctgaggtacttcgacccgttccttgtcctcgacgattcaccgtttctgctccggccggntccccgaccacccgcaccgagcttccagacctcacctacatgctttagggcccctttacgcacgaagacttcnagggcaccgtggacatcaagccgggactncattggtgacggccggccgcggatcttcatccganancccccggcccggacttcaaggctgcactctggtnaactctctccnccaanaaaggtcaacccgggtacaagattcaaacaaggaatccgtcantcgacgggaacgggggtcacgtgccntatccggcaccaanggnntcccccgtcaaccnacccacattnctgantncgncccccggcgtggaac

SEQ ID NO: 83080 - DNA, 578 bp, Triticum aestivum
  unsure (1)..(578): unsure at all n locations
  Clone ID: PAT_TA_83080
aaggcagtcgcagactacaaagtttacactgctagttctgttgtagaccttcttcattttgttgctccaaggatgatgcancgtggaaatgttcacttttcatatggaattgctgataacttggatgatccaaaataccaacattacaaatattggtcaaaccccttgggaaacnaagttaccgaatgctcctgacatggaaatatttccatgtacngantacgcattcctactgaaagggcatatgtctataattggcccacangcagaatgttatatacctttccgaatgacacctccgctgaaggcggggaagaaaatactgcttnaaagggtnttactancccatggngatgaacgtccattcttaatgcnggtacatgtntncaaaaggatgcgtggcaaaanccttcaacccgccggnacaagactacttgaggagataagcaccacanctcantctctggaaagcagggcaccagacggtgacatgttgaataatgggaacttgcncaattaggctnacanatactgtgggcaacgtaggaattgggcataagttatcanttatcantgca

SEQ ID NO: 83081 - DNA, 568 bp, Triticum aestivum
  unsure (1)..(568): unsure at all n locations
  Clone ID: PAT_TA_83081
cgacaatcangantactttcatgactccagcctctgggcttcaagcgagcgtcaagaggcatccagatctggcactgttcaagatcccanaggagtctccccaaggcacaaagttcaaagacgtttcctttgctcagttcgagagagatgtcaaacagacggcgaaatattggaaagacaagctttctaacgtaggtgttgaagacagggctgttgtcngtgtctggctgaggggttatgcctactccgataccgtccatatccagggtcttaactgggcgggatacatccctcagctgctatctctgcgcatgacagatcccactgtcatctatgagcttctgcaaaatccaacgcggtggcttattgcatgagcagacaacactctctcttgaangatagccagtgccgacatccagcgggcgtaacactcgacacggatacagccaactcaggatccntggatccagaatgaagatatgtgcctcattacacactcggncattagaatacaaactctacctacgcncatggttncacactnaaatgtacatacttagacgcaaca

SEQ ID NO: 83082 - DNA, 567 bp, Triticum aestivum
  unsure (1)..(567): unsure at all n locations
  Clone ID: PAT_TA_83082
tcgagttttttttttttttttttttttttttttatcaccaatccaatctactatttcaagctcggtcaagaccagtagaccacacattctgctgtttatgctctggtaaaccatgaccacgcagaccaccctagaggagaaatcgcaaaaatgataattggaatgtcacttgccgccgttacatctttcactaacacattcccgccttgttgctcgtcgtctacccacaactctagaaagatacgtactccttacaagctacgcgctcaccggccggtgaacgcgctcttggccgtcctcggcatgtagtcgaaggttcctcggccttgttctctgtccgcggcgagctcttggcgccgaggagtggcgccgatcttctcgctcatctgcgcggcgacggancgactacgtcccggctctccgctctnacacggatataggataaagccatgccaanaggcatangcggtnaaggaggangagaatggtggcggatggngtganaaaaccggggttaaaatggacccgcggaaacncantaattcgngnccgcgaactccctnttgg

SEQ ID NO: 83083 - DNA, 573 bp, Triticum aestivum
  unsure (1)..(573): unsure at all n locations
  Clone ID: PAT_TA_83083
gttttttttttttttttttcaagcaaacatcggcacctcggcagattttattaatggagacaagagtagaaatggttcttttgggcatcaccatgctcgaactctgaaagggccgtgccgtagtctaacgttaagcacatactatgtgcctgccactacgagcagcagaaagtggagtggcacgcaagcaggaatacaggatggacaaaatcggcaggccattgtgcgttagtctatcttagcgaaatgtacacttggtccagcaggtacacaagtccatctttatttcacatggtcaaacagccgaaaacaaacccgcgcagatgagtattgtccattaagacaattcaagcaagaacatttcgtacacctctccagcatattccagttcacacttcagatttgttcaggtatccggctaacatcctgtcgcagtataccatgctccagacatatcccaacagcggacaacttnaccttatcacagagatctgatactgtattcacgaaacttttgccntatcaagctacaaccatcagtctgtaacaccctcgatacccttaagtcccaan

SEQ ID NO: 83084 - DNA, 572 bp, Triticum aestivum
  unsure (1)..(572): unsure at all n locations
  Clone ID: PAT_TA_83084
atcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaaccggcaggccaaggtctccgtcgtcccctccgccgcggcgctcgtcatcaaggcgctcaaggaacccgagagggacaggaagaagtcaagaacatcaagcacagcggcaacatagcctcgacactcatcagatcgccaagacatgcgaaaagtcatggcaaggattggcgggacctcaaggagatctggggactggtanctcggtgacgtcatggaagaccaagactcacaagagatcatatgtagncaatcctcactaagttcacnnaacatcgnacataatgngttccaatcattctnacnaacccatn

SEQ ID NO: 83085 - DNA, 580 bp, Triticum aestivum
  unsure (1)..(580): unsure at all n locations
  Clone ID: PAT_TA_83085
ggttgttctagttgttgctggagatggtgttgatctgggtgccattgaggcagaagttagcaagcagtgcaacgcgcttccaagaggtgaattcgcttcaaaagcacttagccacagcttcactgtgttcgcgaaagatatggttgaggcgatatcattctcaaatctgtatgcccctgagcatttgatcatcaacgtaaaggatgctgagcagtgggaggagttcatcgaaaacgcagggtcagttttcttgggccaatggaccccagagagcgtgggcgattatgcgagcgggacgaaccatgtccttccgacctatggttacgcaaggatgtacagcggtgtatcgctgaactctttcctcaaatacatcactgtccaatccctaacagaggaagggctgagaaactggggccgtactcgcgaaatggcgaagtggaggggctanagccacaagagaccttaccttagctnaanagtnaggcattactgtcaccctgtcatggtcatgcaacttaaacncatgtggatctgantctcccaggaccanggaacggcattatttcaanaggccggantt

SEQ ID NO: 83086 - DNA, 573 bp, Triticum aestivum
  unsure (1)..(573): unsure at all n locations
  Clone ID: PAT_TA_83086
gtcttgctggccccgcaacaagacatcaattgggaagagatcactccagctgttccacgttatggtcattgagaatgcgcctttccttgagagattgcttgtatcggatctagaaggtccaacaaaaatcagggtcattgacgcgccgaaattgacagcgttggttttcgtaaggtgacttacacaacatttttggttacatgcattaacattttattagttaaatcaaaggtcaaaacttggcgcaaaatgcaaaggggaccaataaaccagtaaacatcaaagttctctcgtttggccccaaccagaggtccagtgagatgactatactgcaccgaaaaagagggggacacagcttcattgacttacgcacctacctttgggtgtatgacacgtgggcccaacgggtggatggcaactgtcatacagcaaagaagtgcagtagagggcaagataatggcacaccacatgaatcatgcatcccactccatataagntccgcaatcaacataatctancactaccactaaggaanatgttnccaanccaaatattncaaaactaaccangngg

SEQ ID NO: 83087 - DNA, 360 bp, Triticum aestivum
  unsure (1)..(360): unsure at all n locations
  Clone ID: PAT_TA_83087
gggcggtgccggtgaggcgatccgtcggtggtgtcggagcggtggaggaggatggccgacgtgcagggagacaacgaagcagttctggaggacgacgctttccccgacgacgggcccttagatacggaggagggaggtggaggagaacccatcagcggaggcgacaaggaagaggaggaggacgtcgacggcctcgccagcttccttgagtcggagatcctctccggatccagcgacgaggatcctattgacgagcagcggcagcagaaggaggaaggtgatgctgcgaanaataagcggaagcagggttcangatcggacggggatggctgcancggcagcganggggagcanacgaaa

SEQ ID NO: 83088 - DNA, 574 bp, Triticum aestivum
  unsure (1)..(574): unsure at all n locations
  Clone ID: PAT_TA_83088
ccctcctcgcctccctcccctccatccaatcctcgaaacgagcgcgcgggcgaggaggtccccctctccgagatggctagggtttttcgcgggtccctcctcctgatgtccccggcggcggcggcggcggcggcggcggcggcaggggccaagaaggcggcctccacgaagccgagggcgccggccgggatcacgaagccgatgccggtctccgaagcgttccgcaggttcgccggcggcgcgcgcgaggtcgcacgctccgaggccatcaagctcgtctggacccacatcaaggcccacggcctccagaacccgtccaacaaaaccgagatcaactgtgacgcgacgctcaagagttgtttggtgggaaggacaagatngggatgatggagtctcgaagctactgagcctcacttctgaagaatacaagcgtgcatggagccgcgcagcctccggtgattggaaatttatcnncaatgnaatccatcacntcaccatcttatctggnctactagtctancngggttcttcttcatttaatccgtcgacatttnataaancttaattgaccccn

SEQ ID NO: 83089 - DNA, 168 bp, Triticum aestivum
  Clone ID: PAT_TA_83089
gtcatctttcatacttggatttaagtgtgcagtagtcgtaaatgattggaatttctgttttagtttggtgcccattcgatctcgagtcgattttcactcatgtaatttgcaaatcttgtacgaagaaatgatccaataaaattcagcatttgtgtcaaaaaaaaaaaa

SEQ ID NO: 83090 - DNA, 378 bp, Triticum aestivum
  Clone ID: PAT_TA_83090
caacgacatcttcgagaagctggcggcggaggcggccaagctggcgcggtacaacaagaagcctaccattacgtcccgcgagatccagacctccgtccgcctcgtccttcccggcgagctcgccaagcacgccgtctccgagggcaccaaagccgtcaccaagttcactagctcctaggcgagcgatgcgacgtgcactcgtctccttcttgcagtagtacaatagtagtacggttaggtgtgttgccgcggtggtagttgccgctgcgtttgttttctgggctcggttgatgtcttttatgtaagaaagtaactgtattgtgtctgcagtaccttaccatgcatgttttaagtagcatccttaatctataaaaaaaa

SEQ ID NO: 83091 - DNA, 522 bp, Triticum aestivum
  Clone ID: PAT_TA_83091
tccgcatcgcgtggaacatttccacgcgaaggcgaggggagggcgacgcgtgcggctagcgaggcgatggttgcgcgacacgctgacggcgacgcctgcgaccatcgatcatccattgttcatctccatccccttcggtggccaattttctctccggtctaatatgcattttgggcttcttttgagtcatgttgttggtgtggaaccgtggaagtaggatgtggactgcaaggatggctagtttactctttactggcattgacagtttacttgtcgttcttcagtcatttggtggcatgtatcatcaagcttctgtcctttctatacattgttatgaacgttgctatgccttttatttcgaatgctgatgcaatctacgagtttctatccttgtatgtgtgcatagacattgttatgaatgctgctaatgtcttaatttgaatgcttatgcaatctatgattgtatgtgtgtaagacattgtattgtacggtttcaagtatatctttgcataaaaaaataat

SEQ ID NO: 83092 - DNA, 386 bp, Triticum aestivum
  Clone ID: PAT_TA_83092
gtccgagtactgacggaaagaaggaacggatggctatgctggatatgcgtaggcggcattgctgatgtgttttgattggtgtacctccttgtccaggcttgctgcctaccactcactccctgtgtgacgttttgctgaaattggtttgtactgtgcacgataatatctggaaatagactctagacagtccttagttatctttttattatataaaaaaagtcagcgccttctcgttagggttgagatgtttgcagtattgatgcttttgtagtgtttttatagctcagcttaagctgtcatttttgtttgatgatttgcaatagttggacccctcatgaacaaaatgcaatggtcatcttttggttcacatggacaaaaaaaaaaaa

SEQ ID NO: 83093 - DNA, 586 bp, Triticum aestivum
  unsure (1)..(586): unsure at all n locations
  Clone ID: PAT_TA_83093
gaactagtttcgagttttttttttttttttttcattttacccagtcgtcgactcgtcgtacacggataagtacagcacaacaatcacactagcttggaaggaaaattaaagcaagcaaaatgcagtggaaatacaaactgatcataaggcatgcatatataacgacgcatggctagaggcaaccaacgacgacacgctgtccttgtccagcctctggtatatctacagttcacgcctccggctgtccttgtccggcgggaggccatcgatctagcggctgaaggaggcagacgatcccagcttggcggcgctggccctcagcacgtactggtggtacgccgcggcgatggcggcgccgatgaatggacccacccagaagtccagtggtcatcccaggccttgtcgttgttgtagatgacagcagcgcccaactcctggccgggttgatgccggtgccggtgatggggatctggcagatggccatgaacacgcaaaccgatggggagagggcaacacgggacatagatcacggnttgcgctgggtcggtggcggagaaacgttaacacacaagtgcgtatccncgca

SEQ ID NO: 83094 - DNA, 230 bp, Triticum aestivum
  Clone ID: PAT_TA_83094
gtgccgtaaagctaattgtaatacccagaaattgttgaatggctgtggaatgtagcacgtggtcgaattgtctgtacaaaatacggagaggccttctttggatctgaaaaaggcttctgaatcttgccagtccttcctttttacgttaacatgtttctcctgtgtggtttgttgtattgtacgatggcatgcctaaatggctcgagatgattgtttttaaaaaaaaaaaa

SEQ ID NO: 83095 - DNA, 275 bp, Triticum aestivum
  Clone ID: PAT_TA_83095
tgatgaagtcccccaaccacctactaaaaagaggaaatgatcaacggctgcgacgagtggttgcttatacgcaggaatgctgcctgttcgtccctgcgcagcagtttactgtttagtgggtagagttttttagcttggtcgtggacaattcatagcctagtttggaaacgaaaaagaaacatttaattgtgcatgtactattaaaccattcctttaatcatgtatctcagattgctatcatggtttctaaattgtgtttgcctaaaaaaaaaaaa

SEQ ID NO: 83096 - DNA, 511 bp, Triticum aestivum
  unsure (1)..(511): unsure at all n locations
  Clone ID: PAT_TA_83096
gtcatcattcgagcagaggggagagagagagagagagagagagagatgaaggagggcacggcgaactgcatcgacatcctcatcgccatcatcctcccgcctctcggcgtcttcctcaagttcggctgcaaggtcgaattctggctctgcctcctgctcaccttcctcgcctatctccccgggatcatctacgcgatatacgttatcaccaaggactagccagctagcgccgtaaaccgggacaaggtgagagagctagctgatcagccagcggaggtaatggagatgaactgctgagatcacttgccctgctgctcaatgtttctggatggagactgaatctcagtgtgctgtgctgtgctgtgctgtgctgtgatgctgctatatactaccgattgtcctgaatttgtccctttcgttcgtgtctgcatatatgtgatcatatcgtaaaattctctcanactcctgtgcaaagtattgatcatcattgttgctgatgaaaaaaaaaaaa

SEQ ID NO: 83097 - DNA, 398 bp, Triticum aestivum
  Clone ID: PAT_TA_83097
ctcccggagacccgcggccggacgctggaggcgatgagcaagctgttcggcgccaccgacgacgagctgaaaccccaggacggggccacgaaagacaagcagaagctcgaactggccgccaccggcaccaactaacttcacattattagagggtcttgttgagggtggtcgtgcgaagaacttgtgcagtaggcagctagctagctagctgccattgttgccatatgagctaagctaggctgaagcaacgtgggaagattcgctcgctggtccggcgcagctggagagcgacggccagcaagctcaggccggccagctcgtggctcttaaattttttaaatcattctctaattcgtggactgtatttcacactttgttttgcccgcaaaaaaaaaaaa

SEQ ID NO: 83098 - DNA, 526 bp, Triticum aestivum
  unsure (1)..(526): unsure at all n locations
  Clone ID: PAT_TA_83098
gccgaatcccaactcctgtgtgtgcctgccaacgcctcgtcgcccgccgccgccgctgcttcgcccctctccgccagccgctcccgctcggagcacgccgccgccggcgtgggcgcgcaccgacggccgtcgtgtcgcatggatatggcccccgcggccgtctcctccaacccgcgctcggtcgaggaaatcttcaaagacttctccggccggcgcgcggggctcgtccgcgccctcacctccgatgtggacgatttctgcagcttctgcgacccagataaggagaactgtgtctctacggcctcccaacgtagctgggaagctcgccgccggcggacaagttctccggattncccaaccgggctctggaaanaatttgcgccaatggcatgcagcccgcnatggtctantcgtcgcggtcantctgatcgtgccatctnatcgccttctctacgngccgctcaacgccaanacggancgctatcacatataatgatctcctcgtcttgaacattncggcaggaac

SEQ ID NO: 83099 - DNA, 231 bp, Triticum aestivum
  Clone ID: PAT_TA_83099
tctctccttactgacaaaagctatgggccacgtagttcgttgggaatgtgttactggaatacctcggcacggctgatgctgtaatgccattctttttttcccctgtattttttctttctcagttctctcagtccttagctatacaaaaaaagttcagttgaacagttggagatgaacccggatgatctaattctttgttgagagcatagcatcataaaaaaaaaggggggg

SEQ ID NO: 83100 - DNA, 574 bp, Triticum aestivum
  unsure (1)..(574): unsure at all n locations
  Clone ID: PAT_TA_83100
cggcggcccccaccacaggagcaaggtccacggcggcggcgcgccgtccaagaatctcatggccgagaggcggcggcggaagcgcctcaacgaccgtctctccatgctccgctctattgttcccaagatcagcaagatggacaggacatccattctcggtgacaccattgactacgtgaaggagctgacggagcggatcaaagtcctggaagaggagatcggcgcctctgcggaggacctggacctcctcaacaccttgaaagcttcttcgtccagcggcagcaacgagatgatggtgaggaactccacaaagttcgacgtcgagaggcggggcaacgggagcacgaggatcgagatctgctgcgccacaaaccccgagtgctgctgtccacggtaagccgctggangtgctgggcctggagatcaacantgcgtggtgactgctcancgacttggatcangctcntgctcacagaggaggaggacgnaatataagagnaattcnagcacgacaaataaanagctgtttcgatgctggtacgaggagtgctcnatatacnnctactcatcaagn

SEQ ID NO: 83101 - DNA, 534 bp, Triticum aestivum
  Clone ID: PAT_TA_83101
agaagacggcgccgtccgggttcgccgccgcctacgccacgggcaccgagctcagcttgtacctcaccacgctcttccttgggccggcgatcgtgcccagccacgtcaccacgcactggctcttgttctccatccgcataatggaggccttcgacacacacagcgggtaccacttcccgttcagcctcgcgaggttcatcccgttctacggtggcgcggaattccacgactaccatcactacgccggagagaagaccaggagcaatttcagttccgtgttcacgttctgtgattatatatatgggacaaacaaaggctacatgtaccacaagagaagcctaccgagctgaagacgaaggaggccgaacacagcgggaaagaagactgagattactactctcaacattttatgcacgaataattggatactgcataaattaagcgtccatcatatacatattgctcgctccgttctgttcgttgcctagaatgaattcaacaatatatatatccatatgtgtcaaaaaaaaaaaa

SEQ ID NO: 83102 - DNA, 315 bp, Triticum aestivum
  unsure (1)..(315): unsure at all n locations
  Clone ID: PAT_TA_83102
ctgctcaccaactggaccatctacaccaacaaggcggcggccgtggccacgctcctgtccgtggccgccgtcaacctggtgctcggcgtcctgccccacgtcgacaacctggcgcacctcggcggcttcctcgcgggcttcctactcggcttcgtcgtgctcatgcgcccccacttgggctggatggagcgctacggactccccgccggcgcgcctgcaccgcaaggaantactccgtacaagtggacctctcgccgtcgcataatntctccantcgattcncgccggatggcatgtcttcgcgggcaaagcaac

SEQ ID NO: 83103 - DNA, 569 bp, Triticum aestivum
  unsure (1)..(569): unsure at all n locations
  Clone ID: PAT_TA_83103
ggagccaacagcactcagcaacggcgttagccactgcccgatactcagccaccttactcgaacgagagaccgtgggctgccgcttggacgaccaagatatcagcgagggcccgaggtagatacaatagcctgacgtagagtgacgcgtgtccgggcagccagcccaatcagcgttggagtaggcaaccatgtcgatggaggaggaggccgtcagggtgagtcccatggtcatagtgtcatgtatataccgaagaatacgcttcaccagagtccaatgggaatcacgtggggagtgcatgtggaggcacacctgctggactgcataatgcaatcaggccgagtgagggtgagatactgcagggcgccgacgatggagcggtagaacgcggcatccggcgcaagggaacctccaaagaagaaacttcgccttggtgtcaacgggcgtgggccggtctgcaattaagcataccacgcgctcgaggggggccggtaccaatcgcctatatgagtctatacccgctactggcgtcgtttnacgtctactgggaaacctgcgtancacttatcnc

SEQ ID NO: 83104 - DNA, 571 bp, Triticum aestivum
  unsure (1)..(571): unsure at all n locations
  Clone ID: PAT_TA_83104
ccgaaaggcaaaccagccaccagtcccaccaccaccaccctctgtcttcgcctccgctgccgattcgaaagcacccgtcctgtcccctcgcaaaaccctagctccagccaccatgaagggcaaggctgacacctccaagaaggacgagggcaggctccgggcgggcggcgccgccggaaagcgcaagaaggccgccgcgagcggcaagcccaagcgcccgccctccgccttcttcgtcttcatgtctgaattcaggcaggagtatcaggcgctgcaccctggcaacaagagcgttgcgaccgtgagcaaggcagcaggggaaaagtggcgtgctatgtcagtcaagagaacaaccatatgtggaccaagctggacagaagaacaggactatgagaagactaagnaaactttgataagaaggagacacaagctcaaagaagctaagactgangatgaggatgntcgaatcagaggtgatgacaagatgcacagtgacaagaaaacatgacatagtaacatctcaagtncangtacaaatcagtgtangtccaatngctatgtttntgcttaa

SEQ ID NO: 83105 - DNA, 562 bp, Triticum aestivum
  unsure (1)..(562): unsure at all n locations
  Clone ID: PAT_TA_83105
gcacacccgagctcgctccctccttccacgtcgaggtccgagtcctgctttgatggcgaccgacgtggctgagactcccgcgccgttggtggatgcggccccagaggcgcccgccgacgccccggcggcgcctgctgccgacgcgaagccggccaaggccaagaaggccaccgcgccgaagaagcgcgccagcccgacccacccgccgtacgccgagatggtctcggaggcgatcacgtcgctcaaggagaggacggggtccagcagctatgcgattgccaagttcgtggaggacaagcacaaggacaagctcccgcccaacttccgcaagcttctgaacgttcagctcaagaagctcgtcgccggcggcaagctgaccaagtgaagaatcgtacaagctgtcgtccgccgccacaagccgaatccaaccaaggcgcccgaagaaccaagacggcgctaagaagccaaggcgctgcaagacaaagtaagaccccgcaagngaagccgcaaaagcaagccgcgcgancgaaacctangaancaagaaccgcaagcaagcagca

SEQ ID NO: 83106 - DNA, 550 bp, Triticum aestivum
  unsure (1)..(550): unsure at all n locations
  Clone ID: PAT_TA_83106
gtcgcnccncgcaagctaagtcncnccactccaatgggcagggccgctggcccgttaantcanccaggttcancctggatttgctgaagaatgctganaataacnctnatgtgaaaggcttggatgtggacaacctcnatgtttcacacatccagttgantcaancccacaagcanaggcgccgcacctaccgtgctcacgggcgcatcaatccctacatgtcctcaccttgccacattgagctgatcttgtcaaagaangaacagcctgtnaacaaagangctgacaacattgtcgcagcantgaagcactgaagtatancagcatgctgatcgaggccattttgtcgaagtantatanccgtaactcttttatgtaccttttcacgcatcttgctctccagactntctggcaccgatgtnttaaatctggattactatttctgtctgaantactgtgttggactgtaagttaactcgtnancaatngtctaanaaacatcatnancnaatctaggggggcccttacaatngcccatatgctcgttanc

SEQ ID NO: 83107 - DNA, 567 bp, Triticum aestivum
  unsure (1)..(567): unsure at all n locations
  Clone ID: PAT_TA_83107
gcgggtcngactgcggatcacnggctccggcnagccgctgagnagggcctgtgcngcgaccgagctcgtggcgggagaagatggacgaagcgagcacctccgcgtccggcgccgcgacgangcgcggcttcgtgcctgngagatcgggagttttctataggttcacccatcagaacctcccagcttggaagccagcaatgacacctggatgtataatagcaatgttcttgattatcggnataattttcatanctttcgggcttctttgtctccanacttcanatcatattgcataaatcatctaccgctatgatgttgactgtgtgcctgatgcttacagaggaaataggcaagcttatattaaggacagctcgatttctaagaactgtactctggaagcgaatgtctggaatacatgagacacantnatgttatatgaacttgagaattcancanaatcacgcagtatgtcaaaataaacgataaacactgctttggggcaaatacacggcgccgtgcatctgttagtggataaatngtcccaatntccgcgttnntgctgagctn

SEQ ID NO: 83108 - DNA, 568 bp, Triticum aestivum
  unsure (1)..(568): unsure at all n locations
  Clone ID: PAT_TA_83108
cttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcggcgttgcaggggttcctgtgcctggaggaggtggacgggaggcggtggagctacgtggtggacggtggggccgcgaaggggaagagcaagggcggggccgtcccgctggggccgccgtcagggccgtgccgctgcatcgccgcttccgcctgccgaggaaataatggatcataagatatatgtggtgctgaaggttcagaagtgtaccctnaattacctaatactganggtctaacantcttgtggaccatggatgttacacagaactnctagtn

SEQ ID NO: 83109 - DNA, 559 bp, Triticum aestivum
  unsure (1)..(559): unsure at all n locations
  Clone ID: PAT_TA_83109
taaccatgacactctatggacaggtggacctggtaattatacaaatcccaatgcacctgctgttctttctaaagtaaggagccttgttgagaacggaaagtaccctgaagccacatctgctgcatatgatctatctggtgaccaaacacagtttggtcgttatctactcatttcgtgctcaaggcctggaacccaaatttccaatctacaagggatatggagcaatgacacttcaccaccatgggatgcagcaccccatccaaatataaatctacaaatgaattattggcctgcgcttccttgtaatcttagcgagtgccaagaaccactgtttgactttattggttccctctcaatcaatggagctaagactgcaaaagtgaattatgaggctatggttggtcagtcatcaatcacagacttatgggcaaaacatcaccagatgctggtgatctgtatgggctctatggcaatgggtgggcttggttgnactcatcctgggacattacgtttacttggcaaaattttaganaaaacgttcacattggaggatagtngt

SEQ ID NO: 83110 - DNA, 478 bp, Triticum aestivum
  unsure (1)..(478): unsure at all n locations
  Clone ID: PAT_TA_83110
cacactctccagcaccagcaggccggcggcaagcagcgcangcacagcagcanatggctaccatcagcgccgccgcggcgaccaccgtcgtcgcccgtgccgccatcgccaggccgcaggccctangtctgccccagctgaggacgangagcgagagggtgaggtgcagctactccaaggacgccaaggaggcgacnccggcggccgccgtccgcggggccggcncgtccctgctcgccgcngcgggcgctgtgaccgngtctcgcngggccggcgctcgctctggtcnacancggatgtctncgganggcaccgggctcancctgcggcngatcaacaaactgcnggggtnnatttcctgngnntcttcggcctatctggncncncatacngtcnacacctnggcacnncaagnctangatncttggggnttngccgaagcatttctctctcgnccantanccgtcncgngatccat

SEQ ID NO: 83111 - DNA, 543 bp, Triticum aestivum
  unsure (1)..(543): unsure at all n locations
  Clone ID: PAT_TA_83111
cacacactcaacaccctcagccaaggaaaacaccccacccactcagttactccgctctaccggctacacgcatagtgtcgcttcgcctccagtcctccctcctgttatcggagcgttcgtactgtctcgtggacgccagatctacaagtctacgccaggagccagaagccagttccgcgagctcttcttcccgcttcgctgaataagcacggcaagctcactggatccctttgatgcataaattacctatgcttttacaaccacaaccctcaacctgttattttatgcatgatatgattttgagacaagttattatggcacccaagccgcttgccgcaatcaatccttgatatatttgttacaaatgatttgagaaaagtgtgagttttcaaaagaaaatgctttcaaaatgtgtatgatgaanggtttcaccttacacctgtgantgggataatcanggaccccnntttagggaaggctaaagngatgccanctggttagcgtnagcaaaggnttccctcaaatangncggtttatcctnan

SEQ ID NO: 83112 - DNA, 544 bp, Triticum aestivum
  unsure (1)..(544): unsure at all n locations
  Clone ID: PAT_TA_83112
gtttttttttttttttttttttggatactgatcgaaccaacaagctgtacaaaaggttaaatccactgaccaacaggtgatcttctcgacggggttcaaagacatgattcaaaccttcgcccatggctcctcaccttcactggtcaccanagtggttttcgggggttcatacatagaccatacttatcaacaaaacgtgtttcatgccatccacggcaaggaaacatgaatacaggctgagtcagccagcacccgctacggcacaaccaaacttgagtagaggatcagtcagcacacctagggcgcatggttgctgtaatctccccttgcgccgccgccgccgtcagtcacaccattagggatgcttgccctattagggttcgccgtggtggantatggagatanggagtggcaacgctgccattgctgctctcaagcgccagccgtactgcccttgtaattcgttcgggtctcgtccttgccatcactctcangtgcgggcgaacggcggcacacaggcgacgcattatanctcacaatcgcg

SEQ ID NO: 83113 - DNA, 176 bp, Triticum aestivum
  unsure (1)..(176): unsure at all n locations
  Clone ID: PAT_TA_83113
cgcgagccanctgacgcaggcgttcggcgccaaggggctgatccaggccgagatggtggcgctgtcgggggcgcacanggtgggcgcggcgcgctgcanctccttcgcgccncgcctctactcgtacgggcccagcggcgcggggcaggacccgtccatggaccccgcgtaactgg

SEQ ID NO: 83114 - DNA, 548 bp, Triticum aestivum
  unsure (1)..(548): unsure at all n locations
  Clone ID: PAT_TA_83114
taagtttctcgtctccttgttcttatcaatccaatcttttccgcgagtggcaggttgtcacctaataatttgagatgtattccataagtccatatcaagctatcccttttcgttgttggttttccaacaactccgtttgacccttctcctaagatgctttcaagctcattcatgataaaagatattgtttttctcctccgttcattccatttcattctctcttttcttccggaggcattgtgatgttgctcttttcagtcatcatctcaaattatgaagatcatgatcttttcatgcttatcctatttaaccggactgttgtgcccctttgctcaagtttttttttcattttatcaagctttcatctcttttcaaccgaagtgctacccaaatcggtcttctttcctcnttcaaccgaaggaggagctcgatgaagtctgtccttgtgtgttccgttcaattgatagtaatggaccattgggacatcgggatctgtgtacattggggaatctcttaattggtcgtatcggcctgatgtgtcggtgaga

SEQ ID NO: 83115 - DNA, 557 bp, Triticum aestivum
  unsure (1)..(557): unsure at all n locations
  Clone ID: PAT_TA_83115
tacggactagtcaggcagccaaagtggggccacctaagggatgtgcacaaggccataaagctctgcgaaccagcgctcatagcaactgatccgtcatacacttctctaggtccaaatgttgaggcagcagtatacaaagttggttcagtttgcgcagcattccttgccaacatagatggtcaatctgataaaaccgtcaccttcaatgggaagatgtacaggcttcccgcctggtctgtcagcatccttcctgactgcaagaatgtggtacttaatacagctcagatcaattctcaaacgacaggttcagaaatgagatacttggagtcgagcaacgtcgcatcagatggctcatttgtcacgccagaactggcagtatctgactggagctacccatagagcctgtagtatcacaaaggacaatgcacttacaaagctggactgatggagcagtaacacacagcagatgcatgattccctggnactcaacaacatcacantaangngatgaacctatcaaatggaagcatcnatcggagtaaccactggcatgtctn

SEQ ID NO: 83116 - DNA, 551 bp, Triticum aestivum
  unsure (1)..(551): unsure at all n locations
  Clone ID: PAT_TA_83116
gccaccaccatcgtagcactggccggtctcgctatgctcagctttattggcgccaccatttggttcgtcaagaaaaagcgccggcgcattgagcccccggcgacactgcctacacagcaaccagctcctccgccaccgcccaactacattccatcttcggctggatcctcactagcttcagatgggttctacttgagatcgccagggtatcctttcatgaggtacagcactgggagccgtggttttccatactccccagccgactctgggattgggtattcccatatgctcttcacaccagagaatttggcagctatcacagatgactttgcanaagagaacttttgggggaaggtggatttgggtgcgtgttcaagggcattttgcaagatggtcgccagttgccgtcangaactcaagatgggaatgggcaaggcaacgtgagttcaagtgagtcgatacatcacagatactcatagacatttggttcccagnaggtatgcactgcggaggcancaatgctgttacanttgtccaacacaacntantnc

SEQ ID NO: 83117 - DNA, 555 bp, Triticum aestivum
  unsure (1)..(555): unsure at all n locations
  Clone ID: PAT_TA_83117
cgagagccagcggatcacccacattgccgtcgagcgcaaccgccggcgccagatgaacgagtacctcgccgtgctccgctccctcatgccgccgtcccacgcgcacaggggtgaccaagcatcgatcgtgggtggcgcgatcaactacgtgagggagctggagcagctgctccagtcgctggaggtccaaaagagcctgaagcagagccgggggcggcggccagcaggcggcggcgccagctgctcccccccgttcgccggcttcttcagcttcccgcagtactccaccgccccaagcaccacgagcagcagcggcggagagaaatgctgcggcacgacgccgcggccgcggacatcgaggtgacgatggtggaaggcacccagctcaagtgctggcngccgccggccaagcactcctgaactcgtcgccgggtgcacaactgcgctccgccgctcaactcaactcacgccgcgtcacgcatggtctctaactcagctcaancggtggaggcatatatggtggctggcttccgttggacgnaagtgagatatcca

SEQ ID NO: 83118 - DNA, 545 bp, Triticum aestivum
  unsure (1)..(545): unsure at all n locations
  Clone ID: PAT_TA_83118
ccgagatggatatctgggaggccaactccatctccaccgccttcactcctcatccttgcaccaagctcactcagcactcttgcactggcaactcttgcggtggaacctactctgatgaccgatatggcggtacttgcgatgccgacggttgtgatttcaacgcctaccgccagggcaacaagaccttctacggccctggatccaacttcaacgtcgataccaccaagaagatgactgttgtcactcagttccacaagggcagcgacggacgtctttctgagatcacccgtctgtacgtccagaacggcaaggtcattgccaactccgagtccaagattgcaggcaacccggtactctcttactctgactctgctccaagcagaagacgtcttggcgatatcgatgactcaccaagaagggtggtggaacgcatgagcgatctctcgcagccccatggtctgttattctctctggacgacacatcaaatgctctggtcgatctactacctacgatctacaaggtggatcaacnagtnctgcccaca

SEQ ID NO: 83119 - DNA, 556 bp, Triticum aestivum
  unsure (1)..(556): unsure at all n locations
  Clone ID: PAT_TA_83119
ctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatanggttaangaggattcacaaaaagtatggtggtgggaaactgctactgctgcagctaacagctcaatcgagatttggtnaaaacttaaagaaacatcagtatgtgtggtacctgaaagtacaactggcaaatgaagccagttagaatcaagggtatgatggaacatgaaaggtcggatgtggaa

SEQ ID NO: 83120 - DNA, 534 bp, Triticum aestivum
  unsure (1)..(534): unsure at all n locations
  Clone ID: PAT_TA_83120
cgctccagactcgttgctcactgaagagtgcgacgtcctcatcccagcagcgcttgggggagtcataaacaaggataatgctaacgacataaaggcaaagtacatcatcgaggctgccaatcaccccacagatccagaggcagacgagatcctgtcaaagaaaggcgtcctcatcctccccgacatactggccaactctggtggcgtcacagtgagctacttcgagtgggtacaaaacatccaggggttcatgtgggacgaagagaaggtaaacgcggagctgcggacgtacatgacgcgcgccttcggggacgtgaagcagatgtgccggagccacagctgcgacctccgcatgggcgccttcacgcttggcgtcaaccgcgtcgcgcgcgccacgtcctcaagggatgggaacatgactcctccgtgtctccgtgtgccctcctgttgtacctctggcctgggccttgtttcntggtaatatgtcnaataacgngttcgagaaaacggtagttaaaatcaaaatggtctctg

SEQ ID NO: 83121 - DNA, 209 bp, Triticum aestivum
  unsure (1)..(209): unsure at all n locations
  Clone ID: PAT_TA_83121
cctcatgccgcaagatncgaccactaccgcntnnacactgcacangtcgancgagcggatgctngngctcgtcagagtctgagcctgggacatcgaagggtggccgtggggctccngcatcctggcccctcaacaaggtgacccgccgcgatcanggncgngtttggnttcgccagcgtctcatcagtcgattgctancanctncttcc

SEQ ID NO: 83122 - DNA, 538 bp, Triticum aestivum
  unsure (1)..(538): unsure at all n locations
  Clone ID: PAT_TA_83122
agagatacctactctcggggaaacacccctagcaatgcggtggtaggcagcttgaactcttcccccgctgcgagcgccaagaagctgcagcgtgaacgggagatgcttgcgaggcagatgcagaagcggctcacggcagaggaaagggagcgcctgtacaccaaatggggcatttcgctggactccaagaagaggaagctccaggtcgctcgccggctctggaccgaggccgaggacctagaacatgtcagggagagtgcctcccttgtcgccaagctgatcgggctccaggagccagggcaatcctcagggagatgttcgggctcagctttgcgccgcagcagcagcgccccctcgccggcgatctccaatggctggagatacgggtccttcgttcggctgatcggtcggatgaacggtgcgacgactgactaagagattaatacctccccccactttttttatatctgggtggttacggtactctgattcgtagtttangaggtactacgggcacattgttgtcggtggctctgca

SEQ ID NO: 83123 - DNA, 543 bp, Triticum aestivum
  unsure (1)..(543): unsure at all n locations
  Clone ID: PAT_TA_83123
cccaaacccagcggaaggaggcaaagcgaaggaaggagctcgccgtcgccgaactgcaactgcaactgctacaggacccgattcccagagacagacaccgctgcaattgcaactgcagctgcgatggagatggcctcttcctccgcgccgaccgcgtcctacaacgtgtccgtggcacaggcggtgctgacgctctccatcaacgccatcctcctctggctcaccaccgtcatcaagtcctactcctcctcatcctcctccgcccgccgccgcgacgccgcccctgccaccgccccggcaccgccgtctccgtccccggctaagcccgctgccgccgctgccgccgccgtcgacttggacgcngtgctcgggctgatgggcgccggcgccgagtcctcgggttcgangaggcggcgcgctgttcnaggangaagagcgacatggaggaggcaagcagggttcgccgtcttcaccgcacgggacggtnatcacgcccggactcgggcgtgtangtcctcgggttnatccgggttccccgcgcca

SEQ ID NO: 83124 - DNA, 197 bp, Triticum aestivum
  unsure (1)..(197): unsure at all n locations
  Clone ID: PAT_TA_83124
acctcatcgatnagcctaaantanaaanagagngantttgaagcgcncgggcctcngcncngctctcgaacttgcgctccatgttctganaagattgtttctgctgtgcaccgcagggatgatgaacacangacgccgcgggcgtgntgcggcgcgccgggcgtgngnganttcaacttcancctgacgtcaaagtg

SEQ ID NO: 83125 - DNA, 387 bp, Triticum aestivum
  unsure (1)..(387): unsure at all n locations
  Clone ID: PAT_TA_83125
attgantcttgaagagatcgancttcttttgcaccacaaggtcnaggatgtcttgcaactgcngatcaagctgcggctgcggctcaagctgcaagtgcggcaanaantaccctgacctgnaggagacgancaccgccgcncaggccaccgtcgtcctcggcgtggccccngnnaagaatgccgcgcccganttcgtcgaggccgcagcggagtccggcgaggccgcccacggctgcagctgcngtggcaactgcaattgcgaccctgcaactgctgatcanatcgatttgacgaccatgngatatgattantatctatcnacttgtggtngtggttngaacaataataagcgagncgantgggtgcatacatagtattgtgtgttgt

SEQ ID NO: 83126 - DNA, 407 bp, Triticum aestivum
  unsure (1)..(407): unsure at all n locations
  Clone ID: PAT_TA_83126
cttagagtcgcttacatgcttagcacgcatgatctggttgaagctgtcagagacgcagcttcagaatgcgccgcatcactgatagccgagtaccaggaaggactgttgaagatcggtaaatatgcagcacgctatttggccgtacggcagaggagattgtcgctcgctgccaaactccggtcggaagatcggtttatggatgttgaagatgacagcgtttcaagaaacgagcactacttcaagtggaaatgagcgcatataccacaagggagtcgacgctcggcatgtccagcaacgccagcaaatcacgggcggcaaggcggcaaaagaanggcggaaaagctggnnnaaccccggggaagaaatggcctccctgncatctcaggggatgcctttgacagncggta

SEQ ID NO: 83127 - DNA, 399 bp, Triticum aestivum
  unsure (1)..(399): unsure at all n locations
  Clone ID: PAT_TA_83127
gagaactggacggcggcggcggcggagacgacgatgcagtggtacttggtggccgcgctcctcaccatcctcaccagctcccagggaatattgaccaccctttcccagagcaatggcaaatacaattatgattatgccacaattccttttttagctgactcttcaattatctgtctcaggctcttcctctgggaaggaatgccatcctcatctccaccaaggatgacaaaggaatggagagcgtgcgactatatgttgttccctccatttatatacctcaacccacacatgtccattttgcanattgactatgttgaccatctactatccantaatggaactttaattgcacacngatttgttagctntcccnaaaggantttccatatcaaggtgatt

SEQ ID NO: 83128 - DNA, 403 bp, Triticum aestivum
  unsure (1)..(403): unsure at all n locations
  Clone ID: PAT_TA_83128
acggaacggaaccgtcaatccgctacgccacagcaacgaccaaccggagccgccgccgccgccgccgacggggacggggacagggaaaccaccaccaccaccaccggccatattaacagctgcgcgtgcacggtggagttctacttccgcccgcgattccgactccgactccgactgctccgttccgtctcgaccttcaaggcgggtaagcaggttgaccgtccgcgattcaccgtatccccgggatacttatggnttccaaagctccttccgcgtcacgctcctcttgctgtcctcgccgccgcctggggactgctgcacaggccacaanctgtattctacccccgtttaattggcattacctttaaggngttttttnaacaatccttctttcnaaanggan

SEQ ID NO: 83129 - DNA, 409 bp, Triticum aestivum
  unsure (1)..(409): unsure at all n locations
  Clone ID: PAT_TA_83129
gcaacccatccatactttcagctgttgatacaaaaagagaagagagaatggcggagccaaacccagagttgagtggtcttattactcaaacaaagaagaaaaatatagtgccaaagttcaccgaaatcttccccgtggaggacacggcctacccttacagcgccttcatcacctccgtccggaaagaagtgatcaaatactgcaccaaccatacaggcatcgtccacccgtgctgccgctgggagaagattcccccgantctggtctacacccgantcaaaaacgaagaccannccatcacctcgccatacgtatggcactctacctggtcggttcagacccccggcgggtgtttgtgggantccngcaaggacgggaaccactcctccacgacacccaanggtcngtt

SEQ ID NO: 83130 - DNA, 404 bp, Triticum aestivum
  unsure (1)..(404): unsure at all n locations
  Clone ID: PAT_TA_83130
gtttatagttctaatttagtttgttgttagttcattgcccatcttgctaatttttatgcccattcatttggtactaatattagatgatgtcatcttatcatgaattaaggagtgaggcttcggttcttaacatgttctcaccttggctttgccatcttggtctgtgatcatcntgtgaaggtgcatatgtnctcgaagatgagcaaagtanttnctgaaacgttttcaactganaattggaaaggttccantttaactgccgtcccantaccggtcccctncttccgctatactacacttgttactaatatccaangctttggtatnggactcaactgaggcggaattataaaaagctgtnaatattttaaataatttaatngncacggngccacagnttnttn

SEQ ID NO: 83131 - DNA, 229 bp, Triticum aestivum
  unsure (1)..(229): unsure at all n locations
  Clone ID: PAT_TA_83131
agcgccgatcgccgcttcaagatctttgcagccgccgatggcttcggccagccactcaaggacgccgtcgtcgcttatctccgcgcccaccccgccgtcgccgaggtcgttgacctcggcgtcgacaagtactacgccgccgccgcagccgtcgcccgacacgtctcctctcccgactcggagcctgaccccccgangtccgcgggtcgtatctgcggaaccggcccgg

SEQ ID NO: 83132 - DNA, 413 bp, Triticum aestivum
  unsure (1)..(413): unsure at all n locations
  Clone ID: PAT_TA_83132
gcccttcgttgcatggtagcctgaacaataanctgtggaattgctgaaaaaatgttcctatgcatcatcaaggatgatgttgatantggcacatgtttcaagctactgttagcttttctttatgtacagcgacttacaagagttcctggcaactggcggggtgcttccttatttccagttgttccatgtcttctttgtcttatatcattccatgatttgtatctgaattttataccatgttctacaggcaaagggcganattattggaaagataanaacataattgaagagatgccatgctgccggcagatgttcaatattttcatccttttgatcctgtagcatacagattgaacacttgtatgtgaagattatcaanagagcncctgtaatgtccctacatagaggnggaa

SEQ ID NO: 83133 - DNA, 292 bp, Triticum aestivum
  unsure (1)..(292): unsure at all n locations
  Clone ID: PAT_TA_83133
ccttgcacgagttcaccttcttcttcgactgctgctccacggcaagtgatcacccgcctcctgattctctgctagaaaagttccagatcgactgcaaagggttcgatccacctgcaggcagtggaaatggtgtttccttcttgtttacctctgaggatgacaacgtttctccgagagtacgaatgggcccgagcactgcattccggatggcatcgtgccggtaaataaagatnccctggatgagaattggcactcatgttgcctagtgatacggtcccttngccaancaagg

SEQ ID NO: 83134 - DNA, 405 bp, Triticum aestivum
  unsure (1)..(405): unsure at all n locations
  Clone ID: PAT_TA_83134
gccgcggcaaggccacctgccacgtcgtgtacggcgagcccatcgccgtgctcgccggcgacgccctgctcgcgctcgccttcgagcacatggccagcctcgactcctaccccccggacgtcgaccccgccaagcacaccgcccgcgtcgtccgcgccattgggtgagctcgcgcgctgcatcggttcagagggcctccgtcgccggccagttgttgatctggaaatgactgggtcaaccgagactgtaccacttngaccgccttggatacatccatctgcacaagactgctgccttgctttagnctcnattggtaatgganaacatcgggggtggtccgaaagcaattganggttgccaantacccaattnatgggttctgtccaaggggtgataatcctgatn

SEQ ID NO: 83135 - DNA, 431 bp, Triticum aestivum
  unsure (1)..(431): unsure at all n locations
  Clone ID: PAT_TA_83135
gccgacggccgcggagtagtcgcccgggtaggagctgtcgcagtagtagngggtaaggggcaggtgacgaagtcngtggtctcctccagctgccaccgcatgcacttgagtatctgcctcgtcaccgcgtcgccgccgccgtgctgagccgctctccacgccgatcgcccggcaccgaanagcacctgatcataggncatggtgggtggcagcgancgaccgtttcttgacgtccttgagctctctgcccctacttgtccttcttcctcctcctctgctgcttcttgtcctgttcgctatatgcatgcctgcatttgggtatccgccagtgatggcttgctttcggangaaccgctcacttcctcctctccgctcctcctcttggaggcggtgtgctgctgctgttgcttgttgagagganggagggaagg

SEQ ID NO: 83136 - DNA, 584 bp, Triticum aestivum
  unsure (1)..(584): unsure at all n locations
  Clone ID: PAT_TA_83136
ccgatcgatcagatcaaaagggaattcctgaaaaggagagaggagcacccttcctcgccatttccgtccaagtgttttcccgaggagtcgtgcgtgcctgctggcgctgggggcggctggaccggaagcattgcctggccgccggcgggaaccccggcgctcgagtcccttctctcctctcctctcctctcctctgcnggggggcagccttttatttgacaacggtataaagaatcaagtacaaatgaagaggacatctctgcccagtaattgatgactgaaagataggtancagtatggtagctgctacaattgcgggaagttcctgtgtgttttgaatccctctgaactgtttggcacaaaaaggaaagatgaaagcgaagacatgttcttgcaaaacatccaattccgttactttggaaagnctananagcnaactgcaaatggcgtgtatacnataaanggcaaagaaggaaatttgttcttacgacgaatcaancacaatcccattacnaaaagtattgacanaagacttggccattgcttgtaattgaaacccatgncgatcccaaaangtagttcaa

SEQ ID NO: 83137 - DNA, 301 bp, Triticum aestivum
  unsure (1)..(301): unsure at all n locations
  Clone ID: PAT_TA_83137
gagttttttttttttttttttcccacacgattggaattccatttcacaccaaagaacggatagccagagaggctacagacaccaagacaaactgctgaaccctagcacaaccgaccgacccgcacaggggtcaaggaaccagtgacgacgccagagcggagagtggggggcgggtcgagcatggctancctagcgccctagccgccgaagccgtaaagggtgcggccctggcgcttgagcgcgtanacnactcaatggctgtgacggtcttgcgccggcgtgctcnttgtaggtgacggcg

SEQ ID NO: 83138 - DNA, 559 bp, Triticum aestivum
  unsure (1)..(559): unsure at all n locations
  Clone ID: PAT_TA_83138
tctcgcccaagttcgcgcaccgcgtcgtcgggtacctcgaggaggaggccgtccactcctacacggagttcctcaaggacctcgacgacggcaaagatngacaaagtccccgccccgggcatcgccatcgactaactgggcgcctccctgcaaacgcaaccctcaaaggacttggtcaaccttggtncgccgccaacaaaggtcaacaaccgcgaacttaaacaactnccaatccggcgtgttacaacaaggtatcaactgnaaggcaaccccggccccattcgntacactgaagctgggcgtgttctgctgaaatttgcatcnctactaatactactactaacaagcaaatgatgtttcgtttgaangcaaaggaatgaaactcttaactgtanagatgtncaattgttgcccntttgggaacatccntnctganaanaacaatgtgcttgcaantactnnccaggganttttgancacaagtccccaaatnaccaattggntaacccaaantnttcttnaaanccacattgtntacccccntnttaaaaaaaaaaaa

SEQ ID NO: 83139 - DNA, 549 bp, Triticum aestivum
  unsure (1)..(549): unsure at all n locations
  Clone ID: PAT_TA_83139
cgcggacgagcgcggcgagagctccgcgccggcgatggccggcgtgcagcgcgaggtgtactcgaagaagggcgtgatgcggcggctgatgcggtggagccggccgcggtgggccgcggcggagcaagcggagtgcgcggtgtgcctggacgagttccgcgcgggcgacgtgctggcgcacctgcgctgcgggcaccgcttcactgggcctgcgcgctgccctggctcgagggcactcacgtgccccttctgccgcgccgccgtggacccggcgccgccgccgccgccgacggcgcctaaaaacgggcgaagctctgtcctgctggggcttgcctggctgggaacgcgccgggcgcctngtcctgtccggncangccaactacgctacccaatgngttgcaccctagcaattgctaatggggtgncatgtaatggtgaccggctctntcatttgcccgaccgagaggaacanacccacanaaccttatgcttggaatttgaccttgcccnaaagacgttgngaattttgtnccttgcccttgcgtcccc

SEQ ID NO: 83140 - DNA, 477 bp, Triticum aestivum
  unsure (1)..(477): unsure at all n locations
  Clone ID: PAT_TA_83140
actacaacgagcacgctgatgatggatacgaccggactgccttcccagacatcacaagcatatcattcaagggaatccatgggcagggtgttcgggtgcctgtccgagctcatggcaagcgacgtcatccccatcaaagggacatcagctttcaangaacatgtcggtaggcatcagctacaagaaagaaagncacatcttcaagtgccccaactcnaaggggcttttcannaaggccggtgttcccgaaacaatttaagaaccngaccttcataataacaaaggcaanctnttnaaccgggcaattggcctaaacaanaaanaacntnactaacaantatgagnncncattcatnccacaacctttannanttgaatggaattggggccccnaccccanaatcnantttcccaattgccangntttttgggncaaaatnttaatanagnggaatcccccctgaaagtttgccgcta

SEQ ID NO: 83141 - DNA, 517 bp, Triticum aestivum
  unsure (1)..(517): unsure at all n locations
  Clone ID: PAT_TA_83141
ccgacgccaaccaccaccacggcaacggcaaggcggaggcggaggcggaggcggtgctctgccagccggcgagcgagttcctgccggtgatgcaagaggtgtacgccgcgctggtggccaaagtggagcgcgcaatcccgggcgcaaaggtggaggacaacaanttctgcctgtcggtcnacttccgttgcttggaggaggcntctgggcccgctcttcaacaagtcgcgcnttctaaggaacacccgggcttgcgcctcaccaaggcccaangtgctggagtccgcccaanattcgctggacaangggaangcctggagttctgctcaancctcggcttcccgccgaagccaaccgcnaaaactnctccatcaacttcgggaanaacgcaccaacaaggacccttnaggttctcccccncccgggaaggcccgggatctcgtncaagttcccaaggaacaacgcgtcnttaagctancaacccncgagtaanganttctgccaanctctcgggcaa

SEQ ID NO: 83142 - DNA, 426 bp, Triticum aestivum
  unsure (1)..(426): unsure at all n locations
  Clone ID: PAT_TA_83142
tccacctggtgctccgcttgcgaggtggtatgcagatctttgtgaanaccttgactggcaagaccataaccctggaggttgaganctccgacaccatcgacaaacgtgaaggcgaanattcaaganaaaagangggcatcccccaagaccaacaagcntctgatctccgccgggaagcanctggagggattggccgcacctagcagactacancatccaagaangagaacactctcaacctgtgctccgcctcngcngtggtcantaangcatggtcattaagctgctgctgtacctgggtatctgcgtctccggngcctctggtgtactctatatggatgtcntctcaataaaatcgtggttgtttgtctgaacgtngttgtngcttctttggttaangaccntngttccncgtgtgtcccaaaa

SEQ ID NO: 83143 - DNA, 572 bp, Triticum aestivum
  unsure (1)..(572): unsure at all n locations
  Clone ID: PAT_TA_83143
aatgactcatagatcgatattgtgatgagtggcctatgatgctgtatgttgaagtggggtttgacgacctcatcactacttaccaagcttcgcacacaacaaaccccacgacgatcaagtgcggcagcagtgttcccgtaacacctcacaaccctcattaccaatgaggcctgtagctcgatctatccagcgaataacacagattctaagccaccttcaacacacaatgtcggcacatcaccagatgccagcagcgccatggcgctcagcttttctatcccacgttgataagatggatctccaactttcatgctcagcacctcaatcacaatggtctcatcactcctcgttcccgtaccgtctgtatcnaggacttgggcgagattccgtcaacccaagacaagcacgctcaaccctctctctacaagntgacntctacatcacactgatctccatggaaaagtactgaactatcactgacgggagaataccacatctggcgnggngactgtcaacgtctctggtctaanacaaatcatggngtcaagtgcggctactctggcaaaanacag

SEQ ID NO: 83144 - DNA, 470 bp, Triticum aestivum
  unsure (1)..(470): unsure at all n locations
  Clone ID: PAT_TA_83144
cggaattcccttccggacaagacacctaccaccacccaccacccagcgcaaggccaggcggcccaggccaccactccttaccttttcccccctcttttgttccttcattcacgaatcccgtcttcttcctttcttggccttctccacctcatcgccgagacgagatntctcccacacgangaggggaacanggaaaggagaaatgggcgggcgggtggatnacgagtactcctaactgttcaagatggtcctcatcggagacancggcgtccgnaaagtccaatatcctctctcgcttcangcgcaaacacttctccctcgatccaagtccaacatcgggtcaattcgcacaagtccctgcanatggccgnaaaacataagntcaaatntgggacaanctgggcangaaggtacgtncaattanagtgctaacaacgttgacccttggaaaacgctttgttcnaatccaa

SEQ ID NO: 83145 - DNA, 574 bp, Triticum aestivum
  unsure (1)..(574): unsure at all n locations
  Clone ID: PAT_TA_83145
caagcacacactagacacagcagcaagcaagcaagacaccaaacattccagtgcccgccttataccgttgcatgacgaggatgagctcgagggcggcggcggtgacggcggcggcgttcctggtgctcgcggccgcctgtccgctgctggcctcggcgcagccagcgccgggcatgcctccgccgtccccggccgcgaacaactcccggctggagaaggcgtacgtggcgctgcaggcgctgaagcgcgccatcacggacgaccccaagaagctgaccaagaactgggtgcgggccgacgtgtgcagctacttcngcgtttctgcgcgcccggcgcccgacgaccctgccaacgcacgngtggctccgttggacctcaacacggcgactcccgggacgctccccgaagactgggctccttccgactcgcctcttcaactcaatcaacgctcancggtcctcccgatnntccgctcctcaactctccacagtcactcagcacaacaacttcgggccntccgccgaactctctgctccaactcagtctggactagtcacaactttcggnagtccgg

SEQ ID NO: 83146 - DNA, 588 bp, Triticum aestivum
  unsure (1)..(588): unsure at all n locations
  Clone ID: PAT_TA_83146
ccttgacttttagtcaanttcactcgttacaagcacatctaccaantatacaacttccgaagtttaccttaatttaaatcccaaaccccaaaancaaacccgacaaaaatgaaagttcggctactgctctcgctttcgctgctgggcntcnctgcccacgccaaagaacgtcanctacaccancgaggtcgtcactgcctataccacctactgccccggtcccactganatcgtccacggcgacaagacctacactgtcancgaagccaccanctcaccatcactgactgcccttgcactgtcancaacccgtcatcacactccgctgtcgtctgccacgactgnnctgtcctcccgcccacacggcaacaatccaccatggccccgtttacctacggtaaccccggnaanctggtctcctgctggcccgtgctaccccacgcggtgctcctccgagncccacgcggtgcngnaagtnccgnttctcggtgccgtctgctgcgtgtcgtctgcgcttctgtaataaangtagaagncantcactgtgctanancttacctataaanttattcctgggatcatattccn

SEQ ID NO: 83147 - DNA, 509 bp, Triticum aestivum
  unsure (1)..(509): unsure at all n locations
  Clone ID: PAT_TA_83147
cgccgcgtgggcgccccgcgctacaggccgtcgcggttcaagctggaggccgcggcggcggcggcggcggcggccaagccgccgaacagcaggccgtgggacttcacgcagtcgctgtgggacacctacgagctggtgaccgtggcgcagaagatcgagtccagcctcgccatcgtggacgaggccacggccaggccaccaaggcgtgccttcaccaacgaagacgccacgcgcggcggaggagggaagccgggcgagggagagcangcgtagcctcaggacctgttccgccggtcctcgtccaggaggtcgaggatcaagcagctactactactagtgttctcctctctacttcctgttctctctctatcctccttgcctgaaaaactggcacgtctatcaacttagtacagactatctgtattgtcaacacactactgtactccatcatttagtanagaaaacatcantagaataatatatacgaacanacaaanaaaaaaaaaaaa

SEQ ID NO: 83148 - DNA, 213 bp, Triticum aestivum
  unsure (1)..(213): unsure at all n locations
  Clone ID: PAT_TA_83148
aaggaaacatnaggtccgtagctaccaccngccagcacgtgggcccgtcnctnttaaatagtgcgattaccngcgggagactgccactgagacntctagccacagaanttncatcattcattntcagtcaacnaatcccaccngttctccnacgcttccgggtagngtagnccaatgnaaggccncaaaaactcccttcnctcctcttgccaa

SEQ ID NO: 83149 - DNA, 565 bp, Triticum aestivum
  unsure (1)..(565): unsure at all n locations
  Clone ID: PAT_TA_83149
ccnccatncanttcaacngncgccncgcntagcatgcaagagcattaangatgccagntggncacaggctgcnctcgcggncgcnctaccngtncncgcaccncttcngcaanaagggctacatcccgcncaccagctanctccgcacctacaaaatcggcgactacctccacatcaaggtgaacagngccgtccacacctgggatgccgcacaattctacnacggtngcagnngtcgcgtctggaacttcaccanacncgncatctgngtctacataaacangcaagttaatggtcacatcacaggaancatatccatgtccgcgtngaccatngcatacatcacgctgcagagaagattctcctgangnatgcgaagatgacacctgangnggtgcataggagcccgcgangcatcacacaagagnancttgggcncaaccttctcaatgtnccgggatacatcnanacgtcatccatccgtacattggcatgatctagggaagnacaggtgttgttgnncctcncgtcacaccgtgtacccagtcgnnaatttgctncacga

SEQ ID NO: 83150 - DNA, 564 bp, Triticum aestivum
  unsure (1)..(564): unsure at all n locations
  Clone ID: PAT_TA_83150
ccgaaatcgttggacggggaaaggaaagcgaaacaagccacgctaagcaagatgcaccgaaaccctcgcgccgtcatccgcgccgccgtctccctcacccgccggccccccgccgttcctgccgcggaggctctccaaaccctgcctaaagcgacgccctcgcctgcgcttggggcgtggcggccagaccaggcggtggggcctttgggtagcgtcagccgccgccgcgccttctcctcctccgcggcagagtatggcaaggatgtnggacgangtgaaccgcaattcgcngaggcgcgggaggagatngangcggcatggagacaaggagacggtctactcaacgangagnctccatcgcgcctgacccgccaacgagcntcgctgcttcgaccgctttacggctccgccaacgacccgagcctccgccgctcaatgggtaaagatggacatgaagccaactcaacagtcnagataccgatagcncggaaggttgatttcnaaaattggcggatgttggtaanactgtctttnanaanaatcaagtttcgcttgtaaaaattn

SEQ ID NO: 83151 - DNA, 573 bp, Triticum aestivum
  unsure (1)..(573): unsure at all n locations
  Clone ID: PAT_TA_83151
ctccggtgcttattatatatcttttttcttttcaattttaggtgagactttcatattcttcaacaagcagatcaaaggaaacaagagggagatcatacagcttggtgtaccgttatttcaacctaccacagaggatgctaattgtcacacagaaccaatcccccttgtcctgcaggctgtcattgaccaccttgttctttgggcgtttaataccagaaagcaggaaaccaaatagtgtccgtcatcaacttcttccgatgaggatgaacattccgcagcctacttcaacctccccatcttgacaaccccatttgcaccttctgctgtctgaaaccacgatggatttggcaggcacttgtcactgacagcaacggtaactacaaagactctcacacttcactaaacaaggnccttacaatgagctgggaacatgccgacaggccnacttngtgtgcctcgtcaaacggcctgacacacttcgcaaggtgangcangacncggtggcataaccacccgtcccacaaggcatacacctgcagcgcaccggtcaggctccagtgcntcccgtacata

SEQ ID NO: 83152 - DNA, 428 bp, Triticum aestivum
  unsure (1)..(428): unsure at all n locations
  Clone ID: PAT_TA_83152
gatacatactactctctgacaagaagcatgctgcacaaactgggtcttgaaaaatatgaaaagaatttcaggaagggtctcctcaacgatcaaacattaccactccttacggacagtgctctgagagatgtgaagatccctcctggacccagacttctcattctcgaccaaattaaaagggaccctggcctgnttcgagcaaagtgaagtcacaattgtcaacaattgggtcctttctgagctgcatagggtttgaaagcaatgccacctcttttttttaaataactttccaaggaaataagcaataatttaactgtgctgttgttaatgtttttggccgatcaattgcatcaccattaantttgaacatgtgtttacatgcacttatcaaatttaaattggcatccgaacgatatgcannctgtggg

SEQ ID NO: 83153 - DNA, 450 bp, Triticum aestivum
  unsure (1)..(450): unsure at all n locations
  Clone ID: PAT_TA_83153
ccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacggggcgctcaccgcgaacaaggccgtctgctacggctcgtgcgccgctcgtgggcaggcgtatacccgcggctgcctggccatctacgggtgccgaggtggccgttaattaaccagaagcagcgcgtanctagcantcnatgtctgttnaattaaatgtcggtttcttgtgctgcttctcgtttttcttcnaatccccttctcttgcttcaaacaagccaagattcgatcatatatacatgttgtcgctcccaagttctgcattgtaatttcaacataataaatatgtattttcnaaaaaaaaaaaa

SEQ ID NO: 83154 - DNA, 510 bp, Triticum aestivum
  unsure (1)..(510): unsure at all n locations
  Clone ID: PAT_TA_83154
agtccaagtacttcaagccgggctccgtcgtcaccttccacttcccggcaccggcctccgcctccccgggacccgcggcggagatcaccttcgcgacggagggcaagggcgacgccaggatcgcggtggagaacgggaacgtcgccgggatgatccanacctggtacctcggcggcgactccgcggtgtccccaagcaccgtccgcagcctggcaaaccgtttcgccgcgctgctcgccgtcgccgcgtgattaaaacggtccggcgggccggttggtccaatttccnttggattgaattcctgaatgtccgtcccggnacccntgttgtcccntgtgtgttgtccnttngaancaaatttcaaantataataataaaaattatgtcccgtaaggtgtgcaaaatgtccttgtggaaacgtaatatgagatanaaaattgacggctctnaactcnaatccatggattangntcactaacttctcaataaaccnctcataaaaaaaaaaaa

SEQ ID NO: 83155 - DNA, 405 bp, Triticum aestivum
  unsure (1)..(405): unsure at all n locations
  Clone ID: PAT_TA_83155
cgacaactcattgctgccctctggaagatagaccgtgctccgtgctcggttggtgtcattcattggaggtggctcctccgtcttgtacagatttgattcgttcgtagtggtctgatgatgctggagtgacagaaatattcagatgcgggatgcgcaggctttaagcttttagtttgtaaaagtctgactaatgcgccctgtattgttgcatctaagaacttttgctgaaacaatgaaaaatcaattgctttggcgaacctgtcnggatngttcccatcctccnatcaatgcaaccgaagaagggtccttcctgcatggttgaaaataagntatcatncancttaactggccttttttccttccaatttgtcctgctgcgcaagaccctgctgcaaaaaaaaaaaa

SEQ ID NO: 83156 - DNA, 594 bp, Triticum aestivum
  unsure (1)..(594): unsure at all n locations
  Clone ID: PAT_TA_83156
gtcgcacaacaacctctccggcagcatccccgccgggttcgcctccgtcagcttcgcgtacctggacctgtcgcgcaacgccttcgccggcgacgcgtcgggcgtgttcggcaaggggaagccgctgcagcacttggacctctcccgcaacggcttcgccttcagcctcacggccgtggacctgccggagcagctggcgtacctggacctgagccacaacgccatccgcgggccgcatcccggcgcangtggccgacctcgccgggctgcagctgttcaacgtcagctacaacaagatgtgcggcgtggtgcccacgggagggagcatggccaagttcgacgcctacagctaccagcacaacaagtgcctctgcggcacccgctgccggcatgcggcaccgttactattgatcgatngatcatcatctatcgatnatgaaagtgtcatgcttgttctgtgtacgttcaacaaggtaaatacattcaagcaaggtaaagtcactcagatggattaactaaaatgagaacaatatancaatgtgggtgcatnanaanaagaaggtaccgtccgcnacnggctanacggtataccat

SEQ ID NO: 83157 - DNA, 622 bp, Triticum aestivum
  unsure (1)..(622): unsure at all n locations
  Clone ID: PAT_TA_83157
gttttgcaggcgtacatggtcggcgagcacggcgacagctcggtggcggtgtggtcgagcgtgagcgtggcggggatgccggtgctcaagtcgctgcaggagagccaccgctgcttcgacgaggaggcgctggagggcatccgccgcgccgtcgtcgacagcgcctacgangtcatcaagcctcaagggctacacctcctgggccatcggctactccgtcgccaacctcgccgcgtcgctgctccgggaccaacgccgcatccacccggtctccgtcctcgccagggggttccacggcatccccgacgggaacgacgtcttcctcagcctgcccgccaagctcggccgcgccggcgtcanggcgtcnccgaaatggagctcaccgangangaggcaaacnactgcgccgctccgccaanacatctggganaactgcagctcctcggctctgatgattaataacgtctcnctcataattattattgcatcaattcacaacctacaacaacatccggtaccctntcaataaaaaaaacgctanatgttgcnttcaacncattaactggctatacaatattgggctgtggntcnttcagtaccncaaacntatgttgtanacaaa

SEQ ID NO: 83158 - DNA, 215 bp, Triticum aestivum
  Clone ID: PAT_TA_83158
taattctgtagcagaaagaccccctacccatgtggcggaatcaagggaggagtgatgcgtgtgagtccgatcgatctgaaggctgctgtaaagaggaagatggaaggggaaggagtgagaagcatgtcagttactctgctgctgtacaaattaaacttagctcttagagtgaggagaaagtaagctgttagctgtctgcctaaaggaaagaaagg

SEQ ID NO: 83159 - DNA, 472 bp, Triticum aestivum
  unsure (1)..(472): unsure at all n locations
  Clone ID: PAT_TA_83159
ctgtgatgtcgccagtatgcaatgcattggaagcaccaagtctggatccactaagctacctgtttgtgggggtctggatacactacctgctgtctgcttaccaaatgttgaaaagaagtgatggactcctggcggtgtttatggtctctcctttccagagacatgctggtataaactgctagcttttctatgtaggactgcatctggttcaaactgctatactgctatgttagtatgtcactgaatttgtccgccatgatgcctccaaggtgtccgaaggcaatcaaagtttgttagctctaaagctgacaagacatcctccgtttactttgcctagtttccaaacgtctaagatcaagtgcagaactgaancggatcgtaaggattgaacatgaacttgttaaaatccggcatatgtaaatcatggatngcgaaatccccntgtaggtgcaatgtccctcctcngctaagt

SEQ ID NO: 83160 - DNA, 230 bp, Triticum aestivum
  unsure (1)..(230): unsure at all n locations
  Clone ID: PAT_TA_83160
gtcctctcctctcctctgcgtccgccactgcccaccgctcgcccgcgcgcgctccattacctcggcgggcgatggccgacctatccaacaccggctccacctaacacgagcagcgcccccgcctangcggcagctggctggtcggtcgtcgagcagctagcggcggcagcgcccggagggaggccgtctcactctcctcgtcggggcggcaggagatggaggccatcgtg

SEQ ID NO: 83161 - DNA, 542 bp, Triticum aestivum
  unsure (1)..(542): unsure at all n locations
  Clone ID: PAT_TA_83161
gagcgcgcggagagcgagagcccgggagaaacagcggccggcggcaaaatggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcangactgtgaaccgtccatatggtggtgttctgtctggtaccgcagtgagagagaggatcatccgtgcctttttggtcnaggagcagaanatcgtgaanaagttttgaagatcaaaaaaaccaaggataaggctccaagaactaggcatatagcatcttccanaatgttaagtccttanaattgttcaacaaanaaatttccctggtttggggaanccgatacttaacaagatatncaaatgatanggttaaatttnaacggaattgcgntctttattttt

SEQ ID NO: 83162 - DNA, 602 bp, Triticum aestivum
  unsure (1)..(602): unsure at all n locations
  Clone ID: PAT_TA_83162
ggccactgctcgtccttcactggccgcctctccgagccacccagccagatcaacccggcgtaccgcgacctgctcaactacaagtgcccccaggggtccaaccctcccgtggccaacaacgtccgcgacgaggactacggcgtggtggcgaggtacatgccggggttcaccagccgggtgcgcaagatccccgacttcctggacaactccttctaccacaacaacctcgccaagatcgtcaacttcaactccgactggacgctgctcacaaacaaggaggcgttcggcaacntcgtggagtacccganaacgcacactgtgggacaaggactctcgactcgctgctcaantaacaagctgccaatgcaaccggaaacacgggnaaatnaggaacaatgaacttctcaacacgcctatataagccactcccttactgcaaaatggnaatcnaaaaaaaggccatngtttcgcaaacaaattcaaaattgtaatcaaatggnccaaaaaattttgtgntttgtcaacatccttgntccatctttaanaaaccatctttttttgntacccntactgtaaacggaaaaacttntacgaattcatgg

SEQ ID NO: 83163 - DNA, 682 bp, Triticum aestivum
  unsure (1)..(682): unsure at all n locations
  Clone ID: PAT_TA_83163
agaggtacagcacgaaaaagagaggcaagagagataggggaccggagggcggcgggccggggcccaagaccgaggggctcgtgcgcaggaagctgatgaggctcctgtcgctcgtccccttcggctgccgtgctggacccatcgacgacgcgccgccgcccgtggaccacgctgccgccgccgccgcgaggaggcgccggaggaggagggccaacagagccgcccagctgctgggggctgctgcgggtgcgccgcagcagtggcgcccctcgctcggcgacatctgcgangagtacagcagcagcaccgacgccgtcaagtcaggaaggcggcgtcctgggacctcgcccgggcgctgccccgcgcgcacggtggcaagcagtaccggcaccttgagaacgcgtctccctgccancgttcgcgccgacggnttcctgttctgattatgcgtcgcnacgcggcnatctcctcatcaacgaggacacgacgcggtgaagacatagaacaacaaaacactacgcaacattaacaattacgtaactatgtaaacaaaggtnatgtnaataaagtgnntcatacacancgaccggataactacatctcntctacatnanaaaacccgncttatantnaaatcttnganaacttttacaaacngnagttnatacactncnaatcnaat

SEQ ID NO: 83164 - DNA, 658 bp, Triticum aestivum
  unsure (1)..(658): unsure at all n locations
  Clone ID: PAT_TA_83164
ccgcttcacgttctcaataatggcgccgttcccacgtcgtcttccggccgccgtgccacttctcctcctcctcggcgccgcagtggccagcgccggcgcggaggacaccgatggcggcaactcccgccggcggcactcccgcttgctgttcgcgttcggcaactcgctcaccgacacgggaaacggggccatcttcccggtgactgcaggcgggccattcacccggccgccgtacggggagaccttcttcggtcgtcccaagcggcgggtttcaacggcangtcgtcctcgactcctcctggaggagtgaaagtgccaaaacccgacccttactggccggaatacgccgccactttgcgaaaaacggggcaatttgcctgggtggtgcaacgggctcnacaagcgttcttaacaaacaaggggataaatcgtcgtgccatctctctcataacaaacaactggtcaaaactttcaaactacggacgcgnacacacatganctanatatgcaaatcatntcantcggganatnggtacannattcgcgcctagaaaacatcctnagncgtancctgtgcgaaatacaaaaaccttggctacttatataaccggcagaaattngtangacancnttgggaaccaaaaggcaatttagggcg

SEQ ID NO: 83165 - DNA, 604 bp, Triticum aestivum
  unsure (1)..(604): unsure at all n locations
  Clone ID: PAT_TA_83165
atttctgtgtatttcattcattcctttaccaatcgtatatattgttactcgtctaccatgcgtaccgctgccgttatcactcttctggcctccgtggtctctgcaactcccttcggccaacgctctcaggttctccccagagcaagcgagacttgccccgtcgtcttcgatggccgagtccctgccaatgcctctctgaccgactttgacacggcgaatggcggcggctggaacccttacaacccgggcttcgtcaagggaaacaacatctcctggtccgagattcttaagctccccaagaccaagaccaagtcgcgctttgataccgangctggtaccatccctctcgangtcactatcagcgacaagagtatcttcatgaagcagcttggcttcagacgcgctggtctgcagttcacaaggatagcaacgaaggcagccctggatcaagggtgtcaanactctgcacttacatcaacaagatacaacgcctctaactgagcanagtactgaactttgcnataaaaggcgattcccgggaacaattcantcangcngtaatcatcggnaaangaacgcncnacngaactccgacagatnactt

SEQ ID NO: 83166 - DNA, 549 bp, Triticum aestivum
  unsure (1)..(549): unsure at all n locations
  Clone ID: PAT_TA_83166
cgcttgtgctccaggagttcgtcaaccatggcggcgtcatcttcaaggtctacgtcgtcggcggccacgtcacttgcgtcaagcgccgtagcctgcccgacgtgtcccccgaggatgacgcatcggcccagggatccgtctccttctcccaggtctccaacctccccactgagcgcacggcggaggagtactacggcgaaaagagtctcgaggacgccgtcgtgccgcccgccgcattcatcaaccagatcgcgggcggcctccgccgcgcgctgggcctgcaactcttcaacttcgacatgatccgcgacgtccgcgccgggcgaccgctatctcgtcattgacatcaactacttcccgggctacgccaagatgccaggatacaaactgtcctcacggattcntctggganatgtcataaggacgnntgggaacaacaggaggagaaagggcaacatttgnccgaaaaagatgatgattatggaccggnattgggaatgcgctganccngatgaanatcgataggggattattggtgnnnatgggaaa

SEQ ID NO: 83167 - DNA, 709 bp, Triticum aestivum
  unsure (1)..(709): unsure at all n locations
  Clone ID: PAT_TA_83167
cgtcatagacaccagcatcgatggctggaaggccgccaaggtgctcatccgccggggagacgtctggaaggttcgtaacaagaagccttccgcggtgtctgaactggaggatgccattgccaagggcaagaggagggctggccttgtctctaagcttcagagagacaaagagaaggagaagcagaaggagaaagaagcaatcacatcaggaaacactccatgctggcagtgggagatgttgacaaagactccagattatcctattcaaacccccgaaaaatcttattctgtgctagaaccaagaagccaaattgcatgatttttccatttgcaagacaacattagaggcaaggaaaacgatcaagacaccatatactgacttnaagaagaattttggacaagcacattnaagacaagatccattacattgcaattaacatatcaatttgataatgtcctactgatgtttggtgtctaaatggacctgttaaaatcaaaaaaatcaactgcaataactggcctcgggccagaagtatnttgtgtgaacacnccaggcacatacngtactttgttcnccctttttttaaaangtcagntancaaanttgccgaattttgattatgagttctatcctttgcaacngcatccntttntgacctttggacgaantttntaagcnccattcgnantantggtttaccnttcnaan

SEQ ID NO: 83168 - DNA, 616 bp, Triticum aestivum
  unsure (1)..(616): unsure at all n locations
  Clone ID: PAT_TA_83168
attagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaaccctcatcagcaccctaggtttccattccgctacgactctggacaactggcacctggatggtgaccttctgcacctccacgtggcgcaacgcctgcgctttttccaacccaaaggcgattcgacgggcagacgtattctgtttggcttgctcaaacgggacctcgattgggcttctgaacttaatttanggtcaactccatcngattctacaagatgacgaattgggcataataccntacngtgcgttggagacatatcctgaagaaagatnntgagacattaagtttcctgctggtctgcgctcgattggatccctagttacgactaagttacngctcgtcgttcttcgctccatcgcacacttttcgcaattccnatacatnaagaactnaggt

SEQ ID NO: 83169 - DNA, 270 bp, Triticum aestivum
  unsure (1)..(270): unsure at all n locations
  Clone ID: PAT_TA_83169
ccaaaataggattttgaagtattacaatactctagtattcgacctaatccatatatattgagatggattggggtgtaattaatttaatttacaccctaattcatcttaatacacgtaaattcaggtgaatactaaaatatccaaccaaagcattatccaggtgtggagctcctccgagggcgattgggagtgtaaattaatttaatttacaccctaatccaccttaatacacgtagatagattgaggtgaatgatttaccacacangact

SEQ ID NO: 83170 - DNA, 690 bp, Triticum aestivum
  unsure (1)..(690): unsure at all n locations
  Clone ID: PAT_TA_83170
ccagaaccctctccgcaatctccccgcctcgctcccgcctccacccaatggcgtctctccctaacggtggcggcgccgccgcctctggctcatgcggcgcgcgccctgtggacaaggaggtggacttcgccaactacttctgcacgtacgcctacctttaccaccagaaggagatgctctgcgaccgcgtccgcatggacgcgtaccactccgccgtcttccgcaacgcgccccacttccagggcaaggtggtccttgacgtgggcaccgggagcggcatccttgctatctggagcgcgcaagccggggccaggaangtgtacgccgtcgangcgactaacatggcggagcaccgcgcgagcttgctcgcgccaangcgtcacggatatcgttgagtgatacanggcacgtggaagacttgaccttccggagaaattgattcatatataagagtggatgggtacttcntttgagaaatcatgtttgatccgtaattcgcactgacgctggtgaagcagtgttattacctancatctcgatntgtacancataanaacngttggtnnaaagaggaagnttntatgcatgatacngacctntttcagaancaactatagggtaaanaatgcttaaaggattcncaantaaatacattagtncaagaaanttccacatttgtactactcagat

SEQ ID NO: 83171 - DNA, 552 bp, Triticum aestivum
  unsure (1)..(552): unsure at all n locations
  Clone ID: PAT_TA_83171
gttccacggggagcggggcgtcctggaccgcctgctctccgtggtcacctacgggcagccgcgcgtgggcgacaaggtgttcgcgggctacgtgcgcgccaacgtgcccgtggagccgctccgggtggtgtaccgctacgacgtggtcccgcgcgtgcccttcgacgcgccgcccgtcgccgacttcgcgcacggcggcacctgcgtctacttcgacggctgggtacaagggccgcgagatcgccaagggcggcgacgcgcccaacaagaactacttcgacccagtacctgctgtccatgtacggcaacccttggggggaactcttcaagggcccttcctgttgggcaaaggaaggcaaggataacgccgaaggccctttcgctgttctaccgcgccaaccggctgtcntgcccggatcgcttcgnaaacccaaggacaattnaanccttcgctcggaacttccctcggnttactttggattcagntcntccatgcattgtccatngatganaattgttaatnaaacatnactcncanttataatntttttt

SEQ ID NO: 83172 - DNA, 612 bp, Triticum aestivum
  unsure (1)..(612): unsure at all n locations
  Clone ID: PAT_TA_83172
cgggagagcgtggcggtggcggtggactcggcggagccgtacgaggacttccgcgagtccatggtgcagatggtggtggagaaggagatctacgcgtgggacgacctgaacgacctcctccaccagttcctctccctcaactcgccgcgccaccacccgctcatcctccacgccttcgccgacctctggacccgcaacggcctcttctgcccgccgtctccctgccagttctagctaggcaggctgctcgccggccggtccgagtccaacacggccggcgcgagtccgatacggccggcgccaccgccatgcacgtacgcttgcatgctgtattaaccacgtactactcctaggtcctaactactagttatctctgtcagtctgtcttgtcctaatgggctactgttatttctacattaacgaaacacgcacagtcaccgangccgagacctattaaccgagtcccggcaacgatngaactactcactgcactgcatatcattgttaactctgatgctctccctaataactgcgtagangcatccgtatcacactacgtctgtatgatcttctnntggcanccggaggaccataaccgggtcccattatcag

SEQ ID NO: 83173 - DNA, 675 bp, Triticum aestivum
  unsure (1)..(675): unsure at all n locations
  Clone ID: PAT_TA_83173
gatgttgttgacctggtgctgattatgtctgtgaatcctgggtttggtggccagagctttatcgagagtcaagtaaagaaaattgcagaactgagaaggttatgtgcagagaagggagtgaacccctggattgaggttgatggtggtgttggtccgaaaaatgcctacaaggttattgaagctggcgcaaatgccattgtcgcaggttctgcagtttttggggctccagactacgctgaactatcaaaggaataaagaccagccaaagacctctagctgtagccgcataaagactggacgtgtaatcatttactcggtgcaatttaccantgatgccatctgtataatgtgtgtcttgtccaactatacgtataccggagatgaaaggagacggaggcatgaaaaaatacctttttttcctccantttcacnaggatccgtgcactgcnccaaaatgcgttcaaattacaaacncacagggggacatgactacagatactccccttaaaggaaatgtnttgggtcaanaaccncggggtatctcaaacngnaaacattacatnttgaaacaaaaaggctctaggttccaaaagggggccgtccattcccaagntcntaccccnangcnttttactcaggaaaccggttccatnaccngaaacccttccnggnaaa

SEQ ID NO: 83174 - DNA, 534 bp, Triticum aestivum
  unsure (1)..(534): unsure at all n locations
  Clone ID: PAT_TA_83174
ccaggatcctcggcacggatgttggtaaaaccttgatgaatatggaaatgctcaagttcttgaaagcacgcgcagtcactaggttatgtccttggtatcaactggaatgtgccttccatttgccgagttgttctataaccatagtttcctttccaaattgagtgtgccattcttttgaattctttcaaacgatcatttgtaaattgccttacgctggtagaaagagtttcaatgatctttgtatcaaaagtaatctttttgtcacttaagggaagaatctacgagtcacctttccctaaggtgccccgttatggatcatgggtaattaactcctcgctgctttggaacccatgcaccatactatctaagctgggattgttgccaccaaatcaaactcatcgttgttcntcaaccctctcgacgtgtttgtgtccaactcaaggggggccggtaccaattcgcccaaaatgatcgtataccgcgccacgggcgtcnttanaagtcgtgacgggaaaacctggcgttaccaactaa

SEQ ID NO: 83175 - DNA, 588 bp, Triticum aestivum
  unsure (1)..(588): unsure at all n locations
  Clone ID: PAT_TA_83175
gccagatanacnccactcanntctgctattcccaaatancacgaatgatgntgttccacattcngttaagnatttgcatgananngtgtccccanngtttaaggtcgatgatgtccaagattctgtnaagagtttgaatganaanctttcngcngcncttttgacgancaatgataanaatgacttgggtanatcancacactanagttgcagaagaggctgttgcaagttgtggaacannctgaagcngangttgcntctctgaagcaactacntgacactgcatcaaanaagantacctctccgggncgatnangtcagccacctagatgaccccttanagantgtgtaatgatcctcaccaatcacgtgnagancaagtgaataacatccatgagacnttgctaacaatccaangaattgnngtcngagaagtttgagctcaacaccatatgcngaactcaataagnattgcaagcangtacagaactatacgtgcantcaacgtgtcgcacgaaaactnanatatggggaaagaancanggnccaagnaaaattanccacgtcaagactaaaaactncgggaaa

SEQ ID NO: 83176 - DNA, 645 bp, Triticum aestivum
  unsure (1)..(645): unsure at all n locations
  Clone ID: PAT_TA_83176
cacaagcgagcgagggacccggggcggaagaagagagagaagacgtctctctcctctcggcgtccccgttccccaacctctcgtctgctgcctgcctgcctgcctgcctgcaaaaaggagtttgtcatggcgtctaaagcgcatcctcaaaggagctgaaggacctgcaagaaagaccccccacatcatgcagtgcaagtcctgctgggtgangacatgtttcaattgggcaagcaacaatttatggggaccacctgacatcccctaatctggcggtgttttcctaaatgaacatcaatttcccgccaagattacccctttaaacctccaaangttcctttaaagacaaagncttcatcccnaatatcaacaacaatggaatatatcccttgacattctcaaaagacaatnggaccctgctctganattctaangcctnctctccatctgtccctgcnaacgaccaacccggacaacctctntcccgganatgccaatgttaaaacggacggccaaatacaatcacggcccaactggaccanaattancatggctacaacgctttcgctctcaccacngngtccanaaaccttctggcgcatttncctgattntttggcctttaccgatcacaggttacntgatg

SEQ ID NO: 83177 - DNA, 210 bp, Triticum aestivum
  Clone ID: PAT_TA_83177
caagattatgccgtgttattatacagcaacttcacaggatttgttctttttaatagtagttggagcaagatgccccaggcagagcacacgtaaacaaggttttgtaagcatacgacctgatgatttgcaaccactgctccattccaattctccgtgtaatagtagtgacctaaaacatctatacagagggagtattaattaaaggggggg

SEQ ID NO: 83178 - DNA, 709 bp, Triticum aestivum
  unsure (1)..(709): unsure at all n locations
  Clone ID: PAT_TA_83178
cgacgacggcgagcgtctgtctaggagcaagatggatgggaacaggatagctcggttttcggtcacctggaggggcagccaacttgatgtggatgcggatccaagttgtaccgtgaaagagtttgggcaactgttgcaggacttgactagtgttaggccagagacgttgaagctcattgttccacgatctacaaacaaaggctccaagctgatcatgccattttccggatgcacattccgagattgacactgaatggatgggtattagcgagggaaaacctatcccgaatgatggganttatgatgatgaaatccgaggaggtatccgacaatggcaaaagacctgaccaacgcattattgggtttgatgaagaagaacagcggcttaagcaaagttcattaggaagncacagtttcactcaaactccccaagggacaatacacctccgcgatttcggaccctcacttacctgggattgactgaatctccacttcggaagcctgaaacaatcacatcttcatgcaacctggtgtaatgcattataaaaacataatganatcgatcatacgaaatgccccgtggtattngnacatccaatgtatttggtcaanacangaaaganancctcccgcacatattagntcggattnagtcaaaacccattancncangggcccaangnatttttccaacttngaccctcgggcn

SEQ ID NO: 83179 - DNA, 649 bp, Triticum aestivum
  unsure (1)..(649): unsure at all n locations
  Clone ID: PAT_TA_83179
gcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagtaaggagcagaaaacgccttagggaatgcagaaagatgttgcttgcacgtcgaagactactttgtgagggacttggcaggaaaccacccatactcttcattctctgccactcttgatgacttcgaactcaagattacacgtatctccactcgtgctttcgcacaatggggtcgacgtggcggtcaaccgtctcttaantacatctcggtgggaacgttgaatctcanacctctcgactcttgcgtccatttttaactgtcaaggaaacaatgactcgtgtnatacacacacatactncataacagnaagatganacataaaggaacttcctgaaanttaatgggaantnntgcaaggacttcaggttaaagccnacaggacttgaatttcatagattaagaaagttaggtgccattancanaaattt

SEQ ID NO: 83180 - DNA, 627 bp, Triticum aestivum
  unsure (1)..(627): unsure at all n locations
  Clone ID: PAT_TA_83180
ctggcatgtatctcggagagattgttcgaagaattttactgaagttggcacatgaagcttctctatttggggatgttgttccacctaagctggagctgccatttatattgaggacgccagatatgtcagccatgcatcatgactcctcacatgacctcaaaactcttggagctaaactgaaggacatagtcggggtcgcggacacttccctggaagtaaggtacatcactccgtcacatctgtgaccttgtcgcagagcgtgcagcacgcctggccgccgcaggcgtgtacagcatcctgaagaagataggcgggacaaattaccaagcgggtgggcggtaaaatgccgangaccgtagttgccttgggacggtgggtctacgaacactacaagaattcagcattgcgtagaacgactctcacagacttctccggcgangaggttctcctccgtggtcgcaaactgggccaacgacggtctggattggactcctctcgcacctcaactccagtacagtatggccnatgcatatctaaatggccgatcanatttggtgnnctcnattaccttcttttnccttcaaaatctttgggantttcgctccttgtgcaatcgtgagnctacgg

SEQ ID NO: 83181 - DNA, 629 bp, Triticum aestivum
  unsure (1)..(629): unsure at all n locations
  Clone ID: PAT_TA_83181
gaacgtacaataagaggttccaagcggatanatagttgctcgaagcctgaaccagagtgagaaangggttcagagcagtgagagtaantattgcatctgataccagaattgagcactangaaggtggtacgtgaattaaatacnaagccaagcctgaggaacaaccattaaaaacagcgttgaacatgagagtcangtttcgatcctgtggaactgtgggttatgggcccaccatgtgggttaaaagtacgagcggtgacatctttcacagtcatgatagcaaggcattcaganagtacatgttagttatgtcggcaacaactcngtaccaagggcgatggacnaagagaaccatttcctgcttgttgaaacaaggcagacaatangcaaattctcntccancgtggttaccggaatgtcacaacaatagtaacagtttttgctgacanaatgtacaccnanatnttacataaccaggggaatatgctgcttaatatatatntacagnnggtanacaacaatgtaaggaaantgacanacatacagacaatgaaggaaattnttaacactattagggntnctccaggaaacaacatgtnncataaggtttattnancctngtaggaaaa

SEQ ID NO: 83182 - DNA, 487 bp, Triticum aestivum
  unsure (1)..(487): unsure at all n locations
  Clone ID: PAT_TA_83182
gaaagctgaaacacttgataggttctgcaagccgatcatgacgaaaccgaagccagctcctaagccgcagactccgcctgtggcagaaaaccaagctcctgagcctcagacaccagagcagcagcaatcaggtggcgaaagcacagccagcgagggagccgcagaggagcctcgagccgagcagatggagacagacaaacctgagggagccacagtccctcggcttactttgccagtgatcaaacattgtgtgattgaccctgttcacctgctgttatatccngtaggggggagttaactaagcgagaggtcgccacatttgatttgagntgtgtgttgggacattcaaggtatcctgttcctgtcccttgacaaggaagtggtgggtgtttggaaggataagacaatggggtacactttctcactttttgtgcccacacctcgatatctttatngatatggccgtaaaacaagtaaaaaaaaaaaa

SEQ ID NO: 83183 - DNA, 536 bp, Triticum aestivum
  unsure (1)..(536): unsure at all n locations
  Clone ID: PAT_TA_83183
ctaaactgacagcaggtcagcagcctagcgaagccaagacatccgccgatctcagatggccgggagaagggtgcgcggcaagagtgccgtggccgtggcggccgtcgcgctgctggcgctgctcttcgcggcgagcgaggccgacgggacgtgcaacgtcgaccggggcacggtgctgaggcagtgcgcgtcctgctcgagcggcgcgccgagccaggggtgctgcgacgcgctgaggaacgccgacttcggctgcctctgcagcaactactgggaacaantcaagaacacgccatacgccactgcgccaagccacccttccgcgtgcaacctcccaaacccaatgccaattagatggaacatggatgcctgaccggacagcgaacggcacttggaccaaacagaataatccgctcattacctgttctcctcctctgatgtgtaantcttgcnttgagtcttatccatatatggtgcctgctaccggggggacttcanaattcttgaacnatggttcacctatcaaaaaaaaaaaa

SEQ ID NO: 83184 - DNA, 668 bp, Triticum aestivum
  unsure (1)..(668): unsure at all n locations
  Clone ID: PAT_TA_83184
ccgcctacggccttggtgcacctgtcctccgatgatcgatcctccgaggccaccacggacgagatggtggaggaatcctctgccccgcggtagagggagctccttcgtgacttccccgatgatgatgatgatgaacctccggtggtcgaggtgccgctcccttctagagtcaccacgagatctgggatgtcctcttcgaagtacccaagcaagcggccacgaaagaagggcaggaccatgctgatctccgggcatgtcctgccttccgccgacattgtccccgagcancactaacagcgantcccctccccccaaagantctgcaccattgctccgcctcaacacccgctgctaacctgaagagaactatcttctccggcattaanttttcacttaacatgtttgttgatcctgaacgagcttaccctcntcttcattagcacaccatcgaagaacaaacaagcatggagtttcgtggcncatgtctgaantggcgcgcacctgcaaagaaatctgtgcctaagctcatgggactcattccnggcatgaanccanctagagtttgcccttgaggcaacccncggctgattcgacataggtccancccgccggcttcagnagttcttcagcaggttccccgcantgcacctgcctcccggcnangaggg

SEQ ID NO: 83185 - DNA, 537 bp, Triticum aestivum
  unsure (1)..(537): unsure at all n locations
  Clone ID: PAT_TA_83185
gcagcacacaccgtcgtccttgtacgtagctagcactagcggtgatagatggcgatgttgagttcctacgccatccggagcccggcgctgcgttgggcgacctcacgcaaggagtcccgctcccgggctgctctcttcacgtgccatgcggataagtacgggtacaacgacatccaacccagtgccctgggtgcaccctcgattcgccgaaaagaacgacggcgactgggaggctgaaggacgagaaggaccaatcaccctccaatttttgggtgggggaagacgacgaccaacgataaactgggagnttccaacaacggaggatncggccaaggctccttggccacaaggtacaanaaaaaggaganacttctcctcctccaacnanaccccggcactcgctggcttcgcctctgatcctcccgntacnacattataagatcagngataataattggaaatacgggctggctaaanattcaacccaagctaaacacaaccaaaacataccatctcccggncagtgacaacacatat

SEQ ID NO: 83186 - DNA, 243 bp, Triticum aestivum
  Clone ID: PAT_TA_83186
gagtttttttttttttttttaagaaacacggcatttcctattccattaggaatgacataaagcaacttgagcgaagtgtaaattttgaggtgcattctttttgaaattcaacgcgtatgcggggacggtccaccaaaattttattccgaccaaggactccagttacgtgagctagcagaagtattcaggtgcaaaatgacccgttgcacatgtacatgaggctgttatatttccgatcgggtt

SEQ ID NO: 83187 - DNA, 612 bp, Triticum aestivum
  unsure (1)..(612): unsure at all n locations
  Clone ID: PAT_TA_83187
tgagcagtccacagttgcaaatgaccgagtactacgcttctcctatcggttctgatatcacactttctcctccactctctccccggtagaaatcagcagtttcagttttgagcctgactggtaaagtaggcgacaagctggaccctggaactttcgcagcactgtgaccttgagcccctgacaatcctttgtcatgaactccgctgctgtaaccctctgctgactggttacacttgtactagcattctcatcggccatggaggagctgtgctaagctgacaaaaccaggctgctacgactctgaactccgtccatgcccgttgtgcatgggtgattcgaggccattgacgtcgccaggaaacttactggaggactgcaaggaatctgccgtgttccctacaggattgccttccgcactccttgccctgaattggtcctttatgtgttctgctgcgcaatcaaaaacctgcagagttgatgtagtttgagggagaagaccacacaatgtctctcanangccggttggttgtttgccagtaatggacttggtgctgaactgcaaatggttcgatttggaatgcaagcagatctgtcantngacatangatactt

SEQ ID NO: 83188 - DNA, 701 bp, Triticum aestivum
  unsure (1)..(701): unsure at all n locations
  Clone ID: PAT_TA_83188
gaggaatcaatggagttgaagataacatgggaggaagctcaagaattgcttcgccctcctcctaaggccccatccattgttattgttgatggccatgagtttgaggaatatgaggagccgccggtacttggaaggaagacttattttgtagcagataaatcaggttcgaaccatcaatgggcccaatgtgaagattgttccaaatgggaggaaacttccaaatagatgctctgttgccctccaaatgggacctgctctgacaacaaatggggattcaagaaagtttcttgcgatctgcacaggaaataatntagaggacttgcagaatcatccctataaaacctgccaaaaacccaattgaagatagatctgatgctatcgatgcttcaaanggntgggacaccttgcaaaccttgcgatcctgggtgaagggaacntcccttcanagccaacaacaaaacacccgcaacgtccgggctgctcatgcatcgtcgcatcaaccacaagcgggaaggtcaaacacagcaacttcactgtacgtttgatacgttcccccttcagaactcatcttcaccanaanaggcacaaggttctcccaaanaaaagcattcataaggcaaaaagctnttcgtcncancancatgacatttgcaanatgaaccatgcctaaaagctcttaggaancccctaanatncaacac

SEQ ID NO: 83189 - DNA, 184 bp, Triticum aestivum
  Clone ID: PAT_TA_83189
gagagagagagagagagagagagagagagagagagaatgtcgttttcctcctggctcgattttattttgctttcaaccgtgcccattgttaaagtacgaactagagtatgcatctatcaaacttgtaataagcatgatgtgcaatcaaacaaaatggtgtacttgtacttccaaaaaaaaaaaa

SEQ ID NO: 83190 - DNA, 633 bp, Triticum aestivum
  unsure (1)..(633): unsure at all n locations
  Clone ID: PAT_TA_83190
ctcatcttttctcgtttagaacctctaaaatttcccccactcgccagtcgcagcagcacctgtagcagtcatggacgccagcggagccggtagcaaggggaagaagggggcggccgggcgcaaggcangcggccccaaggaagaatcggtgacgcggtccgtcaaggccgggctgcagttcccccgtcggccggattngggcgctacctcaaagaagggcggtacgcgcagcgcntnggncactgggcgcccccgtctactcgccgccttcctggattactccccgcgaaggtctggattnggaagggaacgcngcgaaaagacaacaagaagaccccatcacccgcccactnctcctggcgattcgcaacgacgaagactcgggaactgctggccggctcacatcgccaangnggntctcccaactcacccgtgctcctgcccaanaaggcggcgganaagnngcaacggcggnacaaggaccaatcccaagaaggcgcaagtcccaagaaggctagaagtaggtctatttccttgtcgtacatntctgtcaaatngtgtggatnntcgcccagaacncnttgctatgagttcctcacaaaantttaatcancccttttcaaaaaaaaaaaa

SEQ ID NO: 83191 - DNA, 590 bp, Triticum aestivum
  unsure (1)..(590): unsure at all n locations
  Clone ID: PAT_TA_83191
tagcaataatgcctaataacggcgtccgcgccgtggcgacgcccgtcgcgcgagaagagccgctcctacggcgggaagacgacgcagcaccgccgaaggccgccggtggcgatgggcagccgctcgacgcgggcgcccgtgacgccggcagcttcccgtggctgccagccgcgggcgtcgtgtacctcacgctcagctccgcgatggccctgcaccgctgctggccgaccccggcgacgtcgcgttcgtcgtgtcggcgtacgtcgacctcgtcctgctcttctgctgcctccggaggtacgagcgcgcggagcctgggtcgccgctcanggagcggtcaactggcggtgtggctgctcacttccgcgctgacctcctcttctcctataagtcccgccgtcatgccggccgccgttgctgcatcgtctggtcatggtctcacacatctgcggtggntctcgcttcttcncttcanaanaagngtacttcgctcatggacaagagagaaattccgaggtgacatgaaaatacggtacaaatttattgnatacaaattttgacaattaaaataccatttnaaaaaaaaaaaa

SEQ ID NO: 83192 - DNA, 588 bp, Triticum aestivum
  unsure (1)..(588): unsure at all n locations
  Clone ID: PAT_TA_83192
agaacgagagcgtaaccatcagtactcaatagttagagcgaccaatagatgagttcctccccgtcctttggtctcctggccttagcagcagtactcctagcactgaacttagcacaacatggctccctcgccgcaaccgtcggccccagggtcatcgtcgtcggcgccggcatgtctgggatctcggcggcgaagaggctgtcggaggccgggataaccgacctgctgattctgggaagcgacggaccacatcggcgggcggatgcacaagacgaattcgccggcatcaacgtcnaatttaggcccaactggggtnggagggcgttnaacggcggcaagatgaacccatctggcccatcctcaatccacctcaaantccgcaacttccgctcccgacttcgactactcgctcaaaacttctacaaggaggacgtggcgnctacgatgaagattacgncaagaagagaatgaactgggcggacacgtggaagaatgggggaaaactctcgcactttcacgcagtgcaagacaattcatcctncatgancgcctaacaacacagccaacggccgcaanccgtgcatgtgg

SEQ ID NO: 83193 - DNA, 673 bp, Triticum aestivum
  unsure (1)..(673): unsure at all n locations
  Clone ID: PAT_TA_83193
tgagggcgtactcgcgcaccgacgagtactacgacaacgtggacgaccgcatgaggaggcccgcgtacggcgccgacgactgcggctacggcggcaggcagaccgccgtgtacgccgacgagtactcccgcggcggccgctacgaaggctacggcgtcgagcaggagcacttcaagagggaggagaaggagcataagcacaaggagcgcctcggcgaggtgggcgccctcgcgggcggcgcctttgctctgtacgaggggaccgtnccnaagaaggacccggcgaacgcgcaagaggcacaagtncaagccggcgtnggcaacggcggcngcgctggccccggcggtacgccttaccacgacaccgcnaacaagaaggagcccactacgagacangaacaagacacaggtgccgcacggcacggcacggcacgntatcctactactgnactgaaacactatatccatcgatgaaattcatcagaactcatattatacgncctancgcgtnacttcntctgtagtaatagacaactctcactntntttcccattatancacattactatacnctcatacataccntcttgaacttacatcacnggtanaacaagncctctnataccaaaaaaaaancnggggcctaaattcccaatttacccccagcttttaat

SEQ ID NO: 83194 - DNA, 530 bp, Triticum aestivum
  unsure (1)..(530): unsure at all n locations
  Clone ID: PAT_TA_83194
aaattatatgcaatcgcaagcgagcagaatggcgaggtccagtggtagtagaccagtggccctcgtgctgctggcgctgtgcgccgccgccctctcgtcggccacggtgaccgtgaatgagcccatcgccaatggcctctcctggagcttctacgacgtttcctgcccgtcggtggagggcatcgtgcgctggcacgtcgccgaggccctccgccgcgacatcggcatcgccgcggggctcatccgcatcttcttccacgactgcttcccgcagggctgcgacgcgtccgtcctcctgtctggttccaacagcgagcagatcgaggtacccaaccagacgctgcgtcccgaggcgctcaagctcatcgacgacatccgcgccgccgtcangccgtctgcgggcccacgtgtcctgcgccgaataacaagctcgcaacaagggacccgtcntccttcgggggcccttcttcaggtcctctcgggggcnaaaggtctggcccggtttaagaanttggganccttnggccctt

SEQ ID NO: 83195 - DNA, 506 bp, Triticum aestivum
  unsure (1)..(506): unsure at all n locations
  Clone ID: PAT_TA_83195
caggcaaggaaaatggctccgaccgccgccaaggacagtggctccgccgatcgctggcgcgaggtgcaggcgttcgaggacagcaagctgggtgtgaagggcctggtcgactccggcgtcaagtccatcccggccatgttccaccacccgccggagtccctcaaggatgtcatttctccaccagctctgccctcctccgacgatgcgccggccatcccagtggtggacctgtccgtggcgcggcgcgaggatctggtggcccaggtgaagcacgcggccgggacggtgggcttcttctgggtggtgaaccacggcgtgccggaggagctgatggcagcatgctcagcggggtgcgccagttcaacgagggctctctggaggcaaacangcgctctatcacgggacccgctcgcaactgcgcttcgcttcaaattcnactcttcaattccgcgggggccaatggccaanacctcnagtgnaatttgccggtttgggccccngagact

SEQ ID NO: 83196 - DNA, 554 bp, Triticum aestivum
  unsure (1)..(554): unsure at all n locations
  Clone ID: PAT_TA_83196
gttttacgggtatatcacctcggactgcgacgctgtggccatcatccatgatgcgcaaggctacgccaagacggcagaagatgcagttgcagatgtgctcaaagctggaatggacgtgaactgcggcagctacgtgcaggaccacggtgcctctgcgctgcagcaagggaagatcacggagcaggacatcaacagggcgctgcacaacctgttcgccgtcaggatgaggctggggctcttcaacggcgaccccaggcgcaacctgtacggcgacatcgggcccgatcaggtgtgcacgcaggagcaccaggacctcgccctggaagcggcgcaagacggcatcgtcttgctcaagaacgacggcggcgccggcgcgctcccgctgtcaaacccaacgtcgcgtcctcgccgtgatcggttcaacgcnaacnacccataaggtgcccggaacnattcggccnctttctttncgngtaacccncccatggntaaggctanttaaggacnaantttcccgngtaactggccntaattacgatntccgnggcataagg

SEQ ID NO: 83197 - DNA, 566 bp, Triticum aestivum
  unsure (1)..(566): unsure at all n locations
  Clone ID: PAT_TA_83197
gttccaaagaagatattgactccagagagtaacatcaccaatcagaattcatcttctaaagtaggagtagctaatagcacgacagatattaaggaaaatttgagttctggcagtgataataattccagcactcccattaatgggagtaatgttcaagaaattattacagagaaggtgctaaagaaaagaacatttagggttccattgaaggttgtggaaaaaacaactggtggtggaacaattctttcaaaggagttgtattctgaagcaaaaaataggttagaggcactcgataagaaggatgctgagcggaggaaaactgccgaacttaagaataacctagagtcatacgtatattctatgaaggagaattggaagaaagcacagatattttgactgtctcaactgaacaggaganggaacctttgcngagaaacttagcaagtcaggattggttgtacatggccggtnaaatcccaancaatgaatcaaagaacccntggcaactaaggcattggtgaacgatcttcagatgagtgaataaaaccgacactgcgtgaaatctc

SEQ ID NO: 83198 - DNA, 578 bp, Triticum aestivum
  unsure (1)..(578): unsure at all n locations
  Clone ID: PAT_TA_83198
caccaattcggcgcatagccaagccaaggaaatggcgcactaccaccccgtgtccgcggacacttaccaagacctcgaggctggcttctccggccactcctcctcccctctgaagcccgcggcctcgccgaggcggcccggccgcatgttctgcgacccctgcgacgacggcgacgagctccacggccgccaccactacctccgacatctgcttccggtgccgtaaactcctgtccggcaacagagacatcttcatgttacagaggtgacctgccgtttctgcagcgaggagtgccggcangagcagttcgagattcgacgaggcganggagcagcggctgaagcagacgggccgggccgagcaacagcggcagcggcagcaagaagcagacccccaaggttnccatctggcnttngtaggatgagaaatttttggcccccnggaaaacgaacgaacaacntattagtttactgcactcaagaagacccccaagcaaggcnancctcctntgggaanaacccgtggatacgccggccgaccaggaggagaagcccncncacggaaaggcgcaaggagg

SEQ ID NO: 83199 - DNA, 436 bp, Triticum aestivum
  unsure (1)..(436): unsure at all n locations
  Clone ID: PAT_TA_83199
cagaatcatcgcttcttcctgctccggcgatatccgccgccgcctgcggtccggccgagatggggagcacttcctctatgctcacccaatacgatatcgaggaggtccaggaccattgtaaccacgcattctcgcagcaggagatcgtatcgctgtaccaccgcttctgccagctcgaccgtaacggtggtggcttcgtctccgctgacgagttcatgtcggtccctgagttcgccgtaaatcccctctcccagaggctcctgaggatgctggatgggctcaacttcaaggagtttgtagcatttttgtcagcttttagcccccgcacaagcctgcagcaaaagattgaatttaatttcaagggtttatgatactgactgcaacngggaaaggttgcttttgatgacacttganatcttgcaaantntganaggtt

SEQ ID NO: 83200 - DNA, 410 bp, Triticum aestivum
  unsure (1)..(410): unsure at all n locations
  Clone ID: PAT_TA_83200
cgccttcgtcgtctacctggcgttcaggagggacgcggtgcgcacgtacgtgccggtgtcggagcgggcggaggacggcagcgggtcgcaggcggtggcggcggcggcctccgccgacgacgctgacatgccggcgccgttcaggaaggacctggctgatgcttccacgtagacacggagatgctctcgttcgggcagtgaccatatcgatcaatcctgttcatgcatatgatttgtggatcgtcgtcgagaggcgtgctggctcattcgtctgctcagtgaccgaatttgttcgtgtacgtagattatcataagatcttacacgcagccgcataccaagccacacgaacttcgtgtacggttttgatatatccatatcaacantcatcaagtttacaataagaaaaaaa

SEQ ID NO: 83201 - DNA, 565 bp, Triticum aestivum
  unsure (1)..(565): unsure at all n locations
  Clone ID: PAT_TA_83201
ggggagcgcaattccccggcgacaacgacgtcgcggaagtagacgcggcccgcgacggagaggtggaccgccgtgacgtgggcaagatggagcacgggtgcgagcattaccggcggaggtgcaagatcgtggcaccgtgctgcaaccaggtgttcccctgccgccactgccacaacgaggctacggcttccggagataggcatacaatatgtcgtcaggatgttgaaaaagtagtttgcctactctgtgaaacaaaacagccggtgtcacaagtgtgcataagctgtggagtcaatatgggagagtacttttgtgatatatgcaaattttatgatgatgatacagacaaagggcagtaccattgcatcgattgtggcatatcaaggttggtggcaaggaaaactcttccactgtgtnaagtgtggttctgcnatcngttanctcgtgataaccatcantgtgtggagaaccaatgagnaaaatgccaactgttataatacnattgccatacaggaacagantctaacgtggcacaaatcactnacattttgaagaatggggccna

SEQ ID NO: 83202 - DNA, 429 bp, Triticum aestivum
  unsure (1)..(429): unsure at all n locations
  Clone ID: PAT_TA_83202
caggccgacaccacctcgttcaagcaggtcgtccagatgctcaccggcgccgagcagccggccaacaacgacgcgacggcggcgggggcagccgctgccgctgccgccaacggcggtggcgccggcgcccaggcggncagcggcggaccgtgctgccggcccaagaagccgtcgttcaagctgtacnagcggcggagcagcctgaagaacctgaagatgatcgcgccgctggcgatgggctcgccnccgtcgccgtcnccgtcgccgcggagggcggcgccggagatcctgtcgccgagcgtgctggacttcccgtnctcacgctcagcccggtgacgcngctcgccggcaaccctttaancggctaccagcgtcngtctcntcttccnntgaaggctatcgnncngcaattcccgganaaggggtttt

SEQ ID NO: 83203 - DNA, 324 bp, Triticum aestivum
  Clone ID: PAT_TA_83203
ctgttcttccaattgatgaggacatgcagacgttccagtgcaaagaaccccaaaggtaagctttaagcaggacggccagctctgaactgaggctagctgagaacaatcatgaatacctgaaggcagcacttatgtcagcttggcctagctgtccagtatgggcatgtaagctttaccatcttttgtagttttgggagaaacaattttgcaataactacccttgtttagtgtatattatcgattttccgttcatatgctgttgtattgttgtattgaacaattatgtcaattaattaagtcctacactcctacaaaaaaaaaaaa

SEQ ID NO: 83204 - DNA, 472 bp, Triticum aestivum
  unsure (1)..(472): unsure at all n locations
  Clone ID: PAT_TA_83204
ggctgaaagaaatcacgagccctttctcttttctgaatggcatttctgacttctgtatgtgtatgtagcaaactgttgatttcnaaattatgtgttaaacgtatgatgaatattattgatgacatactgatgaatattactccctcctttccggtttatanggctcatctcaaaaaaattgtttttccattttagaagtcttagttctactactcatcatcacatgttcagatttcacgatgcattaaatcactncatgcaaagatcaagaaanagctaaccaatgcatgttgaagtttttggtcgtttaatggcatgcacgcatgcattgtaattaaaagtgtagtcattattaacgagaaactncnatattnatccgcgntcacatctccctggttgncagattanacattgagcctataacgggacaggngtacnataatgataatgatagnntcagtccnaanacagt

SEQ ID NO: 83205 - DNA, 321 bp, Triticum aestivum
  unsure (1)..(321): unsure at all n locations
  Clone ID: PAT_TA_83205
cgggaaccccatggccatggcggcgcagcagcagcagtacatggcgatgatgcagcaacagcagatgatgaatggtcacggcgccggcggcgccggcgggtacccggcgatggggtacgggtacggccggccggcgatgcagtacccaccgccgccgccgtactactaccaccccgatgccgcagcggcacccgcacgacaacatgttcagcgacgagaaccccaacagctgcaacggtaatgttatcaantccctgtcatgcatgccaaggaggcaaaggccctccggtttcaanttttcccccggggctggatatnttc

SEQ ID NO: 83206 - DNA, 515 bp, Triticum aestivum
  unsure (1)..(515): unsure at all n locations
  Clone ID: PAT_TA_83206
ctgccatctgccttcgatccttttgctgaggcaaatgctgaggatgctggtgcaggccccggcgcaaaagattatgtgcatgtgcgcatccagcagcgcaacggcaggaagagtctgaccactgtccagggcctgaagaaggagttcagctacaacaagatcctcaaggatctcaaagaaggaatctgctgcaatggcacagtaatccaggattccagagctaggccagtcattcacttcagggtgatcagcgttaagatgttgctactttccctatcccaggtggggatttgcgaagaagagtccacaaattccacgnttcctaagccgaancgcctcccgataatgcccgaacgccagccgttctaccctatattgaaacttaagnaccatattgcccccgcttttnaccgttccttgctngatcantgtgttncacctggttatanccgcnctgtccacatacatagntttccaaatttccgacaataanctangttggtaaaaaaaaaaaa

SEQ ID NO: 83207 - DNA, 608 bp, Triticum aestivum
  unsure (1)..(608): unsure at all n locations
  Clone ID: PAT_TA_83207
gggtcgggaagggcttccccgcgtcccctcccgtgcaagccgtcgcctcctcctctcgctcgtgaagcctcctctccctcgcgcacggtaccgccacccaccgcctccacctctccctcgcactcgcgcacccaccgtcgcccgccacccccgctcttcctcactccctcctctgcctcgcgcaaagcgcaccgctaccacaggcggtaggaccgcacaacttgccccagatccagaacatctcctatctcctcaactcacgcatgacgacctcctcagtcccccatccgcatctcnccgaagagaacagaactgggtgagcgattcagattccgtcntgaactgaatgtnatgttgggcatgaggagacaaggatggactccttgaancactaaacacaatttggtccaangaaatcatgatnacaaatcattgtgtgttaacttttgggatgccanaatattttttgggtaagattgtcaaacatanttgattggtcnccattctaaaaacattcgtgtcgaagattgttattnatgnatataaanacaacantcatgtnaaaacaaaaaaaaancaggggggccgtacaatcccantatctttnn

SEQ ID NO: 83208 - DNA, 589 bp, Triticum aestivum
  unsure (1)..(589): unsure at all n locations
  Clone ID: PAT_TA_83208
taccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgtcgctgtcactgctactagcacaaagaaagctgacctgatcttcaagtgagttccattcacagataaagaacaagaacatgaccgtagatgttgaaancaaactccagatccaaatatcatttactacanttactgtcaaatgaatttgcaacaccaaggactgaagactatcttagctttgctgttccctgattaagaattctgggaaggtttancttcattatttgcatgattatcctngatttatgcagcgtancctgacncatcctgtaccactctcngtgcttttggacnaaggcccncattggtgcaanttcattgatctgcaacggggaatcacaataaagcgggtgagtcatcataagactnaccatccttatatacacaggagaaactacgggctacacanagtggca

SEQ ID NO: 83209 - DNA, 335 bp, Triticum aestivum
  unsure (1)..(335): unsure at all n locations
  Clone ID: PAT_TA_83209
gtaccctgacacgtanntccgnatcatcgnattcgacaacatgcnccangtgcagtgcgtcagcttcattgcnttcannccaccgggctgcaangagtccggcaaggcctaaacagctcactcaccannggccanatataaagtgccattgcacttttgtcaactctnacattgctttgggttttccttctcaatttgtctttcttacttgttcctaanaatatgtgtatgtccatgttcatgtaacaacatggcnccgagaaancgtgcnccgtatgtnaatgcaatcngtgnctatgnaaatgcacatgcacanaataaacnatacatctgtc

SEQ ID NO: 83210 - DNA, 390 bp, Triticum aestivum
  unsure (1)..(390): unsure at all n locations
  Clone ID: PAT_TA_83210
ctcgtgccgtgcccgcgcgccatcacttgctggggggagctctgccgagacacgcacgctgctggagataggcatccagacacggcaccaccagtccaccaccaccaccaccaccaccgtgacgtgagtgcccgagcgcgcggccgccatcaggctcccccgtcgtcctcgccgggcggctaggtcagagccgggagaggcgggggccggcggcgctaggctangctangctaagcaccgcgtacttccttgccgccgcnccattgggatgggcgacgcgaagcggcgttnccaaaagttccgcaagntcttttntgcgganaacccgcnccaaggtttccanacccttcaattcgcanacttttcgagggaaactctntatgggggaca

SEQ ID NO: 83211 - DNA, 201 bp, Triticum aestivum
  Clone ID: PAT_TA_83211
aaagaaagcagcgatctgtacccaggttttaatggtccaatcggttttagtgtgactatatgttgtacccaaagaaagaaagaaatcagcgatctgtacccaggtttgacggtagatattattctgaatttctgacgggtagtgatggtgcaaatgccatattttgtgacggacgtcactgaactaagtaaaaaaaaaaaa

SEQ ID NO: 83212 - DNA, 576 bp, Triticum aestivum
  unsure (1)..(576): unsure at all n locations
  Clone ID: PAT_TA_83212
ggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactccggtgccaccaagaaaaggctcaaggcaatccatgcttatagctgcggctgcagcagctgcggcancaccaaagcattctgccactgcttttaatcctcccaatganacttctgttagcagctggcaantcangttgttgctgaccctactccaataacagcttcagctatctccccattgccaagagatctcttcancgcttccttttagaacttctnacaggtcctnacaactnccntcagccccgcattcntccatggatgatcagcngaatgaatatgccgcgnaacaagccaagccatnctnaaagttgggacccaatctgaactnacgtnaagnggctanctttggagaagnaggactctggttataatgantatataaagttcacactgaccctatagggctaacct

SEQ ID NO: 83213 - DNA, 526 bp, Triticum aestivum
  unsure (1)..(526): unsure at all n locations
  Clone ID: PAT_TA_83213
cagacgtgtggccaggaagatgtcggaacgggcgccgatggtcgacgggtgcgtgttctgcgagatcgtccgcggcgcccccgcctccaccaccgctctcctctactccgatgataaggtcgtggcgttccgcgacatcaacccgtcggcgttcaggcactatcttgtcatacccattgatcatataccaactgtaaatagcctccgcaaaaccaaagatgatcaccagttaagtgagcacatggtgaangtggggaaaagacttcctcaatcaagatgctccaaattcctgaagaacacaagtttgggttcccatcagcccccattttaatatattgattaaccttcancttcattgccttgcactgcanttatccccaattttgagnaattaaaaaccctcctggaccttaaggggttancccaacaaaaactattggaaagataaaccagaacanaacatcantnacatcatatttacngaaccgctaccctgctaattcatatttgtcctattatnggggta

SEQ ID NO: 83214 - DNA, 589 bp, Triticum aestivum
  unsure (1)..(589): unsure at all n locations
  Clone ID: PAT_TA_83214
tgttcgtgtcgtcatggactcatggtcgctcgccgccgtacctcgttgatgcccgcgcgagctacccaactcgccgccctagcttgaccacgcctgagcgagagactgcaagtcaccgccggtgctcgcccatggctgcgcgcgccgcggcaactcgccctcgtcactgcagctctccgccggcgctcatccatgtctgcacacgccggcgcagttcgccctcacgtcgcggatgcttacgccgtgccagtgcattcgccgtgggtgctcgcccccttgcggatgcttgcgcgtgccaacacagtccgctgcgggtgctcggccatcctgcgcgcgacaagcacantcgcctcccctgcgtgtgttggngcactccgcccgcgaatgcctgagaattggtggcctgaacacacataatggcagatgganagcgcnggagaatggagctgtcattctgaaatgttgaatgcaacaacttaatgacttgttgtaactttaatgangtggntgcaactggnatncacaagatacattcagttaantantcanataatnncacatcncaataatatccaattatcaaaaaaaa

SEQ ID NO: 83215 - DNA, 742 bp, Triticum aestivum
  unsure (1)..(742): unsure at all n locations
  Clone ID: PAT_TA_83215
ctgtcagaggtatcatacctcttgatatgggcataagtatgaaataccaatttcaactcttggaacatcttatatgctccgtggcgttcaaaacatttttgaagtcccggttctaagccataaagcatggtgcactacactatcaagtagtcatcataccgagcttgtcaaaacattcataacgtctgcatgtactcctgcaatagttctgtcacctagcggtgcatcaaggacatagattttctgtgcagcaatgaggaaaaatcctcagatcacggaccaatccgcatcattgctactatcatctttcaacttatatttctccangaacatatcatanataaaacgaggaagatatacgccgagctattgatctacaacatagatatgcaaatactattaggactaattcatgataaatttaattcaattaatcatattacttaagaactcccacctagatagacatcctcgatcatcnaaatgatnacatgatcatatcaactaaacctgtcngataacactgagatggantactgtaatgtggaacacacangtggatatatcacanagatcagttacttcgtccatgtcgagcatatcgatagcaggccgcagttaccaggggggccgnccattcccaatatcatacncccangcgcttnantcnacggaaactggtacactaccctgaaaaccttcatggaacaaggccccttcctcaatgncangaganccntgg

SEQ ID NO: 83216 - DNA, 579 bp, Triticum aestivum
  unsure (1)..(579): unsure at all n locations
  Clone ID: PAT_TA_83216
gaggcgtcggcgtcgacgatcaggagagcgcacgcagttcacccaatctccgctgtccagctggagtggtcgctctggtcaagggatgttgaagctgacataatcccgacctgcagggagcttggcattgggatagtagcctacagtccactgggcagagggttcttgtcgagtggtcctacgatggtccgacaattgtccgatcaagatttccgcaaaggagctgcccagattccagccgggagaacctgggagaagaacgccgtngatattcngagagatcaacgcgatggcggcgaggaaggggtgcaccccttcgcaactggcgttggcctggggtacaccaccaaggaccgactttnccccatacccgggacgacgaagtcnagaactncaacacaacgttgcgggctttcngtggactcaccctcaagaatggctaactcnatctaccctnnggggcgtcaaggcattctacatgantcccaacacttggaaggtcanaaaactccctgtctctgaagntatnanaaccgnggtaattaaccgttttccatnaaatggtngggnccanggata

SEQ ID NO: 83217 - DNA, 728 bp, Triticum aestivum
  unsure (1)..(728): unsure at all n locations
  Clone ID: PAT_TA_83217
ttttttttcagtaagcagcaactggtccagtcattgagataatttagagtaagacacgcgaattatgataagtatgccaacataaataggtaacagttgaagatctaaggaacatagagtgccttgtctaccactggagtacaccttgctcaagatatgcccagtatcattgggaactccggacaggtgggagaaaacactacgtttgatgttccacaaacccaagggaaactatgggatagcagaatccaaaagagtncaaattggatgaaatggtgttccccagaccacagaaggaaccttangtagacattatgaaactttggttcaaatcccagccgaatcctccgttcaagagttcccaaatatgttancaatatgctccatgacgagagatttgggtccaataatttcaatgtgantccaagaaccttccnaatgttgtccaatttgtgccattttcccattacttttgagatccactaacagnacatcattccaaactgggacantcctcaaaagccttgatcanaggtggaatccncnanacaacaacgtgactgaangacttccatcgaacnggtcangganactcaaccccnaggtaccctcacaaccaggggcanttttgttagaaaacagaagaaatnttcaaagatagnacacttttgccccgcattggttaccctaagtccattattcaannccntttgttcacaatacgagnn

SEQ ID NO: 83218 - DNA, 466 bp, Triticum aestivum
  unsure (1)..(466): unsure at all n locations
  Clone ID: PAT_TA_83218
tattgattggtgtacatgatttttctgccttttccatgccagggttgaaaccataaaccacagccaagtttatagcgaccaatttacaataaatcaaaattcaccaaattgacctgatacaaactggacaccgtctctgaacaattgaagagcatatatatatatatatagaccactaaaaacatatatgtatccgacgaccaaaacgaaaatctaggcagggcatgtcccctcggcaccgctccctaaaaatgtgcaacgagtatgaggcgaacgaccgccggctgccatccccggttccgattccatcatacagtgtaatggtggtttgtccacggcctccaatttcaagnccttgacctcaacgcagactccaccttcccnttagcgtgctgactcgcgcaacctggcatctccgcccgggcgcttccgcacaaggggggccngtaccaatcgccctatatga

SEQ ID NO: 83219 - DNA, 736 bp, Triticum aestivum
  unsure (1)..(736): unsure at all n locations
  Clone ID: PAT_TA_83219
ttttttttaaaggctacaacgtcactaaattattattcactccattttttttatacaaatattcaggaacgaaggtagtatatctgaaccaaatcaagcacaaatacatgtacatacacctatatgcctttcaaaactaaatcatcattgacttgtattgggaagtggaggctgaatttgccaagcatcaaggatactctgcagaccagatctataagttggatgaagcagattaacaccaagttcctgcttcatccgagcattagaaacccgtttctctgcaggtacgatcatctcctggataatctaagcctgcangcttggcatcaatggtttcagttatcatatcaaggatatctcctccgtatcaaactcgtagcaaacgcaaaaacttcactcttggggcaggtcctcatccaccacattaaatatttccntgcacatctgatgctcatactaccaagacagctggtagatgtcaaccacgtggatcctgcaatatatgctaaatctccaactcgttcgtgacaaagattgctctcgcaagtgtcaaagcactctcagccatatatcactaacggataaaancgcatttgntacaaaaatcagcacctttcgctaactantgaaccccctngtacgaggccacacatacccaatccanactntcaaggcncataatcaggcngttnccattncataatngtcncnggggggangancatatntcaanatt

SEQ ID NO: 83220 - DNA, 555 bp, Triticum aestivum
  unsure (1)..(555): unsure at all n locations
  Clone ID: PAT_TA_83220
gccaattgagggcatcaagaagttcgagaccctgtcttacttgccacccctctccacggaggccctcttgaagcaggtcgactacttgatccgctccaagtgggtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgatcctattccgcgtcatcggcttcgacaacatgcgccaagtgcaatgctcacttcattgccttcaagccaccaagctgcnaagaatccggcaagcctaaaatgcaagttgaataaccgatatacatgtcatttaatcacatttgtcngnggtctgcttcccattttactcccgtcnaccaatggaatatatgacatattnttaacactacaattagtcaagagatcattaaaatttacacggcatcatatcatattatantcaacaangntaaaaaaaaaaaa

SEQ ID NO: 83221 - DNA, 238 bp, Triticum aestivum
  unsure (1)..(238): unsure at all n locations
  Clone ID: PAT_TA_83221
tcactagagagaatggcttcggcgtggagttgcttcatcgtttctcgtcgtttagcagtagtggttactgaatagattctggtgaacatgctatggatctgtaacgtttctgaagctctgccttacttgaagctgtaggcgaatactccgggttatgccatattccgtccttcaagggcgctgttcaaacagctcttcctcacatgaagctgttagacgaattnanaaaaaaaaaaaa

SEQ ID NO: 83222 - DNA, 308 bp, Triticum aestivum
  Clone ID: PAT_TA_83222
tcaagatcccgggcctcacgcaggcgtggatcagcaactgctacatggactacaccagcatcgtcgccgaggaccccgtgctgctccacgtctccggatccttcttcctcggcgacgccaacgtcgtgctcaaggccgtcagcggcgtcgccaggggcgtccaggtcgtcggcaacatcttcagcggccgggacaagggcgtcgacatcgtgcagctggacggcgccttcgccaccgtggaccaggtgtacgtgcagcagaactccgccacggggatgaccgtcaggtccacctccgcgcgcgcatcg

SEQ ID NO: 83223 - DNA, 366 bp, Triticum aestivum
  unsure (1)..(366): unsure at all n locations
  Clone ID: PAT_TA_83223
cagccgcggagccgccagagacagacgctgccgccgtcggccgtcctccgccctccagttgagcggttcaagcagagctgatggctacatcagagccagtacaagagagtttggtggtgcactactcacaacctagtaggccccgggtcctccttgctgcttcaggaagtgtagccgctataaaatttgagacctttgccgtacttctctgagtgggcggatgtccgactgtggcaccacgccatccttgcactcgttgatagtnatctctaccaagtggnatcttctttacactgatgacgatgaatggcctacctggaagaagataggagatgaatcttacacatcgagctgccggaatgggca

SEQ ID NO: 83224 - DNA, 401 bp, Triticum aestivum
  Clone ID: PAT_TA_83224
cttgaccttgcatttgggctcacagaaacatcacgccttggctgccaagtgatcgcgaagcctgagcttgatggcatgcggctggcgctacctgtagccacaagaaacttcgcagtagatggctatgtaccgaaaccacactgaagagacggtcatctaccacactgaagagacggtcatctaccacactgaagagacggtcatatcggggaacacggattcttacagcatcaattttgtagtttataacctgtaacttaactacagctttgttacttgtatccggccgggtggttcggactaccttgttgagggttgttcatttgatgaacccttgggtacttgcaagagaagagagaacagtgcttcatcctggggcgaataaacacctttctgtgtgc

SEQ ID NO: 83225 - DNA, 580 bp, Triticum aestivum
  unsure (1)..(580): unsure at all n locations
  Clone ID: PAT_TA_83225
cccaggccaatcccaggaaaccggaagctcgaaagctgccaagccctcgccgtcctgccgcccacggcttaccgctgccgcctgccgcctgccggccaccccacccaacgaaaatccgcatatactgtagtactccgtttcgcccgcgccgcccatccgttcggctgcctcgcacgccccaaaatcccctgctgcgcctccaaagccagcagccggcaggtcccgctacaaaagcaagcggcatgcgcgtgcgtgacaggtagcagctgcctgagccagtgcgcctcggtgagcagacaggaaccatangatagacatggcggccgccgtggagggggtnccggaccgaacgctggaggcnaacggatgcccctgcacnttgcggaggctgggcccnaggaggnaaccccaattgggctgccccttaaaggtttccngnaccccggtangntggcccncaaatgccccctgggggccttgttaccncccnggnccggcttcgcggtanggaatcnaatccgccgatcgnaagtnacactcatttgtnggactcttcgctattcactcgcacgnagttttg

SEQ ID NO: 83226 - DNA, 634 bp, Triticum aestivum
  unsure (1)..(634): unsure at all n locations
  Clone ID: PAT_TA_83226
ctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggactcgccggcaacgctgccaaggacaacaagaagacgcgcatcgtcccgcgccaactnctgctggcgattccgcaacgacgangactccgggaactgctgaccggcgtnaccatcgcccaacgncgctgttgcccaacatcaacccggtcctgctgcccaagaaaacgngganaagnttcaancggcgggacaaggangcaatcccccaanaaggcgccaatccccaaagaagnataggttgggagcggtcnatgtgtcatgtgtagtgtaaccggaattnatggttgtactctncctagttcttagtatcatgataagaatncttttctntcgcttgtngatcataaactnaa

SEQ ID NO: 83227 - DNA, 312 bp, Triticum aestivum
  Clone ID: PAT_TA_83227
atgccctaccccctgggcgcaccctcctgcctcgtggctttctcgttgcctctctgacttcatctctaagttttctggcttgctttcggtccaagaaagatcatcgcgaaggtttcattccgtttggactccgtttggtattccttttccgcgaaactctaaaataggcaaaaaacagaaactggcactaggccctcggttaataggttagtcccaaaaataatataaaatagcatataaatgcctattaaacatcgaaaacagataatataatagcatggaacaatcaaaaatatagatacgttggagaat

SEQ ID NO: 83228 - DNA, 533 bp, Triticum aestivum
  unsure (1)..(533): unsure at all n locations
  Clone ID: PAT_TA_83228
caacaacgccacctcctccggcggctctggatcacaccgaaagatgagtcacaacgcgtacgagcgtgaccgccgcaagcagctcaacgagcaatattcctccctccgctccctcctccccgatgacgaccacaataagaagatgagcattccgaccacggtgtcgcgggtgatcaagtacatcccggagctgcagaaggaggtagacggcctggagaagaagaaggaggagctgaggcgggccagctacgagcaagcgccatgaggcagaacacggcccgattgtgtccgccacctgcctcgacgacanggaaatnatgnccaagtcagcaagtgacaccatggccggantctgccatttcaaatgcatcaaggtgctggaatcaagctccgctcanaatcctcgattccgcttccaaaacagattctanacctccatcttcaangaaccaacgaacatgacaaggaggcaaacttttttacaacggagaactctnaacaaaaggggganaaatcgcacatatggatgtaca

SEQ ID NO: 83229 - DNA, 595 bp, Triticum aestivum
  unsure (1)..(595): unsure at all n locations
  Clone ID: PAT_TA_83229
gtttcatcttagcacagccagctgcccagctgcccagcttctcttccctcatagtcgaagacgtcgtagccatgtcatcccttctgaagctggtggtgtttcttggcctcacctttgcaacctcgttcgcaagaagtaacgatcccatgttcgcctacaacggtttctccaacaccaacctccgagctcgacggcacggcctccatcacggagaacggcctgctcgagctgaccaacggcaagtcatgagcaaagncaccttcttcccggttcactgcgcttccgcaattccccaacacacgtcatccttctccgcctcgttcgtttcnggattactcggtgtacaacaaccttacaaccacggctggcatgttctcnccccaagcaagatttcccgccgcancccgtggcaactggctctnaaagccaaaagacggaacggacaacgctctngtctcnactcanactacaaaanacantcaagactgacaacaacattcggataagtaangctcatcgtcanccagcgcggtttactataaggacttgatcttagacnaacctacaaacatcagttgtgcaaacaacccgttac

SEQ ID NO: 83230 - DNA, 631 bp, Triticum aestivum
  unsure (1)..(631): unsure at all n locations
  Clone ID: PAT_TA_83230
agaagatgcgcacgctttcgatgttattagcgtcaagattgcagacctgggcaatgcctgctgggtcaaccaccactttaccaacgacatccagacaagacaatatagatcacctgaggttattttgggttccaaatggggtgccagcactgatgtatggagtatggcagctatggtgtttgagttaatcaccggagattatttgtttgatcctcagtcaggtaccaagtatggtaaggacgatgaccacattgctcaaatcatcgaactacttgggcattccccaaatctctatgtctcaagtgggcaatnggagtcaggaatcttcaaacccgaaagggagaattgccaaacatccaccgactgcggattgggctcctaccggatgtnctacgcnagaattacacttttaaggaagacgagcaaagcgtattgcagattcctcacccaatgtttgggttagtacctgagaacgaccatgctggcggatggaagcactctggttggagaaaactgcataaagggcgaaatgaggctgaatcgtgccntgtaagnatcacgtggcacgantaggagaataatgnttaaaaccccggantataaaaanacaaccaatnaatcagacccanag

SEQ ID NO: 83231 - DNA, 559 bp, Triticum aestivum
  unsure (1)..(559): unsure at all n locations
  Clone ID: PAT_TA_83231
cgatcatcgactctggcatgggcatcacgaccttcccacgtgccgtgttccaaacactccgggatgagctcgcgaaacaggttccactaactgtcctcgacggcacgacgatcgatggcgccgagttgctgtgcttctccacgtcgccgaaccagaaggtgcccaccataccgaaggtgatcctccatctggagggcgcggactgggaccttccacgggagagctacgtgctggatttcgaggacggctgtgcgtgccgatatcttcgtcgggcgagagcgacatgaccatcataggcaactccaacagcagaacatgcacatcatctacgacctccnagancaacaantgggttccgtgcctgcaccctgtgacaantgtgaccactcaaactgcacctgcatgtnttgatgttatgctcnacgcgtgtatccnactactaacttnctacggntacttcnaggtaaaaacgacacaaaggaattgtctccaagtacatcctgctaaataaaggaggatatccaatctgatacatcaatgaaagtccaagctaaaaaaa

SEQ ID NO: 83232 - DNA, 563 bp, Triticum aestivum
  unsure (1)..(563): unsure at all n locations
  Clone ID: PAT_TA_83232
agttagtagcatctcgtttcagagctcanaggagggaggaggaagaagaagcagcagcaaggcatggattgctgcatctgcagccccgtggcgtccgtgtacaggctgccaaggaacgccatctgcgctccctgccaccaaggcgccaaggccatcatcggtttcctcgacagggatggtgagcgggaagaggacgacggcggtggccgttctgtccagctccagcctcgcggctcggccaaggggctgagagatgcgttggagcaggtgaaggagatgataccaaggaagaggagaccaagcaaagagctgccttcctccaacacgnttcgccttcngcntttgaaagagggaatcnacaccacatcgtcgtcaaaccttgcaccggtcccgcnattccagccaaaaagccatcctggccgcgcgtccngnngtgttcnggacatctttccgggacacngtgcaaagccccgcccggggtccantcgntcccggagtctncaacanaaanttcctctgctccctcctctaaaancgcctggngggcaaganangagagagag

SEQ ID NO: 83233 - DNA, 408 bp, Triticum aestivum
  unsure (1)..(408): unsure at all n locations
  Clone ID: PAT_TA_83233
ataagcatttccctagtagtgtacatacccttgtagattgctaagcggaagcgtttatcaatgtggttgatgtagtcatacaccttcacgatccatctcgatcaagtactgaacgtacggcacctccgcgttcaacacaggttcagctcgatgacgtcctcgccttctcgatctagcaagagaggcaaagtagtagatgattccgacagcacgacaacgtggtaacagtgatggtgaaactatctgcagggcttcaccaagcacaacggacgtngatggaggangaactagaactaganggagaggcggcgccgcacacggttggttcntgggtgtgtttccctctccctcctcaatatatatatatatatatatatatatatatatataaaagntgaggggaggggg

SEQ ID NO: 83234 - DNA, 621 bp, Triticum aestivum
  unsure (1)..(621): unsure at all n locations
  Clone ID: PAT_TA_83234
aagatgagctacgtggttgatctgagacctggcgaactcacggaggtcgttggtggtcatgaagtttggaccgcagtaccagccggggacgttgacggcctccatgtagtcggcgtagagcgcagcgatgaaggagttggcgacgacgtactgcagcggctgccccctgccgtggttgaagagcgccatcccgcccttggtgaagttgaaggcggcgaagcgcgggaagtacatgcacatgtttgaggctggtggcgtttttggtaaccggcgagcgaccctcctacgggtaaccgggtttnangaacatgcgcaacccccacagcagcaactgggcgcccggagcttttttcccaactgaacacngagaattcaagatttttaaaggggggcccgtacccattcnccctanatgatcctataccncctcaatggcttcttttaaactcctgactgggaaaccngcttaccaacttaaccctncaacaaaccccttcgcaactgggtatacnaaaagcccacgatgcctccaaaatgccacctatgcaatggaaccccttacgncataacccgcgtttgtgtacccactaccaactncaagccacncgcccttccttttct

SEQ ID NO: 83235 - DNA, 646 bp, Triticum aestivum
  unsure (1)..(646): unsure at all n locations
  Clone ID: PAT_TA_83235
tttttttttttttgacgaacatgtttttactatattaaggaggtaaatgtcgtcccttctcattcacaacagggtttaacaagaacatgaacacaactattgggcaaatgtcgaaatgaaagaaattttttgatgctggaccagcactgcctgccagagatacattagtccatgggagtagaggacagcttttgcttcgggcaaaaattccagcactcctgccatgtagacttctatgcagtcctttctgatacacgagagaccatagacaatgaaatccaagacacatatttacctcagggtttcagattccgatgcacattgctttcaatgcatctagtatagtagacctgagtatccatttgatttcgaccggtgctgattgccttcctcctctgtccaccactatccagcaaaatctcnttacnatctcactcaaatggtcctangtggaaaactcctgatgtgttgaccacatgtgagatccgtctgcacatangaaaaccctnaggccagaggaattacatanggatctgagaaccaggtcgttanncccgaataatcgtaatgtatgtcggangttctgaataggcaatcagacattatgggtactcgntcaancagcaangttgtntttcgggaaaan

SEQ ID NO: 83236 - DNA, 319 bp, Triticum aestivum
  unsure (1)..(319): unsure at all n locations
  Clone ID: PAT_TA_83236
ccgagttcctgaagaaattctacaccagcaactactaggatccgaggccgccacaaaaatttccagccttcctgtagaagtgcccttgacatgtactctgaataagacgctgagaaacacatccggcccaatttattttattactctatgttttgctttgttcgagcttgatttgattacttggtcatctctactcaatgagatggtgtctgccagtgaaacggttgtaactcatagaccctgcttcccaagctcatgttgaaggattgatgtcttgcagaggcaanatccatgaaaanaaanaaagaaaaaaaaaaaa

SEQ ID NO: 83237 - DNA, 631 bp, Triticum aestivum
  unsure (1)..(631): unsure at all n locations
  Clone ID: PAT_TA_83237
ctggttttgaaattctgaaccaggtgcctggaggaaggagctgacgagttcttcctaaaacctgtgcggctatcagacatgaacaagctcaagccccacatactgaaaagcagatgcaaccaggaacagcaccagcaaagtgacagtcacagtggcgaacgcaggaaccccacaatcggcagcagcagcgatagcataaacaaccgcaagagaaagggtgcaggcaccgaagaaatcttgccccagctggcaaacagttcaaggcacagttaactgagaactgactagtacagctaaaaccttttctttttcactttactttggcctactgatttgtnacgtagatgttaccctggatttgcaaaacgggaacggatctgtnaactgatactgcttgagtcnaatcnatngaagtgattctgcaccaaaaaaaggggccngtaccaattcgccctatatgatcgtataccgcgctcatggcgtctttanaactcntgacnggaaaacctggcgtaccaacttacgcttcaganatccccttcgcanctgggtataccaaaagcccacgatgcctccaaanttcnacctaangaatggaccccntacggctaaccgngtttggtacccactn

SEQ ID NO: 83238 - DNA, 447 bp, Triticum aestivum
  unsure (1)..(447): unsure at all n locations
  Clone ID: PAT_TA_83238
ccagtcctgccaggaaccatccatatatacatgctccggtgagctttgctcgacgacagtcatcatgcatggcgcgcggcgagtgaattgaatcggagcaattttggttgccaattnacnnaacttttncttnacggaacnaaccaanatttncattcaacttgtccaatccaattcaaaacnaaaattggngntnaaattggaacacaaaggcnaaatctcataggagacaanaacaacaaaacaccctgtnnccctcnaaacaggggnggtgtccanacaaanccttttcccgntatnccagangtnttgcgggtgctgnnacaactnttcaatnttgnggagcacaactttttngaggacaaaaggngcacatangagctnntcagaacaaaacaggcgggggggagcacaccacaaaggnggtctccaagagggccgtntttt

SEQ ID NO: 83239 - DNA, 594 bp, Triticum aestivum
  unsure (1)..(594): unsure at all n locations
  Clone ID: PAT_TA_83239
gaagaatcatcccagccatcgccacctcaactgcaatggccaccggccttgtctgcctggagctttacaaagtccttgctggtgggcacaaggttgaagactaccggaacacatttgcgaacctggcgatccccctcttctccatggcggagcctgtgccacccaagaccatcaagcaccaagacatgtcctggaccgtgtgggaccgctggacggtaactggcaacatgacgctganggagctcctgnagtggctgaangagaanggcttgaatgcgtacagcatatcatgcgggacctcgatgctgtacaactccatgttccccgagacacaaggagcggctggacaagaagtggttgatgttgccangaagtggcaaattggagtgccttcctacgccgccatctggacnttgttgtggcctgttaagacgacgacgacnatgactcgaatccctcgttcaatttantccngttaagaggaacacgccgtttantaatgatcttgtgcangttgtcanaagtnttcataatnccatgcaactcaaganaggntgctaaaccatcgatgattccaaccggtaaccgnnggna

SEQ ID NO: 83240 - DNA, 368 bp, Triticum aestivum
  unsure (1)..(368): unsure at all n locations
  Clone ID: PAT_TA_83240
aagccgtagagggagcggctcccacggcatggcggggtcccatatcgcctaggagcacgcgatagtgaggttgtagccagcgcacgcaacgaacaagcagccccgcccgccgttccccacctacgcagagcaatgggacccgcgagccggccagccaggacggcacgggcgcggcggccgggtcgaacacgagcaggcggcacaacaccaagtagactccgcgatgaggacgagctacgccgcngcggccacaaaccgaaacggcaaccgggcgggagaagacggtcccaaaagcatcnggggcgccgacatcccttcctatcccaccgcacgacatntgttcgtaggcatgaaattcgccgccgtcg

SEQ ID NO: 83241 - DNA, 704 bp, Triticum aestivum
  unsure (1)..(704): unsure at all n locations
  Clone ID: PAT_TA_83241
tcatttttttctatagctgttagaattttactttgctcagttcatactataaataatatgagactcttgttttgtggtccaagtgtttagcgcttagggtgccttggaagtacgctagcttgttgtcatgaagaagtcattcaagttccttccagtgagttattagttcttatgtatatttctgtaacatgtaattttacaatctttatgcacattggaggtgtatttacgacataattaagcatcataaacaaatatattttaagagtagaaagaaggacaatgcactccattatgttttaaacattgacttttagtttacctcaatgcaaccttttcaagcactccnatattcctggacataatgttcaatcatttctggggtaatatgtcatggcatttgtcctgtccttggganaggataagtctgggccanacggggncangtcgccggctgtcnancggtgatctcaatgtacgacataggatccaagagacataatatatnaaagncnatggagaaatacaactcacataactcatcanaaaatctcactaagtcgctncacatagatnanactagnacaaaanaattaagacccnagtantacatattataccaaataccttggtataaanggttgttatagnttaaaagtataaccctagaaanttgtaaaaaaancggggggcattccnttttt

SEQ ID NO: 83242 - DNA, 206 bp, Triticum aestivum
  unsure (1)..(206): unsure at all n locations
  Clone ID: PAT_TA_83242
aacaggaggaaccgtgagcccccgcagcgtttcaggcgccgggatgatggcccaaggccaggtcagggcccaccgcgcccaggtgctgctgccacagcagctccccctgctgccgctcctcgtacctaagttcangaatgcgtttcaaggcttaattnccccaacctatgggaaaaanggacttttccntgnttttgaaaaacaat

SEQ ID NO: 83243 - DNA, 545 bp, Triticum aestivum
  unsure (1)..(545): unsure at all n locations
  Clone ID: PAT_TA_83243
aaaacccccgcaaaccctagccgccgccagctaggcaaggaatggccgccctcctgcggctcgccgcagcccgatccgccctccccaggcgcgccctcgccccacaccggaggctcgcggcggcggcggcggccgcgatggaggagtggtggtccgactgggagcaggacggcgaggaggaggcgcgcgcctcggcgccggccgccggccttgaccccgccggcgggggccccgggggcgtgcagtgggtcgtcatgggccgccctggcccgcaaaagcacgcccacgccgcgcgcctcgccgaggtgctcgccgtgccctaatctccatgggcgcgctcctcaagcaggagctcaaccctcctcgcaactctacangaagattgcaaactctgtgaatgaaggaagcttgtgccggaggaatatatttggttgctgacgaagcggctnaggacggtacaacaaggtgaaangggtcattctannggatccagcaccgtttgaanctgaaatcttncaaattnngttnattgtnntaatttaatt

SEQ ID NO: 83244 - DNA, 501 bp, Triticum aestivum
  unsure (1)..(501): unsure at all n locations
  Clone ID: PAT_TA_83244
cttatttgtgtcttcggggagaggacgcacaagataatttcttagaaagcaggtgtaaccctctctccctctgaattaattggtgcacatgaccacttattaaattaattgagttctgcatctgctttagaaaattagcggtataccttctctattaattggctcaaaaagcgacaaggaactcagtggattgactaaacaagtggagaaaatgaatgtcgctagcgctttttatttagtgttgcacgctctattgtattttccccttccacgactcagaccacctttcanggatggcccgacgagcatgacgatatctaatgaaggaattcaagatctaattggggtggacggtcaacaacactcgtgcatatggtaaacaccgtagctgcatggtgaaaacctcacgatgatgttagcntgaccgggtaagnaatggtgatcacgacattgcccgtgtccataagtgaaaaaaccctgatatgtgttttgtcctcctta

SEQ ID NO: 83245 - DNA, 597 bp, Triticum aestivum
  unsure (1)..(597): unsure at all n locations
  Clone ID: PAT_TA_83245
atcactctctcccaccttcacttcacctgctctctctgttctcgagctagctcacatcagggggaggaagaggaaccagcacctgcctcgccatgtcgtcctccatggtgtccaagaacgcgccgccgccggccgggtacggcgacggcgaaggcagcgtcgtcgaggccgcgccggtgacgagctgcctgtacctgcgccccggggcgggggcgctggacagggacgccgtgctgcgccgcatccgccaccggaggcgccacgaccgcctccacgacacgctgcgctccatggtgcaagcgccgccgcggtccggctgagcccggacggcatggacggcgcaagaacggcactcccgtggccgctcgacaacccttctcggngccttaacttttgtaatatagaattatcncttgtgcaattaaccaaatgcacatggaaatggtcaattccctcttcttgtgtaaactgtgaataaaaatcagttaaataacncctattatgcaatgcantaatgnttatgaanttatgcaggatgancatgntattcaagattgtttggaccacatttcganantgttactcaaaaaaaaaaaa

SEQ ID NO: 83246 - DNA, 614 bp, Triticum aestivum
  unsure (1)..(614): unsure at all n locations
  Clone ID: PAT_TA_83246
cggaaatcaattgaacatatatggagagcattgaaacacgaaaatcccttgaacatatatggagagaagattgttgcagtgtcataatacaaattccctcggcggtaagttataatcaaagcaccgttatatgaggataaacaaactccacgaccaagagagtaaacgcagtcaatggagaccggtctttaatttctttgtacgcatggaagcgtgaacatggctatatcattcttatcgtcttcngttttgtccgacgtgtcttccttcttctcttgctcnccctgggctgtgcaacgatgccagcaatctttaacagatggtcattggggtttaacaccaaggaagnnattaanggatanatgacacaaacttcttcttcaaacaccttacncatatnatgtccacnggacattttgcancctggacanactttgaagaccatgcaattcagggtcaacgcacaacttctgcaaaacanatcancanagtgnantctgancacacctcattgaattgaaggccncgtanaantgcacanccttggtgtcttgcacanaanaaatttggggggttccctcacaaaaaaacatgttacctggaattgtagttct

SEQ ID NO: 83247 - DNA, 415 bp, Triticum aestivum
  Clone ID: PAT_TA_83247
tggagctgttcttctcatgaaaagatctgtggctctgaagaaagggctgcccattcttggtgttttcaggtgcccggcgcgtggctactcttctaaatgaaatgaagcgccggggcagagactgcagatttggtgttgtcaccatgtgtatcggatctagaatgggggcagcagctatgttcgagctgtgttcggcccggctggaggtatcgaccatcactcaacactgtaacccgatggtgatcggcgaccgtgagcttccatgttattgcgttctgatacttgagacttttattatgactatgtatgagatattgtctcttattagtactggatgatgagatgtgtcttattatgactatggatgagactttgtgatgtaattgatgagactttgtgatgtaaaaaaaaaaaa

SEQ ID NO: 83248 - DNA, 540 bp, Triticum aestivum
  unsure (1)..(540): unsure at all n locations
  Clone ID: PAT_TA_83248
gagttcgcagcggcactccagggtccaggcccagcagcctcttcggctcttcgttgggggtgcgtggacaccggaaattgcctcggggattgcgttcctgatctaagcccggcatgaagggctgctcannancgtttgctgctcctgctgctgctggcatcgtcgttgttactgtccgtcgtggttgccgcgcancanacttgccctgccgacctcgacagcaaatgcgacggtggcgcgcctgatgactgggagggggaattcttccccggcgtcncnaaaatcaagtatgaggggtcnaacaancangaacctcttgcttataantggtatacaaggnngaagtcattctcggaaaganancaaagactggatgcgcttcattgttcgttctgnanacattccgtggtantgnagctgatccttttggtgcgcntananagtttggccttggnaagacggaaaaatcatgngcatggntatanaatatgaacccattnanttagnaaaaacgggggttaaaatgtgctcannatggaa

SEQ ID NO: 83249 - DNA, 714 bp, Triticum aestivum
  unsure (1)..(714): unsure at all n locations
  Clone ID: PAT_TA_83249
gatgccaggacctcggggggtcatcacagtcaatggaaacacagagcgctctctccgcacggaggagcacactgcggccctcgtagcagaagcacaaagcaacctcttcaggcaatccaccagttcggtgattaaacacccgaacaccgtcaagcgcgcccggagtaatctgcaacaagaccgcctggcacattccgagctcgcatagcaatgcggcccccaccccagtcccagccaaacggtgaaatccgtgccacgcgtacataattacgcattgaaaataccatgggcatangtgggggggcacgactacggcacgcaccaaaacgcggtcaaccgcactaagggcttcccgctttgttatttttctctcnttcaaggactttatctctgggaaacccgtccggcagtacgattgccggacacacgatacaacaacaaggagnanaaactactccacatggactccaagtggctctgataacnatgaaatacaacttaaatacantctaacttgccttgaggggaatgtaaatatccncttttgtacgacactttacattctctcagcactttnataacatgatacacnnctatacgaatccaancntttaaatggcccccaaatntaccgtaaccgngggaatcaagggtnagtcccaanggngaatccanntttangggccctttaaatancccncatttgggatgntt

SEQ ID NO: 83250 - DNA, 424 bp, Triticum aestivum
  unsure (1)..(424): unsure at all n locations
  Clone ID: PAT_TA_83250
cctcgcgtcttcctttccgctgcangaaagtgcaaacccccactcaactaaaaaaanccgcaaggcaaagagaaaaagcaacgcgaancaaaccaccatttcggcctccccacccccatcccatctcatcccctccgaggctccagggacggcgtgatgaggncagcggcgccggctgcngcggcggacncgcacnagtcgcngctgctcnacgagctctgngcnctcctgctgaacgtcctcggngcgtcnccggacgacagngcgggggcgcngccnctgctgccgctgcatgtgacacctgccggggtggcgtcatgctgctggggcgcgtcatggnctnatgctctgccggctcngtcaccttnaanctccggattcttcctcattccctgngtcttcaggctcggctcctcncctcttc

SEQ ID NO: 83251 - DNA, 353 bp, Triticum aestivum
  Clone ID: PAT_TA_83251
caagtatcaaaggagaagataaaaagcataggcatcgagttgattccactggagacgagcgtcaaggagaccatcgaaagcttgaaagagaaggggttcgctagtttttgactcgagcaagctgtgaaacataagtgttactgtactacgtgatgttgcattgtatacatgcatcggacttcgcagttcccaagctattttggtagctttggtctgtaagattacctaaaataaactgagccacgttgccacgctgtagcttttgggacatgttatgctttgatcggattgagacacgtgatatatgatcgttgcttacaaatgtggtacgctctatctccaaaaaaaaaaaa

SEQ ID NO: 83252 - DNA, 385 bp, Triticum aestivum
  unsure (1)..(385): unsure at all n locations
  Clone ID: PAT_TA_83252
actaaaacgaaaattagggccgaaatcgcgatcgaaaataatcgcgggaaaaccctagaaaaaaaactgacgaacaggccaacgaacgaatgttcgctgtctgcagctaacgggtgaaaaccatttgttaaatcgaacgtacgaacgggcgttcgctaaataactaaaccagaaaaaaaataaaccgatctaataaaaaaatgcatctaggttttcgaataaaaccaaacggtttttagaataaaaccgacggctacctcgtggatcggganngangcggcagcggngcggcgtacccgggcggcggggcgggtccgggnggtnggcggcngngtttggcagcgacgcngnggngcatcnggangtnagagcngtgcatcactgg

SEQ ID NO: 83253 - DNA, 729 bp, Triticum aestivum
  unsure (1)..(729): unsure at all n locations
  Clone ID: PAT_TA_83253
ctcgtgccgtttttttttttttttttaaaccatgaaacattaaactgcggtagttgcaaaaggattccacattacagcatcatatactaggaacaaaagttaaccaatgccaagttttgctcatcaaattattattcttcactaaatccgtaacatataaaaggggatggcacaggcgcacagcttgaccgagccaagggaattaaggaaggctcacagcgtcaaaagccgcaccttacctttcgtcggcaggccattatgggatgtcccacggcttaagctcggggatggcgacgaccatcccctgcagctccggcgcgaggacgacctggcagcccaggcgcgcgtgcttgttgactcgcggtcctggacgcgcgcgtgagcactatcgctcctcgtangacgtggtggaacttgtcaagcactcctgcgcgattggactcgcatccgcggacagcgtcatatcctcaaggggggccggtaccaatcgcctatatgagtcgtatacgcgcgctcacggcgtcgttanaagtctacgggaaaacctgcgtaccacttanccctgagaaanccctttccacngntatacaaaggcccacgttcntccaatnccactaangaaggaccccnncggataccgggggttngtaccaantccnaatnaagcaaccnctttnttccctttcnatcggttccaacaanggccttggccttnttngccccaatttg

SEQ ID NO: 83254 - DNA, 552 bp, Triticum aestivum
  unsure (1)..(552): unsure at all n locations
  Clone ID: PAT_TA_83254
aagacattgactggcaagaccatcaccttggaggtggagagctctgacaccattgacaatgtgaaggccaagatccaggacaaggagggcattcccccagaccagcagcgtctgatctttgcgggcaagcagctggaggatggccgcactctcgcggactacaacatccagaaggagagcacccttcaccttgttctccgcctcagaggtggtatgcagatctttgtaaagaccctgactgggaaaaaccataaccctggaggttgagactcngacaccatcgacaatgtnaaaggcgaaattcaagacaaggaggnatccccccgnccaagaacttcgttnttcnccnggaaanaactgaggatgcnancctancaaantacaantccaaaagngagacctncactttggcccttccctggggncattattagggtctttaactccattnccgctctcggngctccncanagnggtgcaaatacgccgttcttataatcttatttgttaaaaggccgttttttttcncacaanntcaanataaanttgntt

SEQ ID NO: 83255 - DNA, 202 bp, Triticum aestivum
  unsure (1)..(202): unsure at all n locations
  Clone ID: PAT_TA_83255
nacttcctgctcagcatcgtgtccggcggggtcgtcttcgccggcatcggggggggcagtcgtcgccgtctccaaaattcgacccngggaagaggggggngatcgcctcgcnggattctcagggcanntcgcctcnctttggacctccaaaaancncttttcggtgttttattcgggantcctgttcgtagatagatccatg

SEQ ID NO: 83256 - DNA, 289 bp, Triticum aestivum
  Clone ID: PAT_TA_83256
gcagccgctcccactactagattcaggtgagctcatcattagtgccccggcccttggtgcggtgcggccaacggccatggcgaagcttgccgcgcagctcaagagcaagttctttggcctcgtcggccgcatcaccagctgtggccgcgccggcgccacccacaaggatgccgctggtgcgacagaggccaatcatcagtgggatcccagcctgttgagatcaggtcaaaggggaggtgctcctccccgtttgatggaggggcaaggtcaacatcaacagtgacacaca

SEQ ID NO: 83257 - DNA, 575 bp, Triticum aestivum
  unsure (1)..(575): unsure at all n locations
  Clone ID: PAT_TA_83257
caaacggagagagacaatcgagagagatggcaaactgttttggtgacgtcgtggacaattacaagctagacacaatgccaagatatatcggcaaaaagaagactcgagaagaccgggcacgagaggcctcctatctcagtaatgagaatgagaagtacaagaaagctaaagactatgtgaacatgctgaaggactgggtacggcaatggagcgtcgacgctgtgcgtgatctacaaccagacgggcggaaccctgcggtacgtcgacgacaaggactgggctggggctacccggggcccgacncctaccccgacggagattggcaacgggaattgggcncctcctccactccacaagaccgggcctcntcnggnccaatggccgctgtcgtctaccgcggcaaggacggcggcggnacnagcgcgactcnccatggctggacaccctggggcgctccaaagaacagggctactgcaaatnggaactcggtcctcantccantgganatctcncaaaaaatcacaaggngngatacatacacccngtggacaaccntcanttcgccacncaaggaa

SEQ ID NO: 83258 - DNA, 245 bp, Triticum aestivum
  Clone ID: PAT_TA_83258
gagagagagaactacaagacagaggaggaagggtaggagatcgtgcggttcatttttgcagatcgtacggtaccggtgcgaccggcccaaatttgggccggcgcaccggcgcctatcagtcgccttaaacacaatcacgtgaattgaacatgtgcgcttggttcggcttgtacgagtcttatgtgaactcccggcaaaaaagaaaaatcttgtgtgaacgtacgtttataaaaaaaaaggggggg

SEQ ID NO: 83259 - DNA, 563 bp, Triticum aestivum
  unsure (1)..(563): unsure at all n locations
  Clone ID: PAT_TA_83259
gtcacttggaattgcattgacggtgtatggcagggaagaagaagctgacaccttgatcgagcaaatgacgagagaccaagatcccatacttcgttacggcggtatgtatgcattggctctagcatacagagggactgcaaataacaaagccatccaccagcttctgcattttgctgtgtcggatgtgagcgatgatgtgcgaaggactgcagtgttgggctcttgggtttgtcctgttacaatgagcctgaacagacacccaagaattgtgtccctaactatcaagaatcatacaatccacatgtcccgtttacggggaaccctggncgttcggnactcctgtgccggttaaggattaancgaaccactccctacnggacctctgacacaaactctcgattcntgcgccaaggtgctctaatgccaanggaatgggtgatgtcaaacaatgaacttacgatcacgcgtcggncatnaagcgcanttggaaaanataancctgcaaacacaggcacatggcaaaatggggccaaatgggntcnggantcacacccggngaagaa

SEQ ID NO: 83260 - DNA, 591 bp, Triticum aestivum
  unsure (1)..(591): unsure at all n locations
  Clone ID: PAT_TA_83260
agtagcagcttcccttctccgtggaagaacaacagaagaaaagggggtaggtaatcttcggcgccggcggccgccggtccccgcgatggacgcggagaccggagatacccggtctcccctgctgccgcatccccctcccagccaagacgcaggtttcctcagcgaatcagcactataacaaacccttcaactggaaggccccagccattattttggccttcgaatcctgggagagcattgcttactctggtataacactcaacctggtccgtgtaccttgggaaccgtcctccaatgggaaccaccgcctccaaatgcaacgaacgtcgatgccttggaacggcgccacgtttcntaacgccggtccctgggacctttcctggcngatacatactggggggaaatncaagaccgcaactatctccaataatatccacttgttgggctgctcaaaattacaactctggcgtaatacgtcctaagggctgctcgtgtgaaggggtnaagccaactgaacanggttantaattgtgccccttggtcattgncccaacncaatgtacggggggtcaataanttnnttcattggac

SEQ ID NO: 83261 - DNA, 694 bp, Triticum aestivum
  unsure (1)..(694): unsure at all n locations
  Clone ID: PAT_TA_83261
ggcacgagcgctccagtatacggtccagactggacggtccttgattgttgcgcttgaatggcttcttccgctgaccggatttcgatccgctgaatccggcattgaacgtcgtatcctcggtgctgtcgccgttgttccgtcgcttgtgtctgttgtgccatggcttgccattattgtcccagacatctgaagttccagaatgtggcgtagtgctactgcgagccaaccagttgtcttcgcccgcgcaaaagcgatcattaagtgtcataagaccgccatgggacttgggttccccctggacaagtgtcctggcgaccactcatcaatggatatatgattgaaacccccaaaggttccggctcccggacattcgacatttggtccttttaagtaaggaacgggtccaagaattcctggctgatcctccggctgttgaattaagtgtccaaatcaccggnatcggaggttcacatattgcccggaagtgtaaggaatctctcaagttttcaactgcaatgganttcggcagctgtttaccatgtcggcagtcnttactaagggaaatantatacatttaatacncncggcatntaagttgggagaancccatcaacgcggtccgtggcaacagatccagttangntaacctctgatcaagcacnttaaanaaaaaggggttggccctntnggaata

SEQ ID NO: 83262 - DNA, 576 bp, Triticum aestivum
  unsure (1)..(576): unsure at all n locations
  Clone ID: PAT_TA_83262
ctacattcggatcttaagccacaaagatatcagcaacctcagcaatatcaacagtaccagccaagacaacatcaagttcaaacggattcatatggacgcggccgaggcagaagcaggggccgaggaaggggctggggtactaggggtgggtacggcggaggctatggtggatatgaatatgataacaaccaagtaggttatggtgggtatgaacaccacggtggatatggacatcaaggtggatatggaaaccagggaggatatggccacaaccaaggtggctatggccacgaccaangtggctatggcggttatggttacaaccaaggtggatatggaggatatgtatttttgccatcagaaaatggaggctggaactacaaccggaacanaagcggtggcngccgaggacgagcaatngggctatgtggtcctggatataccttgtggcaaaagccaagtggcctgncgcaagggctatgtcnaggccttgacaatggttgccgccttgacgggcaacaaactctatanacaaggnatttcacggcctatgncgtagnttcccatccccaattt

SEQ ID NO: 83263 - DNA, 735 bp, Triticum aestivum
  unsure (1)..(735): unsure at all n locations
  Clone ID: PAT_TA_83263
cttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactgggaacaacactcaaccctatctcggtctattcttttgatttataagggattttgccgatttcggcctattggttaaaaaatgactgatttaacaaaaattaacgcgaatttaacaaaatattaacgcttacaatttaagtggactttcggggaaatgtgcgcggaaccctattgttaattttccaaatacatcaaatatgtaccgccatgagacataacctgataaagctcaataatatgaaaaaggagatatgatatcaacattcgtgtcgcctatccttttgcggaatttgcctncgtttttgctaccanaaanctgggaagtaaanatcgaaatagttggtnacantggtaacacngnttanacgtaaattctaagttcnccanagtttcagananccttaagtcgcagtggcgaaaccttaccgaanaaacggtccaaaattcaaaatggggnccntcaaanttnggngagaaatnng

SEQ ID NO: 83264 - DNA, 449 bp, Triticum aestivum
  unsure (1)..(449): unsure at all n locations
  Clone ID: PAT_TA_83264
ggcgcggcaagggcggcaagggtctgggcaagggcggcgccaagcgccaccgcaaggtcctgcgcgacaacatccagggcatcaccaagccggcgatccggaggctggctaggaggggcggcgtcaagcgcatctccgggctcatctacgaggagacccgcggtgtgctcaagatctttctgggagaacgtcatccgtgacgccgtcacctacaccgagcacgcccgccgcaagaccgtcaccgccatggattcgtctaccgctcaaaccgacaaggcgcacctctacgcttccngcggtanncccttcctcatctggtggcgaatgcatcttnttcngcggtgggcctgtttgtgtgcctatccagtgttatccttctcnatacntcctgtttcntggttcttgtacccattcccncaatacaactnccattatcatggaaaaaaaaa

SEQ ID NO: 83265 - DNA, 622 bp, Triticum aestivum
  unsure (1)..(622): unsure at all n locations
  Clone ID: PAT_TA_83265
gaaccagtgggggcacgcagagtgcacccactgggtgtagtccccgagactgcggtcgacttcttggtagtcgactggggtttgagaatctctcctttttttactcgtactgggcagaccataccgagtgtaaaaccagaccagtgggggcacgccaagtgcacccactaggtgtagtccccgagactattgttgaatgtttgattcagcagtagtcttagaacaattttcgttgtgattgacttttgtttttgtcgactaacatatcttatttgctgactgcagaagtcttgtgaccttggagcccaactttctgagctgaataagaagcagatcagcctcggccttgatctgggatttgggcgaagaagaacctcaagaaggccaaggacaaaacagctatcatgggaggtaaccactcgtccacatcaacttatgattcctgtcncttttcgtcccttgaaccgagtgattcactcgaacagtgtcgtagtgaaaattgtaacttaagctctcgaagatgtattctagacaaantaacaactcggaaaaaaggtagatntgcgcgncaaagnggncagataaatacantcgcaaaanttggtcatncanttgaaaaaat

SEQ ID NO: 83266 - DNA, 712 bp, Triticum aestivum
  unsure (1)..(712): unsure at all n locations
  Clone ID: PAT_TA_83266
cgacgacggtgacggtgaggtggagagcggagtggcggatcgtggctccgatccacaagggacggctccacacatcgggttcctgcctctgctcagcagccatgccggtgaggcggcggcagccgcgtcggccggagacgggtgcggcggagaggtacagggagatggggatcggggctgcgctgtcgcggccctgggactatcccacggcctgcggcgagcttgcagcgctgctgcgcctcggatacgcggacctccctaaggcagcccaggcgctcgttgcctccgacgtgctactcgcgtttcgcctccttcccgatgtgcagacaggatatgcagtaagcacagctaatgttcttctccaagcagtagaagttgctctacaaaacaaaagaaggccangctgttcaaaattcaagcactctattattgcacataaaaggcgtcaagaatcaacaaattcaggtcacacacatacacaagatatactgtcatanctcagttctgacatcatcttgtacaaaagtctgtcgctaaggnctgaatnacgnaatganacaaaggggaaatnattaccattttttgcaacattgttcaaaatccnncngggaaaaacaatntgcnatttcaatttgggaggcctcaaattnaanccnagantttnanacaangccttattntttgnnaccaantttcaaatccaaaacaataa

SEQ ID NO: 83267 - DNA, 407 bp, Triticum aestivum
  Clone ID: PAT_TA_83267
ccgaccgggaggcgtgggagaagtgggccgcggcgtacccggccagccgcgtgttcgtcggcgtcgtggcgtcgcccgaggcggacaaggacgcgtacatgttccagaaggacctctactacaacgtgctgcagttcgcccagaaggcgcccaactacggtggcctcatgatctgggataggtactacgacaagatgaaccactacatcagcagcagctaataattaagcttcccatccacatccatccacatccacccggtttatcacctaatatataatagtattattgtatttttcttcttaactttataatacactgtaatgtaataatgtgatgatctgatgatccaccaacggaataaaatggtcagcttccagccggtgggccgcgccaaaaaaaaaaaa

SEQ ID NO: 83268 - DNA, 392 bp, Triticum aestivum
  Clone ID: PAT_TA_83268
taggcccctgcaaatagcggccgctcactctgtgtgggtgggtggggtgaacaggtggtgcgtggtaaaagcgaagtagagagaaacaagcgacttgaagaggcctgggttcgttcgtgtacatacgatcgagaaatcgtttcaggtcattcattcatccattcattcatccatgggcacatactgtggtattacggagtattacggtgtacgtgtagtgtgccgcaggagagacgacgcgacggcagcagtgcgttttccatatgcgacgggacgggagcattcgaggagatgatggcaatggcatggttttgtgtactgtacggtaacatttgtcgctgggaattaataataaaaaacccgtggctggctgatgcagcaaaaaaaaaaaa

SEQ ID NO: 83269 - DNA, 700 bp, Triticum aestivum
  unsure (1)..(700): unsure at all n locations
  Clone ID: PAT_TA_83269
agcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcccggaacccctatttgttaatttccaaatacatcaaatagtnancgccaagaaanataacctgaaaanctcatatatgaaaggaaagtnganatcanattcgtgcccctatccttttgcgatttgctccgtttgccacaaaaccngnaaataanatcganatattgggacatggtancaaggttaaacgnaatctaatttccaaaatttaagngnccttatncaatgcngaaccttncggaaaatggcnaaaatcaanatnttccaca

SEQ ID NO: 83270 - DNA, 434 bp, Triticum aestivum
  unsure (1)..(434): unsure at all n locations
  Clone ID: PAT_TA_83270
gccatcttcgacaagaagatcgacgcgcttttcatcaacaacaaccacttcgagttcacgctgccggccagcttcaccaactcgacggcgtcggtgatcgtgctggcgaaccttccgcgggtgagcggctgcctgccgagcagcatcggcgacatggccggcacgctcaacgagctcatcctcctcaacagcggcatctcctcctgcatcccgccggagatcggcaagctggacaagctcaccgtgctcgacctcagcttcaacagcatcgccggcgcgctgccgggacacgatcggcggcatgcgggcgctgggagcagctggacgtcgcgcacaaccggctcaacggcgagattcccgaagagcatctgcnactgccgcacctcaagaactcacctactcgtacaacttcttctgcggngaacaagccggtg

SEQ ID NO: 83271 - DNA, 649 bp, Triticum aestivum
  unsure (1)..(649): unsure at all n locations
  Clone ID: PAT_TA_83271
tcgcgactcgcgacgcctccgcagccccagccccagccccacgccccgcgatccaaaccctagccccctccaccgtaccgccaccgtcatggccgaaccatccgccgccgccgtcaccgcagctgaggtcggggaggagtccgatgccgccgcgatggaggaggtcgcggcggccgcgaagaggtggccggggtggcccggggacagcgtgttccggctggtggtgccagtgctcaaggtcggaagcataatcgggcggaagggcgagctcatcaagcgccttgtcgaggggaccaaggccagatccgcatcctcganggcccgtcngcgccaccgagcgtacgttttgggttctggaaaagaagntcaangcttggagctatctcaaccatggatgctctcatgagatttttaagcgttcaatggggataacagtggactgcngaggnantcagctgctgctaccctggtgtattgctgccgatgttggttctggagctaaggaattaactaattggaacaagtgcacataaacatcaaganacacggtgtcataggtatatanaatacatagagacattagtactacataaggaattaatcagcatcanaaatttaacatnacgnttaacactcgatttggtcaaag

SEQ ID NO: 83272 - DNA, 553 bp, Triticum aestivum
  unsure (1)..(553): unsure at all n locations
  Clone ID: PAT_TA_83272
ggtttcagcttgtattcccactctgtcgcacagcgtcgcccgtcgccgctgagatcctaggaagaaatggagctctctcgcaagctcttcacggccgtcctcctcgtcatgctgctgctgctgtccgcagaggtcgggccggtggcggtggcggaggcgcggacgtgccagtcgcagagccacaggttccggggcccctgcctccgccggtccaactgcgccaacgtctgcaggaccgaggggttccccggcggcaggtgccgcggcttccgccgccgctgcttctgcaccacgcactgccactgatccgctccgcccaacggccggctggcgtcgccgtcgattgcgtcgcgacaatccatggctccatgcatgaataacaagggtgtgcgccgtttgtgttgtgatgccaaatgtatcctcgtcgtgtgttgaacaacggctgctttgtacgtactcgcctctgttcatgttncggatttcatacaaatcatgcgtcatcagatcactccaaagaattcatagactcnataanttcattaaaaaaaaaaaa

SEQ ID NO: 83273 - DNA, 715 bp, Triticum aestivum
  unsure (1)..(715): unsure at all n locations
  Clone ID: PAT_TA_83273
tgacggtacagtggagacggagccggaacgaaccgccgcccagccgaaacacggtggcgatgtcgctcagagtcagagatattctccggcgagggaacagtgcagcagtccgaaaccagtggaggttcagaaggggatctcatcgacctccaaatccaatgagccgccttgtgtgagtgcggcggcagattcaccagctgagacggcctcaaggtgggcctcaatgaagacgggtttccagaacctcaagagcgaccatgggcggctccaaggaattcctcctattgggctgtctcctaagggccgggacgaacgatccgctacggaatcactccgacgaattctcccggaaacttaagcggcattcgaacaacgccgatgcgancnactagacgacgacgacggttacttttgaccaacgtagggcaagggaacaacacagacnacgcaacatgttgagacggcaaagtctcntccttncttgngtactccacaatcaatctangtacaacaagaaactaaggtggaaggataaggtaactgatggaaggatagncaggtcagacataaattttcgnagtcaggtaggaaactgcaaataggaaacctaaattnattcttaacccaaacacgnggggcaatttttggccgtncctacgtgtttttaaaaaaaaacnccggggcgncaattccaaaggtttcccccggctttaat

SEQ ID NO: 83274 - DNA, 664 bp, Triticum aestivum
  unsure (1)..(664): unsure at all n locations
  Clone ID: PAT_TA_83274
gtttgattatcttgtgttcttgctctagagagagagtgtagtgtttttctgggttacgaatgagtccaaccgaaccgaaccccctctacgttgcgcatgggcctccttttatacgctaaaggggtcaccgataggtggcaacgcagagaagggtacaaatgtaaaaagtggggtggttggtacagttacttgtacagtgcaccctacctaaccctgacggcaggggacaagggcattaaatgcccgtctgggtcgcccaaacagtgcagaaaaggactgttaggggcgccaccgtttgccacaatggcgatcttgtcagcttcncatgccactgtgcaccgctggctgcacagcctcccgccacgcgcgcctggagaagccccaangcgacacttggtggatgcctggacntnggcacaaagtggcccctgccacggtaacgccttgccgctgttgtanctgtcggtccggaactgtcctaacgggcctcaagggggccgtaccaantcgcctanntgagtctataccgcgctantggcgtcgttaaagtctactggaaacctgcttaccactaacncttagaaacccttccactggtanacaaaggccaacattccttcaattccactatgaangacccctcggataccgngtttgngtacca

SEQ ID NO: 83275 - DNA, 636 bp, Triticum aestivum
  unsure (1)..(636): unsure at all n locations
  Clone ID: PAT_TA_83275
gtttctttcttcgagagagggcaaaaaccggcaaggggagcgaagcggagagtctcgagagcaagggagcgcggtgacgtcatcgttttccaaggtttctcgatcggctgctatggcgaccagggcggcgtcgagattcctgcagcgcaggctcctgtcttccggcggcaaggtcctcagcgaggaggagaaggccgcggagaaagtgtacatcaagaaaatggaacaagagaagctggagaagctcgcacgcaagggccccagctcangagagcaaccttcgtcgactacagtctctgcagcaagtgatgtgaagactggggctgggccaacagatcagcgtctgcaaacgtgtctaccgacaaagaacangaactacgctgtcctggcaagcacaattgctgctctgaatggctggttggatcattgtcaaagctaagaatccgaggaagtntggactgaanaaggggtacaaagcaactgtggatggtggnctaaattcacaagggtacttcgcgcanacntcggaaaaatgtgaantacctgantcgnatactgtcgaggctgttnanacganattaatcgtcccanagtcctattccccncctaagttcaagttatgacctgccactctcg

SEQ ID NO: 83276 - DNA, 241 bp, Triticum aestivum
  Clone ID: PAT_TA_83276
tgaatgatggcgtcgtctccagctgaacgttaatgtttctgatgtttcggaagtgctgccagtttttgcttgaatactaccctatctagagtgtaatgactttgtttacttggtttgttggagttttagctgctcctattactaggggttggttttgtcttgactttgttattttggttgcatggataatcgtttcgtttggatctattgtccgattgttactcgaattaaaaaaaaaaaa

SEQ ID NO: 83277 - DNA, 386 bp, Triticum aestivum
  unsure (1)..(386): unsure at all n locations
  Clone ID: PAT_TA_83277
ggccaacgcgaggctgcaggtgctcacgttgtgcctccaggctacgaagaacgttaacctcatgctgctccggacacgggtgatggccatctcttgcgctctgggagtgtctgtcgcgtcagttgctgcggtgtttattagatgattttaagttcagacctctgccggaaggatacttagttttcaagtatcaaaaggaataaaaatgcactgctaataggcaagtagacttcgaactaaagatattttggtgcttttgggatgttgggattatgcttagttttggtgattgtacacgggagaggggagattaaaatatgattgttcngagacatttctattacaatgatattaatcctcaacttggtagaaaaaaaaaggggggg

SEQ ID NO: 83278 - DNA, 689 bp, Triticum aestivum
  unsure (1)..(689): unsure at all n locations
  Clone ID: PAT_TA_83278
atattgttggaacgcctgctgcattgttgttgcaaaaagcaaatgcaactgtcagcattgttcattcacaaaccaagaaccctgagcaaataacgagacaggcagatatagtcatcgcagctgttggagtcgccaacttggtcagaggggattggataaagcctggagctactattattgatgttggcatcaatccagttgatgacccaagagagcccccgcgggtacaggctcgtcggggacgtctgctacgangaacctccaaggtcgccgggagccatcacgccgggtcccaaagcggcgtcnggccgatgacgatngcgatgcttctgtcnaaacacctcnaatccgctaagacggttcaacggatcaaattaccgccgcaccaacgttcgttcaacaanagagaaccnaaggctttggccctgccaaccaacccagactaatgcaaggncctnaggaaaaataaataataattaataaattgaccanatganatggaatccaactgacacttgtagggaatgtgctntaaaattgnacagtaatcnagngcagtaanctggtaatttgcgaccatcncggttaanaattntncancatgtagggaccggtttatacgtgntacgggnccttcntgaaaccgtttcatgtcnttaaaggggngtggcccttttttttgaaacccn

SEQ ID NO: 83279 - DNA, 501 bp, Triticum aestivum
  unsure (1)..(501): unsure at all n locations
  Clone ID: PAT_TA_83279
gtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttgggaaacctgcacttcagtaggcatctatccgtggttccaactatatccagattttgtgctaagacaaacatcatcnttttgtgaactaataatatggactttaattgctgctaatatcgacctactgttaattatgcaacttcgtcnaagctgtgctgtttgtgatactgttaattaatttcaagagaaacaacggcaacatcnaacttgctgaagacaacgattgggtgctc

SEQ ID NO: 83280 - DNA, 697 bp, Triticum aestivum
  unsure (1)..(697): unsure at all n locations
  Clone ID: PAT_TA_83280
ctcccacggtcccacctcgcctctcgcgctcctgcccacccagcctgtccgccgtctggtgtccgcctgttccccaaaagcaaagagaggcgcagagccgccgccgttgatctctgacctttccgatccagagcctagctctcaccgtctaccggagctctcaccatggcggtgagctcgcggtttccctcccaacccgcggcgcgtggcctcctgcgccgcaccccgcagcgcatcctccccgtcgagcgcacgccgcgccgcctcgccctggtcgtcaccgccgtctctgggggacctgtacctggcggattgcccgttcccaagcgggcgccaacgccggaggacgccgcgaccgtggcaccgactcaatgccgttgtcggcgcctcggcatcgattcctaacctgtgtaacgctcaagacacaaaaggaaaggnggataaacatacataaggcctgatcatgtgataattaccaatggcctgatgntcgatgcngtgattgctgctgtggtgaaaagngtcaaaattgtatgtgatacatgaaaactatgttggaattaccacgtgatactaggtaaaaaccgggcaaaacanataatnaattgccatttntggggggaacgcgtaataaanttggaaattnaaatttntttgacccctnaaatttaaggaanntcccgggataaaaagnatg

SEQ ID NO: 83281 - DNA, 701 bp, Triticum aestivum
  unsure (1)..(701): unsure at all n locations
  Clone ID: PAT_TA_83281
gttatactggagacccttttcttcaggaagaaatttagtcggaacatcaagctttcccttagtgtgctccttcttggtgttggtgttgcaactataactgatctgcaactcaaccttgtgggatctgtattgtccctactggcaatcatcacaacctgcattgctcagatcatgacaaatacaatacagaagaagttcaaggtatcttcgacacagctcctgtaccaatcgtgcccataccaagcattgactttgttcctccgtcggccattccttggatgggtttttgactaaccaaaacgtctttgctttcgactacacaactcaatcctgttcctcatcgtgctgtcgtgcctgatctcggctcggtaaactcaacacttccntggtgatcgggaagactcgcctgtaactacaattctcggcactgaaaagtgctggnccccccntcngntactccgcccacaacgtttactggagaaaatactggaanctgatgcgggatcggaaggnctgtacnctacttcgacagaaaaccacaaaaccggaaangctcccgaagcatctgagcaaggngggaaccaaccncgattgttccgacncncaaangggatncncgnaaaaccctagggcaagtgcccataccagggtaaggtttnacggnaaggtaaaatcctgngaanaaangggggacctcctng

SEQ ID NO: 83282 - DNA, 189 bp, Triticum aestivum
  Clone ID: PAT_TA_83282
cttgcccgaggaacctattgagcaccgttaagtgaaacattctgtgctgtgatactataacatatctcgttgagcccgagttttggaatcatctgcatgttcgaacggcgtccaggttgggagtatatgatttagtcgaatagtttatcatattgaaattcagatccaatggctaagaaaaaaaaaaaa

SEQ ID NO: 83283 - DNA, 702 bp, Triticum aestivum
  unsure (1)..(702): unsure at all n locations
  Clone ID: PAT_TA_83283
gacaacttgagggttgatcgcggtgtcgacatctgcttatctcagtcactctaaacgaactacctcacaaaatggcttcaacagaacaatccatggatctccctgtgattgacctcgatgtctacctaaacaaccctctagactcagaggccgttcaagaagagtgcaggaaagcagccaacgccctcatcacatacggtgctctcgtcctccacgacagccgagtctcagaggaggataactcaactttcctccgacattctcgaagattactttgctcaacccgaagaggtctcaagaaaagatgagaaaccccgagctgactatcaaatcggtgtcacattaagagaataccgaaaacccaagtgtgctgttgatgaccatgcctcnatgtcatcaagagacccgttcntcacaaaagacgttgggtattcagccantcaccgatccaaagtgcaaatctctggagaatgancgancaaccgcctttgagaccanttcctgggtnaacgcccgaagtggncctgaanccctcatatanggancgtggagccatcataacatggggactcataaanncgtnccaattggaaaatacncgtggcaaacnnaagcaatttaatggggaaaggnccaaattttccaattaacggaatggaaaaanctggggttaaaattnatccaagngnccacggntaagng

SEQ ID NO: 83284 - DNA, 683 bp, Triticum aestivum
  unsure (1)..(683): unsure at all n locations
  Clone ID: PAT_TA_83284
gtcttcttgtctccctcgacattgcccgtctgcttccttgcgccttgcttgtgctgtgggctcccttgtctcgcctcttttccagccgtggccaattgtgtccattgctgggtttgccaccaccttcccgtgtcaaggcaaacccctccatttcgagcacgttccaaacccaaacttcacattgccttcttttgagagctacgtaaggttccaaatttgaaactgacaggtcctagccgtgctgttctgctggtggatcctgtgactattgaggctgacctgaaagttaaaggccgtactgaatctgaggataaacacttgagctttctancagtgccaatcttggtcatgatcccgctcgagtcatgcctgcgtacaaagagattcacagcaagcttancacctgaggttgctctcgcaatgttgttctctcagtggaggtacaatantgtgcaattcgtggtgggtaaggctgaaggcctcgtgccaattgctgccacacgtgataaagtctgaaggaattgcctgctngatctgggacanaacgcgttcgaagaangacacaactgcgcantnacgtnatattggactaacttcgtaggatgaagnggganctannaaaanggttaacaaagagttggtaganctagtggtngaagatncggcgcttttccagaaaaatt

SEQ ID NO: 83285 - DNA, 499 bp, Triticum aestivum
  unsure (1)..(499): unsure at all n locations
  Clone ID: PAT_TA_83285
cagcaccagtccccaattatttggcctccgtcagagaggggagaaagacccgttcgaggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaactcatacgcgacgccgtcacctacaccgagcacgcgcgccgcaagaccgtcaccgccatggatgtcgtctacgcgctcaaacgccaagggccgcacctctacgcttcggaggtagggcctcttcgtactggggaatgctaaggtgatactctcttcctgtggtctatgttctgcgtcctggattatcaatttttttcncaatgaaaaatctgnaaacatatactgcaaaaaaaaaaaa

SEQ ID NO: 83286 - DNA, 518 bp, Triticum aestivum
  unsure (1)..(518): unsure at all n locations
  Clone ID: PAT_TA_83286
ccccagaccgtgctcgcgcccatgccgctggacgtccccgccgccaccggcatctgggcgtcgcccatgcctgcagcaagtgacgtcggtggcgtggcgctggaagacgcgttcctcgccgacctcggcgcctacggcgacctgctgctcggcggcttcggcggacagctgctgcaggacaacaaggccaccgccgccatggagctccccggggcgtgctacttccccaacatggccgagatgtgggccgccgaccacgcccacgtccacgccaagccgccgcagggctctgcaacacgttcacataggatccacgaaatgatttgctccattgggttcgtcagcacgcacgtaaccgagactttctccccgattgtgtatgagagatcgnnaatcacatgtgaatattatactagaatagatagaaagtgtaccatgtagtgtggattacatatattacttcctataattaactgagttggattatatatcgcgcaaaatttactaaaaaaaaaaaa

SEQ ID NO: 83287 - DNA, 480 bp, Triticum aestivum
  unsure (1)..(480): unsure at all n locations
  Clone ID: PAT_TA_83287
ctagcagtgatgtgcttgaagactcaaagactttggcagatcaaaaggtggataacgattccattgttgcattggcactaagaaaagatgacggtgagtttgaggaagttttcatcgctaggccggaggatttcatgtcatcatcatgataaagattagtccatcatttctacaaagggaccactgcgcgttcttggagtggaccgtcgctctatgctggttcttctagaatctgggatgtggcttgcttgtccctttgggaggaaaaagaaaacttttatgtgagatcccaaacaaccgttgtggatgatattaactttggatttgacctccaactggatccgtgcttcntgtacctacnggtgtcttctggtgttgggatnaagagcgcactaatgtccttttttgtacaacgttgtatgtgaaccatctgtgcctcatcactaatgcacccctgttgctgctggcaaaaaaaaaaaa

SEQ ID NO: 83288 - DNA, 698 bp, Triticum aestivum
  unsure (1)..(698): unsure at all n locations
  Clone ID: PAT_TA_83288
gttttttttttttttttttactggaatctgaataagcgcttttgattggctgattcaattgaattattactctccaaaaaaaagtaaggccccgtttggatccttaaataattcagctcgaatcgaccgtgcatgacccgtgctgttgaatcacagagcaaggtccagtacaaatgtacagttgatcggaagagcaagtatgagacgcggtgccgggccactatccaatgtacgggttggttaccagagacatggaaacccagaagattaactcatgcagttgcaatacgtgaaaacccattttctcattgacatacagcaagatattcgactccctaaatattgccatacaggtagaaatgcatctgcaacatttttcgagtgccttcaagcttcagcatcaacttctgatgcaactcactctagtccaaacaataaacattgcatcctcgcttaataattaagaaaangatgatctttcgtcagcaacagaacattaaaacgggcaccactctactganatgattgatcaaacttcagacacctggcgtataacagtaaaatgatggcagaaatatgnccttaacatctagaatanagtaaattagccanaaacacnctnttgngcanttctacaggggactcaccctcaanncaaaagcagttcctagtattaccgtaacacgaaacctacccnn

SEQ ID NO: 83289 - DNA, 641 bp, Triticum aestivum
  unsure (1)..(641): unsure at all n locations
  Clone ID: PAT_TA_83289
caagagcgctcccctaccctttttcccctcctcgcagtcgcagcagcagcgcacaccagaaaagcttttctgcctcctctccaccttgcttcccgcaactaccacgcacgccgaatacttggcaagaagaaaccctttctcgtcccgttgaactggcgccgtcgactccaccggggcacgctgtcgcgggttgctctccggtcctcgttctccttgctgctgaatccgctagtggagatcgacctgatttctcctgtcctgtcaattgggattttaacccggttttcaaggtagagaaagaactgtctgggtcatcatggccttcccaactccagcttctgtttttgttgacgagaaccaacagataaatagangtaagaaggtgctgggttaaaggacaaaagggctgaaccgtcggagaacctgggaacctagagaggaagtcttaaggtttnccaacttgccaaaaggacaggttgaaggnactcacctgaaagaagnccanccaaggnttagtaagtgacaacacnttaaggacgcttaaganaggcatacaagagaatcaccaaacagggcnagaccagtaaatatancgtaaatacaacgttatattgcaagatgggtgaggttaccanaatatn

SEQ ID NO: 83290 - DNA, 420 bp, Triticum aestivum
  unsure (1)..(420): unsure at all n locations
  Clone ID: PAT_TA_83290
cgagttttttttttttttttttttttgcatcaagagtaacaaattgcattacaagctcgatttccaacatccgatgcacacataatttcatcactgcttcatgattcaggtaaacctgctagcctcgcgattcagataaacctactagtctcacgattcagataaacctaccacagccagagatgaactaacaagagttcctgaaactttcttgaccgcaagacttgtgggcacggccagaaaacgtcgcatctgcagaaggggagaacatcgcgaggagcccatcagcctagccgccgaaccgtagagggtgcggcctgggcgcttgagcgcgtagacgacgtccatggcggtgacggtcttgcggcgggcgtgctcagtgtangtgacggcgtcgcggatgacttctccnaggggggg

SEQ ID NO: 83291 - DNA, 662 bp, Triticum aestivum
  unsure (1)..(662): unsure at all n locations
  Clone ID: PAT_TA_83291
cctcgccccaccagcacaaggttcctttcatacgaagaactgaaagtggcaacaaataacttcgagccttcaagtgtgcttggagaaggtggttttggccgtgtcttcaagggggtactgggtgatggcactgctgtcgctataaagaagcttactaacggagggcaccaaggagataaggagtttttagttgaagtggaaatgctgagcaggttgcaccaccggaatcttgtgaaactgattggttattacagcagccgtgaatcatcacagaaccttctttgttatgagcttgttcccaatggaagcctagaggcttggcttcatggtacacaaggtgctagccgccccttggactgggacgccaggatgaggatagcacttgatgctgccaggggattacatacctccatgaggatcgcaaccttgcgtaatccacagggatttcaaagcatctaatatattgcntgagaatgattccatgctaaagtgtccgatttggtctggnaaaaagcccggaagtccgacaactatcttcaccgtgtaatggaacttcgggtatgtncacggagtacncatacagacactgctgtaaagtgagtaaaactatgantgttcactgacacaactggagagccttnattaagcctcggaagaaacag

SEQ ID NO: 83292 - DNA, 372 bp, Triticum aestivum
  unsure (1)..(372): unsure at all n locations
  Clone ID: PAT_TA_83292
aacagaacaggctaggaaagatttagagcgtcttactataatccgtcaacaaagggcagaagctacaaagaagcgagaggaggaaaaggctgccaaagaagagaggaaggctaataaagctctcaagtgacctgcacacgatagcgttttgggagatgtgtagctagtagtggtggtgacgactcatcgatgagcgatggcaagttggcaactgtcagctttgtgcgcggtgtagtagccggagcagtagcaactttgttgaaaaatacattcatgctgtggcgtttttcctattcaatccgtaggtccttatactgctacagtgtaaatccatcattgcaatataatcaaggttttccnaaaaaaaaaaaa

SEQ ID NO: 83293 - DNA, 639 bp, Triticum aestivum
  unsure (1)..(639): unsure at all n locations
  Clone ID: PAT_TA_83293
gttcagaaatcatatggcaatgcagacttcgataacattccttttggagaggacatgtatagtcgagtccgtggccggccacttctgattgatacatctgcaaggatcagtgatgacaaacccaggcctcgacctgtatcatcacgtgaggagcagaaagtcaagacaaatggctcggtagatattaagtccagttcccctgaaaatgctagttcaagcaactctgaaaagcaggaaccgaaaaaaatgggtgcctgaagatactccggggtgaaagaacattaagggtgataatgtgatgccagtaacaccatctttagntctgctacgtcaacttccaaaggctgggtaaagggaagacacgggaaccagacccactgagcggcaaggagatgggcaatctcggtggctaatccaaagaaagatctagacaattttggaagataacatgtctgggcgtagccctgagggtcaagaggcacgcctantgaagaaggaatcccatcatcacaactganacgagtgacacgaaaagnggttcacacgaagntaagtaggcaagccaaacntgngncaaaaaagccttcaagaacccaaggcaccnttnacgtccctggaatttccaccacnttttgcctg

SEQ ID NO: 83294 - DNA, 552 bp, Triticum aestivum
  unsure (1)..(552): unsure at all n locations
  Clone ID: PAT_TA_83294
cggacggaaggaagacgagaaggccccgaggcgagcgggggatcaaagaagaagatgaaggtccgtgcggcggtgaagcgcctgtgccggttctgcaaggtggtgaagcgccggggaatcgtcttcgtccaatgcacggccaatgccaagcacaagcagcgccagggcttctccaccatcgccgaagcagccgccgtctcgtgcgttcacctgcctccgccgccgcccgctagcggttccgcctccgccgcagcgttcgcagagactcgaaggtggcgaggcaagaatgtctatgaattcaattggcggctggnttaactgccctgttcaagaatggagaaaaataatatacaagccttctaccatacgctgacatttttaagcagatgttgaataaggcattggtacgatgatatcaagagaacatgtacaaaaactgggaaactgcacatcattattcagtggataatatgacanatatgtacttcctaaaatgtcgatctgantgttaaatgtatacacttcacaagctgttgtgctaaaaaaaaaaaa

SEQ ID NO: 83295 - DNA, 297 bp, Triticum aestivum
  Clone ID: PAT_TA_83295
ggctatcttctcctgtgaggtacagtaatgcatcttagtgtatcagttgttgtttgtttcattatatgtaatagacacctgaacttgattccaatcgtcttgtctgccatgctatattatcctcctttctcaaggtagatgcatattgtattacactattagttaattttactagtatcgtgaacctgtcactgtgtaaggacttgggagtactcagtagatgtcatttttccgaatattgtatatgtccaccctctgtgatttgtggttcagtttattcgatatggttatttgcct

SEQ ID NO: 83296 - DNA, 590 bp, Triticum aestivum
  unsure (1)..(590): unsure at all n locations
  Clone ID: PAT_TA_83296
ccctccctctcctcctgctctaccccgcccttctctctctcctctcttctgtcctctttctctcgtgtcctagtaaagaaaagacagtttgattgcacagctagcccaccgctcatatcatccgcctcccctcgccccccctctctctctctctctcactcacaaacaaacaaacaaacaagcctggatcgagcgaattcagccgagcttcagaaacccttgcaagctcgtagcaacttctctcaaccttattcggctttcttctagctatataacgaccctaaattagtctgcttcattcggttcttgcgaattgccaagaccgaaagaacagcttattactcttctgttaagaaagactcgaagaggccggccgagatagactatcagctagctagagggagctaactactactagctagcatgtgtgactacttcctgcaaaggatggntaagggcgacacacaacaacacaagccggagactcacggagtctcgaacggggggcatgatnagaactgtcgcgggntcctcgnggnagggtggagtccggcancanaangggaagctntccgcatcagcctcgctcg

SEQ ID NO: 83297 - DNA, 260 bp, Triticum aestivum
  Clone ID: PAT_TA_83297
agcaaattgacaccttctccgttcccgacgactcccgtgagcgtggagaggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatcctt

SEQ ID NO: 83298 - DNA, 598 bp, Triticum aestivum
  unsure (1)..(598): unsure at all n locations
  Clone ID: PAT_TA_83298
tttcaagcttctttctggtgcgacatttgtaggggcaatattctgctttggtgctttttgtttcaagagcctttatgggttcataccctcctttgcagttggggagctttcagttttcgcaactcaggcacctgtaaattttgtatgccttcacgccgtgaagccacatttgcggccattggcaatggccgtatccactgtttcgatccatatatttgngtgatgtcccttcttcacctcttgttgggctgcttcaggacaaaatcaataactgggagggagacagctcttatattgacatccatccttttcgctgcagttgtgttctggttcattgggcatatttgtccccagcgtcgaccgtttcancgaaagagagcgaatatggcttactgccgctgagagtcaagtatcangccactgcttgggtgaaaacgaccacggacatctgactaaaactgcgcaatcataacaattattacttggaaggcaattaggaatgttgtttcctctanatatagactggntaagtgaaatagcaaatagcccattggtactattagttcagcantgaactaggacaggtaanacacttgag

SEQ ID NO: 83299 - DNA, 617 bp, Triticum aestivum
  unsure (1)..(617): unsure at all n locations
  Clone ID: PAT_TA_83299
tcgccacgagccgccgccgctcccgctccgccccagcgcatcgcccgccgccacagcgtaccgcgacctcatctatcaccttcagctttcaatcatggcggacgtcgatgtcgaaccggaggttgccgccggagctcccaagaagaggacgttccgcaagtacagctaccgcggcgtcgacctagatgcgcttctcgacatgtccactgacgacctcgtccagctcttccccgcgcgcgccaggagaaggtccagaggggtctgaagaggaanccatgggcgctcatcaaagaaactgcgcaaggcgaaaaaggatgtcctgctggtgagaanctgaccatcaaagacacactccgtaacatgatcattgtccctggagatgattgggaacatgttggtgtctacaacggcaagacttcaaacaagttgagttaaacctgagatgatcggcactacctgctgagttcccaatctcctacaaancggtcaacacgcaggccggtatcggtgcaacaatctcgcggttantctcgaatgagctggacncgntcttatatccagaaantttgggtgtcattcactcagantcaantaacattnaaattaaaaaaaaaaaa

SEQ ID NO: 83300 - DNA, 683 bp, Triticum aestivum
  unsure (1)..(683): unsure at all n locations
  Clone ID: PAT_TA_83300
ccgctgctccggcgtctgctcctcctggcggccctcgcggcctcctgctcctactacctcctcttcctgcaggcgcaggcctccgtcccgccgcggtacgacgggttcgcctacggcggcggcgccgcgacggcctggaaggacgccgtccttgtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcgctttacatagctaacaattgaattcatcatcgacatatccattgctggagctgttcttcaaagaacaaggaaaattctacaattctgcacatcatctctctcggggccctcccgtactctaagaatgtcaaagatgctgccaaactgttggtaataataccgaattctgtcnggctnaacnatnggaaaaaaactcggaacaaagttcttagttacggtcacanggantcttgngcncgttctcttgtaatggttcncanctggggggttncacacaagncntgttgatctgnccctgttcaaagtanngttaanttactcantannttatgcntcacgganggctnaantccancagggaanaaantttcattaag

SEQ ID NO: 83301 - DNA, 714 bp, Triticum aestivum
  unsure (1)..(714): unsure at all n locations
  Clone ID: PAT_TA_83301
gactcgacccgttgatgacgccgtcgcggccgtgttgactttgacgataacatccgacgacgacgatcacgacgacgacgaaaaggacatagcgcgccgtgagcacaaaccaagatccaacagatcaagggcatcattcaatctggagcaatttaccctgagtcggatcaaaataatattcttatctcgacctccaactagaacgcgcttctcacttaatcatactcttcaccatcaccgccatatagccgaataatagcaagcatggttgacttcaagagtgaaaccgtcaccaagtgtcngaaaagnccacgatgccactgaaaagatgggcgacatgcttgaccaagccgagctggcaagatcccggcacaaanggcacaacccttctcngcngtattcgtacacttngaccggtggtatgaagaatgctggtactaagggtatctggcggctaataaggacttgaagnaatctctgcgcacaagatctcacgctggtaccctgctggacaaggactctcctcatgntccaagnacgacaacacggaatactcacgctcngttcaatgccgatanggncccanatgccccagtattcccacngngcccaaggtttaggcgacaccngccanatttgaatntgagaccatacgccacaaaagtaacctgaggncaacngggcccaaaggtgnnctaggngtttgggnggccg

SEQ ID NO: 83302 - DNA, 267 bp, Triticum aestivum
  Clone ID: PAT_TA_83302
gtcgttgaagatgcaaggttacctacttgtacgacgtacgccaatgcgacctgtgtagctgtgagtagtctaatgttgcagtgacatgtaatggcgcacccccgtcctactaacagatgcttactggagattgccatagctgatcttgtaatttgttatagggcagtatgaatatatttatggtagcttgaatctatttgtggattcacttcgtttttccatgtttccttgtctccagacctggacttggactgctattgatttttg

SEQ ID NO: 83303 - DNA, 704 bp, Triticum aestivum
  unsure (1)..(704): unsure at all n locations
  Clone ID: PAT_TA_83303
ctgagcccatccggaaccctagcctcctcgtcgttgaatccaccacaccatgagcgggagcgcctccaggaagctcttccaggccgccaggtccatcgtcctctccgcttctcaacgctcctccttctccgtcctcgccgccgagggccgcaccgccgcgctcgccaactttggcaggaagatcctccccagcgcctgctcctaccacaggcagggatcccacgccgcgtcgggatggggagcatcgctgccgcatccccgccgcatttacatgctccaaggaccaaggaggtcatgctgcagagatggagcgcactttcatcgccatcaacccgacggcgtccaaagaggctgattctgagattgtgaaccgattcnaagagaaaagntacaacttgttgccatcaactgattgtccatccaaaggatcgctgagaacatacatgattcaaggaaaggcttctnaaanggttgtgtgactctaactctggcctgtactgcatggttggaaggaaggtgtntagttggagaaataattgtgcaagaccaagaatctaacagaacataggggatntgggtgtgtgaaaaaatattnngattatgccgaanaaagggtaantccttngttacagacngccctacacagcgaatgntagggatacannaaccctngngntttcttattnatcaaagngtaaatcccg

SEQ ID NO: 83304 - DNA, 480 bp, Triticum aestivum
  unsure (1)..(480): unsure at all n locations
  Clone ID: PAT_TA_83304
gcgccccgcagcttgcgtcatcccacgtcctcgcgcggtctgcgccttcttcgcggccgcctcatctgcccgcccctctccaccaaggagctcgggcaccggctgccactgcacgatcctgcgccggcgaccgtttgacgccgccgcctcagcagcagcagcagcagcagcgtgctacttcacttggcacgctctccttctgactgggcgctgagggtgcggaagctggatcgtcatcgatggcgaccgtggagtagcaccccaaagctggcgcgcttttcttgccgtcctgccagcgcttctagcttgggttccccatgatcctccgcagcgcactaagggtgggtcgcaacctcccggcgggtcccctgggtcaactcattgtggaacacgtgaccctnncgacacacacggtgtgctactgataccaggatggtgaagaanatccgctgttttgaattggtggggganctcaatcgt

SEQ ID NO: 83305 - DNA, 656 bp, Triticum aestivum
  unsure (1)..(656): unsure at all n locations
  Clone ID: PAT_TA_83305
ccaacatacaccaacctcaataggctcgtttctcaggtcatctcatccctgactgcttccctgaggtttgatggtgctctgaatgttgatgtgaacgagtttcagaccaacctggtgccctacccgaggatccacttcatgctttcctcctatgccccagtgatctcagctgagaaggcttaccatgagcagctctctgtcgctgagatcaccaacagcgccttcgagccttcctccatgatggccaagtgtgacccccgccacggcaagtacatggcctgctgcctcatgtaccgtgggtgatgttgtgcccaaggatgtcaacgctgctgtggccaccatcaagacgaagcgcaccatccagtttgtggactgggtgcccactgggtttcaagtgtgggtatcaactaccagcaaccagcgtctccaagcggcgactcgccaagtcaaaaggccgtgtgcatgattccaactcaacancgttgtcnaggcctctccgcatcgacaaaanttcgactgatgtacctaacgtgctngtcacngtactggtgaggatgaggaggtnattccgaggccgtangatntgcgcctgaaaagnnataaaattgcctattnacaggcaggccgtntanggtatngncaacaatanttcacga

SEQ ID NO: 83306 - DNA, 531 bp, Triticum aestivum
  unsure (1)..(531): unsure at all n locations
  Clone ID: PAT_TA_83306
taacgaacgaactcttgctccgatcacgagctagctgaggtcgacgatggcggctgtgctgaacagcaggaagacgccgcaggcggtggtggccgtgctggtggcggcggcgctgctggcttcgtccgcttcggcggcgatcacctgcgggcaggtggggtcgtcgctggcgccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtcaccgactgcaacaagatagctaagttacgacgacaagctaataagctaccgaactacacgtactccgcgcgctgcacaannatnaaccanggaagaataaataaacnctgtatgcaagacacatcantancatcaaaa

SEQ ID NO: 83307 - DNA, 461 bp, Triticum aestivum
  unsure (1)..(461): unsure at all n locations
  Clone ID: PAT_TA_83307
acttgcactgccctcccagctggtttggtttggtttcgttttggttttggttgggttttcacaggcaccgcgcgcgcgccggngatcgagatggccgactggggccccgtggtggtggcggtggtgctgttcgtgctgctgtcgccgggcctgctgctgcagctgccggccaagggcgggcgcttcgtggagttcggcaacttccagaccancggngcctccatcttcgtccacgccatcatcttcttcgccctcgccgccgtcttcctcatcgccatcggggtgcacatcaccacggactagccgtctangccccatagccgggaccgggatctttcttcgttacagtctgcctgtatatacatatatacatacatgctcagtacgtacgcnttacactctgtcagtgagtantctttgtatancaccntgctgtgtgcgtacctancanngttaaaaca

SEQ ID NO: 83308 - DNA, 619 bp, Triticum aestivum
  unsure (1)..(619): unsure at all n locations
  Clone ID: PAT_TA_83308
taaacgtaaatttttatcgcaaaaggagctaaaaaaacaaaaaattcggacagaacgcgctatcggtttcactttcactcacagctattacacatgcgaaaatgcatacagtaatttttttttggcacgagatttggcggtcggtccccgcgggaagattgctctgctagttccacatccaccaccagctgacctggccggcgtcctcgtcgtcggcgtagtagctgcatccctcgtcgctgccggcgccgtcgtcgtcgtccgactggatgcctccagcgccgtgggttactggacccatcgtcccgcagccgtggtactgggtcctgggacctcggcgccggggaagtacgactcgacgctgctatcgacggccgcgccgccgatcctgccgttgtacaacagcgcgtccgccgcgtcaacaacgcgctcccgccgctgcccgtgctcagcctgtctcggacttaactgccgctctcgaacgccgccgcctctgcctcggctcggctccggctccggttctcaagtcatcggcacgaagcctanacgccacgccgnaagccccgcgngcctttgngtccctcgngctctttctgagttttcgtaagaacactttacc

SEQ ID NO: 83309 - DNA, 710 bp, Triticum aestivum
  unsure (1)..(710): unsure at all n locations
  Clone ID: PAT_TA_83309
gttcgttcggcatggaacagaacgccggctcgttcctcgccgtgcgtcgcctctccggtggcgccatccaccaccatcgtcaccactcttccccggctgaggtcgtgggcgtgtccactgcgtggctcggtaaggggctttcatgcgtctgcgcgcagaggagggagagcgacgtgcgcctgtccttcgatttgagtcccattcaggaagagtgcttgaataggttgcagaaccggatagaggtgcagtatgatggttcaaatctggagcatcagaaagcactggaagccctttgggcgttcttcttttcctggaactgaacttctagggttaagtatcagaccagtggaaggagatgggatggcaagggaaagatcatctacagatttcaggggcggtggtttaaatccttggagaattactgtanttctctaggaactatccaaaatccttcaagagtccntctaagcagaatggtgatagacantgtgggaataccnttcntactgggtaaatatacatcatgctgantagatgctnacctcaacactaancactcttgntgagcgnttccaaacacctaaaaatntnangtcaatntacgatacctaacgatggtaaatgttaatcaccattatgattaaaggtataacaagggcaccaangacntcaaaatcaaacngntcactagttncgaaattacccgcnca

SEQ ID NO: 83310 - DNA, 653 bp, Triticum aestivum
  unsure (1)..(653): unsure at all n locations
  Clone ID: PAT_TA_83310
cggaaaaccacggccggcgttcctgcttctctacccggtccgaattgctgaccggatcaacccgagaccttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggccatttctttagcaatgtttgtgagctcgatttagtgtttaatttcacaangttacctgatactagatgaattaatcttgctggggagctgcaagaaacaagcaaaaaggaataattgacgaatgggtaactggagaactggatacaagacaagaaatctccgctgtttgatcaattgataatcttcagngttaattgcncccggntcttcgctaaacttatccatcgtancaagatgatatacacaggtatnaactctcaaanaattcncaaaaaaaaaaaa

SEQ ID NO: 83311 - DNA, 301 bp, Triticum aestivum
  unsure (1)..(301): unsure at all n locations
  Clone ID: PAT_TA_83311
gctggttgcacgaccacctgcttgcttgaactgatctgatcagctgtcttgtgtcgtgtgtacattctgtttgctgtgttcgttgttctgtttgattgcaagttcgcaactggtgaatagactaaagaggtgaagtgcattgttaacactcaacttttttttagcagttgttaacgggagcggctacctgccaatcgactgactccagaaacgggtcagtcgaatgacaaaaacagcgaataaagaattcagaagaatgatttgactgacccaaacttanggccagtcgaaaaaaaaaaaa

SEQ ID NO: 83312 - DNA, 614 bp, Triticum aestivum
  unsure (1)..(614): unsure at all n locations
  Clone ID: PAT_TA_83312
ctagtctcgactttttttttttttttttctcagtcatatttgttttcattttcataatctatggtcggtacgatggggtacgatccatgacttttccacctgtacgtagctcattcgaagtcataagatcccattggtcatcagtcctcgccgtcgtgcctcatcataattttgacgtagtttacgcagactttttatagcttctgcatggcagcaacgtcagtggactggacgtaatcctcaagctcttggatctcctcctcgaggtcggcaacggaaatcttctcgtcctcaacaaccatgttaatctggagcttcttaacaccgaagcccacggggacaacttgggaagcaccccagacgaggccgtccttctcaatagcacggacggcagcctcgagggaaccatanaagtctcatcatcccangcttaacgtcaagagtgacgacgggactaacgatggnctaggcttggccncttctctcngtccagaagagctctcacgncncaacggctctancctcctctcgtntccagtccangggggccggtancaatcccnaagggtctatagccccaaggcctcttaaactcnnacggaaaccnggtacaa

SEQ ID NO: 83313 - DNA, 677 bp, Triticum aestivum
  unsure (1)..(677): unsure at all n locations
  Clone ID: PAT_TA_83313
gctaattaagctgctactgctacgctagcctcgatcgatcaagcaagcagctcacagacccaccggcccacccacccacccacatggcggcgtcccgttccgctctgatcacgctgctcgtccttgtgagctccgtcgcggcggcctcggcgaccacgttcaccgtcggcgacagtagcggctggagtcgtagcgtcaactacgacaactgggccagtggcaagaccttcacggatggagatcagctagtgttcaacttcgccaccgggaaccacgacgtggtggaggtggacaagagcggatacgacggctgctccaccaccaacgccgccaacacaatccaaaacggccccgccaccgtcaactcacctccggcacccactactacatctgcggcatcagcggccactgcagcggcgggatgaactcgctgtcaccgtcggctcggctccggctccggctccgggtccccaccccggcggcggtcgccacacaccacacaacacccgagcgccccgccccganatccggcggccgtcgtcgctacggcggncacgctcccgtgcgcactctctcgcctcttcgatcgattganattatnatgacgtcagacaganaaggatcagataagatctttcnntnaatttgtacacttatcagnggtttgcccntttatc

SEQ ID NO: 83314 - DNA, 549 bp, Triticum aestivum
  unsure (1)..(549): unsure at all n locations
  Clone ID: PAT_TA_83314
ggaacaagatgtagcgaagattaccaacctgaatgcttttgacattatttccctttcagaaggctttaatctttcaggcttatttgaagagtccgagaaaagaaaagaggcacggttcacatctagtcaatcagcttcaactattatctcaaaactagaagatgctgccacctgttcaaagatgacaataaagaaaaaagaaggtggtgtgctaaaaatggaaggtgcaaatgaaggaaggaaaggtgtactatctattgatgctgagatctttgaagttactcctgctttccatcttgtagagattaagaaaaataatggggatacactaagaatatgaaaatttgtttaagcaggacatgaaaccagcgcttaaagacattgtttgggcatggcaaggtgagagtaaggacaacaagccaaggatnacaatcaatcataaattactcaaccagtttgttccatagtaagaaatatgtttgttagtgtcaaaattgtatcacttaaacttccgtatttgcataacattatttgntcaaaaaaaaaaaa

SEQ ID NO: 83315 - DNA, 600 bp, Triticum aestivum
  unsure (1)..(600): unsure at all n locations
  Clone ID: PAT_TA_83315
ggatcacgtcaggctgcaccccgccgccgtcgacgactggcacaagaagggtggcaccgtgctcaagaccacgcggggtggcttcgatctcggtaagatcgtcgacggcatcgtcgcgcgcgggtacacgcagatatatgcgataggcggggatggaaccatgagaggggctctggcgatctttgaagaatttaaacgccgtggtttgaacatatctatcactgggatcccgaaaactgtggacaacgacatcggcatcatagacaggtcgtttggtttccagactgcggtggaggtcgctcaacaggcaattgacgccgctcatgtggaggctgttagcgccgtcaacggcgtaggcattgtcaaactgatgggaaggagtacangccatatcgcccttcacgccacctcagcagtcgggacgtcnactgctgcttgatccagagtggattcacctggaagcaaggtggctgttcaattctgtacaacggttaagaaaaggcatcttctctggccccaaggactgcagaacnatccggctgacataaacggacagacatcgaaacnctccactannctgtatcactgaatgtgaagaaa

SEQ ID NO: 83316 - DNA, 310 bp, Triticum aestivum
  Clone ID: PAT_TA_83316
tttttaaaataaaggtctgactgaaaacagctcagtgctccagtccagaaggaactttcccattaaagaaaactcggtgccacttttagcaaggtaatgaacataacagacagacggtgccgaggtaaaataacatggtacctggtatctaagttatgatatatcgtttatacttattcatcaggtagttgagcaaaatatggaaaatgggagaacacagtatatcaaccacaatgaaagacagattcagcgataaaggctctcagatctcaagttctcaagcaatctcagtttcccagcggtcaccatt

SEQ ID NO: 83317 - DNA, 654 bp, Triticum aestivum
  unsure (1)..(654): unsure at all n locations
  Clone ID: PAT_TA_83317
agcgagcgagcgagcgagccaccgcccgagagagagagagagagagagagagagagagggagagtgagagtggggattcaagtttcaaactcactatcgaggggggataggaaggtggtcactcatcggtccacagctagctcgtcgccccccatggctgactggggccccgtggtgatcgcgacggtgctgttcgtgctgctcacgccgggcctgctgttccagctgccggcgcacggccgcatcgtcggattcggcaccatgcacaccaagcggcgtcgccatcctcgtccacgccgtcctctacttcgcgctcatcaccatcttcctcatcgccatcggcgtccacatctacgccggctanctaaggccgggtgtcttcaatcacaccccttcgtctcttcctctcatcatcggccctgctagcttcctagtcatgtactactactagtcttctttggcggtatgccccatgctacttactgcgggaacaataatccggacgcggtaccccagtatgttgnattaatagggatgtatgngtttaatgtcactcttctcnctacctggtgcctcattnataaatgncggcggcctgatatcgaaantttttttttntnaaaanaanaatncggggtgtttaaaaaaaaaaaa

SEQ ID NO: 83318 - DNA, 507 bp, Triticum aestivum
  unsure (1)..(507): unsure at all n locations
  Clone ID: PAT_TA_83318
ctcatagccattcaaagcctctccatctccgaagctccaacccaacctcgaagatgtcttgctgcggaggaaactgcggctgcggcaccggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcaactgctagattcatcatccgttcatgcatgcaccgtnccctgcctncatcatcgattcgtatcgatttactactaccataccatgtnaccgcaactgattcganggctttatttcccacctgacctgcatcacatcaagtgccatgccatgattgtaaacaggcccctaaataaaactcccttgataactatacatgttctcgtggtatcatatatanaacntcttttctcaaaaaaaaaaaa

SEQ ID NO: 83319 - DNA, 673 bp, Triticum aestivum
  unsure (1)..(673): unsure at all n locations
  Clone ID: PAT_TA_83319
ttccagcaggggctttacatgggcaacggcggtggcgccaatgttgtcgcccctggatacaccaagggggacggccttggcgcagagatcgttggcaccttcatcctagtctacaccgtcttctcggccaccgatgccaagaggaacgccagggactcccatgtccccatccttgccccactgccaattgggttcgcggtgttcctggtccaccttgccaccatccccatcaccggcaccggcatcaacccggctaggaccttgggcgccgccatcatctacaaccgggatcatgcgtggagcgaccattggtctctgggtcggcccttcatcggcgccgccctggctgccatctacacaagtgatcatcaagggcatcccgttcaagacaagtcttaactgccgcgggtgtgctgagnatgtggggaattattgtctgccaagcctattcnccgctgaatcttcatctctctcccttaaaactgcnactgctcacgctcggtactgaccaaaattctgtacccgtacgaacnttgtaagttttttctcaacngttgtgaagggtccntccctttagcttggatntganaaggnaattnngttgaactggttnacacncgggttttccaaaaaaaaacncgggggccgacaatnccaaggtttaccccaggnt

SEQ ID NO: 83320 - DNA, 325 bp, Triticum aestivum
  unsure (1)..(325): unsure at all n locations
  Clone ID: PAT_TA_83320
aagaaactcgctgaaacgaggccaagggtgcgaggtcagtttgttagacagccaaccaatacggatgtcatcagcattggagatgatatatctgaagacgaagatgacgatccatcgtccagggaggtagatatggtttcttctccagagtagtagtggagaggtcctccatgtgaaaaaatagactgcagatggttactgctcatcttgttacaactcagtagacctaggcaatacaccctttttgctcacacacagtattacattttgtccctaaaacatgtggctgttacctgggttgccttaatgaagaancatctttgat

SEQ ID NO: 83321 - DNA, 651 bp, Triticum aestivum
  unsure (1)..(651): unsure at all n locations
  Clone ID: PAT_TA_83321
gtttactccccacataataactgtgaagcccaatgaggatgttgcgtccaaaataatggctttttcccaacaaggcccgcgcactacatgcataatttcggcaaatggtgctctgtgcacggcaacactgcggcaaccagcaacctctggtgggatagtgacatatgagggccacttcgatatactctctctttcgggctcattcttgcttgcagaggatggtgacactccgcagcagaacaggtgggtttgagcgtggcactgggctgggaagtgatggacgcatattggaggttgtgttgctgggaatgctgatggcagcgacacctgtgcaggttgtaattggcatttcaattgctgaactaaaaaccaaaagaagacaaccaaacgtgaccaacatcggtgccaccgcacaaacttctttggggcggctcgacgcaacccccatcngatggacataagtgacatccgatgatccgggagccatgggacaaacgnagtcatcacaacgcggggntcctgnctcaatatctcanttgntgtcncatagaggacaaaccttatatcaattaaatatacnacgatgggngttccactccttacattctacatnggcancagganctaatgaacctcagaggtnttcataat

SEQ ID NO: 83322 - DNA, 710 bp, Triticum aestivum
  unsure (1)..(710): unsure at all n locations
  Clone ID: PAT_TA_83322
gcgcactccgcagtcggtcgtggagctctcgagcaaaagcgcgcgacatcgtcggagctagctacgcgtgcgcgctccggccggcggatcggatcggatggcgtcgtccaaggcgctcctcctgttggctgccgccgccgtcgctgcggcgtgcctggtcggcgccgcggacgccaagttcggccggctgggacggctcgtcatcaccggcgtcgtgccctgcaacaccggcagcctcatcgacatcgccantcccccgccttcccgaacgcggacgtggagctgcggtgcgcgggcagggtnngtggcggncgcgacgaccaacaccaacggaccttctccatggagctggacatgacaaccgctggcgcgttcaatcggcggtgcacctggtggtggaacccgctcgtcaatgcaacccgactcacgactcggaactcgctcctaactgcaaggcccgctaagcgcctgctcggngnatctcaactcttcccgccggtttcctcacgtcgacanctactctatcaacaaanntttactactacacngnnaccaataacttaaatcgtanacaataannttactcacncaattaagtttaaatttagcacttaataacaattacaataaaaaaaaanncagggggccgacattccaaggtttacnccaaggtttaaataggaaccggtcataantgaaaccttccggaa

SEQ ID NO: 83323 - DNA, 725 bp, Triticum aestivum
  unsure (1)..(725): unsure at all n locations
  Clone ID: PAT_TA_83323
ctccctgatgcaactggcaccacctgtggccagcgccttgagaaggtccttggcaccgagcactgccatatccttcgcgtgccattcagaacagaaaacggaatcgttcgcaagtggatctcgcgatttgaagtctggccgtacctggagacttacactgatgacgtggcgcatgagattgctggagagcttcaggccaatcctgacctgatcatcgggaaactacagtgacggaaacttgttgcgtgtttgctcccccacaagatgggtgttactccactgtaccattgcccatgcgccttgagaaaactaantacctaactcccgactccaactgggaagaantttgaggnncactacacttctcctgncattcaacaactgacttgatgcaatgaaccagncgactcaacancacanacttccaagaattcccggaacaagaacgtcggcaatacgatcacacatggcgtcacatccggcctgtacgcttgtcacggaatgattgtcacccaagtcacatctgtccctgcgcgnnctgtcatcacttcctcacagtcnaaagagntgactccttaccgaattagaccccgtagcaacnaaacggccanttttttacaagacagcatantttcagncgccacnnaantacggcngggcttgcgaangtnaganggaacccggcttggaaagacctcagagggngcgttaaattncccatacgg

SEQ ID NO: 83324 - DNA, 229 bp, Triticum aestivum
  Clone ID: PAT_TA_83324
cagacgcagaccttcggaatttgaccgctggtagtatttgccaacttttttttgcaatttagtttttttcagttttttttacaaatatgtccttttgcagtttcatttcaaatatgaaagctctacagccagtgtgggacattgtttttcagacgtcgaaacaactgtatgtctgtatgtatttgcgaacaatagaactgaagcaaacactgtatagaaaaaaaaaaaa

SEQ ID NO: 83325 - DNA, 712 bp, Triticum aestivum
  unsure (1)..(712): unsure at all n locations
  Clone ID: PAT_TA_83325
tgacgatgcaacctctaaggatggacgcacaagttgaccaagtgcagcacacccaggtgataccagctacacctatatctcctacagtagtacagatgcaggcagtcctgtgcacggccaagaggtcggcagttggtggcacagctgtctaggccgcatctgcagcctgcatcattagcagcagcagagagcagttgttccaggcaggacgtatgctcccccaaatgtttccaggcaagaacttaaaaaccgcaccaaagctagcactcattgttctctgaanttgattgtttcctgtgggggaacataaattacttgtccctggtaaccaagataacatgcgataatctctgcattctgaaaacatgcaacagagaactgtttatgacttgcaactggtagcgattggtgctccatttttgtaataaaatantcctgtaagtcaaggtaagttatgctactttcgagtantattccgcttagaaanatccntgggtaaggggggccggtaccaaatccctaagtgagtctatagccgccacggcgtctttaaactctacggaaanctgggtancacttaacgctgagaanccccttccacngtaaacaaagccgacntgcctcaattgcacnagnatgaccccgtcggntancgggntngaccacnacgaatcagcagcgccttcttctcttcntcnttccnacaaggcct

SEQ ID NO: 83326 - DNA, 712 bp, Triticum aestivum
  unsure (1)..(712): unsure at all n locations
  Clone ID: PAT_TA_83326
cccctacgtacgcctttcctctggaaacccttctctcgcctgcctctcccccgccgcgccgccacttcccctctcccgtcaactccggcttccgcgcgaggtcgagctagcgtttggagttctcgagacctgctgtgatggcgacagagcaagcggcggagaactacacggtggaggacctcgtggccctgaacccctacaaccccgacatcctcaacgacctcgagaattcgtcaatgagcaggtctcatctcagacatataacttgggatgcaaatctcagccttcttcgcttgtaccagtttgagccagaaaggatgagcatacagatgtggcccacatactgattaagntctcatggcaatgccaacccctgactcaatttgtgctaatcctaatccctgaacatgtgcaaatggaggacaattaangtaatgataattcttctcactacctanagatgntaagttcatcaatttgggatgaacacaaagaacgccaatatcggaacaatgcaagttcgaacaanatcaatccatgcgatcntgtcttccttaatacaaaaantcaaggcaatctgtgagnataaatnaaggtcccttggaattctatcagcgcaaccaggttgtattaaagnggatccatatgtctcntanttaccagntaaaaaacgtcttcttactaacaatccgctgataggggaattaacccg

SEQ ID NO: 83327 - DNA, 471 bp, Triticum aestivum
  unsure (1)..(471): unsure at all n locations
  Clone ID: PAT_TA_83327
tagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccaagtgcaagtgcggcaccaactgcggctgctcctgctgcaactgctagntcgatcatccgaccatatcatgcaccgtnccgtncntgcatcatcgatcatatcatntactactacatacaatttnaccgcaacctgattnaaggcttaacnatcacctgacctnataacatcagtgcatccatgatgttaacagccccctaaataaattccctgattactanaaaaaaaaaaaa

SEQ ID NO: 83328 - DNA, 415 bp, Triticum aestivum
  Clone ID: PAT_TA_83328
gtatcgtgaagggtgactacctgatgatcaagggatgctgtgtgggtccaaagaagagggtggtgaccctccgccagtccctcctgaagcagacttcccggctggcgctggaggagatcaagctcaagttcattgacacatcgtccaaatttgggcacggtcgcttccagactaccgatgagaagcagaggttctttggtaagctcaaggcgtaaggtgctgcggtgcagcgaaagtcccatttgtcaaaatcatcaaactgtgaaacctttgtttgttaccttgctgtaccaagttttgtagcaggatgatttggggagcatgttccggtcttcaatggattgttctacgcttcaagaactgcagtgactatgtttgtgctatttggttgttttaatgccctaaaaaaaaaaaa

SEQ ID NO: 83329 - DNA, 492 bp, Triticum aestivum
  unsure (1)..(492): unsure at all n locations
  Clone ID: PAT_TA_83329
ccaactcctccacatccctcgccccgtatcagcgcctggagaagaggcatcgacgccaggacacagacgcgggcgaggcgcggccggctggctccgagtgctcggaggtgatcggcggcgcgagggtgcgccccgccgaggtcgaggtctccgaatcgtcctgccctgtctccgtgctcgagtccgacctcgcctgcccgaagcagctcgccgacgacgctgaggcgatcgagaaatcctccgcgtgcgatgagctgaccccgtcgtcggagcccgatgaggaggaggtgctcagtgattccagccactcgggtactcccccagtcccctgataactcccaattgaccgaagatgacaacgacgaccgccctctgcgacttctcctcttctcgactcgccaagcattcgtccctgcttgacccaaacgtgcacgtcacattcatctcntntctgacgggaagcgttnaggacttgacaacaagaaactacaa

SEQ ID NO: 83330 - DNA, 279 bp, Triticum aestivum
  Clone ID: PAT_TA_83330
ggaagataatcgggctgtggtgagcagagagcagcacattaactgcgacatcccttttgtttttctgttgtttttttgtcgagtggggggaggaaaactatttcctgaatttgcggtgctacagatgccgctgtccacagttttgtcgtcgacatgatcgcaatgcaacccattcttttttagttggtatcgatacatttgttcgaaccttccggtggctaattgcgaggccagggtgcagtttttaacgcgcaaaatttgttatataaaaaaaaaaaa

SEQ ID NO: 83331 - DNA, 614 bp, Triticum aestivum
  unsure (1)..(614): unsure at all n locations
  Clone ID: PAT_TA_83331
ggttcgtctccatccgcctctcgtccccttctgctccatcgaaggtccctcgcgatctcgcctcgagtagctagtgcctcgcgcgccgggggcgactgcgcgcgcggtcagtcagtcttcggcgtgcggggcgcgcgcgagatctcctcagaggtaggggagaaaatcggtgagggtcggcgggcctgatgggcggggcggtctccggtggcgcggcggttggggatgcggcgggggcggcaacttacccggtggttctcaacgtgtacgacctgacgccggtcaacaactacctccactggggcgggcttggcatcttccactctgccgtcgaagttcatggatcggagtacagttttggagcacatgatcaccatcgagtggagttttgaagtggaaccaaagactgccaaggttcatatacagatgtacggtttaaaaggcacacaactctgaattccttggaattcagaatcatnaaaggatggctcagaatacatggaatactacactaattcaagaatgtacactncaatattacacagattacaggaataatccggtggtaacactncagnagggcnttnatgctcacaangntcgntatataaaag

SEQ ID NO: 83332 - DNA, 595 bp, Triticum aestivum
  unsure (1)..(595): unsure at all n locations
  Clone ID: PAT_TA_83332
ccaccatcccctctcccctgccctgcccccaccgccccgcttccttccgccttgctccgttgcttcctcccaccacagtccactccactcgccggccctgcagctcagtatttgactgagactggtggtggagctgctagcagcgagcctgctacttcctggtcctgacggtgcgttcagacctcagaccagtgccgacgacgagctgtgaggagagggcaaggaaacaagcctgtgaggaaggcggcgatggagaggtacgaggtgatcaaggacataggatcgggcaacttcggggtgggccaactggtccgggacgtcaggaccaaggactcttcgccgtcaattcatcgagcgggggatgaagattgatgagaatgtccaaagggagatcatgaaccacaggtcactgangcatccaaacatagttaaatttaaggaggtgtgctaactcccacacattggcataattatggatatctgctggtggtgactantggaaggattgtatgctggaaattatgaggatangcagantttctcaanactattcagagtagtatgcaccaatcaatatcatagnanttaactgaaa

SEQ ID NO: 83333 - DNA, 694 bp, Triticum aestivum
  unsure (1)..(694): unsure at all n locations
  Clone ID: PAT_TA_83333
cgtagacgctgacgataaccactctgacgcggactcgtcacttggtgcggataatgcatcctccacagacagcttgagaagctcaattcttgacttccgtcaagaaaatggaagaacataccatgctttccgagacggcaaatacaatctcccaaacgatgacgaggagaacgaaagattagatctgcaacataacttgttcttgctcactcttgataacaagctcggtctaagccctcctaaccatcccgactccaaagttaagcgcgtcctcgacgttggcactgggaaccggtatctgggcgattgactttggcgacgaacatccccgaggcaactgtcattggcgttgacctctcgccgagccagcccgaactttgtgccaccaaatgttcgcttcgagattgatgatatcgacgangaatggacttacagcgagccgttcgacttattcacaacagattatgaacttggcatcaaaactggaatctacntgacaagattacagaacttggtcagcggtatttgacgcaaatgtcatgtatatggcacacatganctaggagcatcatgtcaatgggcgcttcanacaccgaattacgtcttaagactcactnagtatctaaaggcgntctgttntaaccnatgcacacattgcagcaattaggttgatgnatagaccgccgggnagctt

SEQ ID NO: 83334 - DNA, 678 bp, Triticum aestivum
  unsure (1)..(678): unsure at all n locations
  Clone ID: PAT_TA_83334
gtcgcgtccaaatcatcctcataccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgtcgctgtcactgctactagcacaaagaaagctgacctgatcttcaagtgagatccattcacagataaagaacaagaacatgaccgtnagatgtgaaagcaaactcaagagtcaaatatcattactacagttactgtcaatgagattgcaacaccaggactgaagactatcttaactttgcgttcctgatcagagntctggaaaggttgacttcagtatttgcatgataagctggattaatgcaagcgttatctgacagcaatcntgtagccaactctcngcngctttggnacaaagntccncattggtgaaanatccattgatcgccacgggaactcacaaatanatgcgggttgtgttnccagaagacttacnanccttattaaaaagggaaaancttcggncttcacaaggggcattaaacnactttgggagnntccaatttcanagaaacccnccttggaaaanggccaaactntggcnaaa

SEQ ID NO: 83335 - DNA, 675 bp, Triticum aestivum
  unsure (1)..(675): unsure at all n locations
  Clone ID: PAT_TA_83335
ttcgccggcaacgagcacccgcccaccaggatccaggtttgtgctgcgagagggcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttgggcagtgtatgtgagttggatttgatattcaatttcataaggctactacatactggatgagatctcatcgctggtgaacttcaagaatctacaagaagaatgttgcaagactaatgctgcacaagatcaatggtcnagctgctaaagangaancactcataagtacacaatgccaggcacaaatgantctcagctgcccccttcctcaactgtatgtgaaacaatgtaancacngacgtatcattgcccgccagttagnttagaccagtatnatactagttacnatgnagttnctganaacatncnctgtgcaaaaaaaaa

SEQ ID NO: 83336 - DNA, 663 bp, Triticum aestivum
  unsure (1)..(663): unsure at all n locations
  Clone ID: PAT_TA_83336
gttggaaagatgaccaagcaatgtcctgggttttctcttattacggtgagagtgaaggacaatcaggtgctcagaggttggatcccagatgaaactaacctacgcccaataacaccgaaggatgatcttgcccctgaccttcccatgctccaaccaagtaaacttcaaaagaaagcatctgcaatccacagacaagctgctcctcctttaccagtccacttaagagaacgttacaattgcaaacctcctcaagatgaggaggctgtgggagacatctactggctaagcacatcatccctccctgctccnaagaccttacgttggtcctgggttgttgcaacaacacctgtttcngttatatctgggaatgtttcaaagccttgccaaacaagacactggtncttgagccaagaaccacaactacgtggtgcaatcacaattaaaccgccaaccgtataatatcatgcaacacgtggataagattcatgttgaaggaaaatcgtcctgagttacantgattcgaanctcagtgaacaagngtcataggcaaccccgctgtttcactcatgataacggtacatagtcaagaaaccatacgcatacncaattttagacacataccaaattntacaaaanncacaccgagntttgnataaacncatt

SEQ ID NO: 83337 - DNA, 675 bp, Triticum aestivum
  unsure (1)..(675): unsure at all n locations
  Clone ID: PAT_TA_83337
ctcgtgccgcaagggagctttggatggtggcctggatattcctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgacgacatggaagctctgtacaagaaggtccatgctgccatccgtgctgatccttctgtggtcaagtcaaccaagcagccaccaaaggagcacaagaggtacaaccccaagaaactgacatacgagcagaggaaggcatctcattgaaagctcaaccaactcaactcctcgggcggcgcagatgacgacgacgaggatgacgagtaaattccgtcccatcgaagtatgctatcntatcgggatcagtatttgtgcatggattacgctactgtatcgtcacatcatttgttaagttgcatcgaacaagttgttcgtaatttgactgagtcgatattacttataataaattgacnatcaaaaagggggccgtacantcncanatagcnatagncctacggctctttnantctacngaaactggtacactacnctgaaaccctttcaggntanaaagg

SEQ ID NO: 83338 - DNA, 663 bp, Triticum aestivum
  unsure (1)..(663): unsure at all n locations
  Clone ID: PAT_TA_83338
gccgtgcctccacccaggcgacccgggttcgatcccccacggctgcatattattcccccctttttttcctttcctgcactgtgcgtatgacagggtggccccacctgtcatactctcttagcctgtctgtttattatttatttatttatttatttattattattaagtgttttatttctgttcccagagaattttccatatctggcatttagtacctttccatttcgggcaaatccttttctggacgtttccaaatatggaaagtgccatttctgtcaattaccattttaggcgggtttcatcttagtgcatttgtgatgatttttctacagcaaccctaacatattatatatgtttttgggggtagaaaancccaccattccattggtggataantccgcatttgagcaattcataaccagcatctcactctatgtgttttgcnctaagtgcttgtcatcaatagcnattgttgtttgcaatgantagctcantgcatgctactcaagcagactgtcatgcatgacanccggtaagagttgtnaaccataanatcatgataancgttttgcggtcagattcacaagtcgnaangtacctganatgcagcattacagccagggttcagtaccagtaagttcnggacccgnaccgtanacntaa

SEQ ID NO: 83339 - DNA, 586 bp, Triticum aestivum
  unsure (1)..(586): unsure at all n locations
  Clone ID: PAT_TA_83339
caattcatgcgaattactatgtttacagatagacattgctgttttattggaagagaataaatcatgtatatttatttgagttgaggaacccttattattgcttgtatcagtaccgccgccatgttcagcgcttcacatgtgctgaccgaccattcttattgcttgcttcgcttccattcatctgcgtgcttcgaactcgcttgattgctgcaggccattattttatatatgtgtacccagcagtagtaccttcactcgcttaagctcctcgacaacctctgccatggttggcctctccctcttgtcttccttgaggcatcggacggccaacatgccaatcatgtcgangcaacgcttgttgcatcgagattgagcatcctcgccagctgagaaatcaatctgctacatacatcgcacaccgctaccgtggtccttgaagcacttgacgaacccatggggagatcttgtccctggggatctgtcaacaagcngcctccctcgtgatnagcccanaacacagccgaaacgtnaatcgacncaatgtaatgtcgtctanncaggggggccgtaccantcccaaatggtc

SEQ ID NO: 83340 - DNA, 409 bp, Triticum aestivum
  unsure (1)..(409): unsure at all n locations
  Clone ID: PAT_TA_83340
agaaaatcaaagtcactcgctaccagagcaccctgtacacgatgcactatggtgaatatgttgcgtacctcaagaagaacagaggtgcagccccgtcaattantggggctcctcctgtagttaatggcttcaagccaagccattgatttatcatgtataaaaaaaagctcaaagaacatattactataatttatctgcgagcaatttggggggtgtagtgtaaccaccccccacagttcattgatctagcatcattcccttccaaggaaaagncaaataggggcgtcatgacaagcgcccagaataataatgccttcctggatggatcatggatgatgcttatgtatcttgaaaacacatgtgcttcaagaattcaaattgtgtgggtgaagttaattgaaaggggggg

SEQ ID NO: 83341 - DNA, 407 bp, Triticum aestivum
  unsure (1)..(407): unsure at all n locations
  Clone ID: PAT_TA_83341
ggccnggaggacgtcgaggccaccgggctttatggngaggaagagggagagaanaantcancgcggggatcanggatcnaacgactcgtagtcgcttgatcgggcggttggggctaatccggtccaactgttcgccggactgccggcgcctatcactgcccttcngactatgcaagaactacaggaaataaacatcacgtangtatctancttncttgtntcntcccanccgatcnaatcacaacttcttcngtagtcctgaaatttggtttgatgtttttctgtggnagttgaanctacagcaacatagaaccaactaanacttgttgcattgagttataatggccaantttatttccttctgtgtactttatcaccggtggttataacatcccctcctcttgaaa

SEQ ID NO: 83342 - DNA, 693 bp, Triticum aestivum
  unsure (1)..(693): unsure at all n locations
  Clone ID: PAT_TA_83342
ccggcgtggacgtcggtccctgccggtggtggttattctccattgatctgaaggaggaggtgcgtggccgatcggtgtggagctgaggttcggtcggtcaatgagctgtgcatgcagtcaagtgctggagaagcttggtcgtagcatctcagcaagggtatatatatgccgggtcgtcggggtctggggacagcgacgtccacgcagaagatgacgtcacacacggcggcttaccctgtggaggtctccctgggtgctactcggattacgtcagcacggacgcgtctctgcctggctcgcctcgttccttaccgtgcctctttgggaggtggttcgattcatgcgtcctgtaaataaattaaagaatgagaacgcaccgaatactcaatcgttacctacgtgatacgtgctaacatcctgtagtaaattaaagatcacacacacaaatgcacatgcntaacaaagcatatcaatcaccggtaaatctaaaaaaaaggggggccggtaccaantccctaagtgagtctantaccgnctantggcgtctttaaactctactggaaanctggtaccactaaccctgagaancccttccactggtatacaaagccnaacnttccttcaatcnactatnatgancccttcggataccgggntngaccactcgtaattagcnagcgccttntttctntt

SEQ ID NO: 83343 - DNA, 699 bp, Triticum aestivum
  unsure (1)..(699): unsure at all n locations
  Clone ID: PAT_TA_83343
gttcacgcaagtcttctcgtttatcaatgtgcagctttttaacagccttctgctgcggcgtgagtgctgctcgttcagtaacggagagtacgtgaaggctgggctggatgagctagagcattggtgcttttggctgactgaagagtacgcaggatctgcatgggacgagctgaagcatatcaggcaggcagttaccctcttgatacttgacgacaagcatagccggagtctcgcggagatcacagacgacttctgcccagtgctgagcatgcagcaactgtaccggatcagcacgatgtactgcgacgacaatttgggaccctgggcattccatcagaatcgtctccagcatgcggaccaagatgatcgaaggtcgtccaacagccgtcggcgcacgacgacatcaactcgttcctgctagacatgactnaacatacgttctccgtggatgactcacnaactgatatgcactcgacgtacggncatggattgcaacgctcaatnaganacacgcggcgntcaaatggacattaggagtgcatatcacccntttttggttgttncgtatgtcaatgcggcanatgcccanacaggtttgttttctccacggcctcantttcncaagcacactatanagccgttgtttccntttatgcaacgacntgaanagagaaaaccggancattttaaaaaaccngg

SEQ ID NO: 83344 - DNA, 642 bp, Triticum aestivum
  unsure (1)..(642): unsure at all n locations
  Clone ID: PAT_TA_83344
tcgctatggctcagggaagaggcagtgcgacncgggggcttgccctcggcagcctactcgccgccgctttcctcctcctcctcggcgtcgccgacgcggccacccacagggtcgactggtccttcaacgcngacagctggtccaagggcaagagcttccgtgccggcgacgtcctcgagttcaactacgacccctccgtgcacaacgtggtggccgtggacgccggcggctacaacggctgccggccctccggcacgtcgtacggctccgggagcgaccgcatcacgctcggccccggtaccagctacttcatctgcagcctcaacgggcactgcgggatggggatgaagatggtcgtcaacgccagctgagcacgacgcttatntgttagtactgcaaaaatatatgggcantggtggtccgatagatnntcaaganctcaatcgtgtgcatactcgtaccgtgnttcaatggacancgttatgtgtngtgtatcancactgccggtagtcagcatatgtactgtggctgatggcgtgtataaacatctcagcttgtgtacttgtcatnaanacggtcttgntgtnncatacactcanaatttttanaanaaanaaacagggggccgtacaatcctaagga

SEQ ID NO: 83345 - DNA, 576 bp, Triticum aestivum
  unsure (1)..(576): unsure at all n locations
  Clone ID: PAT_TA_83345
aaaaaaacttgttccaaatcgtcatcatagtgtaggaataggaagtccaccgtagtatattttttaactatatgtggctcctggtcctaaatctgtcgatgatatggcacaccatccatctaagttctctgtgcttcttcttcttcctttgtctgcaggaagaggctgcactggcggctgcagaggtggccttcatcctacagtcggccaggggccgcgccctccagtttgccatcgctccagactcccccgccaccccgcagcatgagccagtgtcgcagcaacagcaatagtggctgacaaccacatccccagtagttgctcacgactactgaccatacgtatctgttcgttttcctggggcatcatactgatcacaaagttaagcctgggcttctgcctcccgttggcaatttgggtgtcaatgtcaccaaaantcgttacaccngaaacctgtgcttgtataaacgantgtgttcgagaatatacaatttatgtaatcatctgtctacgcggnacatataacgttgttgacngtatgtnagcctcaaatacaattatttcaaaaaaaaaaaa

SEQ ID NO: 83346 - DNA, 587 bp, Triticum aestivum
  unsure (1)..(587): unsure at all n locations
  Clone ID: PAT_TA_83346
ggacaagacccaactcggcatgcagcagctgatccagcactcgtcggcaaactcccggcagcgggggcaaagcagcggcggcacgacgagaaaccaagacgagctgcccccgcggatgccccacgacatggcaggccagggccagcagcagcagcagcaggtgagcttcgcttacgctgggctccccgcgcaccaccacggcctcgcgctgtcgcacccccaagcagcaagcgggaagcggtcagcgccgttcggcggtggctttcgctcacgctgggcttcaacaagaacaacaaccggacctacgtcgccgacctctccccggccgcgctccccgcaccgtttccggctggaggacgtnagcgaccctacgttatgcaagggacactccttcngcggcaagacgccattccgaaaggggatgggcggcacaatttgtgcatgactggtcgctgattcgttcttgnactgttgtcggatcantgtacatacnatgttagggaacaaagcaccacatggaanaacagaatattacntgtgataggctatnaggcaccatgcccttcgttaaatnntccatttgtaat

SEQ ID NO: 83347 - DNA, 704 bp, Triticum aestivum
  unsure (1)..(704): unsure at all n locations
  Clone ID: PAT_TA_83347
cggcgacaaccgggcgaccgccgccgacctacgccaggtgccaagccgttcctcagtcccatcacgaggccttcaacgaacccttcgccggcgacgagaaaatctaattttcccaaacccgcttcctcgacttcctgtctcgactctcccaagtcacaaccctcgacctcccccctactccaactactggaagtgccgacccatcaggttctgattgattcttctgccccgaaccgcagcggcaagcggagatgaactgcgagacctgtcagctgaaagagctgggagctgggaactgacggagatcagggatgtgctgcgctgtattttgcacaccatatttttccatagaacctcaacctgggttcgccccaaagatgttgactgtgattcctcgatattacttatgtacaatgtggtctaacggaactagaaaaggaattgacgaaaagatagacaattaagtgcatgggtggagaaacaccaaaccgcagaagcagattgcctctcctttcgacagaacacagacacctggtggttgtacaaacaggcgatcaatggacaangtcacaattnagnangtccaaagataagagtcacagtcaaggtgcaantcacaatncttggnacacaaggtctgantggggcatacatgggtcattaantcacnaaggcaatcggnccgaggttaacaatttcaacng

SEQ ID NO: 83348 - DNA, 525 bp, Triticum aestivum
  unsure (1)..(525): unsure at all n locations
  Clone ID: PAT_TA_83348
cgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttaagtggaaagaaggaagccaagactgaggcggcatcaccacaggcataggtggcggagatggattatacccgtatctgtggcctggcaacaatgttaaataaaaggaatgctttatgttgtgctttcaaagttgataaattgtgggcaacaggagatttgctttacgtaagcaatatattgaagaactacccttactcaatccaccatgaataaccttgctgcaatgggactcattcngcgaacaatgcaaacttgtactcttcatgcgatgaatanttgatgtttactctgttgcaacaacagttgaacctgtactgcagantgataagatccgtgcttcaaaaaaaaaaaa

SEQ ID NO: 83349 - DNA, 659 bp, Triticum aestivum
  unsure (1)..(659): unsure at all n locations
  Clone ID: PAT_TA_83349
cttgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctctgctggccctggaggaggccggcgtcgactacgagctcgtccccatgagccgccaggacggcgaccaccgccgcccggagcacctcgccaggaaccctttcgggaaggtgccggtgctcgaggatggcgacctcacgctcttcgaatcacgtgcgatcgcgaggcatgttctccggaagcacaagccggagctgctgggcggcggcaggctggagcagacggcgatggtggacgtgtggctggaggtggaggccaccaactgacccgccggcgatcccatcgtggtggagtgcgtgtcccgccgttcctgngccgcgagcgcaacaagcgtggtggacaaaactggagaaactaagaagtctggagtgtacaagccgntggcacgtcactactcgcgggaattctanctcgcgaatancccttacatancacgctntgcaanaatcccgtcctcaggntccgaataannctgtgaaggcnccccnccgngcaaagngnaatatcgnggcga

SEQ ID NO: 83350 - DNA, 560 bp, Triticum aestivum
  unsure (1)..(560): unsure at all n locations
  Clone ID: PAT_TA_83350
cnanatgggaccaatcacctcaaggttgttcgaattaacaanaaagcgattgcagcccgccctttgcaccanantaaggncaaatttganggctaaagctaaagccatcaagacatccgcanagtagtcaagcttcccattcnctccagcgatatgacctacctttgtcatctctcagaatcgcccccatcgtaccctaancagatcatgatcaaanagaagcatcactantcagttaacananccctangaggacannacagcccccngcctcaaaagncgccnggggagatgangcaattaacaacgtttacgtnacgggtacaanccnaataaatccaaggtgnatctgagttaactccttgtgcaaaattncnggcntcccaacanggttncaaancnaaacacaantcnttaggcaacattgtggtaacctnaaangattcctggccnggtagnaaatttggtcttcaacacnangtcccaaaatggcaactcaagncccattgttaaacctcntcccaccttntcaaattatngcttancnaaaagaaattgtt

SEQ ID NO: 83351 - DNA, 672 bp, Triticum aestivum
  unsure (1)..(672): unsure at all n locations
  Clone ID: PAT_TA_83351
agatgatccaaatggaggattacttcactttcagacccactttgtaattgtacatcattgtcttaccacagaagttcagatggacatagtatccaggataccaaccatttggaactcctctctacaaaaaagggttaaggggattgggtaactggagttcagagcataaaattattctaattgccatgcctacagtattgtatacacagatttgagagaggaatagtggatagatgagcaatggaccattaaagttgctttccatggtctccttaagggaccattgcaaaaggtgtttttgtttgggataaaggcatccgagctaaggtaactctccaatagactgggacattacatgtcctcccccggcgaggaaccaagtgacctccatccaatgccttccctcctaaccctttcnccnatcgtagtccctccaatgcgtaagttcnttcgtcgtcccaagtccaanggaatctgcaagctgctcagtncncattgataaaagnacaatgggtggcaactgaactcaaatggaaacccccngtanattatttggtctganccttcccaangtaagtattgacactnggaaaattancagttgggggagcatgatttgattgtganaaggcnttatgctaangcaanttnaaccnaatncngttanttttt

SEQ ID NO: 83352 - DNA, 337 bp, Triticum aestivum
  Clone ID: PAT_TA_83352
ggatcttctgggtgggcccactgattggcgccgccatcgccgccgcctaccaccagtacgtgctgagggccagcgccaccaagctcgggtcctaccggagcaacgcctaagttccgcccggacgcgccaggagctgggcaccgttccgattctgttcctccacatgacgccctgttctgtttccgtgtggccaggactccgctcgctcgctgctgttttctacttcggaccaaagtgtgacatatctttgctttctgtatatgtatgtaggaatgcatcatgtaaggagaatttggaatacaattgcgtgagtttttatccgattaaaaaaaaaaaa

SEQ ID NO: 83353 - DNA, 592 bp, Triticum aestivum
  unsure (1)..(592): unsure at all n locations
  Clone ID: PAT_TA_83353
tatgctgatgctatcacatgttacactgaagtactccgtatagatcctacagcagctgatgcactagttaatagagggaacacattcaaagagattggcagagttaatgaagcaattcaggattatgttcaggcagcaacaatcaggccaaacatgccaagaagcccatgccaacttggcctcagcatacaaggacagtgggcatgtnagaaacggntataattaactncaagcaggtctccggctgcgtcctgatttcccgaagnaacctgtaactcctgcataccctacagtgtgtccngtgaccggggaaaacagagatggatgtttccagatgttgaagaaatattagaagnaaataaagatnccagtacttccaagtgttcaactttccaagccattgctaacccaatggtcatgcttgcttgggaataaccgtaatatccggccatgtcctgatgcccncgtttggggcgcccctttgtgcatcactctgtctgtaaacagaggtaacacgcgactgaannggtatgtanatgatttggacacccnttcnaccaggattantttgagcagnttgcaacaggcnttt

SEQ ID NO: 83354 - DNA, 654 bp, Triticum aestivum
  unsure (1)..(654): unsure at all n locations
  Clone ID: PAT_TA_83354
cggaggtgccgcacccgacagccgtccctgagctcccgaaaccagaggtgccgcacccagtgccggagctgcccaagcccgaggtgccaccgcacccgacagccgtccctgagctcccgaaacctgaggtgccgtacccagtgccggagctgcccaagcccgagctgacaccgcacccggcggccgtgcccgagctgccgaagtctgaggtgccgcacccagtgccggagctgcccaagcccgaggtgccaccgcagccgacagccgtcccggagtcccgaaacctgaggtgccgcacccagtgccggagctgcccaacccgaactgcctcctcacccggcgtcccagacttccaaacctgaggtgcctcaccaatcgcgccaaagctgccaaacctgaatcctcctcacccgacgtgcaaaactgccgcaccaanagttccggagtgcaaacacaactgccgcctctacgaaactgactgcaacgaagccggagggcataccggagccggagggaaacatancggcgtcattcgagatcgttactcaattttccgatgaaactactgtcgttgaatncttaagattnaagtggtctnctcatcagactaatgannacnattccacattggtaagtaacganaaaaanccattt

SEQ ID NO: 83355 - DNA, 542 bp, Triticum aestivum
  unsure (1)..(542): unsure at all n locations
  Clone ID: PAT_TA_83355
ggcgactcagccagattgagttagatggatcatttgaagctgggcttgtaacttgcatggaaaaaatggttgaagatgttgtccttcaagacaaaatcaatgatgagcttgtggcatatcgaaaggaacaggggacatttggaagagaaattgccaaaaggcagcggagaaacaaaagctttgatccagctcaatggtggccatcatgggtcaagattcaccaaactcaagagtattgggcgatgcggattttganttggacatgcactcctccgcttgtgaagaggatttaagtgttttcaagcaggtaagaaagaantacaattaccctgttctcaacttctcatattaatgcccttggaaaaaatttgcctagttaatgccaacaaacttgatttgttctcaacttcatagaatgtcctgttgccgtgttgtaaatgtaccaaccctgggtgttgtgttgcctgatatgaattgatggntggttgtgctgtcagtgtatacttcttgatgtaaatatattcctgctcaaaaaaaaaaaa

SEQ ID NO: 83356 - DNA, 576 bp, Triticum aestivum
  unsure (1)..(576): unsure at all n locations
  Clone ID: PAT_TA_83356
caagagtgatccaggccgaccatggcttacgtcgagagaggtgttgtgaaagacaagcggactatatggcgactgagcataatctcagacttctttcgggctattgtcaacttcatcagaatcttctttgacacactgttctcagtggacaaaactgacagctacaagaaagggtatggtgctggtaagaagtgggatggtggcccggtggtggtggtgggcggggccaaggaaggtggaaggtggagtgtgttttggcggccnggangtggagtggtaggggtcctcgcactctatctgacatccaatccaatgaccacagtctctccctgcttgtggttcctgcngcggctaatgacccanaccgttctgcctgatgactgcttaacagatgaatacacatcttcaatatttctgaagaacatcatactatcatattattcacgtcanacaatgtataaanataatagngtgtcnttataacantanttactgtactnacncggatgatcaatggnnatcagggttaactttgttangngtncggtgnaaacccattattataaaaaaaaaaaa

SEQ ID NO: 83357 - DNA, 666 bp, Triticum aestivum
  unsure (1)..(666): unsure at all n locations
  Clone ID: PAT_TA_83357
cccggaccctgggcgtcctcgcagcaggcggccgccgcgcagctcatggcgctgctcaacagcgccaggagcgtgcagggaggcggcggcggcaacatgcacaggctcctcggcctcgacgccgtggcccacctgcccctccatgtcctgccgggcgcgggcaataatgccggtggcacggcgccgtcgttctggccgcaggccgcgccgcgtgtcatccccgcaccgccgcacatggatcccactcggcatggggccgctgggccagcacgacgtgctgtccagcctccgggtaaagtgccccgccatcgccgtcgccggcggcaantactacagcgaccactgcacccggtggtgacacgccgccggacgcggacacgattacgaaacaccgcctgcgcaactcactgccttgcacacggngctgactcctcccgccgggcgcgtcnagcgttcgctcactggcaacgcgcacgtcggctanactccgctggtctcctctcgcgcccanatcaatatgggccggcggcgcatntcgtgcttgccgactnccacccacgngcnttcctaaanacatgnccnactgttcgtgngacnttncacaatacatactatctacnttccattatnactattctactctattngtnantaaccnccggagtt

SEQ ID NO: 83358 - DNA, 433 bp, Triticum aestivum
  unsure (1)..(433): unsure at all n locations
  Clone ID: PAT_TA_83358
ctgcagaagagttaactcgtggctatgtcganatgagaaaaagagggaatanccctgggagcanaangaaggtcataacagcaaccgctagacaaatagagagtttgatccgtctcagcgaatcattagcccnaatgcggttctctgaagtggtcgaggtgcgggatgttgtggaggcattcangcttcttgaagtcgccatgcagcagtctgcgacggatcatgnaactgggtacnantgatatggntctgatcangacngggatatcngcaancgtaaaggcanaggcgggagaacctcattgccncaacccgntaacctgattgcggncaanatgcanctnggaggccccnaatngcatnattnatttcctggcggaactgaggaancatgncncatggaantccatagcacaattccncgggctcntgg

SEQ ID NO: 83359 - DNA, 472 bp, Triticum aestivum
  unsure (1)..(472): unsure at all n locations
  Clone ID: PAT_TA_83359
gatgatttcaacaactttcacgaggctacggcctatgatttcgtctagaaacctatacttaagaggagtttctaaaagaacatatgcgaacaagccaccaagcccagtgtctcagttctatcgcacattcactcgacctatcgcaaagacacttctcatcgctgtctttacgtaccagttggcttactggacttgggtaaaacttgaaacggatgagatccgtgcggagcgagaagcaacgattgagaagcttgaggcaactatcaaggattatgatgctgcgacaaaggcaaacaaggcttaaagcgtatgaatgagattacgggggttcgaagcaaccaatgtctttagttgttctgtgtaggatattgataccaaatcgctcatgttattcaaaataaccttactctacaaaagtatgggcctcctgactttgacacgaaattcagacgtcgctggnaaaaaaaaaaaa

SEQ ID NO: 83360 - DNA, 687 bp, Triticum aestivum
  unsure (1)..(687): unsure at all n locations
  Clone ID: PAT_TA_83360
caagcccagtcgagggctcggcccagtcagccttctccgtctccctgaatgccaccgaaccgcaagaggcgagcagcagccatggatcccgcggcaggaggcgccggccagcagcgccagaacaaagcttcggcgggcaagaaggtaaagaagggcggtggcagcggcgggagatggccggcggtcaagcccaagaaggatctccagatcaatcgcctcaagggcacccacctcctcaccattccagacttcttcacttctgcggaggcgaaggctttcattgatatcgctgagtcgatgggcttcacgcaccagggcagtttggggccactaaagggggangcttacagagacaacgaacggatatctgtgacggatcattgcttgctcaagccatttgggaatcaggaataacaggattttacagacatcaacgtctctggcaaagtacaacaggatgaatcaatataagttcacagtacactgaaggcancttttggtcgcatatnataaatgtcncctcgggatggtcaaaactatanacccttaanaacttttggcaaggaatgcaagnttatcnggaaacnctntcgagggaacgtcttatataanagngatttccgagtnccatcagnatgaccccnctaatgggcattncgntaacnggtttaaaaacatnttcctaat

SEQ ID NO: 83361 - DNA, 666 bp, Triticum aestivum
  unsure (1)..(666): unsure at all n locations
  Clone ID: PAT_TA_83361
cacacccaccaactgacctgacccacgagggatccgcagatgaagatcattccggtcccttgcctggatgacaactatgcctacttaatcgtggacgagagcaccaagaaggcagcggccgttgaccctgtggaaccggagaaggttctcaaggcggccggcgaggtcggcgcctacgtcgactgcgttctcaccacccatcaccactgggatcatgctggtggcaatgagaagatgaggctgcaggtgccagggataaaggtatttggaggatccctgggacaatgtgaaaggctgcactgatcaggtggagaatggaatgaattgtcacttgggaaggacattgagatactatgcctacacacgccttgccacactaaaggcatatcagctactatgttctagtaaggagggtgaagatcagcggtcttcaccggagatacttgttcaatgctgggtgtgggaanttttgagggntctgcagacaaatgtacatccttaatgtacactgggttcctgcaaatcaaccgagttacgtggatgagncactgtaagaactaaaantntgctncactgagcaaagatnganacaacaaactgaatgctaaaacaccaagcatacaaatgctcacangaatattgaaatantcanngtgtacaaatcag

SEQ ID NO: 83362 - DNA, 516 bp, Triticum aestivum
  unsure (1)..(516): unsure at all n locations
  Clone ID: PAT_TA_83362
ctagcatacagacgaataatctcttcttcacctcactaacaccagctagcaactctttctctcctgcaataatggccgctcgctcctcctcctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccactgcaactgcctcaagagcatgacgggccggctcggccgcggcgtcagcatggccaacgcngccaacatccctcaangtgcggcgtctccgtcggcgtcccatnaacccaccgtcgatggcacaagataactgattgatggacatanggnggtactccccnttggttgnancntacttgcatcanacatnatcgt

SEQ ID NO: 83363 - DNA, 625 bp, Triticum aestivum
  unsure (1)..(625): unsure at all n locations
  Clone ID: PAT_TA_83363
ctcgtcttcaacgctgttggtggaggaacgggctctggccttggttccctcctcctagagcgcctgtctgttgactacggcaagaaatccaagcttgggttcactgtgtacccttccccccaagtttctacttcggtagttgagccatacaacagtgtactgtccacccactccctcctcgagcacactgatgtggctatactgctggacaatgaggccatctacgacatctgccgccgatcccttgacattgagcgcccaacctacaccaacctcaacaggcttgtgtcccaggtcatctcatcccttactgcctccctgaggttcgatggtgctctgaacgtggatgttaacgagttccaagacaaactggtaccctacccgaggatcacttatgcnttcttcgtacgctccaatcatctctgctgagaaggctacacgagcagctctctgtgctganatnacaacagtgccttcgancatcttcatgangcaagtggaccacgcatggnagtcatggctgctctcattacgtgngatntggcccaagatntaatctgcgtggcacacaagcaacgacatcaattctggattgngccgatggttaatgggataataaacccca

SEQ ID NO: 83364 - DNA, 482 bp, Triticum aestivum
  unsure (1)..(482): unsure at all n locations
  Clone ID: PAT_TA_83364
tggaaacgtccacgcatcctccgtctccgtccccatctcgcgaagctagcgggaataacaagcaacgatacctacgacgacctacccccctttccctgctctctccttccaactcttgtttctgcaacgccagggcgcaaccatgggtcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcangtgggattgggcagccacttgcgctattgatgaagatgaaccctcttgtttcggtgctccatctatacgatgtcgtcaacgcacctggtgtcacagccgacatcancacatgaacactggtgctgtggtactggctcttgggcaaccacagttggaaatnccggg

SEQ ID NO: 83365 - DNA, 302 bp, Triticum aestivum
  Clone ID: PAT_TA_83365
gccttcgctagtggtatcttcatcactattggaaattcagctggtgttgccgcccctttcctgttcagcaacgagtacgagccccattatcgtcccggctacggtgcctctattggcatgcttgcccttgctgtctgcattcacactaccgtctacctccacttcaagcgtctcaacaagagaaagctttctggtcaggaggattggcgcatggagggcaaaactgaggaggagattgctgagctcggcgaacacaaccctcgatacatgtacactctctaaagactcagtctgctttccct

SEQ ID NO: 83366 - DNA, 700 bp, Triticum aestivum
  unsure (1)..(700): unsure at all n locations
  Clone ID: PAT_TA_83366
ctacggattgctgatttagaaggaagtatcgagttgacatgcaaccggctatgttgtgattctcggcgagatggagaaaagcaatcgggaggaggttcgtgtagcaggatcaggcgagacgtgcgtcgatcgatcggatcaatcgggcgtacagtgcaacacgtgcaagcggcggcccgggaggcggatattggcagcggcgcgaacacgtacataaagcgctagggcaggcggccctggctgtgttgtaccgcgcgaggtgcgcggcttgagctggctcacgcagcangggcccgcgactcggctgggcgtggcgcttgtccaagcgctagggctcaaatcgagctgcaacgaaccaaactggtgcctcaagcaagctgtacgaagcctcaaggggcaagatgtgtacgtgtgctgggtctggtgatgcncacttggacnaattgttttggcaaaaagaanacgatctcactactgacacggagataacagnaaacaatctanctgagaaatccatcanggtaacancattggagnaagtcatggaaacaaactacattggntttgttaggtggcacacaaatctnaagnacgangaantattacnagntaanacaatnngtaaatcgganatattgacccaggggccgacattccaagggcttaccccaggcnttaagcggggaactgtacaatactn

SEQ ID NO: 83367 - DNA, 593 bp, Triticum aestivum
  unsure (1)..(593): unsure at all n locations
  Clone ID: PAT_TA_83367
gttcggtagtccctctcctctcgaggtattagcagtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctgggcggagctgcttctgcagctgaggcaaagaaagaagagaaggtggaagagaaggaagaaagcgatgatgatatgggttcaacctcntcgactaagctgcacagtcatcacagtattgttttgggcagtgaaacaagaggaaaacagatcatgttagatttaaacctgnttaagttggaaagtactggaaagatgcactgtcntaaattggnaatcacctaaattgcnagcnggtggattaccgtaacaagtttcggctaaaaaccnaattgtaccaaanttctggntttac

SEQ ID NO: 83368 - DNA, 668 bp, Triticum aestivum
  unsure (1)..(668): unsure at all n locations
  Clone ID: PAT_TA_83368
tccaggttccccacttttcgactctactcgagcaagcaaaaatagtaatgatttacgattcgaggaatgaatcgggttagccacccacagtatgtcgggcgtgtaaccatttaacagttcaaaacccaacaaatcgggttccttaattgacttgatgcttagaggagttgttcccggtactactaggttatagcttaaccgacccaggagacgacgtaaagactatagagataagaggtagaaggaaattactatanggtacagcctcgggtatcctanggtttccaaagatatgatatgatatgatcgggtatttatccaaattggaaatantagaanccctgcgcagnttgctgtactgaacnccttatagtctacctgtcaaacccaagataaggcaaggctggggtttatatccactagtggggtttaaggttccagttcaatgaagcactccttcgcttcatctgtcaacaagntaaggagagagaaggattaatcacgagaatacatcatactcaactcaaatttcagtncaaggaaagcgtaanccncatgtaacnccacncaattanagnccaattanaggngctggacngcaaattgnttacgagcncgtcgatganattttattttntatccggcaacctcatgaaatttngtgcctt

SEQ ID NO: 83369 - DNA, 538 bp, Triticum aestivum
  unsure (1)..(538): unsure at all n locations
  Clone ID: PAT_TA_83369
ccagcacacatttccctttggcggatcgaaggaaggaaggaggagatgggtggcggcatggaggtgcacaaaaaccggtggatcgaagagtggaacgccggccgggagaacctcgagttcaacttccgctgggacccgccgcagcctcgccgtcgtccggctcttccgcctcgctgtccccatcctccgtctacaagggcatcctcccgcgaatccaatatgcaggacgaggatgcaagtccggcatacaggaantccctgtaagcggctccaaggctgcaagatactccatccctccaccggggctgcnaggagggganttcccttcatttgttccgaatgttttaanccgaaccngatgaacatttggatgctgantatgtgcctgatccaaatgaataaggtgtaatgaccctctttcaattactgaaacgggaatgttgaattacntggtcactgtatggaaaatacagcgttgtcatatacgttaagacntatttancnccntgaggaaatggatancatggagattgntttn

SEQ ID NO: 83370 - DNA, 668 bp, Triticum aestivum
  unsure (1)..(668): unsure at all n locations
  Clone ID: PAT_TA_83370
gcgggttactaccccgactggaggaagaagcgtatgatacggctgatcggccacctcggggccgcgatagagaggcattcctgcggaaagctcagccttcgccccaacgccatccaaataaaaatgcatggggagatatgccagacctgcgagacatattgggaggacaaagcaaagcattcaaagatcgatctacagtnaacgagggcgcaccactcctacgagacggtaaacgtcaccccnggatacaattaaaactaacccggcaagcccgaacacagcgggctggncccatacgantacttcgcaatataccccaatacaagagcgcgcacaccctttatgcttcatagacgaantatgggacacantccccagaagnttcaaacctggtaaacattgancatacgacagcacaacagtccnttntatggatgangactctctccatatcacatggccacgtgatgactacatgcatcaattactccactaaactcaaggacacgctgcattgcttaaaacttcacaannccattactttggaaanttggancccattcccnaantttaggnatnnttgacacattcaatgnttgccaaattncncccaantcgcaaaatttgggccggntttaaaaaaattcnntcgggggggtttggttana

SEQ ID NO: 83371 - DNA, 533 bp, Triticum aestivum
  unsure (1)..(533): unsure at all n locations
  Clone ID: PAT_TA_83371
caagcggctgggcgagccaaccgtcccgaccctcgaggacgggctgtggcggtactcgcgccaccccaactacttcggcgagcagctctggtggtggggcttgtacctcttcgcgtggaacctgggccagcggtggatgttcttggggcctctccgtcaacagcctctgcctcggctacgtcacggtgctggtcgagcgccgcatgctgaagcangagcaccgtgctgaggcgtacaactataccaagaagangacttcngtgtggttccttgggtcaaggaagncgtccctgaaccaaactgaaggaacctaaggcacactgtccttaattgtttgggcatacccttgtccaagtgttcacangttgttgtttgttcanaactccatgtttaanaactgttgttcaaccgctattgtgtaatcancgtantgcaataaatgcacntgtacaatcatgatgactgttaangtgaagttaaagtaagtaccanatctttgctggncgaacncgattttatgcaaaaaaaaaaaa

SEQ ID NO: 83372 - DNA, 537 bp, Triticum aestivum
  unsure (1)..(537): unsure at all n locations
  Clone ID: PAT_TA_83372
gccgttcggcgggaggcaggggaagcacgggcaggcagccatgaacggcatcaaccccaacggcgggttcctgtcgtacgggaacatggagagctacgcgatgtgggtggcgaccggcgtggcgtcggccttcttcgcgtccctcgagcgctgctcctgcatccacctccacaccgcggaggacgacggcgacgangaggaggaggacctcnangaggccgccgtccttctcccgccgattccctgagtactactacgaccggcccggtcctcccgctccgtcgccaaaatgttacctgaccgaaccgcgcctccctccgccccaagaaatgcttggtgatacatncgtttccttgattcaatangtnctccctgctnantccttgatccccnaccaagaagatgaacaacaacaaaaatatatatgtgctgcgtatccaatgtacaattgatgagatggttgactcccgtgttccgtagttctgatattcttccccgttttttaancttccccttatatgggtcaaaaaaaaaaaa

SEQ ID NO: 83373 - DNA, 435 bp, Triticum aestivum
  unsure (1)..(435): unsure at all n locations
  Clone ID: PAT_TA_83373
attaatggggctcacaatcatagaagatgtctaagatagtatatttatatgtgaaatctctcttccttcaatattctttcatgaattgttcaagtgcatatataatttcagatttatgatatttaaatcattcaaaccatttactccataggatataagtgaagcacacgagtaaatgacaaactactccaaaaaagatataagtgaagatcaatggagaagttaaataattatgtagctatgtgaagatcnccnaacattttaagaattttaatcctgggattttattcaaacatcaagcaaaacaaaataaaatggcattgcaaggatancacaacttatgtgaaagaagcaaaacttagntcaaccgatactaaccgatattgttgaagaagaagngggatgcctaccggggcaccccaacttagtgcccaa

SEQ ID NO: 83374 - DNA, 689 bp, Triticum aestivum
  unsure (1)..(689): unsure at all n locations
  Clone ID: PAT_TA_83374
cgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaaggtggcacttttcggggaaatgtgcgcggaaccctattgttaattttctaaatacatcaaatagtaccgccatgagacataacctgataaatgctcaataatattgaaaaaggaagagtatgagtatnacattccgtgtcgccttatccttttgcggatttgcctccgttttgccaccanaacctggggaaagtaaagatgcgaagtanttggtgacaatggtaatcaacggttcanaagggaaatcttaanttcnccanaantttcaaganagantaagttgaagtggcgataccgntaccggaanaaatcgncn

SEQ ID NO: 83375 - DNA, 455 bp, Triticum aestivum
  unsure (1)..(455): unsure at all n locations
  Clone ID: PAT_TA_83375
ccctcctctaggtccgggctgcccggcctctcctactccctggccgactcgctcggcctcatggcggacaccttcgcccacccgctggcgtcggggttcacggacgtcgccaacgcgtgctgcggcggcggccggctcggcgccgaggcgccctgcgcaccgaacgcgacgctctgcgccgaccgcggcctttactacttctgggacagcgtgcacccttctgagcgggccgcagcgctcagagcccaggctttctgcgatgggccagctcaatacactacgcccatcaacttcaagcaattgggtccacatggcatgatcggtttaacccatttgcttattcanacccagcgaaacaattatacaaagatgatattatgtcaaaagtgaaccatggtaatcccttgttacatggacaattgaccggaaaaataaagaaataatattgaacaaaa

SEQ ID NO: 83376 - DNA, 569 bp, Triticum aestivum
  unsure (1)..(569): unsure at all n locations
  Clone ID: PAT_TA_83376
gccaactgcagtagctagcagcctgcctaacacagttcgtcatcgacctcgagggccggcaagcaatcaatcacccaagctaagccatggcgcctcgcagccgcctcctcgacctcgagaagcacgacgtgctcttcttctacggcgatggcgcctaccaccaagagcgagcgcgtcagcgtggtcaccagagcgatcgccttctggccgtcttcctccgtcgccgccctgctcctcaacctcatccgcgccgttcccgcacgtggctgccgtctgcggggcgctctactcttcctccctcgaccgcgcaacgcangcgactgctccaactccgtggctttcaatgcactgccgcgccgccngnaagaggctctcgcccantatcggtgcacaacggcaggtatacgncnttcaanaatttaancncnatggtaacatatctcgtgcatcttctcgttgcaggttgtaattggatgctacaattacatgctaattgatgttcaatgncttactattaacttcaaaatggtgtgaanaatggttaacaaattcgctttaaaaaaaaaaaa

SEQ ID NO: 83377 - DNA, 244 bp, Triticum aestivum
  Clone ID: PAT_TA_83377
aaggaaggccgcgtgggtccttgcgttactcatacagtagtagtaatgtaaaaatatagaagcagcggtcagtctactctgctgttgctgtattatacaataaccacgtcgctccctccgtttgacttctccacgtgctgccgttgttgctcaggagtcaggagtctggacatgttcggttacatcggaactattctgaaactattctaaatgatcaattattatataaactaaaaaaaaaaaa

SEQ ID NO: 83378 - DNA, 632 bp, Triticum aestivum
  unsure (1)..(632): unsure at all n locations
  Clone ID: PAT_TA_83378
agtctccagtttttttttttttttttttgaaaagcaatgagtactgggggcatccattaaccgttttcattcatacattaggggaaatcatttgaaacaggatacatccataccgcgaaccctcgataagactttttaactttgatatgaaatacttggattcctctgttacacaagttctcactaggaattgaaaatatcctgttcactagaagccttttgaaatgataaggctaccatattaagcgtcactgatagtcacctcaacctccgacacctggttcaatagtgatcgangtgatctgcttgacaacgtccgggtgtactgacgaattgatnaccctcctggtgaatcctcatctcaaagcgattccaagtgttggtacttctccacanggaactcccgggtggggatgttggacacttggtaagatccgcacgggcccttgacttgactccttaccctggggccttaacaaatcccgcancttnctccaaggggggcccgtaccaatcgcccaaaagatcnataccgnccacggcgtcnttaaantctgacgggaaaaccgngttccaataacnctgagaancccttccantgggtanacaaaggccnacatnctccaattgnn

SEQ ID NO: 83379 - DNA, 170 bp, Triticum aestivum
  unsure (1)..(170): unsure at all n locations
  Clone ID: PAT_TA_83379
ntgtangacatgatccctnggannctggcangcccataggaaagatttttctctcanaccttattttcaaaaatatctttttcctctcttctnttatnatctttatcaanatantcanttttacttanancanacccctttccccttttgancacacnaagattcagctg

SEQ ID NO: 83380 - DNA, 612 bp, Triticum aestivum
  unsure (1)..(612): unsure at all n locations
  Clone ID: PAT_TA_83380
tctgggcctcgtccggtcgtccgtcccttcgcgcccctgaaattgtccgaccgcgtggcgactcgggtcggacggatgccggtcgacgtcgaggcggcgatggccccgccccaggcggcatcggcctgcagctcgtcgtcgataggcagggacagcgacgagtgctcgccgccggggaaggaggaggaaaaggggagggggaagggtgcagagcgcnacnaaggggaaggaggagggggcagcctcgctgggttggaggcattggaggaggcgctgcctattcggcgcagcatatccaaattctacaatggtaaatccaaatcatttgtgtgcctgaaagaagctataacattttcaaggctcctgcaaaaagacattactaagtcanganaatgcatactccagaaaacngganaactcnttcctaatcatcatgtatggaaanacatgaacacggnanctcaantttatgaaactgccgccctaanagcatcnatttnatanaaatctttgtgactnggtanaacattcaagagcagnacanntaacatnaaaacataangccagatctgatctcgcgtcactanggttaancccacacattggcctntt

SEQ ID NO: 83381 - DNA, 623 bp, Triticum aestivum
  unsure (1)..(623): unsure at all n locations
  Clone ID: PAT_TA_83381
ggaatatcggtccattgtcttcaaagagccacgctttgtcgagtatttccgccttgcaacccctgaaacagagtatggtaggatgaacataggaagcaggccatccaagagaaagccgagcggaggtatcgactcactccgagcaatcccatggatctttgcttggacacaaacgcggttccacctcccggtctggctaggatttggagccgcattcaagaatgtcctccaagaaggacatcaggaacctccacatgctccaggaaatgtacaatgagtggccatttttcaagggtgactattgatctggtgggagatggtgttccccaagggtatccctggcattgccgcactgttatgacaatcctcctttcaanaggactgcatccattgggtgagaactganggcaactattaagaaaccanaacttcncttcaagttgctgggnaaggatcttccggaagggactctactgaacaacggtccncctgcgtgagcctanncacaacctgaactctgcaagcctaacctgaacgttctntaccggcacattccgctngcccactcccaggattatggcccacaaggtcgngncngtaactacctgnacaaacacgggtng

SEQ ID NO: 83382 - DNA, 499 bp, Triticum aestivum
  unsure (1)..(499): unsure at all n locations
  Clone ID: PAT_TA_83382
ctggtcacaaggacgtccttgaaggtgatccttatctgaagcagcgtctgcggctgcgtgagtcctacatcaccactctgaacgtgtgccaggcctacaccctgaagcggatacgcgacccgagcttccaggtgagcccgcagccgcccctgtccaaggagttcaccgacgagagtcagccggcggagctgggtgcagctgaaccagcagagcgagtacctccaggcctgggaggacaccctcatcctggaccatgaagggcatccccgccgggcatgcaagaacaccggctaagccaaatcttccgtgtgcaaataactgtctccccatgagacggtggacgatatgtgttagcctgtggacatttatacaccgggcantgtttcctggagttttcatgtcagaccttctcctggttgcttgctgtnaatgccaagggacttattggtgttgaacctgatcaaanaaatnccaaacattttttgttaaaaaaaaaaaa

SEQ ID NO: 83383 - DNA, 333 bp, Triticum aestivum
  unsure (1)..(333): unsure at all n locations
  Clone ID: PAT_TA_83383
ggctaatcgacctattgttcacagccacgaggatcttgccaaaaaacttcaggaagccatggatataaataaaaggtcgtcttcaggaacaaggtcttcagatgtttctggcaagcggatgcgggaggtcgcatgcccaacctgcacggtccatcttcaggtcgaggttccagcttctggttcggagacgatagagtgcggcgtatgtcagaaccctttcctccgtcagcgcccgttgaaccgagttcagcggttcaggcnccttgcggcggattcttctcggattcgcaagcgaagattcgccctgttcaatcnaacctggcgcttgattcc

SEQ ID NO: 83384 - DNA, 261 bp, Triticum aestivum
  Clone ID: PAT_TA_83384
cctatcttacctgttcactgcagcccacagcgcactgccagcccatctccacaggagcttcgtcctcccactgtacgcgcgcatcgagagcctccacgtcgacatctgcggtgatttgacggccggagactgcccgagagccctatttagcacgtcctgtgccttgccctagacctcctctttccattcccctcctctcctgcctcgccgccacccaggtaagcctctccatgccaagtcgtggccatggccgagctgagc

SEQ ID NO: 83385 - DNA, 623 bp, Triticum aestivum
  unsure (1)..(623): unsure at all n locations
  Clone ID: PAT_TA_83385
tttttttgtagcaacaaagttcaatcttgtagactcgattactcgaatcgactaaaacatcaacatcaatttgataagtacaacagtaaacaagacaaacagctgacagcagtatcacattgaacagaggattcaagagccaaatagatcaaaacctccagtgcgaaacaatcggtcctgataggtcctcagtgtcgtcttattcagagcaccacccggagtataccagatgttgtaaatctgcaacacagntcagaagtaatgcttgtgtagaattcctccagaaancaagantccctagatccttcgaccccactcgtgcaccaaggcctcttgggccgtnacatactgcccaatccacatgatggcgctgctttgcatgttcgacnagttgttcacctcctcccgtcgccgttgaacagaacatacaacactgggggttggngactccggtttaaggttncctaacgatggccaacggactgaaagggtgaaactctcaggtgtaattccangacggggganaacggatccgcttaaaatnaaaccgggcnggctctcaacaggcattggggactnacgccgactaagcacnntcaaccggcggcgctcgtccgccgngn

SEQ ID NO: 83386 - DNA, 479 bp, Triticum aestivum
  unsure (1)..(479): unsure at all n locations
  Clone ID: PAT_TA_83386
tccgctccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgagganccggcaaggcctaaacagtcactcacgacaggcatatataaangccattgcattttgtcaatcctgacatgctttggggtttcctctccattacttcctaattgttccctaaagaaattgtatnccatgttcatgttncaaacaggtccnagaaanatctcctattgaagctaccgnggtagtatatcacggcccatatatatcata

SEQ ID NO: 83387 - DNA, 635 bp, Triticum aestivum
  unsure (1)..(635): unsure at all n locations
  Clone ID: PAT_TA_83387
ctgtcatgaagagaacaacactggtggctaacacatcaaacatgcctgtcgctgctcgtgaagcttccatttacactggaattacaattgctgagtatttccgtgatatgggctacaacgtcagtatgatggctgactccacctcccggtgggctgaggcattgcgtgagatctcagggcgtttgggctgaaatgcctgctgatagtggttacccagcttacttggctgcacgtttgggcatccttttaatgaacgtgctgggtaaggtaaaatgtcctgggaancccagacaaggaatggcatgtccacaattgttggactgtctctccctccctgggnggtgattttcaaaccctgttactcccgcaacctcnatatgttcaagcctccgggggttaagataaaaantccntccaaaggacattcccaccngtgaatggncattcccnatccgaananccaaagccttgatccttttacnagaattgttccaagttcatggatattaggnaaaacactgagngtncaaaggagacatcgaagaatgtcactnttggaaaatnccgganatcgcanatancggnaagaaactttnanaaatattgaaatgatcccaagaaattgcatcaaacct

SEQ ID NO: 83388 - DNA, 488 bp, Triticum aestivum
  unsure (1)..(488): unsure at all n locations
  Clone ID: PAT_TA_83388
tcaacttcgaggaggtcgacttcgacaggacggacgcggtggacaaggtcatggacgacttcgacacgtcccgcaacgacgtcgtcgaggaggaggagttcgtgcaggggatgaggaagtggctggacgaggccaggcgcagcgtgcccgtgggcggcgccttctccagcaagttcatccacgagtaccacgagaggacgaggcaggagcacgacgagctggtcgacaggtccgacgaggcggtggagagcgtggagaaccccgggtggtgcatagccaagccgtggcgctgctgctgctgggctccgccgccgccgccgcgttcgccgacccgctcgtggacgccgtccacggntctccaacgccacgcgcatcccgtccttctcanctcctcatcgccctcccgctcgncacaatccaacgagnctctcgcatcatcttcgcaacaagaagaacaaangactgtccctcactntccgaagtgtacg

SEQ ID NO: 83389 - DNA, 582 bp, Triticum aestivum
  unsure (1)..(582): unsure at all n locations
  Clone ID: PAT_TA_83389
gtcgtccgccgccaccaagccgaatcccaagcccaaggccgccccgaagaagcccaagaccggcgctaagaagcccaaggccgctgccaagaccaaagctaagacccccgccaaggcgaagcccgccacaaagcccaagcccgccgcgaagccgaaagccgtagtgaagccgaagacacccgccaagcccaaggccaagccagctgccaaggcgaacccaagaccgccggcgctaagccgaaccacttgctaagaaancggcgcccgccaaggcggcgaagactcggcaaggacacgccaaggaagaagcgccggtggccaagaatcccgctgctgccgcgaagaagccctgccaagaagccgtccctccnaagaagngggacccngtgcggaaangctcccgtaaggcaagaattaacggcaagaagggggcccatctttaatttgtaccgagagtccggnacatggcatcaatttccgaaccatactangtaatgnnatggagatgtttatacnactataatggngtgtttcgtaacggtgaagataattggaanttnancacctagtaaaaaaaaaaaa

SEQ ID NO: 83390 - DNA, 639 bp, Triticum aestivum
  unsure (1)..(639): unsure at all n locations
  Clone ID: PAT_TA_83390
cttttctcaaccctgagataaactacaatgagaagtcgtatgtctgcatgtacaaaataacgttggagcagttcaatgacatcttgtttcaggagaatcgtttagtgctggaggatggcaaagacggaaacactgtgtatcctgactctcctttgattggttcatctgaaatcaagtttatatctacaaacagagctgttcatcttgaacctattaaggatagctggtactccaatgtactttatcttgggaatgaggatgaagttccaattctaactatgacgtgccccgcatcagatattgagaggtataaatctggtgagctgcgtttagcacctccatcagagacgtatgcggccactccngataaagggactagtggaaagcaagcaaatggatgccggacggactgcaagctcacaacctgctgctgcaagancttgttaangngnttcacgtgngctttgtcagcaataagnatacaagntacactactgtancgtgggaccaagaaactnattgtcncaaanggnaantggtcaattaatgggaacatgatcancttccnactgatacnggaacgggttcctgctggttatcggaaaaaaacnttcggnncacnattggggtcaaggcccn

SEQ ID NO: 83391 - DNA, 603 bp, Triticum aestivum
  unsure (1)..(603): unsure at all n locations
  Clone ID: PAT_TA_83391
gaactagtctcgagttttttttttttttttttttttgcgtagctaatgctctcaattcagctgactataattcaaagcctcaactcatggaagatcatgtatgatttctacaatacataagcaatacacacggcgagtataaaatataatccacagcttcctcgtatggcatcaggttatagcagaactagaatctgtcaacgacaacgatgtgaaaaatccaaacaagcaaataggcttcctgtatcttccaatgggatagaactagtcgtcatccttgtaggggtatcctccgggacttgcttggataatttcacccgcatctcatangcatcatcccccgcgaacatgtcacgtaccattcactcctctcaaagacacatttcaatgccccctaataatccacttaacaattcatactgaagccttggaatgtcagggaccaacaaancaacaaanggtgtcttccangaatgctcactgtacctcaaatccaatggcanatncatcaaccaagaaattgagcaactgaanntgctccaanancanacaacggtcagtgtaccgaaaaaccttgttaattaaaggtaaaaangattancc

SEQ ID NO: 83392 - DNA, 565 bp, Triticum aestivum
  unsure (1)..(565): unsure at all n locations
  Clone ID: PAT_TA_83392
ccggagcgcacggcggcggcctcctgccgaccttcgcggtagcaagctagcagctagctagccgcagttagcgtctctttcgtccgtcctcctgcgccggccgtcatgaccttcccgctggtttgctactgcaacgcggtgccgcgccccgtggccgcgctgttcaagaccatccacgccgcggcgctggtggtcgtgctggtcctctgcttcctgggcctctacgattcccctacgaccccgaggaccacgcgccggtgatcaacgggcgggcccgcggcgggcgggaccccctgggccggagcgtgaagcggactcccgtcctcgattcctggactgatggtggtggtcctccctcntnggggcggagcggtccactccggtttcctnaagctgagcgcgacgggtcngggtggaaatcccangcttcaancgcctgannacgcggttactggcaagtactcccttgccccactgtcccgggcccgctctgatgncgttgnacgtataanccctctcgacggtttctcagtantntcctccttctgttagcccgaatggcggg

SEQ ID NO: 83393 - DNA, 617 bp, Triticum aestivum
  unsure (1)..(617): unsure at all n locations
  Clone ID: PAT_TA_83393
ggccggtcgctctggctctgccgctgctggccctcgtctgcgccctggcagcgtcggccgacgcgacgcagttcagggtgggcgggcagagtgggtggagcgtgccgggcgccggctccgagccctacaacacctgggcggggcgactccggttccagatcggcgaccagctgcgtaagtaggagtagtcgccaccgcgcgccgcgtcacctgctgctgctcatcttgggccgtcgtcgctgggtgcatggtgatgacgattctttgccgtgagcgtgttcagtgttccgtgttacccaaaggagacggatccctgctccttgggtggacccgccgcctacaaccctgcaaacctcgtcctactctccaagttccgacgacggcacacgtgtcaacttcgacgtccgggggctcttcttctcaacggaacaagcaactgcctnccaacanaactcactctctcctcccnacgtccgnaacgnacccgancancancgcccgctgcnaccgcctgctctgtngccccgactggacaacatctctngcactctcgcgtccgaacaaccactgcagtccacttactcgggctgccaaaanccaatccacggccntcaaan

SEQ ID NO: 83394 - DNA, 570 bp, Triticum aestivum
  unsure (1)..(570): unsure at all n locations
  Clone ID: PAT_TA_83394
attcggtttccggatagcttacctcacatcgacggtcggtgagccgttcgtgagtggcgaggcagtgcgtgcgctgcagcctgcagggcaagaacaggcgacgaagaagatgagcacgctggacacgcggacgctcaaggacgagctgacgagcatggacaggaagtgcctcgtggaccttggccacccgctgctcaaccgcgtcgccgacagcttcatccgcgccgccggggtcggggcggccagggccgtctccagggaggcctacgtcgtcaccgtcgaagggtttcaggagactcgtccgggctgggacgccgacggcggcaagcgggaccattctccaacatcaaagtgacgacggcaaaagtcgctccacgcagtggtaaaaacgccggtaaggagnctccaatgggggtttgnaaccggatcnatctgggtcactaccgctcnggaagcaagggatccacgactggaaaaaacgcatccangccaatnctgggcgncgtacctcacggtgagcggngcatcgacaactcgnaacttcatacgggcccttcaancggaactgtc

SEQ ID NO: 83395 - DNA, 571 bp, Triticum aestivum
  unsure (1)..(571): unsure at all n locations
  Clone ID: PAT_TA_83395
cgctcacacagcaaatacccacagtccacagcaagaaccgaagatgttcggaaacatcggaaagatcccgatcatcggcgacctgacgggcagcaacaagaatgcgcacctcaagggcaacctggtgctcatgcgcaagaccgtgctcggcttcgacgtcaccaagcatcgccggctccctcatggacggcctcggcgagttcctcggccgcggcgtcacctgccaactccgtcagctccaccgtccgtcgaccccaacaacgggaaccgcgggaaggtgggtcaaggaggcgagcctgggagcatggntgctgcacccgccgccggctgctggccggcgangaccattccgcgtcaccttccgactggggaagtgggagaaacacggctccccgggcncatcatcctgaaagaacaacaccctcccgattcttcctccaagacatcacatcgacnattccccggcaaggccatcgtcttngcgccaatcanggtgtaccccantaaatnccgtanaacgctctctttcnaacnnactactcccggggngatagtctaaactccatccaaa

SEQ ID NO: 83396 - DNA, 639 bp, Triticum aestivum
  unsure (1)..(639): unsure at all n locations
  Clone ID: PAT_TA_83396
caggcaaggccaagagcccaagacggtcggggcggagcgcgagaggcaggcgacgcgaggagaggaggcggtgctgtggtggcctcacctgccctgccatgattataaaaaataacggagcgcgacgcgggtagaaaccggaaggcccgccgctgcccgccccttcttccttcccgtcccacacacgccgccgccgccgccgccgccgctcgcttcctccaccccccggtccgcgcggcgcgggctgcctgcgcgaccagggaggcagggcacgcggcaacacgtggggaggcgacgacaccacaccaccctatgctctctgtcctcgcccgcagggtaagattgcagcagcagtgaatttgggacttgaagcttcatccgaagacatggnaaaattatntgcccgggntactccttcaatgcaacgatcctttcnnaaagaanccctgattgggtgtctaacccgtgggaacaccatctctcctctccgggngaataacatatggttaatcccnctatgnccaaacaacaggtgatcnaatttcngaantataaatccatcatgcaagacatcacaggtaanaattcaactcaccaaatcgttncgcccaatattatttctcgntcaactagnaanaa

SEQ ID NO: 83397 - DNA, 555 bp, Triticum aestivum
  unsure (1)..(555): unsure at all n locations
  Clone ID: PAT_TA_83397
gttgtttaataggaaaaaggggaaacttaattctgaccagaaaacatattacgatggaaagcttaaagaaatagagcagatttttagtcttagcaccaatgctgatgaagatggaccagaatctgacaaagggaagaagactgaatcagctgacactgatactgacgctgagatgaagaagttatgtgaatatagtgttcgcaaggctgctaagatggctgcagggtatgtgtatccttcattaccatgtggattcacaactagtatgttggtacttatatttagttttgtcaagtattgatgaaacatgtcaatttatagagaaccattttagcatgtagttgactaagatagatagcaactttttaataaaatgcaatgtatacatgatgaaacaacattacttaactttttgtgagacatttccatcaaatcggctctaaaaagtctcncatttaacttagacgtgattatactacactcgcagtcacacgccttgggtgggttcncaacnagtttgaacgaccanataggtggacatcnccagaggggtca

SEQ ID NO: 83398 - DNA, 300 bp, Triticum aestivum
  unsure (1)..(300): unsure at all n locations
  Clone ID: PAT_TA_83398
gccaacatgctgctgcccaagaggccgttgcctccgcatctcattacaatcccaagtttcacttatggatatcanccaggcagtccttggtattaaaccaacttaagccaaaaagcctaagcttgggggangtacaaaattctcacggactttacattcatgttcacacactagtcgtcggtgctcaaacncttcattgnattaccnagttaagtttaaatcaatttttccangttcctcctnggggnngtttgganaaactttaaggaaaaacnaaaaaaattagtaagttaattcccc

SEQ ID NO: 83399 - DNA, 580 bp, Triticum aestivum
  unsure (1)..(580): unsure at all n locations
  Clone ID: PAT_TA_83399
ccgatccccggcttctgcagctgctggcatgcaagcgtcctaatgagacacggttgagagcattagtcctctctgtcatgaagatagttcttgggcaatcttctcaggttttttctaccattggcggaatgaggtctcgattcttttttgctccagttcgacttcccagcaattgtgaataaaggctgcagctgacatagaaaatctcaataaatgcaaagataggaattgggcaactcattcacttgccattttctgtccatctcggaaatgagaggagaaatctgattggtagtaggtccaaactacttatatcctgtataagatcaccgatgcaaggatcctatctgaaactgatggtccgtactcaaactttggttactcacaacatatatatagagaggcaatacccaagggagataccacccggaaggttaacaactcaatatgtaacatcngctttgttaacatcangaggganacactagggatgatacatttagatatacacactagatcaacagtnacactaataatacggaaaggattnncaaccttgacctaatganacnacatcngg

SEQ ID NO: 83400 - DNA, 600 bp, Triticum aestivum
  unsure (1)..(600): unsure at all n locations
  Clone ID: PAT_TA_83400
agaccgagaagcaatctctcctccccccggccagccgaccgaccgaccgacccatggaccgccgtcctgctctcgccgtctctccgcgcccgccccgggtgccccgcccgcccctcgtgccagcctcctccgtgcaaacgcctccaggatcgatgaagaaggcggcggctccgatgcgcgcgtccgtctgcgcgatcccgtcgccggtccgcttcgagcccagcccgatgcgcgcctccatctccgtctcccgtcgccgattcgcgccgaaccgancctatcgcgcgcgcgttaccgcgcgtccaaccaacaatcgcgtcaantcgactggtgcttctcgcctcctccggnaagggcggcggcgacaagaaattctcctcgccgngtcctttcccctcgcaaggtgggttcnacaagaaactctccgggcgggcgagccannacactntgnntaactcccgcgatgcaagaancggaccnctggtgccctctntgngggaaantagactcanngggcccgaacaacggtaacgaagaagattccttatcnggantcctcgcgaatgcccaaaaangcaaacctttcctcacttaaccgnn

SEQ ID NO: 83401 - DNA, 499 bp, Triticum aestivum
  unsure (1)..(499): unsure at all n locations
  Clone ID: PAT_TA_83401
gtctcctccaggtaatatatgtctctcatgctttctaaagagtactactactagtatactgactaaactagccacctgccctgttatctgaatcgtgacactttgccagctgaaacttgcctgattaaagaatgatttctgataccgcggcggcaaattgatgcaagccacgttagttagtttaggatgcgtttggttgaaggtgtcatatgaatgggttgggaccgtccaattttttggggattgatccattcaatcatgcgtttgggctgaatataagagatgagctaattatttaggacgggaccaccaatcatgctcacatatcatgcaagcaaagggtgccattttgattcccaccgattttngttgggtgggacggttcaacaccttcaaggatatccccttttttgactttaacatcaagtgctttataaccaaacatgtcnatttttnggacattccaaccnatcnagacaccctngnacaaaccacctta

SEQ ID NO: 83402 - DNA, 195 bp, Triticum aestivum
  unsure (1)..(195): unsure at all n locations
  Clone ID: PAT_TA_83402
ttcatgaaatnttgacgtcatcataantttcatatttagagnantctacactancccaaactgttnnactctacnttgtgnttagcattaacnatattatctccactttacantatgaattatcacanntaattgtnantctagnatatggtctaggatagatagttttgctacagattatatcnttantattta

SEQ ID NO: 83403 - DNA, 615 bp, Triticum aestivum
  unsure (1)..(615): unsure at all n locations
  Clone ID: PAT_TA_83403
tccgcctccgctgcatcccatggcggccgtgcagcgcctcctccgggcagtcgcccccggtggctcggcagcggcggcggtcaggaggcgcatgacgtcgcttgcgccggagcaggcgccgtctgcggccgccgggttcccattcgcggcggagcagagagcaaggcggccggtggcggcggagaggaacgtgcagtgggtgttcctgggctgccccggcgtgggcaagggcacctacgcgagccgcctgtcgcgcctcctcggngtgccgcacatcgcnacggggggatcttgttcgcgacgaactcgcctccaccgggccacttctaccaacttgctgaaattggttatcaaggggaaattagttccngatgaaattacaataatcttttgtccaaaaggcttaagaaagggaagacaagggagaatcnagattatccttganggttccccgtcagtaaaacanncgngaaaaccttaacaattgtaancnacttcaatttgtcctttacnacaattgaccaanagcggtaatttnanttaaggtttctnaataatncggggttgggaaaaanaaantatcaangtcaannttcaatttngcatganaggnnt

SEQ ID NO: 83404 - DNA, 355 bp, Triticum aestivum
  unsure (1)..(355): unsure at all n locations
  Clone ID: PAT_TA_83404
cagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccaattcgttgacaagtacggngccaactcgacggtacagccatctacacgccaagaggaatggtctgatctggtgaccgctacgcccggnggaacnaccggcttcntatctgggcgtcaccttcgccngctcctc

SEQ ID NO: 83405 - DNA, 425 bp, Triticum aestivum
  unsure (1)..(425): unsure at all n locations
  Clone ID: PAT_TA_83405
gtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccggtgagcacaacgcatctcctgggtactacnatggccggtattgggcaatgtggaaagctgcctaagttcgggtgcaactgacgccacacaggtgatnaaacgaggtggaggangtcaagaaaggataacctgacgctttgtccgcaacaancggattcaaaaanatgcgtcaggtgcantgngcangcttaacggccttaagcaacc

SEQ ID NO: 83406 - DNA, 535 bp, Triticum aestivum
  unsure (1)..(535): unsure at all n locations
  Clone ID: PAT_TA_83406
caaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctaacccagcagaccagcaaatgctcatataccaaagggaaaaattctgaaaggatgagaccactttgggaaagcaacgggattgctgangaacactcccttggttaanaatgctgtccaaaggctaaaggatcctcaaatnggactccaacggctactgctngcaaaactcctnnaatccaaaccnaaactggtgccctgcaaancnanttttagaanactaaaaacnctgtncaaaactaaaangactccantggaanaacaaggggcccaatngnaaggggctnaacngatanncaattttaatnagganttcaacctttttaaggaa

SEQ ID NO: 83407 - DNA, 496 bp, Triticum aestivum
  unsure (1)..(496): unsure at all n locations
  Clone ID: PAT_TA_83407
gcaaaacccttcagaaacccatcggagaagaggcggagggcgatcggagagcgggatcatggcggggccagttgcggcggtgacggaggcgtgggacaagctcaccgtgttcctgtactcccagctctacgacgagaggaactgggccaaaaacaagaagttggcgaaggctcttgggtgtgttcgctggatccatcctgttcatgcgcacctgtggtgatatggtggcatctagggagccttcaaaattgcctaccgtgaactagagacaccccttttttgttggattggtgtttcttacttcggcaagggacagttgaagcgtatctaacccctagaacgtttgccttgcnnaaatcgcaaccaaaanattggcnaaagattantgcaatggngaattatttcacccaangcacattgcattttttttttcccnggaccatttgattccnggacatggaagggacccctnctngggtcccttaaaaaaaaaaaa

SEQ ID NO: 83408 - DNA, 554 bp, Triticum aestivum
  unsure (1)..(554): unsure at all n locations
  Clone ID: PAT_TA_83408
acgtggctcgctatgtcagcatccggtttgaacaaacccggttttgaatggtgcagacaagttatagcacctgtttttctggttctgagagttcggagacccaattgacacaatatatcaagttcgaggactgctgatgcattttaatcaaacggaaacatcaagcttttggggatagaagtagtaccgaagattgattgtggtgttatgcatgatcatggacatggagcatgttaaagtgaacctgttgtccnggaactggatcagtttcncngtaaagtgatangagctgggaccaagtatgtangntggacaattactngtanagttccccccttttaaactgacaaananattttggctgtaaacatnatccngtcggttggtgaanaacatgcagctttttaaanactgggttttttngcccggcnaaaataaacttgggttcccccaantctcccaangggcaaaggaacccgnaagtcaatttaatggccaaaaagggaanacaancgcnttaaaaccattaatngggaaaacaantttagncaatg

SEQ ID NO: 83409 - DNA, 243 bp, Triticum aestivum
  Clone ID: PAT_TA_83409
gcaagataggcactggtaggcagtgtggggtatgtttggcttttgtttttgtgggatcagtgttgttgggcaccttgggggaccagacatgtacgcttaccttttttatgaaaaggggacaaaaactttcctaaaacaggtgtatgccacgggatgctagggagcacacggttgctccctagacacgtccgttttaatatatctaaatttgccgtgaatgcaagattggtcaaaaaaaaaaaa

SEQ ID NO: 83410 - DNA, 598 bp, Triticum aestivum
  unsure (1)..(598): unsure at all n locations
  Clone ID: PAT_TA_83410
tttttttttttttttttctactaataaatgaatcatatagaacattgtgtttacagacttatgatacaacatgggcacatggaacacataatacaaaaaaattgcttctacctctcgggtattttcgatctacctctttgacccttgacaaaggcagacacagccagatgctccgaagcgtatgtcataaatgacgccagcaccacaccacccgctaccatcaacccaagttttgcaaaaatggcagttatgccgaggacggttggtgataatggtgctatccgtagagatggtaccatccccatccaaatangaaagctgaantgtgtcacaatcaagacgtattccccccggatggctgtgccatatgatcncccgatgaacccaaactggccatacccaacatgattttgcactaaacttccccatttgtnnacaaaacgaaggtaccccccgaacaaaaaaaagatgncacaaaggccancngaaatcagaanaaaccgtcaanggacnactgncggtgggaaaananggaggaatncnngaaatccatgnaaatgaanagctnccanggttgcccanatanaaggaatncnng

SEQ ID NO: 83411 - DNA, 427 bp, Triticum aestivum
  unsure (1)..(427): unsure at all n locations
  Clone ID: PAT_TA_83411
gaggtactatactttattgactttgtagttctaaattaatttccatggccttggttgcatcagaatcctataatatgtactgttcaattgttctacataaatgttgcttttgtgatcttagaaaacttgatttctttgtaacgactgtagcaccttataaaatatcagaaattatttattttttagactaccttgctattgtgtttttgtagaagtccatttgttgatctgacacatttaaagatcnttaggggatatgcctatanactcacccaacctgggcatccccaaaggtgttccaaggatcaacntccaatggaccanggtgtgcctccccnatgacgaaattgccaaaccggatccaaatcaagaaaaggcnangtnttcataaccgttcaacaatcaaatcctggaaggttgggcaaat

SEQ ID NO: 83412 - DNA, 582 bp, Triticum aestivum
  unsure (1)..(582): unsure at all n locations
  Clone ID: PAT_TA_83412
tgggaagcttgacctggcagctgaatgctacattaacgccctaaagatcggccacaccagagcgcaccaaggccttgcgagggttcatttccttcggaacaacagagtcggtgcgtatgatgaaatgaccaagctgatagagaaggccaggaacaacgcgtcggcatacgagaagagatctgagtactgcgagcgggagctgacgaaaacggacttgcagatggtcaccaaactccgaccctctgcgatctacccctacagatacccgtnctgctgtgctggatggacaacacaaggagaaagagncgttcccngagctgaccaagcgatttccttcnaaggnggcctgaactgtccaactgcgcgcggctttcnacnacacattcggngacatctccnangcctccggactgcgcncggcctccctggtggaccccaaccaccaggagatctggactcacaccggtgganaaccaagacatnacgganccgcatggggttatcaggactnatagaccctcanacnacccgccaacattttttgtcaaaaaacatnattagnatnaaanccttagtcccggg

SEQ ID NO: 83413 - DNA, 490 bp, Triticum aestivum
  unsure (1)..(490): unsure at all n locations
  Clone ID: PAT_TA_83413
ggagaatggggcaaagatggtgataatcagcaattcctctaggcggtcatctgtgacaatgaagaagctcaagagcctggggttcgacacgtcctgtttcctcgcgaccatcaccagtggggagctcacacatcagcaccttcagaagagagacgacccatggtttgctgctcttggaaggaagtgtatccatatcacttgggacgatcgaggggcaatttctctcgagggcttggtttgcaaattgtgaacaatgttgatgatgcagantcatattaacccacggtactgaactcttgggtcacctccgggnttcctccttcccaaaatccttgangacttgacaagttctaatgctttggcatagaaaacgacttccnaatggtggtaactanccaaattattcactgncgaactccanatntccgttcnagcctgggantcnggaanctaatataaatcttggggngaattnaatggntgggnaacc

SEQ ID NO: 83414 - DNA, 446 bp, Triticum aestivum
  unsure (1)..(446): unsure at all n locations
  Clone ID: PAT_TA_83414
ctaggagttaacatgcctgcaagggcagagcagacccctaaggaagatgaaagcaaaccgttccgtgaggtgtacgatgtggtcctctacctgggcatcattgacatactgcaagagtacaacatgacaaagaaaatcgagcacgctgtcaagtccatgcagtatgactccggctcgatctcggctgtggaccccattctactccggagcgttcctttgaacttcatccagncgtcttcccctgagaaattcgtactccatccaacaanaattttccctgggaaatgcccgcccantacantttgctganaattcatccaanngagancccagtnttccnaattttgncctttggacaaccnaaaaattggcccccttangtgtgcccgtgccttcccggttaancggaaggaaannggcaacaaaaaaancccttnngaatttgg

SEQ ID NO: 83415 - DNA, 597 bp, Triticum aestivum
  unsure (1)..(597): unsure at all n locations
  Clone ID: PAT_TA_83415
ggatcaatcacactcactcgcggccattgtcctgcccgtgcgtgctctgccttttcaggcgatcgaccaaccaacttctcgtcactgccatggctctgctctccgacctcatcaacctcgacctctcgggccgcaccgggaagatcatcgccgagtacatctgggttggcggttccgggatggacgtcaggagcaaagccaggacgctgtccggacctgttgatgaccccagcaagttccgaagtgggaacttcgacggtccagcaccggccaantccgggcgacgacagcgaatcacctttccctcgggcacttcagggaccgttcaagaangggcaaaacatactggcattgcgactggctacgaccgaacggggaccgttcccgacaacaagcggcgccgggcgcgaaatttttaccaccctgactcnaggcgaagacatggtccggattnacaaganaactctccanaagcacaatggtccgtttgcgcgggggtacctggctaaggactacncgcgcgtcgacggnatctacggcggganactggaccgacaaaggctgctcaacggatcaatatgataagggagcngcggg

SEQ ID NO: 83416 - DNA, 227 bp, Triticum aestivum
  unsure (1)..(227): unsure at all n locations
  Clone ID: PAT_TA_83416
cctgtattacctgcaaataattggtgcgttgtagncagtttgtttttcttcctaaagtccagattaacttgaaagctggcattgttgtatatttctgaacattatttagcataattgaaatttggactcgagtgataaactgcatatctgttgggtgttcctatacttggcactgtaatggaactacggcaggcaatgcagattatttttgttttgtaaaaaaancn

SEQ ID NO: 83417 - DNA, 631 bp, Triticum aestivum
  unsure (1)..(631): unsure at all n locations
  Clone ID: PAT_TA_83417
gaatatatgagctgcttcatcttccctaaattacagcgtggcacagatcgaccttagtttgttacaacatataccagatcgaccttagtttgttacaactctgtgcggagtagtatcgcactttgcagagagacaagcagataaatgatcagaataccagatcaccagctctctagttacagatcaccatcagtatattctcgaccatttgggggtttcaggaaacatccttgaaatccaactttgcgtncgtatacaccaggcagcaacaaaaatggctacataaagcctgctgctgggttcattgtatggatgggtcaacaccccgaccggtcatgtnngaaaccccgatatatgcgaggctgccgccgctccttctgtggtaaacaataagacctgctcctaagtctcccgtcctgacatcatttatgcgaatgttctcaaccatctgnagacaccganaagccctgtctagaaangagactttgtcaagtcnagtcngcggacacnangacaacatgaccctgaanagcacagcaatcatcctgccaagaaaagtgtcgccaaagtaaatcacatgatggatgaaggatgcacaacctggttacctggatgtccaagtcacattngg

SEQ ID NO: 83418 - DNA, 253 bp, Triticum aestivum
  Clone ID: PAT_TA_83418
ttatcctacatcccaaagtaacaagccaaagacttcgatgataggatagatgaatgacataagataaattatttgttcccaatttgcgatgtataaccgtgggaacaataattatcatgttgtattgccttttgtaattctcaccctgctatatcagagagacgaaacctcatacgggggtatatttgtatgagtatattctacaatgatgtctaaaacgagacattcaaatgttcttactaaaaaaaaaaaa

SEQ ID NO: 83419 - DNA, 407 bp, Triticum aestivum
  unsure (1)..(407): unsure at all n locations
  Clone ID: PAT_TA_83419
gtttctgcaaaatgctgaagggtcgggtctggcaccttttgactgctggctttgcttgaggggaatcaaaaccatggctctgcgggtggagaaacaacaggctaatgcccagaagattgctgaattcctggcgtctcacccgagggtcaagcaagtaaactacgctgggcttcctgaccatcctgggcgagctttacactattcccaggcaaagggagcgggtctgttctcattttctcaccggctcactggcctctcaaagcactcgtgggagaccaccaagtacttcagcgtaacatcacttccgggagcgtgaatccctcatcacctgcctgcttcattcccacgcatcatccctgcctcggccgcnaagagcgtngcctaaccgacaactcctccgggatatc

SEQ ID NO: 83420 - DNA, 599 bp, Triticum aestivum
  unsure (1)..(599): unsure at all n locations
  Clone ID: PAT_TA_83420
cgagttttttttttttttttttggctacaagaggaattttgttgatttcttagtacacagctcacaaaagagactcggtggagcttatgagaaacctcccgggacctttgttcctcttctctatacacaggtcctttatttctctcctcccgtctcccgcggcattaacttcaatacttaaaccccttactgaccctcaagctcaagcaagaatcttctcacccttggccttgggcggaggcgaancaccaaccatgtagaaggaacctcaagaagnttgtcacttcancgttaaggatggcctntaaggatttntggcnccttaaggcaacgacttacctcngatacantgaaaactgngcacatnaaagntggtcaagaaacctggttctatnggacgctccgacataactngcnggctcaaacantcatcataccanaaggcaatataccngaaaactngnccccggagatnngcngaacggtggcactcntatgnctgacaacaaccggggnncaacaacggactagaccaaggtnaaacgggtaatacaaccaggaacacagnannatggggtcatgcaaatggganggaagtn

SEQ ID NO: 83421 - DNA, 615 bp, Triticum aestivum
  unsure (1)..(615): unsure at all n locations
  Clone ID: PAT_TA_83421
tgccgtcggccctgactcttgggcacttggctgacgacccgttctctctctctctctgcaactgcaactgcaacgcaccaagaaactgccggcgatcgatcggggaaggagatgaacatggtgcacggcaagctggaggtcctcctcgtctccgccaagggactcgaggacaccgatttcctcaataacatggaccccttccgtgatccttacctgccgcacccaagagcagaaaagcagcgtcgcaaatgggagcaggaagcgagcccgaatgggaacgagacttccgtcttcaccgtctccgacgacacccccgcagtgcacctcaaaatcatggacancgacctcaccaacgacatttcgtccggcgaacaacaccccctgggagccgtgtttcaaagaagnaccttcccccggcggtcacccggccntcaaggaggagaattatgcggaaggcaantcgcntcacttaatcccaacaacggatcccgcctgatanacaagagggcgcttaagaacggattgtcnacgcaagggatnatgatatnnttcacaagaaaaagtatnatnatcaccagaganacatgtgcgtatcancncacacaaagttctatt

SEQ ID NO: 83422 - DNA, 234 bp, Triticum aestivum
  unsure (1)..(234): unsure at all n locations
  Clone ID: PAT_TA_83422
ccgggatcgaggccaccgtggaccccagcacgcaggtggtgtactcggagagcccggacagcggcgtgctggccgacaagtacnactacgcgatcgtggtggtcggtgagccgccatacgcggagacgttcggcgacaacctgaacctgacgatcccggcgcccgggccgancgtgatccactcggtgtgnggggccnccaagtgcgtantggtcctcatctccggcangccgc

SEQ ID NO: 83423 - DNA, 500 bp, Triticum aestivum
  unsure (1)..(500): unsure at all n locations
  Clone ID: PAT_TA_83423
cggcttccggccccgctcctccccaaaatcccccaaaacctgacgagctggagggccgatccgcggctccccgccgcctgatccgagcagtctactcggcccagccggggatccaagcgggatggggtacttgagctccgtgatcggccaccccaccgatggatcctccgtcagcggcggcggcctcagccaagaatggtagatttagctatggctatgcaagctcccctgggtaaaagggcatccatggaagactctatgagacaaaaattgattgtgtttatggtcagatattggccttttggantttntgatggcaaggtggtgcnaangnaacaaagtaagtttaagaaaactnttcaacaatcnttttantccatccaaantcacaatgatactnaancgctaatanagagcttataaaacaccgacagngatcctanaaccgacatatcaaaacaatgcggncaacnnatcaacgcttactgtggggtnccctc

SEQ ID NO: 83424 - DNA, 501 bp, Triticum aestivum
  unsure (1)..(501): unsure at all n locations
  Clone ID: PAT_TA_83424
ctccctaggaggacccagcaacacacacagccgagctttgcttaggcaagatgaacaggaagccaggagactgggactgcagggcgtgccagcacctcaacttcagccgccgagacatatgccagcgctgtagcgagccacgtggagttgctgatcgtggcggcggaggaggaggaggaggcgactacgccagcttcggtggccgcggtggtcctccttcggcggcggctttggcgctgctggtctgacgtccgccctgggtgactgggtactgctcctgcggcgcgcacaacttcgccaaccgctccaactgcttaaatgctcccgcctacaaagaagaggcccctgtgaacatggcctngcgnttttacggnacattnacntcaangggtacggttccggaacgtctctggtctggtctgnctcccgtatacaacgcccgttggatccngaacggtttgacaaatnnggtcaaganaaatttcaacaagatgatctaag

SEQ ID NO: 83425 - DNA, 653 bp, Triticum aestivum
  unsure (1)..(653): unsure at all n locations
  Clone ID: PAT_TA_83425
agccgctgggctccaacttctccaacggcgtcaacttcgccattgcagggtccacggccatgccgggagtaaccaccttctcgctggacgtgcaggtggatcagttcgtcttcttcaaggagagatgcctcgactccatcgagagaggtgagagtgccccgattgttgagaaggcgttcccagatgctatatacaccatggacatcgggcacaacgatataaacggtgttctccacttgccctatcatacaatgctccgaaatctccccccaagtaattgctgaaatcaaagaaancatccaagaggttgcacgagaatgggancaagaattcctggatacatggaacgggagcattanggtgcatgcctcaaaactttcctatccganggatgacgacagcgactcgatgacatggtgcacgcaagcattaataattctgcaagattcatccctgccgaatnaaccttggacaacnccttngacactgaaattcgacnactcttgggnganatttcgcnacaatatntctgttgcaacnancaaaatggatnaaaacatgatacatnttggcatggagcccttaacntgaccaagnaacgatattggaaaaccnttaacttggaaattaactggcgggtaatcgacnaatgg

SEQ ID NO: 83426 - DNA, 365 bp, Triticum aestivum
  unsure (1)..(365): unsure at all n locations
  Clone ID: PAT_TA_83426
agctgctgatgtanccaagcagattccagctggnattccaggtagccgggcnaacaactattaccgtgcaaatggncancacacgggnaacttccttanggaccgtccttcaaccaagggttcatgctgctcctgtnggtgggctcatcccctggggcnacctgtttggccggaaagtgatgttaactgatgggtgcctgcttaatgaacgancgatganttggcctgnatcncggttacccatntggtgaaaactggnaaatgtttgggtttcacaatttaccacctgggttccatgtnctcngtccggtagggttcantgtgtccaanctgactcccggcntngaaaccagttgccaaaaaac

SEQ ID NO: 83427 - DNA, 347 bp, Triticum aestivum
  unsure (1)..(347): unsure at all n locations
  Clone ID: PAT_TA_83427
ctccgccttcgctgacgaggacgagcaagcggaggaggaggagaagaagaagaagaatgagaacaaggaggaggagaacggcgacaagccagccgccgccgccgccgatgccgccggcaagtgagacggagacgcgagcgcgcgcgtgttgtcgtcgtgccgggtactgtgcgcggttgcagggcaccgttgcgcgacgcatctcncgcgtaaccacgcgtgaagatgcacgtatctatcgtctttctctgtgactttgtgttgcgtgtcccttttctccntttttttccttcaaaaaaaatgtattattacctgtatctatcgatccttgcatgtttaccgcataa

SEQ ID NO: 83428 - DNA, 535 bp, Triticum aestivum
  unsure (1)..(535): unsure at all n locations
  Clone ID: PAT_TA_83428
cgcaggctgggtgagcggcgcgggtcttcgtcggccggccccttcaccggtggcgagcatccaccagaccaccagtggatgcgcccctgccccccatgccccaggtcgagtcggccactgcctcggaggcgccgccgccgcaggacgcatggctcgtcgagctcggcagtcgcctcccgcagtgggagtcgctgcgggattcctccaaggtcattatcccgatttcaatatctanggtgaacatttgatgctgcaaggctagatgtttgagatgtcngccatgtttgaaagagcaactatcaaatgttctcctttngatgaaccaagatcctaatccaaatatgacctgaacttgatgcttcccttgattcccaacccnggaggtctcaatttggggctgacaacctaaccctnggaatcactggatnactgaggacaaaaattacgggaanaccacactgggaaagatttnacaagttggaagactggnttcnttccaaaanaattatggataacttgttggggcaatatttgg

SEQ ID NO: 83429 - DNA, 644 bp, Triticum aestivum
  unsure (1)..(644): unsure at all n locations
  Clone ID: PAT_TA_83429
gccaccggaaggtgctccgggacaacatccagggcatcaccaagccggccatccggcggctggcccgccgtggcggcgtgaagcgcatctcggggctcatctacgaggagacccgcggcgtgctcaagatcttcctcgagaacgtcatccgcgacgccgtcacctacaccgagcacgcccgccgcaagaccgtcaccgccatggacgtccgtctacgcgctcaaagcgccaagggacgcaccctctacggatccggcggctaagccacgccgaatcgaccccacaccaccagattngtgctagtaactactaatggtgtgttatgttccntgggttttggttaaatggccgcatcttgctgctgtattcctggccttgatgctgtttgggtgtantctgggtgggattgaatnnatggttacttgattctccngcgaaaaaaaagggggggccggtaccattcccctanatgatcctataccgcctaacggcctcgtttanaactctgacnggaaaactgggttaccaactatccctgcanaanccccttccaacnggntatacaaaggcncacatgccttcanattccactaaggaatggaacccttcggataccgggntgtgtaccactacgnaattcancc

SEQ ID NO: 83430 - DNA, 393 bp, Triticum aestivum
  unsure (1)..(393): unsure at all n locations
  Clone ID: PAT_TA_83430
gagcttttcatgtgttctctccattttcgattctccggaggccatcatttctgaagaattcttcattttcaacattcatctctcatcctccaaattcttaccggtgcatttttcaagtattctttagtcagctcgtgatctctttgttctattttatctaaattccctcaagtatcttcgttcattttctaattcctcccggtgattcattcctttccttggtcgttttcaattcctaacngtggttcgttcaaagaatcaacctcccttggaattaaanaattcccttggtaancgnattaattcaatcgttccttcnaaanccaaaacgggtgaattcntgaagattttccaaantttccccnaaaatnncccctaaccttgaanaaagaa

SEQ ID NO: 83431 - DNA, 598 bp, Triticum aestivum
  unsure (1)..(598): unsure at all n locations
  Clone ID: PAT_TA_83431
ccaactcccatctctcactacggcaacactttgcgagctgagccatcaaagctcggggcggatggcggggcggcggcagatcaagaaggagtgggtgcaggcggcggcggacgcggcgtcgtggtgcgtggcgctgtcgctggtggcgatgctggtggtggtgtgcacgcttgggcgcncggggaaaggcgggggcggcgcgccggtggtggtggtgcgcngcgcggcgctgtcngcgcggccgttcgaggaattacgtttggntggcggagggcgagacgctgcacaacatcaagcgacaagtgcggcgacctctcatccntgggagcggaacccgcacgtncacgaccccgacgactnctcccccgcctctcaacccgattangccgtcnaagccagtaatnnatgngattcacgtctcntgaacaaacanatccttgctactnctcgttctnacccctcggatatcccctactacaaacgttgnaatgncncaaagaccttnatcanagancattcgtaattctgaactttcaaactgcaagctcactcgnttaattaggncccaagctatataaanaattgtaaaaaaaaaaaa

SEQ ID NO: 83432 - DNA, 411 bp, Triticum aestivum
  unsure (1)..(411): unsure at all n locations
  Clone ID: PAT_TA_83432
ctgaatttgctctcagctgcagccacctctccccgtgccgtcgtcgcaggccaatgagcactagcacctcagctcagacagctcatacccaagagtacactgctcatgtcactgggatgtgaagtgatgtgagccagtatggttgcatgtgggagctggatctcaggaggaagtgtgctcaaggctgcaagtgtgctaaatttggtgtacaactgtatatcaccttgcctgggtctgaaatgttgcaggcacataaccctgggtggttatagggtttaactaattnagtccttacattagatcaanttgttgcaccatcaatcccactacttttgtgggttgttaaccagtaccacaactgtccccngatttggccgcatttgctccaactgggatgataaaaaaaaaaaa

SEQ ID NO: 83433 - DNA, 496 bp, Triticum aestivum
  unsure (1)..(496): unsure at all n locations
  Clone ID: PAT_TA_83433
gagctccaggacagggtaactaagtaccaggatgatctgagggacatggttttggagacggcagaaaggctggaggaccaaggcccggaggaatttctgaagggaatggattgaccccttttgaagccctggctctggggcctgggaggaatacgagtgtattatgggtcggcgataactcactgtccactccgattatggtttaaagatggggagccatcaaagaagatactttaataggctccggctgcatccatttcccttacaatcctttttggataattggtgctanccttaacccacctccaacatcccttttcccttccnaatataggtaataattttgggttaaaagggggaaaaaagaatgggagtaaacttgtacctttcgaaaaataaacgtcccantaacgttaaaaacatcctgatttttaaaccgcacaatngctttgatccanttatggtcatacccccgntccaaanaagcttgttgggt

SEQ ID NO: 83434 - DNA, 624 bp, Triticum aestivum
  unsure (1)..(624): unsure at all n locations
  Clone ID: PAT_TA_83434
ccctcacccncctccactcccncctcccangcgctgcncangtaagtcggcggcggcgatganaacgcncttcaataanaaccgcaagaagcgcggncacgtgtccgccgggcacggacgcatcggcaancacaggaagcacncgggaggtctcngtaacgccggtggcatgcancaccaccgtancctcttcgacaagtancatccgggctacntcagcaacgttggcatgcnttacttccataantcccgcaanaattctactgccacgcggtcaacatcaangctctgagtctatngtcccgccnacaaggcggcgaagccngctccagaaggcccncagattcaagtnacgcatttngntacttaaagggctcngaagggggtctgcccccaaaccattgttatcaaggcaactnactccaagncnccgatanaaattaaggataagngngcgttngctnacgctannttatcttttccctccggtttgaatcaaacnaacganatgttcngccaacaantgtttaaaaacttttttaaangtggtcctccgtgggatgttaaggnttnggcattnaaaaannttcanatananaaaaaanccaggggcggtacatttnn

SEQ ID NO: 83435 - DNA, 238 bp, Triticum aestivum
  Clone ID: PAT_TA_83435
tttttttttataggaaaacgacggaccatttaacgcacagttgcagattactattactggctgcagtgtaccatataatacccagggacaagacaacagtacatcacatagctagataactgcgaagccaaatacccgtctcagcgagaccaccataaatagagcttacacaacatagccaacatgcaatcattttagaactgaccagatgcaagaggcaggattctccaaggggggg

SEQ ID NO: 83436 - DNA, 508 bp, Triticum aestivum
  unsure (1)..(508): unsure at all n locations
  Clone ID: PAT_TA_83436
tttttttgacactaaggttcaccttaagctcacaacattttacacggttaataaagagcagggtgagggaggccgtgtggcagcaactgctgacaatgaataaacccccttcaacggggggaaaaatcagaacaaataatacacacatttttacaatgttaactatggcactcttcaacagtaaaaaaataataatcacgattttcccccaacccaatccgcaacaacctaccaatacccactcaaccaanttgatcatgtttcctanatccgtgggtcccaagaactttgtggggtanctaacaattaataccaacaattcngtnaaggccttaancncccaagagattactttnnccctnattgggtttcatgttctccccganatccnnggttggaggaaaactttacanacaggctgtttttngcnccacagggattcaaccatctaaacccngccncttttggggggtcccccnggaaattnttttngacagcnccccattgg

SEQ ID NO: 83437 - DNA, 590 bp, Triticum aestivum
  unsure (1)..(590): unsure at all n locations
  Clone ID: PAT_TA_83437
tcccgctccaagcaggacaagaactcgatcgtgcagtccgcggccgtctacatccacgagctcaaggtcgccaaggagcagctccagaggaggaacgacgagctcaaggccaagatcctggggcacgacgagcagcagcagtgcgtcaaggtccagttcgaggtggacgancctcgtcctccgtcgactccatgatcggggcctcacgcgcctcaaagagcatgaatgtcaagaccaggggatccactccacttgtccggcagcggtntacgacggagatgaattcnaaaccacgattgccgcctgcnaagtaaaaaagnaatttgaggagtctccaagaattnagaggatcaactgcctgacacnagcccgtttcccnggaacagaccgcctggctcaaacataaaactgcaaagtgttctgaaggttctaaccacaagancatgaaccaccgtcatgttttccctcccttttccccttctccgagaatggcaataaacncacaactatgtgcccnaccccgtctgtctgnggctttaagcgtaaattacacnccaattttcnatagtactgatatgntgaataaaaaa

SEQ ID NO: 83438 - DNA, 635 bp, Triticum aestivum
  unsure (1)..(635): unsure at all n locations
  Clone ID: PAT_TA_83438
ttcccgttcccgagggtggctacaagaagatcaccagccttgagatgtctgagcacgttggtatccgccacttcggtagcttcttgaagcaggtccacgacatgcttgatgatgatggtgtcttctttcttcagtacgctggtctccgtaaggcttggcaatacgaggatttcacctggggtcttttcatgaacaagtacattttccctgggtgctgacgcttctaccctctccggctgggttgtccgacaagctgggagggtaccggcttcgagattaaagcacatccgataccatcggtgttcaactatccngctaccctcctggaagtggtaccgcaactgggatgtccaaccgccacaaggtnnaggcaagtaccgcaagcatggtccgttanccggganactcctggcctacccaacacaactccccccaaggtatgcacttcttccaattaacccgggcaagaatnanccaccacgattaggnatnaaccattcgcataacgggacctgaaacgcgccgntcatcngggcaaanaaaantaaancccgatactgtaagatatnaagtaaagacggtaatctacctcaaccgaaaattatgaagtctaaaaagcanttatcnacctacag

SEQ ID NO: 83439 - DNA, 556 bp, Triticum aestivum
  unsure (1)..(556): unsure at all n locations
  Clone ID: PAT_TA_83439
agttttttttttttttttttttcacacacaatcacataacaatatttaaatccatagtctcatcaattacatcataaaagtctcatccatagtcataataagacacatctcatccagtactaataagagacaatatcacatacatagtcataataaatgtctcaagtatcaaaacacaataacatgaaagctcacggtcgccgatcaccatcaggttacagtgacgagtgatggtccgatacctccactaagtgaagagggttcaaacaaatctaacccgtcttctccgttcatgcgttggcaangtaactgngaggggcctgatgttcngtaagtggaatgtaagtgttggtggaggtgaaagaccaagataatgaacaaaggngtggtggtgggggcaccgggacgtgtaccccttnggccgtgcaattggttgtangatgttgcaatggtgaccggtgtacaaaatatcangttgcgtactgtgctcaaataacccgagncccnaattctccngggtgcccaatcgccggtntnaatgacnacggacncacaa

SEQ ID NO: 83440 - DNA, 640 bp, Triticum aestivum
  unsure (1)..(640): unsure at all n locations
  Clone ID: PAT_TA_83440
ctcccactaaaccctagatctctctctctagaatgccgacgccttcggctctcagcaagcgcggcggcgacggcggggacggcatcctggccgccctctcccgttcgcaggtggcggcgcacgggcgagaggcggcggccgtggcgaaagaagctgctgcggagcacggggaaaggcggcgtggattcgcggggacaaccttcctgggtgctggtgggtgccgctgatcatccgagatggaccgggagcagcagtcaacgacctcgagctgcagcagcagacgcttctgggcggggcccgccgccgccggnncggacaagttaatagatnccgtgcatccaccttttcgtccccccccccctctcnctctccnagagtatctgttactacaattcatcatccgantactacaattcaacattccnntactacaattcacatcnatccattnaggtaaggattacgatcgactgtttcgntggcntaacaaagagcaaacgcttgttgatttngtctcgatnaaacaattagtccctcaanaaaaaaaanaaaaaaaatcangggggccgtacaatncccnaagnatctntanccccaaggcgtgtttaagtnacngaacctggtacactannctgaaanc

SEQ ID NO: 83441 - DNA, 623 bp, Triticum aestivum
  unsure (1)..(623): unsure at all n locations
  Clone ID: PAT_TA_83441
acacttgattgattcagtgggtagctagctagctgaatcacaatggatcctaccaagttccgtccgtccagcagccacgacacgacggtgacgacgacgaacgcgggcgctcctgtgtggaacgacaacgaggcgctgactgtggggcctcgcggtcccatcctgctggaggactaccacctgatcgagaaggtggcgcacttccgcgcgcgagcgcatcccggagcgcgttgtgcacgcgcgcggggctccggccaagggttcttccaatgcacccacgacgtgacntcnctgacgtgcgccgactcctgcgcgcgccccgctncggccccttatcctgccttctcnacgtgattcacnaccgggtcccccggaacatttcgcgaccccgcggttcccgtnaattctanaccgccaaggcaactggactgctgggaanattcccgtctctnaaccgcgaaggannattcccgangtgtcangcgtnaaaccaacgcggtccactnnagatacgcggtgtcnaatctgngactcccgaanncngaacttttctcctcacactggnttcntccatacncaatgaggtcgntancttacttctaccgngaaggatattattntga

SEQ ID NO: 83442 - DNA, 459 bp, Triticum aestivum
  unsure (1)..(459): unsure at all n locations
  Clone ID: PAT_TA_83442
cgtgtatctagctttgaagctcttcattcancaaccaaggctcttccaccagactttgttcggttaaatcaagacattttatcccctcgagcaggaaagaaagagctgtacacanaccaagacacttgatttttgggaacagataaagnccccagggatgtctttgagatgctctggattatatctttctcggttccgccgtacctctcctcatcttttancctcangagatngcaaaagaactgccantactgtangcgangtgtacatccatccatcngccaaggtgcatcctacctcagngattggccccantgtttccanatcagcaaatgcncccgttggtctgggtnccaggcttatcaaatgcaaaattctatatggggntggacttatggcaaatgcgctgntaancatccaattttgggtgnaatnaaccaatnggnaaatgtcacgttt

SEQ ID NO: 83443 - DNA, 632 bp, Triticum aestivum
  unsure (1)..(632): unsure at all n locations
  Clone ID: PAT_TA_83443
ggcatatcagggtcgcacccgctcatacaagctgcccaaaggacgtttgtaaaccgccgcccgcggtccggtttattccaacaaaatctagagcaattaatgatatcggctcccgcttataccggacaccactggagtttgtataaacatcaacaagcagatgggatgaaccattggccgagttgctgacacagctcatacgggattatttataacccaccgcagtcacctcaacattctatggattcacatcgtgctatcgacgccaataatatacaccttctgctatgngtcaaatatggagaatctcaagacaactcctccgantcgtcctaagactcgggggtacaatgacatgactcaacaancttgccatttcaacaagctcaagaatccggttattggaggaagataaacggtccggaganacgccatattgatganatttaaggcgtcagaatttcggtcaaaataaatccgttaaanctggtcaaaaaaaaanaaaaaanaaaccaggggggccgtccaatccctaaggatcgtttaaccnccacggcgtgttaaactctacnggaaaccnggtnccactatncctgagaannccttccannggatacaaagcccccttcctc

SEQ ID NO: 83444 - DNA, 628 bp, Triticum aestivum
  unsure (1)..(628): unsure at all n locations
  Clone ID: PAT_TA_83444
cgcctacgccgcggctccggcgcccgcatccgtctcaggagtcccttctccccgcgggtggagacatcttgatcgtttctgagattaaactgatgatgctgatgctcgtttagttatcttggtttggagatatatcagatatgggtgatcggaatcatggacgctctctccctctactgctctatctacatcttttgctgccaatacttccgtttgctatggcagatatagcctccgagaagcaagcactctttgcttttgcctcngcagtctaccatggcaacaagctgaattggagccaaaatatcccagtgtgctcatggcatggtgtgacatgctcactggatngatcatgtatattggcccttanggtgccaaggtgctggtttgattggtaccaatcntgctgatactcttggcaagcttgttcccccaangttttaaacatgaggccaaccgtttgagtggaaccttcgtacatgttgtccactccttattaaagcatattgtcacacaanaaatgcagganactcctcaatnccccccaactannactgattcctanacncttaagncaatccacagttgnnanctacaaatntcgcnaattaanaaatccgtcgggcat

SEQ ID NO: 83445 - DNA, 478 bp, Triticum aestivum
  unsure (1)..(478): unsure at all n locations
  Clone ID: PAT_TA_83445
gccgacaagcctaactacgtccggtaccacgagcagctgctccgcctggtgcgcgtcgggggtaccgtcgtgtacgacaacacgctgtgggccggtactgtggcgcttccccccgacgcgccgctcagcgacctcgaccgcaggttctccgccgccatcagggaactcaacgtccggctttctcaggatccccgcgtcgaggtctgccagctcgccatcgccgacggcgtcaccatctgccgccgcgtcgtctgatgtgatgatgatccgacgaccaagacatatatcattccgctccgtcgtctctgtcatctttcaactgcctgcccgccgctgtccgctgccgtcgtcaattaataatgcatggtcctgttcttttttttttggactgcactgttgtgttgattnaacnccggcgatgtactgcaacaacgggatgaatgcaacacatgcgtgcaacnttactaaaaaaaaaaaa

SEQ ID NO: 83446 - DNA, 640 bp, Triticum aestivum
  unsure (1)..(640): unsure at all n locations
  Clone ID: PAT_TA_83446
cggcggcgaggcgtgcgatgtgttcgacggcgcatgggtacccgacgacaccggccgccacccgctatacaacagctccgagtgcccgttcgcggagcgcgggttcgactgcctcgccaacgggcggaacgacactgggtacctcaagtggcggtggaagccgcggcggtgtgaagtgccgcagtttgcggcccgcaccgcgctggagcggctgcgcgggaagcgggtggtgttcgtgggggactccatgagccgcacacagtgggatccttcatctgcatgctcatggccggcgtggatgaccccaggacggtcntcgangtgaacggaaacgagatnaccaaagacgatacgacacctggcggtccggttcgcgtcgcacggctcaccgtcnaattcttccggtcctgtcctcgtgcaagganacctccccaacggnatccccaaaaggncaaatcacttnaaggcggacangatgatatttaaccggaatggtgaatccgactacgattcaatacggggatggtggaccccacaaatgttgatagggtgcaattcggaagagtcctaaatagtaacacaagcnggtnagatgganaaactggccaggtcaaaaantgttacgaaaagtttcttcaan

SEQ ID NO: 83447 - DNA, 541 bp, Triticum aestivum
  unsure (1)..(541): unsure at all n locations
  Clone ID: PAT_TA_83447
gccgctacctgctcgcatccagcgccccgccgccacccctcgcggtgatctatgtgggcgacgtccacggctacatcacgaagctggagagcctctgttccaacctctaggccgcactccccgccgacgccttggccaccgcgctggtcatcttcctcggcgactacaacgaccgcggcccgcacacccgcagggttctcaactttctcctcgcgctcccgacgcgctacccagcgcagcgccatgtcttcctctgcggcaaccatgacctcgccttcgtggcgttccgttggggcgctgccgctgccgcccaaacggtccctgttctttgggcacctgcgcaacgccatctctctgtcctccctctctcgctcatcctccccaacgccctgcttattacgccattcttaagaaagattgatactgtcanaataaaagactcgagaaatnccgcggcggaatctggcatggggcacacaacacataatcnctaactcnacggatncctcnggtcggnaatctcggagaaaccctcgttctt

SEQ ID NO: 83448 - DNA, 197 bp, Triticum aestivum
  unsure (1)..(197): unsure at all n locations
  Clone ID: PAT_TA_83448
cggaaccctatangcggagcanaagtgagcctccacctccacccgccgccgccatggctctccgtcgtgtcaccccgcanaggagacccgttctccccctcccncgtgncttcttctcctcgtgccccccgttcantcngcccccgtncccggggaangancccgacgacgaccattccncgtcctcctcnccggca

SEQ ID NO: 83449 - DNA, 618 bp, Triticum aestivum
  unsure (1)..(618): unsure at all n locations
  Clone ID: PAT_TA_83449
gaaaaatcttcagcggagccgtaaccaaggtaaaacaattcgccggacagtttttggtctgacagtacaatatttcaggataaatcgccgccgctcgtttgagtaaacggaccaatcacaaaccgccaagaaggtcgctttctgctactgtgtgaacacaagataagtgcagatacattgatcgagtgcagattgaccaagtcagaagaaaataccaactgtgtgaacacaagataatctgaatcaggctatcaaatcacgaattgggacatcagtcaaattacagctatctaccggtcgtatctgccgtgacccaatcaacggcgtcgccccgctctaaaccgccatcgctttcgacgaaccaccatgtcagatcgccaccacaaccttgtcttcgatcgccgggtccgcctctgcgtgatcccccaagactcatctcgcgacttcatcacacttgttcgttgcnnatctctctgcaattgttgtgccgatcactcanatgcactccaaatcgcaacncctggcgtcgcctcgntcaagctaccgacctcaacgcgacatgcggtgcaacggnncaatcggtaggnaatcagcatccccgtgctacccgaacantgg

SEQ ID NO: 83450 - DNA, 587 bp, Triticum aestivum
  unsure (1)..(587): unsure at all n locations
  Clone ID: PAT_TA_83450
tcctgatccaggtgtacgagggtgagcgcgcgaggaccaaggacaacaacctcctcggcaagttcgaactctccggcatccctcctgctccccgcggcgtgccccagatcacggttaccttcgacatcgatgccaacggcatcctcaacgtctctgccgaggacaagaccaccggccagaagaacaagatcacgatcaccaacgacaagggccggcttagcaaggaggagatcgagaagatggtgcaggaggctgagaagtacaaggcagaggacgaggaggtcaagaagaaagtggacgccaagaacgcgctcnagaattatcctacaacatgangaacaccatcaaggacgacaagttcctccaactccccgctgaggacaagaagaagtcgaagatccgttgacggcccatcaactggctggacaacaacaactggctgagtggaggattcaanacaanatgaagactnaagggntttnaacccacatcnnaaattncaaggcaaggcccgnatggcctctctgatgataagatcccnncggtggacgtctgccaaatcagagggataattgtaagtcaggtgt

SEQ ID NO: 83451 - DNA, 594 bp, Triticum aestivum
  unsure (1)..(594): unsure at all n locations
  Clone ID: PAT_TA_83451
gaaaaactcaggtcactgtggaagatgtacctgagtaattctgatgcactgatctatgtcgttgattctctggacagagaaaggatcagagacgcgaggcaagagttccagaccattatcaaggaccctttgatggcaaacagcataatcttggtatttgcaaacaaacaggacctgagaggcacgatgagcacggacgaggtcagcgaagggctggggctgcacgacctcaggaacaggatctggcacatacaggggacctgcgcgctccgcggcgagggctctacgacgggtccgactgggcttgcgtccaccctgaagcactgcaagaatcgggcacgcgactcggtcgctggnccttccatctgattcaacgcaagngactcaatgcctcaaccaactgacacaanccacaagaatatctccaacgcaacgcatcctttggnggtgtggtgcccctggggtgnggattccttcgtccgtgttccgtgtggnacatataaccattgtcaccggaaggaccnntatttttcccccgaatgttgtaatgtgacggtgatccgcattgatttttcngggtcatgtgttgcactt

SEQ ID NO: 83452 - DNA, 606 bp, Triticum aestivum
  unsure (1)..(606): unsure at all n locations
  Clone ID: PAT_TA_83452
ccgagaattactggtaccgagtttgcgaaggacgagctgccaaagtcatccaaaggccttggtatgctatctggaagtccaagagactgatgaacattgtgactgagattgcaggtaggatggattgggattacgacggtttacatgttgtccgagggtggaaggcgcagaacaagcaaatgtatccaaacctggattccgacacgtcgcctgatgcgctcgttgataaggtgaccaagcttgttaagccgatgagagatctctacatcgcaactaatgaccatctataactactcgacaactcaggcacactccatgtccatttgcttgatgattacaaggactttgggtcaaacactagtgaatggtacaacgagacaacaacacttaatccgggcaaacaattccattcgaccctacatganggtgatgtngcactgagnatttacagtncgaagacacagttgagactcaacaactgacaagggatgcaaagatggnncatactgcaactgtgacacatgatnaccctcggatattgtgggtcaaanacctcaatggngganacagancatgggaccacaggttgcttgatcatntagtttn

SEQ ID NO: 83453 - DNA, 342 bp, Triticum aestivum
  unsure (1)..(342): unsure at all n locations
  Clone ID: PAT_TA_83453
gttcggcctcttcgacggcgtgcccgtctccccgggctcattcgccatgcattcctcagcctccgcgagaggaggacganggctcctcttgccggcggctgcggcggcggttgtggtgctactgttgggtgcagtggcgccagcggcgggttgctatccgcncgtgttcaacttcggggactctctggcggacacgggcaactacncgttcgtctatggcaacgactcagccaanctccngncaccctacggcganaccttcntccaccgcnccaccgggcgcgcctctaacgggcgcctcatggtcnacttcatcanggacacgctccgtctcncgttcgt

SEQ ID NO: 83454 - DNA, 591 bp, Triticum aestivum
  unsure (1)..(591): unsure at all n locations
  Clone ID: PAT_TA_83454
agtctattcccattgccggtcgagatattacctacttcgttcagtcccttctgcgagaccgaggcgagcccgattcttcgctcaagactgctcaggaaattaaggaggagtattgctacgtgtgtcccgatatcgtcaaggaattcagcaagtacgacagggatcgcactcgattcgctcagcatgtcgtgtcacaccccaatggccgacaggtttccgtcgatgtcggttacgagcgcttcctcgcccccgagatcttcttcaaccccgagatttacagctccgacttcttgactcctctgcccgtggttgtcgacggtgtcattcagcaatcgcctatcgacgtccgacgaagtctttacaagaacattgttccttctggtggaagcaattgtacaaggatttcgggcgccgattacaggagacatcaagcaactggtagtgccagaattcgaccancaagtcccaacgtggtgccctaccgtggncggactgtcgttacacccataacnacacaaacgtcctggttgaggatccctggtnaacccgattcataacgcatcaggcantcagaaatgccacattgcaaat

SEQ ID NO: 83455 - DNA, 587 bp, Triticum aestivum
  unsure (1)..(587): unsure at all n locations
  Clone ID: PAT_TA_83455
ctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctccgccgcgaagttctggagttggcaaggaacgccgcgaaagacaacaagaagaccgcatcatcccgcgccacgtgctcctggcgattccgcaacgacgangactccggaactgctggccngctcacatcgcgcaaggnggctctccccaaacaccatccgtgctcctgcccaagaaggcgcnganaagnggcaacngcggaacaaggaccaatcccccaagaaggngcaatccccaagagntaanaataggtctcattgccgtgtcngtacagtctgnaaatcgtgtggatttctccatactctgntcattagtcttn

SEQ ID NO: 83456 - DNA, 560 bp, Triticum aestivum
  unsure (1)..(560): unsure at all n locations
  Clone ID: PAT_TA_83456
tctggcccctcaccgtctacttccccgtcgagatgtacatcaagcagcgccgcgtgccccgcggcagcaccaagtgggtctgcctccagacgctcagcgtcgcgtgcctggtcgtctccatcgccgccgccgccggctccatcgccgacgtcatcgaggcgctcaaggtttaccacccgttcagcagttaattcttgctgctgtggatgtgctgggtggggcctggcctggcctgggtttggacgtatgtgcatgatgcattcattgcgttgcgttcaactgtggtcaacaagggagggagacagatgcagatcagtgtgagatgtttgcatggaggccctatagaaacaagtgaaatttaagccccttgtgcaatctggtcgcattccttgcaagaatacaagggtggggcagaatgcataactggtgtcctttcnaatcctctctcttctccctcctctcttaatacatttctttaagtgtttctcnaataagtccggtttgtantcacgtcaaccatgtacggaaaattnnacaggaatccatanaaaaaaaaaaaa

SEQ ID NO: 83457 - DNA, 606 bp, Triticum aestivum
  unsure (1)..(606): unsure at all n locations
  Clone ID: PAT_TA_83457
ttcnaaaatcccatcgagtggagaacaaacctcccactcggaggcttagctgcagcccaacactcgcctaaacatgacnagtacaagtcgattgcaatttgtgcttcgtccctacctgcaaaagagcatcacataccctagtgtatattccaacccaaggatgatgattgtttgaaagcagaagcaaacatattcaacggcaaaccaatttcggatagcatcctacggatccaagaagcgctcaggcatcacgcctgttaaggtttatcaagttacaaaaatcactccggcattccgangcaaattcaaagcatcaagcanagaattttttancctcctacggatggctgggaacgcgcaacaaaccctccaagtcgatcatctgcgattccgaagggcatcagnatgaaggctccatgaagntnagaatcagcttcttggtgttggcacttnagaactccaactttcctctcgcgcatcctgcagggaaacggacaangataaacaactcggacgcattgnagaaactctcatcntgnatcaactggantngtcatcagnntaaggancaggtgtcnaatgctccctgcanacncttcagttact

SEQ ID NO: 83458 - DNA, 572 bp, Triticum aestivum
  unsure (1)..(572): unsure at all n locations
  Clone ID: PAT_TA_83458
caaattcgaaggtggttgagcatgccagaaatatgtcctcgcttggtttggaaggccaatcaattttgcagagaagagctgccaaattttctttgccaaatagtgatatccatatacggagtaatatatcttgtcctgtatctccatgtggaagtcctcttctaagatcaagatctccacagcatcaaaatggtagaatgtcaccttctccaatttgcagccccaggactacttcgggtgcttcaacccctctgactggtggtagtgggagctgttcctttaaaccatgtgangcaaccaacttacagaaatganggttcacggcacacaagangtttgatgacacatcctaaccngctgttgatncatacaggacttttatccaatgcacatttccctgggtccggaagaaaggtatcncgaattgacatccgacnccaatatggaagataacatcaagttgggncccatgatagcatactcgacgtctccaaaatgcttggaacagnaacaaactcacggctaatggcccgnaacgggaacagcatatcgtcaantaggtactcancgnn

SEQ ID NO: 83459 - DNA, 493 bp, Triticum aestivum
  unsure (1)..(493): unsure at all n locations
  Clone ID: PAT_TA_83459
gccggccaggcgagatctttccacgcccagccctaccatggtacgccctccccgacctccataacaaatcccgtgctgcttctgcttgcttttcgtgactggagtcggatccttccttcccgggtgcagccaaggtcggcgtggtggagttcctgaacggcgtcgggaaaggggtggaggcgcacgccgcgaagctggaggaggctgtgggcggcgacctccagagctccttggaggccgcacgctgcggctcaaagaantccggcacccctgcaagcatagaaaatgatttgantttgcacacaanaccnccttggcccctggaaccccaaacaagaccaagaaanttaaantggtccttccttgaaaatatcctacgttggactgaggatgttggggaatngatattgcttgtaatttagaactcaaactttgtccccgtcnccaacatacttattgcnacattaccnaaaaaaagnccaagaaaatccaa

SEQ ID NO: 83460 - DNA, 545 bp, Triticum aestivum
  unsure (1)..(545): unsure at all n locations
  Clone ID: PAT_TA_83460
tgacaagggcgtacgggccggtgtggagcacggaccgggcccccgccggcccgctgcagttccgcgcggtcgtcacgggcggctacgacggcaagtgggtgtgggccgagcaggaggtgctgccggccgactggcgccccggccaggtctacgacaccggcgtccgcatcgtcgacgtcgcccgggacgcatcccgcggctgcaccgccgccgccatggacgactgggaagtgaagtgaggatatggctgggtaagattaaaaatacgtatgaatacatactaacacgtcgccacatccggtgctgcgacactcctgggtaagaagangacagcatgcaatggtccaagaacacacccccccaaacgcgtccggctnccaagangagaggaggaagaacattggattactacaactangtgtnattgtgtatcagtctccaacaaggccntccgattagatcangaaaaaaaagactggatcatcgnattctaatgggncatggtcatcaacctggcttacacaaacnacaaaacaaaggaaaat

SEQ ID NO: 83461 - DNA, 426 bp, Triticum aestivum
  Clone ID: PAT_TA_83461
gcacgacgaaggccatggccaggacgacgaggaggtggtggtggaggagaacgtggtcatcaccgcctacgccaacagcaactaccaggccgtcaacaactcggtgctcgtcgccggcagctgcgccgtcgacgaccccggcgtgcacgtcgtggtggtggagcacgtcgacgagatacgcgactacgacgaggacatcgacggccaagagttctaagcactgtattgttattactgcattactgcaagctatatggatggattgaagggcatatatatatatatatacctgcatgacaaataatatatatatctatgtactatatatactacatatacattacatctacattttcctggatcggctttgtactggtactactgtaagttgttaattattttgatgcatgctgctacttgaataaa

SEQ ID NO: 83462 - DNA, 608 bp, Triticum aestivum
  unsure (1)..(608): unsure at all n locations
  Clone ID: PAT_TA_83462
gtttttttttttttttttttctaagcaaatgaacaaattggatcatactcaagatatcaaccaaacagttttggggaatagcaacaagcctggttgccgccgcatcctcggtgtctagatcacaggaaccattctggtttgtgccccaatacaaccagccaacttggttcattcatcatgtcctaagcaatctatgcaacacaattacaggcctcaaaaagcggcattctcccttgtgtcgaccagcttcagccacgaccacggcccccacctttgttaccacctttggcaccaactccaccccttccacggccaccactgcctctacctccatcatcttggccacgtccaatgcctctgcctccaggtttaacaccgacgtccccccttcctcntccacgggcaacacctggtggcttcctatctgatcggctttanaattcctcctgaactgtcaatcactcacaggaacccaagatactaatggtgttccgcgatgtacacccggaacctcaaaacttacgtccttgaggngaaataaccctagaggtgtcatcacntgtncaatgacaaagccgttgtagtccacatctacncacacatggggc

SEQ ID NO: 83463 - DNA, 424 bp, Triticum aestivum
  unsure (1)..(424): unsure at all n locations
  Clone ID: PAT_TA_83463
tagaattgttcagacattcttgtacctatctctaattgttgtttgaaaggcatgaccttagtgggttttcccaaataaattttctttcattagtgctttgtcattattaacaacttgtaggagaaggtgaaaccggagaatgaggagatgtggttgttcatggacgacagcatcaagaaacctgcaacatgcaacctgattttaagaaatctgccacctgcaacatgactgggcatgggatctcctgagatatatgtggacaacggcaaagaatactatgcatacacaacaaaagancctacaacctgatttnanccatttgtncaaacanccttgggaccattaccccttgatttngaactgatgtgcattttattttaagtcattttaccggatgcattaattcccaaagaaaaaaaaaaaa

SEQ ID NO: 83464 - DNA, 659 bp, Triticum aestivum
  unsure (1)..(659): unsure at all n locations
  Clone ID: PAT_TA_83464
tgcgcgcctcgactggtagcccgaaccctagctagcaggtcggaggcgagagagcagccatggcgcggtgcctcgcgctcgtctccctccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatnccgcgactgcctatgatgtgtcacttaatgacgactcttgggcaacacaacatttgagctttcaactgggagaaaaatcgaagacattggaaagnttgacctgggtgcaatggtacacaacatatttcctggagaacaaaacacaggnaagttcaaggttaacaactatatacttcctgttcccanaaagntgtctttaaggaggctaacaatccancttccaanggtatccccctganaattccganaaaattttaatgggcaaaagnttttgcaaanaaggtcctnggtcgttgtccaattgttggatgttacaacnnttgaaacctcaaaacantaaaggacanaaaaantgtnactaantcgncanttatttccgggntttccgagaacctganttntacaacttaatttatnnccacanatgacantg

SEQ ID NO: 83465 - DNA, 282 bp, Triticum aestivum
  unsure (1)..(282): unsure at all n locations
  Clone ID: PAT_TA_83465
attaaaggcaagttcgggggctactgaggaagtcctgaattatggggtccccgggcgtccgggctatgtaacatgggctagatgatgggccgcaaagatacaagatagaaggctttcccccgtgtccggatgggactctcctttgcgtggatggcaagcttggcgtccggatgtgtagttcctttctttgtaaaccgactttgtaaaacctaaccccccccggtgtctatataagccggagggttatccgttaaagntaacaaaacatacatgctaaactct

SEQ ID NO: 83466 - DNA, 452 bp, Triticum aestivum
  unsure (1)..(452): unsure at all n locations
  Clone ID: PAT_TA_83466
ttcaaaagagaggaagcaccaccaggccgcgcgacggagcaaaacgaaacgcggcagccagcacaacccagcagagcgcgactcgactcgaatcgaatagtcccgtcctttcggttctacctttccctcccgcgccgccgcagccgcctccagggccgcggaaaccctagccacctcgtcagtgccgcgcgccgggtgtctcgccgccgcccgtcactgccgctgacaccgccggagcgatcggtntccgagaccgtcaaggagacacgatggaggattgggattcctgaaattccaaccccgttgctccctgttgtgaaanccaaccacttaaaatcaatgggctgatgaaatgtcnatcccgacnacntaaaattcatnggaggaagaaagganagggaactaacaacgtgttaaaanaccacaactacgtaggccgctaaaaaggaaca

SEQ ID NO: 83467 - DNA, 530 bp, Triticum aestivum
  unsure (1)..(530): unsure at all n locations
  Clone ID: PAT_TA_83467
gtccctcttgacagttttccttgaataaaactcttccagcaaggcccgactttggttttaccatttgcctaataacaactaaaatttgcatcaggagtaattagcccgaggattcttaatcaacaacacgggccagtgctcatgagtgttggtcaaacctgtcaaccaccggtagccgccaggggcacttctcgattggcctactagaagtttggacaatccgattgtggcctgagatgaggtacgcgcggccactatcaaggtgtcngcatgtcnggaggcctgctggtttgttttaccaatgtccgaaatacctgtgcacaaagatccgatccgatncggagggcccgccatggagattncnccccggttcgtgacttgtcaatggctaatttgggaccccctgnacctttaanctttcnagaccctaaccacggttatntggnaaagggattttaanacccggtgtaanaattgcataaccattaaaagtcaacgcngtgtaccgnaaggcncttcacaagtcggaa

SEQ ID NO: 83468 - DNA, 622 bp, Triticum aestivum
  unsure (1)..(622): unsure at all n locations
  Clone ID: PAT_TA_83468
aaacattcgaagccgtatctgggctgactcaataaaaaaagaaacaaactgaactaaagcttgaattaaagatacaatgatgcatcacggcgcgggaagggaaagcatcaaggcagcgggacggtcacaacaaacgatggcacaactaaagatgatggggcgacagcgagtaagccgccggcgtggcgtccaccagcgggaccatgcacggcaccatcgcgcccccctccccggaaacataatacagggcgtaaattgttgcaccccgagcattgacgatggttcctgtcccgtcaacatatccaaggacccatgcacatgtnagacggactgcttcgctgaccaacggggatnccactctccccaagacggngccnaacggacatggttcttggacccgtggttctctanatccttcaaatggatgacaactgccncttccaanaaacacaacattaacaaggttgcaactgtcactcanaaaccggcggaancattacaagttcancantaaacattcaagtcaggtgaaccagatantcgtgatactcctcanctaaggaatcttcagtctnatccaggcattaatgtagttntccttanacnctcagatcccngggcg

SEQ ID NO: 83469 - DNA, 241 bp, Triticum aestivum
  Clone ID: PAT_TA_83469
ctccagggcatgccatatgagggcatgcacgtacggcctcggaggggaaccagaaaattatgttaacaaaataatctggaaccctaatgtatcagtgtcatcatcagtgtgtagtttaagctagctttgctatggttacgttctttgagatgagagtcttgatgaacagtaccattctgatgtattgctttccttgaaattaatgcatgcttcttacttctgtctagctaaaaaaaaaaaa

SEQ ID NO: 83470 - DNA, 639 bp, Triticum aestivum
  unsure (1)..(639): unsure at all n locations
  Clone ID: PAT_TA_83470
gccactgttagaaggaagggcatccctgaaaaggatggtctggaaagcacatatgctgtattcactgttgaagaaccgaagaaaaaaagtggagcttggatcaagacagggggcaagaacaaaaaacatcaccttttatctagcatagttggggaaataaaggttgcgcgtcgaaaatcaagatgccaccatacaaccgatgttcatgtacacagggaattgtgttggttggtccaaattctaccatcgtctgaagaacaggtgattcaaatgttaagtgggagacttgcacttttatcaacacacttcctcaacaagaagcaaaaactcgaacatcatctcacagaataccaagcaaagaatcaatgccaattggctgtggttccccccactgggaatttcaaccctaacacaaaangcnattcncttaaccaatgttttgcatactcccngaggttcaaggnacaatacactggcaccatgccttgatnaaagnggagcaagaagacttttacgttgcgatgganaagtgttncaantccacgatntcaaaaatgncntcagnaacagcaagtggaacnaaattgctcaatnggcattcaanagnagctntagctctaaggnttantgatatacatn

SEQ ID NO: 83471 - DNA, 534 bp, Triticum aestivum
  unsure (1)..(534): unsure at all n locations
  Clone ID: PAT_TA_83471
gacgtcaccaccgtcatcccctaccatgtcaacctcaccaaggcaggatacagggcgcttgtgtacaacggcgatcatgacctagacatgaccttcgtgggcacccaagagtggatcagaagcatcggctaccccatcgtcagcgactggagaccatggttcgccaaccgacaggtcgcagggttcacaagaacatacgcccacaaccttactttcgccactgtgaagggaggagggcacacagctccggagtacaggccgaaagagtgtcaggcatgttggttcgatggacatcaagaagcaagccaactctgatgaatgtggtgaccgcggaattaacaaattactcntcnttggtgtctctcccttcgaattactcatatgttataataataataagacnggtttaatttgatcaatagctagggagaggaagcacttgtatactttgggtaagacattccacnctgtgggtccaagacatccatcaacaaatcggttaccgacattaaaccatnctataaaaaaaaaaaa

SEQ ID NO: 83472 - DNA, 549 bp, Triticum aestivum
  unsure (1)..(549): unsure at all n locations
  Clone ID: PAT_TA_83472
ctgactagaactagtacgtagatccaacactcgggacgaaattaaaagagacnacgcacatcaaccancaggcatcgcgcggtcaccaccatggcggcgcagganggcngcatgaggctggtgtcgcacccgatcgcngcgcacgacgggcggctgccgcggcagtacacngtngatgggcagggcgccaagaaggacatgtcgccgccgctggagtggtacagcttcccgatggcgcgcggtccctggcgctgctgggtgcaagacatcgacccgacccagctgctnttngacccactgngtggtggcaacatcccgcccgccaccaagggctccccnaggggtctcncgcgccgcgggggcnggccnctacaactccggcggctncaagaagggtcaacnacgggacaccggctgcncggcctncngcctccanggcacgatcatnaactctanccnccatacaagtgactccgaacaagngccangataccatgngnattacggcctctggaaaaccaactntccctgtcaagaatctncacaata

SEQ ID NO: 83473 - DNA, 339 bp, Triticum aestivum
  unsure (1)..(339): unsure at all n locations
  Clone ID: PAT_TA_83473
gccaaatattggcagcaacgttacagcctaaaagaaggaattcctagtttccttacgaatgttgccgcaacgattctaacaacagggaagtatcttaatgttatgagagaatgtgggcacaatgttcaggtttccttgtcagacaattctaagcttatgagctttggctcaaaccaccaatatcttgaatgtataaaatctgcatatgattttgcaagtggtgaattgttgactcctggatgaaagataagtatgatctcatccgggaaactccgatccctgaagcgctatctaccccttggaccaaggtgactttttggnccattttatgggatattg

SEQ ID NO: 83474 - DNA, 638 bp, Triticum aestivum
  unsure (1)..(638): unsure at all n locations
  Clone ID: PAT_TA_83474
ttttttttttttttttttggcacaaaaacaataacaccagaagaaaacaaaatgtctgcttgaatgtcaacaacaacaacaacagcgtgacctcttaactacacacaagaatgtttctcgtcaagcattcaacatgtacaccaccaaacgcctgccttggaagcgatatcagtatatacagcagcagcagtaggctttacaaactttccgaagacacactacacacttgatagagcgagaggaccaacaacactgggctgactttttcactttctgctccggtctgacttgggaaggttccttaggtcccgaagcaaccggatgacttccttaagagcgtgncggtggccggtactgggaaccactcctccgccttccaggactcctcaacgcgttttgcctccaacancgctcgctctcttcggttcctggntacatggaacttgtcctcacttcnccgcatatcactctctttcaattgttcccaactctcattaactccaagttgcttcttgggtttcccangaaganacgntantctaaaactgtccactttgctccatcctccaacntgataanantcctccgttcacctcanacaatccgtatgaccctgtcaggagttcgacagtacgatt

SEQ ID NO: 83475 - DNA, 642 bp, Triticum aestivum
  unsure (1)..(642): unsure at all n locations
  Clone ID: PAT_TA_83475
gctgtgcgcgcacccggcggtgctcgaggtctcggtggtcgccagggccgacgagcggtggggcgagtcgccgtgcgcgttcgtgacgctcaaggacggagcagcagccgacgggtcggacgaggcggcgctggccaacgacatcatgcgcttctgccgggagaggatgccggggtactgggtgcccaagtcggtcatcttcgggccgctgcccaagacggccacggggaagatcaagaagcacgactgagggcaaagcaaagactcggccctgtnaaagaagacangtgttagaattntnggggccnacggcgatagcgtgtgatncatggcaacaactccaanaccttgctccaattcgcgcatataaatcaatgantcntgaaatnccaatacttangcttgcttgtannttccgnaacaagattcaaacaattccgattataattnnaanaaaaaaaaaccttagggggcccgtaccatnccccnaaatgatcctttaaccccnacngcctcnttaaactctgatggaaaactgggttncactaatccctgagaaacccttccactggtatacaaaggcnacnttccttcaantccaccnatgaangaccccttcggataccgcgttttgacccctnc

SEQ ID NO: 83476 - DNA, 639 bp, Triticum aestivum
  unsure (1)..(639): unsure at all n locations
  Clone ID: PAT_TA_83476
ctgctttctcgaaagccaagctctgatgagttaaaggctcttttggctgattcggaacgaagtaggcttttgagaagactgagtgaagcaaatcaatataaccgattcctcaagagacagttgcaaataaaggatgatgcagtcgtaaaattcaaaggtgaacttgctgttttggaactagaaatgcaggctctggttggcctagctgaagaggttgctaatttgatgttccgttagggctaggaagataaacggaaaatatattcanctcacttctctccaagattagaantgtccatgataagattatggnacaagtaaagagtgttgacgctttaaagacccaagaatcctgtctactgggattgggcatggctganaatgtncagatnatgggttnattccacgatggcacaaggcaagcatgtccaaggatatcaagngactacggaaattcccgcaatccngaactaagactggaaggacaannaattttggtnatgggaatggaatgtccccgaataccacgctggagaggacgaccananacatctgtgtgataaaaactccacacattaacacaacatgcgaatnacaanaagctctcacgaaaanctanagngaatgtcccaaacaaan

SEQ ID NO: 83477 - DNA, 605 bp, Triticum aestivum
  unsure (1)..(605): unsure at all n locations
  Clone ID: PAT_TA_83477
ggaagattaccgggaacctgtaaggcctcaatcagctttccagggtgttggaagaacccttggtggtggaccttccccagatgagagtgcaacacctgctcctgcaccagcggcccctgctgcttcgaggtccgctggcatagtcgtggatgactcccagccatttacatccatacagctgaggctggctgacggcactccgcatggtcgcccggttcaacatgcaccacaccgtgggagacatcangccttcatcgacgcatctcggcctngaaccgcaagncgtttcaactgcaacagtttcccacccaagaactggtgacccaaccaaaccgttgtgcaancnggctggcaatccgttacatgcagaaatgtatgtttcgacacatggtaactagatgnacntaacgaacttttgaaangtctatgtggttaaanacgcccggggctcatcaaggctaanatttaaatcactataacgattagcttcgattaacaatacgatncattacttatcagtcggnnacacatgtctgaaaaaaannanaaaaaaaaactagggggccgacantccaagnncttanccccaggctcttaacnnggga

SEQ ID NO: 83478 - DNA, 345 bp, Triticum aestivum
  unsure (1)..(345): unsure at all n locations
  Clone ID: PAT_TA_83478
agctttcgtgaataaaacctgaatcacccacaacaatgttctaagtactcagccagtggtatttactggttgacctactgtagtttgcgtcggaatagatatgtttttttactcttcgtggggcagttttgtactgggtggattcataaggactctgattatggtgcgttcggaacttataataataagcacatgaaatttgcttcaaggtgcagtgatgctgtctcattaattattaattattagttgctgtcttattaatttacaagtcgcactgggtttaagcggacacctgccttgattacccctcnccttttccaaaacttcnncatcctgtcccttttt

SEQ ID NO: 83479 - DNA, 514 bp, Triticum aestivum
  unsure (1)..(514): unsure at all n locations
  Clone ID: PAT_TA_83479
taccacgcggccacgcccccgccccccgctgactcacgcaacgcgcgcgacgacgcggaggagaaaaccaggaatcccataaaggtttcagttccgcaagccaagccactcccacacccccacgctcgagcgaagggaaccagcaatggcgcgtcgcgggccgtgagagacgggaacaagaatggctgccatggtgcgcgggcccgcgatggcctctgcggctgggccgggtgcgacgtcntcngctgctgcggcgctgccgctgcggcggaggagatgcngtgggcggcagctatacagcggcgtgagcgcggtgtcttcggntcganggcaccgccatatcgtgtccatttcgtcgccatggcacctcnacantctccgcccccgacgacggccaacgccccccgggccgggtntctccgccgcttcgcctcttctctccggcgnatngtgggccccgggggacgttccanggggaggaancaaggtaacgccctcaaatccgttaccaaag

SEQ ID NO: 83480 - DNA, 635 bp, Triticum aestivum
  unsure (1)..(635): unsure at all n locations
  Clone ID: PAT_TA_83480
agcaagtccatccatctcatcatctacatctgagctcagcactactactattgctagcttgatcaagatggcccgtgctgcagctgctcaactcgtgttgttcaccctcgtggcagcaatggtcctcacagccacagacgctgcaatctcctgtggccaggtgagctctgccttgagcccctgcatctcctatgcacgcggcagcggctccagcccacctgcggcctgctgcagtgggtgtcaggatctggccggcgcagcgcgganaccgctgacaacaagcggcgtgcaatgcattaagatgctgctgggtgggtcaatgctggaaagncgctggatccctcccaaatgcggngtcagatccctacgccattactcatcgtgggacgntcnaaaatccctgattaacaatggcacaaggccccgcctatatgcatccatcgaaactatagttcggncaanaanacacacaccacacagttncgataatgcgtnatgtnagacaaagnnattttcaacaatctgntggcggcaactatgtccaagttgtgtaatcccccgtagnaaanttggtgtgantttcagtgactcgatntgtaaatcantaaaanaaaaaaaactcnggggcggccatt

SEQ ID NO: 83481 - DNA, 469 bp, Triticum aestivum
  unsure (1)..(469): unsure at all n locations
  Clone ID: PAT_TA_83481
ctaatctagtcttctcaccagcgcggagctaagtgctgccactaggacgtgggagggagcccccgaggcccgagggcggcactccggagactccggggcgtgtacagacccactcattattgcgtgagagtgtcacgagtggagaccttcacaggcactggtccttgcttcatgggtaagaacttcctgaggtgctggatgttccaaggcattctgggatggggatcccgtcctgtgtctccaaggcgcacggcaccaagctgggagacgtngggcaatcccgaaacgggcctcccacatgggtgaaagcttgtgcanccttcccctgggagaataccgcctcaaaagacaaattaccactcaagctcctggagcngacgctaacgnaatnataccgcccaaccctacnggacttccgccccnaacgaactttacgggggttctccccnaaacgaggcatccccccatg

SEQ ID NO: 83482 - DNA, 442 bp, Triticum aestivum
  unsure (1)..(442): unsure at all n locations
  Clone ID: PAT_TA_83482
cgacctctgtggcggcggtggtgcggggagatcggggaagccggagagccagctacggtaagcgtatggggcgccgatcaaggaagcgtcgtggcaggattgggaggtggatgcactgacgctacgctcgtggcggtgcaatctgcgttgtgaataggctgcaggggagcggcggccgtgggatccggccatgatggcgcgggtgcgggagcgttgcgggggtcaccggtgangtaanggtnngggaaggaggcagagaagcntttgtgttttactccgtggccaagcagatgaataatttaacgttccgcttggcgtggagtgaagtatttactccaattanaggatttacaccctcngttnaattnataattagagtatccaacnaatttaccctttgacgatttaagttccnccaaaatgttntagnacacattctccc

SEQ ID NO: 83483 - DNA, 639 bp, Triticum aestivum
  unsure (1)..(639): unsure at all n locations
  Clone ID: PAT_TA_83483
aatgtttaagtctttattcatcttttaccacgtatgagtttagtactccgtacaacacttgcatatagccacgaagcgagcggaacagcgctgtaaaacatgtctacaaagacggagtggtagtagttgcagtagccctggcagtgacaattgctccagcctcggtgagcagaggcaccagcttcccaccgtccgtgcatcgccatggttgcgtcacagccaccaatccgctcccctttcacgaagacattgggaacantctctggccatccattcaagcgagagtgactgcactcaacgccatcactttccacatccaactccaataccttgtacttgcccccaactttggctaacaattgtttcactcgggngcaaaaaggacanaantttggccggaagacgacgacgggtggggagggacggcccttggcttccngagactangcgaccgggaagaccntatcccctggctctcaagggggcccgtaccaatcgcctatangatcgaataccgcccacgggcgtntttnaagtctgcgggaaactgggtnccactatccctganaaacccttccactggtatacaaaggcgaccatgctcaattccacgatggangaccccgncggataacgggg

SEQ ID NO: 83484 - DNA, 577 bp, Triticum aestivum
  unsure (1)..(577): unsure at all n locations
  Clone ID: PAT_TA_83484
gaactttgttcctggaagaatgtataattgccgatgaagggagcgaatggctccatgaactcgccgtcaacaattctgttctggtgacactgaacttctacatgacagaactcaaagtggagcctgccgatctggagcttcttgcaaggaactgtaaatcattgatttctctgaagatgagtgactgcgatctttcggatttgattggttttctccaaacctccaaggcactgcaagaatccgctgggaggcgcttttttcgaagtcggagagtacaccaagtacgaaaaggcaantcccacctagctatgctcctgggggggcctaccttcatgggtaaaaacgaatcccgttactttccgtatccgcgtcgcttaaaaactggacctgcatacacttcctcacaacngaaatnacgtcacttaacgctaaagcccaacctacgggtctcnaggggggccggtaccaatcgccctatatgatcctataccgcgncacgggcgtcctttacactctgacgggaaactgggtaccactaaccctganaancccttccactggtatacaaaggccgacg

SEQ ID NO: 83485 - DNA, 612 bp, Triticum aestivum
  unsure (1)..(612): unsure at all n locations
  Clone ID: PAT_TA_83485
cgaagcccccacacctggatcagggtgggcaaacactccaggagttagtttcaatgatgctcctactcccagggataactatgcaaatgccccaagtccatacgtgccttccacgcctgttggccaaccaatgacgccaaactcagcctcatatcttccaggcacacctgggtggtcaaccaatgaccccaaggcaatgctgggaatgggatatgatgtcccccgataataggtgggtgagggttgaantacatggctgctgccggatgttttgggcaatgtgttnagccgaggtgatgacggcctgggtgtgggtaaggaagtaccccgggatggtncttgccgattgcacttgggccttccgggcaacggtgacangggtgacgttcttcccnaacaagnccaggcatcaagnccgaanaanantgacaaatntaaatacngatgnatttcccttgggacacangaaattntagnaaaatggtctgaccgatatgaggtnacgaacatacaattnnnaattaatatgggattnggcaaacggggantgaangtgtaattgnttgtacttcacanaaaaaattttanangccccttgaaaaanttttggnt

SEQ ID NO: 83486 - DNA, 474 bp, Triticum aestivum
  unsure (1)..(474): unsure at all n locations
  Clone ID: PAT_TA_83486
ctggaatggtcctgaccgaagcctaaaggttaggcttagatgtgggctgagcaatgagcttaatgacgttgatgagcctagcagatgcgagtatgttgctgtattgtcgacgcccgcactctgcgtcgaggagaagctgaaggagctgcaaaacaaactggatgccatgtcttcgaagcagcccgggcatgatgaactttaaacggttccggcgtggacaaagaaaattcaccaaggaagcatagatgacattacactcataaccttaagggtggaagtcaatgggggatatggacaagaaanggcaagctgaaaaatgggaatgtaggtcaagcncctactggaatgttactggnaaaactgttttttaccgaattnattggtgttcattttccaaccacccnntttttngggggagggacgaacgtcttcctggnggttanatgccccattaatnaggaanaccagntttgg

SEQ ID NO: 83487 - DNA, 631 bp, Triticum aestivum
  unsure (1)..(631): unsure at all n locations
  Clone ID: PAT_TA_83487
atcaggaggcactacagtggaggatgcgggagccaaatttgggtgcaaagctcttccttggtggtgttggagtgcagaagacaggtgaggagattgcgactgcactgaacaacattgacattagctctgagtatgttctgaagctccgtcatgagattgaggactctgcgtggaggttttcatactccagctgatcgagagaagatcaancctgtttatcaaagctangagaggcaatgcttcatttaagaaatcttcaatccgcactgggacattgngtggatcctgtggtaccaccatcctccatcccttacactgtgccactgtcanttatgantnggatgatacgaatatggggaaaatgagtgaacattcatggggtgcaaaacttatactacagnttacactaatgttccttngtcccaaccattntgacattaacactacatccttggtcactgatcatgancatgtcaaaaagtccanggggnccgtaccaatcgccananganctatacccgccacggcgtntttnactctacggaaacctggtnncactaaccctgagaaacccntccacnggatacaagcccccnttcctcaattcacnangangacccctncgcatacn

SEQ ID NO: 83488 - DNA, 193 bp, Triticum aestivum
  unsure (1)..(193): unsure at all n locations
  Clone ID: PAT_TA_83488
ctcgccttcccttccccaccancccgtctctctcttctctctgactctctctctcgtaaccgcgtccacctcgcaccancaagcaancgcnaccaaatggcncctctaggagacngcgganctgctgccgcgagcggcntccaanaacctggnggtgtcnttcggcgaaatgctgatcgacntcgtccccgac

SEQ ID NO: 83489 - DNA, 454 bp, Triticum aestivum
  unsure (1)..(454): unsure at all n locations
  Clone ID: PAT_TA_83489
gggagcctctcaccattaccgagcacagaagaagtgcaccactgcactgagaatcatttagcgccgctgttggcttgcgtcaagcgatagggatgtgcgtcatgtcgtctgcatgaaccacctgggcggctttgtcggggtgcggtgagggctgccatcgctccggtgtgggggacaggttttctcatcaggatttatggctccaccacggatctggtgtctgccgcgggcgggaccctttgtgctacgaactccgcagtgaggtcacgaggatctgaagaatcatcctggtacctggaatctcaagtcacaggtcaagaacaggtaccgcangatgaggcgcatggaaggatgctgtggcaattcgtgagagtctangccgtcgtctcccagtcaactttgggttgctggaccgttgtcncctaaaatgtaantattanttattgtgggggtt

SEQ ID NO: 83490 - DNA, 454 bp, Triticum aestivum
  unsure (1)..(454): unsure at all n locations
  Clone ID: PAT_TA_83490
ccccgcgngatgcnggtgnancgcagggacggtaaggcggccggccccgtcatcangntcaaggnctcccacggcgccaacttccnctangtcntcgngcnggcncaggctaccttcggtgagttgaatacgatccntgttcanactactggcttggngcctganaggcaaaggctcttcttccgtgggaagganaagagtgacaganagttcctgcacacggcaggtgttaangatggagcaaagctgcttctgctcnanaagcctgcccctgccaacatanagcagaangttgagcctgtgattatggatgaaagcatgatgaaggcatgtgcggctgttgctcctgttanagttgaagttgataaacttctgctaangtgtgtgacttnngagaanaatgtactaagagggagaaagttgaggatanagaattgttgtcttgaacggggnt

SEQ ID NO: 83491 - DNA, 451 bp, Triticum aestivum
  unsure (1)..(451): unsure at all n locations
  Clone ID: PAT_TA_83491
gcgccgcttgccctccacatacggccgcggcgaggaacccaaaaggccaaaaccctcccaaaagctactacacagtacacacacggaacggaatccgggcatccgggaaagcagccctaatctcaaggccgcggctgcgagcgctgcttcccacctcccaactccagaagtcctccctagacgccgccagccgcgcgcacacccaccgagagctcctcgggctttctttctccgttcctccctcgcgcgctcagggtttcacgatggaggccgaggcggcggcangaggcgcccgnaagggcggggaggacgccaccgcccggtnggcgggggccgaagcggtggtcgccggtgctggcgancaagcgggaatctccgccgtcatcccaggatggtctccgagatcagcccatgtggccggtgangccatccttgaagnggtttggggggt

SEQ ID NO: 83492 - DNA, 446 bp, Triticum aestivum
  unsure (1)..(446): unsure at all n locations
  Clone ID: PAT_TA_83492
gtccgggcctagcgtcagcgcaaccgaacacgccggcgaccgctgccgcccttctcccagctgcccaggtcttcgtcgggccctttgcctgcggcgtcggcgacgagcgcctgccacaccaggaatcccgttaagtttatttatgctcaccaatttaagggcagaacttacggacctcaagctcttggttactcctgatcttctctaggcgactaggcacaattgccctctggcaaaatgccatcagtttatctttacatccctaacattatcgggtattttaggatcatcataaatttcattgcatttgcggtttgctattccaacaaggctctctttgctatcctgtacttcatcagctttgtccttgatggtgtggatggttggttgcaaggaattaatcaagcatcaaccttggantgtgttagacatggntagtnggggnt

SEQ ID NO: 83493 - DNA, 447 bp, Triticum aestivum
  unsure (1)..(447): unsure at all n locations
  Clone ID: PAT_TA_83493
ttttaggcggggtcaatagaaggcaaggtggttgaaataggactcacttctacttcattgatcaatccagaaaagctccctgtcatagtacccaactctttgttctccagtcagatgatagttaacagatcacgagctaattggcgagctagtgtgacaaagattcctattcgaattgaggatattgagaaggttccttctgcatcagaggagataaagactatgttaaggtctaatcaaaatgtgtcctttgatagtgatgttccttactgctatctctcgagattggaaattcatatggagagctcatcattgggatgcaacctaaaaaacatgangaaagatgagtggctatctgcccaacaagaaatctttgganctgctangattatcaaatcacatggcattgaactgggaaacacatgcagtgctgttngttntngggtt

SEQ ID NO: 83494 - DNA, 456 bp, Triticum aestivum
  unsure (1)..(456): unsure at all n locations
  Clone ID: PAT_TA_83494
gaaacctttaaacccataaattttatcatcgtgtaattggtataagtgaatcaaacgaatctgtcttgtttcactctgttctctcaagtcatagaaagacaagcacgatcatgcaccgtaagaacacgtgacgtgagtctccaaagtaataagtattcacatttacaaggaacacggcaacgaacaagcagtgaaaagtacaggattttagcaactgggatggcaaccacttcacaagattcggcaacattcttccccgcctccgcgcacctaatactcctgggagtccaggccatgggaacatgtgatccacacttccatcttgcgcttcacgcacagcaggaagaagactcaccatcctctcangtgggtctctggttgagaacatcccgccttgtggggttctgaactgctgcccttgaagcanttcntcgcaactcgtgcttgnggngggtg

SEQ ID NO: 83495 - DNA, 436 bp, Triticum aestivum
  unsure (1)..(436): unsure at all n locations
  Clone ID: PAT_TA_83495
ctcccggccaacttccgcaagatcatgctgacgcagatcaagaagctcgtcgccgccggcaagctgaccaaggtcaaggcctcctacaagctcgccaaggcccccgcagcgcccaagaagcccaagaccaaggcgccagccaagaagaagccggcggcgaagaagaaggccccggccaagaagcccgccgccaagtccccagccaagaagaaggccgccgccaagcccaaggccaaggccccagccaagaccaaggccgccgccaagcccaaggcggcagcgaacccaaggcagccgccaagaccaagntccaaccaagacaaccaaggcgccgcgaacccaagccggccgccaaggcaaagcgcccgccaancnaggggcgcccgccaaggcgcaanactcnccaaggaccccaaggaaaangcccctgngggnt

SEQ ID NO: 83496 - DNA, 451 bp, Triticum aestivum
  unsure (1)..(451): unsure at all n locations
  Clone ID: PAT_TA_83496
gaatactgtatcaaatatgcctggatacatggtcatgatcactttcagttaattaatattcctgctgaactctgttagctgcatctgcaagtttttgtagcatgtattcaagatcactctacgcagtgggcagtaatttgtactgtaggccgtatcaccttgtggtttgtgtacgttgtcattaaatcatggttgcatccattaaataatgaaaactgacttgtaacatggcacactagttagcagcgaatccttagactgccactagttgatgtacaataatctactccggagtgggtatttcttaagcatataagaaatgtttaaatactccctcccacatctcaagtaaacatgtgaaaacacacccttgaaaacccttttgatttacctgttgttccatatcattacanggcactgggggcattactatcaagattgnggggggntn

SEQ ID NO: 83497 - DNA, 450 bp, Triticum aestivum
  unsure (1)..(450): unsure at all n locations
  Clone ID: PAT_TA_83497
caattccccatttcccgtagcacggcagacgcgctcccttctgatttctgaatccccgacgccatggcctccgcaccgacgccgccgcccctcctcccggtgaccaaccctgcgtccggatcgtccccggccgccgccggaggctccgatgcgccgatcgctacgccggctttccggctcttcctgagccggatctccgactcggcgcggcgctcgctgtcggatcgccggccgtggggaagagtcctcgaccgttcggcgttctcgaagccagactctctctccgacgccacctcccgcctgcgtcgcaacctcgcttacttccgcgtcaactacgccgccgtgggtcgccttcgcgctgggggctcgctcctggcgcacccttctcgctcctcatcctcctgggctcctcgccgcctgggtgctctcnactcttcggntgnggnggtn

SEQ ID NO: 83498 - DNA, 634 bp, Triticum aestivum
  unsure (1)..(634): unsure at all n locations
  Clone ID: PAT_TA_83498
gagcagtgagaccggccggccgtgagaaggaagacaggtgactggtggtgaaagagctagcagcaccagcatggtggtggggatcgtgattaggctggtcgtcgctttcgtgcttttggtactagtcttcagttcgtcactgcatcgacaagcaggcgttggcgctattcggctgcacgacagaaggcagcacgcgcagagtgggccggaggagaggaaccagctgaggccgtacatgaccatggactacccccatggcaccgccgcgtgcccaagcacaactgatctgattgatccactgcactgccagcantactgctctttccntccggcagcgctagcaactgcatctgtgcgaacatggtgacacacaggagaagaattgatataagtcatccttttcntcttgttaactnatgcatangtgtaccacgtacactgnctccaccactancgtgcaatatatcaccaatttccacccactnacctgactacaatgatggatgcagataatatataataccagtantatatnctgatacagtctgtgtccagttcgtaaagccaagttgttgtagtaaanttcgctctcgaaattatgacatnngggttctcaaggtaaaaaaaananaan

SEQ ID NO: 83499 - DNA, 672 bp, Triticum aestivum
  unsure (1)..(672): unsure at all n locations
  Clone ID: PAT_TA_83499
cgggggcggcgacgacggcctggtgctcattcagatggtcaacttctacccaccgtgcccgcagccagagctcgcgctcggcttcgcgccgcacactgacctgtgcgcgctcacggtcctcgtggccaacggcgtgccgggactccaggtgtccatggacggcctctggtacgacgtcgagcacgtgccaggagccctcatcgtcaacgtcggcgaccagatcgagatttttaagtaacgggaggtacaggtcggtgctgcaccgggcgacggtgagcagggagaagacgcggattcgtggccggtgttccgtgggaccgcggagagagtactccgtcgcgccccaccgcgcctcgtcgccggcgagntcctgccaaattacnatacaaggcaagacttcgagaactacagatactgcangatcaacaactaccgcagtagacgtccgaacgccgccggctatcatgctgcaccntgaacaatcagtgatataattcacctgcaaactcagtgtcaacaacatccctatagngaacaantanacatgtanttccctttactcacttatgtccgcgcactcnctacaaatcatnngggccttgctnactttacaaaacatntaaaataanggcacctttccaaanggctggtttaaccaantaaacttttncn

SEQ ID NO: 83500 - DNA, 466 bp, Triticum aestivum
  unsure (1)..(466): unsure at all n locations
  Clone ID: PAT_TA_83500
tgcagctctaggctggtgatgtaattttttttattttttatttgtggagaggtgagtttaaaactttgcagtaggttttttttcctactgttttcttgttaaaaaaacaaaaagtgatgtcttgtccgcttcattcgtttttacggtggccatctccaaattccaaactcgcgcgtccaacgaaaagaaaaggtaaaaatcataaacccactcccgccagcgaacttcaaaagaagcccttagccacccatgtgaatgctgtgtgtgggcccctcaccgacttaccttctcctaagaacccaccaagcacagaanttccccaaacctttccgcgtctcctctccgggtaaaagaagcaagcggacggntccacggcgagcggccttgacgattccttttgtagcggcggcgactccancctccttggacaattggnaagttccttcnngtgangtttgggggggct

SEQ ID NO: 83501 - DNA, 426 bp, Triticum aestivum
  unsure (1)..(426): unsure at all n locations
  Clone ID: PAT_TA_83501
ggacgacgaagcggcgaggcagtgactggggagagatgtcgggcggcaggaggagggggcttgtgtggagcctccccgtggcgaggtcggatgcgctcggcaaactgggccctgccttcggcatcggcgctggctgcggcgtgggtcttggcttcggcctcatcggaggtgcaggcatcggagctggattccctgggtttacaattggggtttggagctggagctggatgtggaataggaataggttttgggttacggctttggaaaaggcgttgcatatgatgaaagtggaaggtatcnaacatcaagagaccttccaagactcccagaacattgctttccatgagaattccgatacattttgacgaactgatggagacaccaagaactggccaaacaacacaaagaatntacaaatggagggaa

SEQ ID NO: 83502 - DNA, 263 bp, Triticum aestivum
  Clone ID: PAT_TA_83502
ttttttttttttttggtgggaagataggcaactgtctctcctctattgtccaaaaagacatgcatgatgccgcgaatatggacaagaaacagtacaaattagctggtgacacacacacacatattcaacaaaaccgtgccggcgtcattgatcatcgtgaaccggcagctcctttaccatgacaactcgcctcctcctccccacccaggagacccatctggtcccttgacacgaccctctactccaaggcagggtacaagctc

SEQ ID NO: 83503 - DNA, 647 bp, Triticum aestivum
  unsure (1)..(647): unsure at all n locations
  Clone ID: PAT_TA_83503
ggaaagcggtcagaattggagtgcaagcgacgcgtcgagccccatcccgttcccgcgcctcgccgagagatctgcgccgtcgtcggcaccaatccgtacacccgtcagtccgtccgtcgtcggcgccggcgaacgagtagagatggaggagacggcggcagcggcaccggctgagaaggcgtcgtcgtacaggtactgggtgcgggaagccaccggcgacgccgcgccgctccccgtcccgcgcaagctcgaccccgccgccaatgggaacgggaacccgccgcccctcgggtccgtctggaatcangctggaacttgggaggaaaagaactcaactcatgggctaatagtaggataaaggatttgctgggctctctaggttcattgaattccctacanggaatgcatccgttgatgaagtgtccaatgctcangcgatgcctttaagtcactgtccgcaacaagaagagagtagatatactacaactaactgagatttaagtgaatggtagttaagaagaaacanaagtnaaagggcattagcatccgagtccgttcgtaaatatactgagtgaataggtatgacaaagggcnccatcacaaaggaggttgaggttaatcttaggccgttngaaatcctntcaaaa

SEQ ID NO: 83504 - DNA, 642 bp, Triticum aestivum
  unsure (1)..(642): unsure at all n locations
  Clone ID: PAT_TA_83504
ctaatcttcaagcaggagagaaaaaagcataagctgagcatccatcaatggcggatgctggcaacgaggccgagggtctgacgctgttgggcctgcacgtgagccccttcgcgttgcgcgtgcgcatggcgctgagcctcaagggcctgagctacgagtacatcgagcaggacctgttccacaagggcgagctcctcctcagctcaaacccgtgcacaagaaggtgcccgtgctcatccaccacggcaanccatctgcgatccctcgccgtccgtgganactcgatgaggctgggccggcgcgccgccaccacctccccgccgaccccacggncgcncaccgtcgntctgggncnctantcgacggcaanttttcccgctggacaggatatgaagcgggacggaggaacgaaggcgataactgaggaaccacccgcggnctcaactggagaaggctcccgagntaactctactcaacaacacgngcggctncnggcgngatcgtggtactgactccgctcggtgccctgcgtgttcggcgcncgccatcccgggtcaaatatcacccccaagctcnnctgtggttgccacattggaanccgtgcaagagtctccaccgcagttgctacanaattagcangct

SEQ ID NO: 83505 - DNA, 668 bp, Triticum aestivum
  unsure (1)..(668): unsure at all n locations
  Clone ID: PAT_TA_83505
ggaatatcaactacaaggaatttgcttgcagatgatgctatggtgcctatctcctctcctttgactcctccactaggtgacagtgaagaaactgacaaaaagggggctgtggtaaaacgcctaaaggtccaagccataaaaaaagatatcaaacagagtcccaagaaggtgaatctagtagcaaagctggttcgaggtatgcgtgtagaagatgccctactgcagctgcaagtgactgttaaaagggtgccaaaacgtttaccaggtggatccatctgctccggncaatgcactcacaaccatggattgggtcctgataaccattgttgaggaggctttgtgggaaanggacttcctgaagagatgtcctacatccaganggaancccggcattatgtgcgacaagtgcagactgacatggtggttagagaactacagctgaggaggaggaaagtcccaactcaggtgagcaactacaagaactgacaagaaggacacaactatcccaaagntcatcaggtanccagtggntccagaggaancgagctgtgcacggtatacttagttcanactcatcncgcttnaancngacaaatcctnctgaaatantatcccccggcattncaangttaaacagctgtttttccaacagtgtgggntaaccaaac

SEQ ID NO: 83506 - DNA, 675 bp, Triticum aestivum
  unsure (1)..(675): unsure at all n locations
  Clone ID: PAT_TA_83506
gccatgcctgctggcatcagtcgtgctccatcagggtcgtctagtggtgggcttggtattatctatccatttctcactagggttcgacaaagggcaaacactaatggtaatgatgaaaggaatggtcaatctccaaatgaatcggctcgtagtagcacccatcttaatcagcaatcaattccgcagtcatctcaaactcatgaagcaggtaatctgagatctccagttgatgtcaatgttggagatgtgctctgagacctcacctgnggcagcagaatggtctgggtcactctctctcaagataatgggacttttttggatcaaatgctcccaangcgaaatgttccgaggaaatactcaagcagcaaccacaatggttccaacgaacaaggagagggtanaancttgcaacacaagaattcangaccatgangagcctacctttctggatggcagacaaattagcaatttccccaantgaacacagatcaaagtgnccacagacacagagacacnnacagtgatctggantgaaacagnctaggattccaatgntcacagtccgtaaataacgcgacaatgtgaccaatnaaaggaagactatgctgatgatcacttactaaaactcattctnttncacgtgttaanaggcttnnaagggatntnnaaaggttg

SEQ ID NO: 83507 - DNA, 587 bp, Triticum aestivum
  unsure (1)..(587): unsure at all n locations
  Clone ID: PAT_TA_83507
cgaatccagagccccacgccccgtccgaaccccagagcagagcaaagcctcctcgacctccctgtccccagccttccccgatggcccgcacgaagcagacggcgcgcaagtcgacgggcggcaaggcgccgcggaagcagctggcgacgaaggcggcgcgcaagtcggcgccggcgacgggcggcgtgaagaagccgcaccgcttccgcccgggcaccgtcgcgctgcgcgagatccgcaagtaccagaagagcacggagctgctgatccgcaagtcccgttccagcgcctggtccgcgagatcncgcaggacttcaaagacggacctccgcttccaatcctccgccgtcgccgcgctgcangaggcgccgaggctacctgggtgggctcntcgaggacacaactctgtgcatccangccaacgctcacatcatgccaaggacatccaactcgcgcgccgatcgcgngancgccctagccgtccgttcgggctgtccctacgctgagngtaataaccctcaggtgtttaaagtgtcgtgttcaaagagntcctgcagtctattaacgggattgtacatttaaaatca

SEQ ID NO: 83508 - DNA, 486 bp, Triticum aestivum
  unsure (1)..(486): unsure at all n locations
  Clone ID: PAT_TA_83508
cgcagcatcggagcgctcgcaaaacctcgacaccttcctgaattagtagccgctagctttagctgctccccttggaccggtcgagcttgagctgatcactaaccanttctaccagctcgatcagcaccgtaacctgatggagttcgacctgctgaattantacagcccggaagaagcgcagcttgagctgatgaacacgatgctccagctggagcagctcaccgcgctcgacggncatcgtcagtcggcgatggcacctgcctcgccgccgaatatccccgatgtagacccaccatgcaggtccccacagcttctcgcctctgccacacacgtcgacnacatgaccactaccgcnaccntcaccgggtaccatagaagcagnacgcaccgncacgggccgtgtanggcgccacacttccagccggctcnagcaacacnactncagctcaggacggggncgctgcangccggcntngtcgaggggag

SEQ ID NO: 83509 - DNA, 536 bp, Triticum aestivum
  unsure (1)..(536): unsure at all n locations
  Clone ID: PAT_TA_83509
ccaacctcgattcccggcgcaggagcaaccataactactatctcgatacttcgcgctactcctcacaaaatgactggtcgtggtggtggcggtggtcgccgtcttatgctgcctcccatcaagtatatcttcgagcttctccgagaacacgccacagtcagcatctggttgtacgagcagctctccatccgtattgagggcaagatccgaggtttcgacgagttcatgaacctagtcatcgatgaagccgtagaggtcaagcaggtcaccaagactaacgagaaggagaccaaggagatctcttgggtcaaatcatgttgaagggaagacaacgtctcaattaatccaaaaactctcgaaataaacaaccttgcaatggaactggacttgggtcaatggaaacaagacgattaccaaaaccgcctggccgattgatggcaacgaggactttcaatcatggaaccantcacttgagtattcactgaantagttgaatgggtggaaaaaanaatggctgacaaaaaattgtgttctgc

SEQ ID NO: 83510 - DNA, 340 bp, Triticum aestivum
  unsure (1)..(340): unsure at all n locations
  Clone ID: PAT_TA_83510
cgcaaacggacctcacccacccgttcctccatctccgccccttgccggcgatggcaccggcgccggcagcggcctcngcggggcggaagtctcatgtcaccgttctcctcctctacgtagtgtgcggcttgatcctgctgcttctcctcgcctcctactcgccccgcctccagccccacgcncacggtcgcagcntccaccgccgcctcaatctccacccaaagagctccttaccatccgacgcntcctccggtnggaacggngggcaananaatacnagcancantncaacnatgcggcttccttcgacccgacatcgccgagctggancgtcngctgg

SEQ ID NO: 83511 - DNA, 272 bp, Triticum aestivum
  Clone ID: PAT_TA_83511
acacgatgatatatcagtaggttcatggatgatgggactgaatgcaacttacgtggatgatgaccggttgtgctgcagcagttccagacaagagaaaatctgttccaatgcttgagcggaaggcgtggctgctggcctgttgctgtacatcctgatgaagattttgcacacctgtcattttgtatacactgctttcgtgaaccggaaaaggctactatccagatagaaacggcttgcaccaaaatttaggaacttccatcaaaaaaaaaaaa

SEQ ID NO: 83512 - DNA, 483 bp, Triticum aestivum
  unsure (1)..(483): unsure at all n locations
  Clone ID: PAT_TA_83512
tttatgtctttgttccctttggagcatttcatttgccagtgtaattgcgaaatgcctgcgatgtgaccctgtgaagaaagagtcattggtgatcatgccgacttttggaattcaattagagcaacacttttggagtggaagagttcatcgcaaatttgtgcccattggcaagattctaagaccagtgctgaatgagcatgtgacccctgtctcatgctactggagcttggccttgcttgtacgcgaagaatatgagctcatgcttgttttcaagagcttgaatccaccagtcaagatgttggttccaatctgggaaagcgttatgtgcattcgtagactccaattctccggggcaattctgcattgcctcaacccacatgaacatgcttaaacaattggtgggtggctgtgtgcagccccgatgataattcgaacatatggntcgctgaagacttgctgactgacaacaanaaaaaaaaaaaa

SEQ ID NO: 83513 - DNA, 626 bp, Triticum aestivum
  unsure (1)..(626): unsure at all n locations
  Clone ID: PAT_TA_83513
tcagtatgccgggcaaggtttgtttggatcaggcatccctatgacacacgcccaagtgctggggatgttttctggaatgaacggcaaagccaatggctatgtccataggcacccagtggctgctgatagtcttaaaacagcagcgcagaacggagatgtcggaaaggcagctgtcaaccctgtgcaaggtgcaggtcatgatccaaagattgccaacggtaatattctgctcacccaggcttaaattccggtgtccatcctcaggtccccacctaagcgaacgctgggcaaacccaaacaccctgatctggcttgcagctatgaggtaccaattggacatatttgccttaatactgtgatctgtgacagagcatgattcaacactgcttcntccggtaccttgccaaaccggacacgagaccgtncaaagagtaagaatgtttggttgtctcaaaaaaaaggtggcggaaccggacacgtgtaggtccccgaattaantgataattgaccctgtaattgttgtaaagggaggtacttcgtcaggtcaanctacngagatanatnctcgataagnacnccgctgtcanttgacatatgaattnaagaaagagganntcagcaaaaaa

SEQ ID NO: 83514 - DNA, 603 bp, Triticum aestivum
  unsure (1)..(603): unsure at all n locations
  Clone ID: PAT_TA_83514
aaagtctttgcccaaaaggataatcctagaattccgtctgtcttctggatttggagaagtgccgattttcaagaacgcgaatcttatgatatggtgggaatctcttatgataatcatccgcgccttaaacgtatcctaatgcctgaaagttggataggctggcccttacgtaaggattatataacccccaatttttatgaaatacaagatgctcattgaatgataagaaattcatgctcacttatacaacacaactccaagattttattcaagtcaaggaatatttttaggtcttttccctaagatgaaacggaatacctatttataattaatccctaattatacaaaacatcccagatagactgagcaaaaaaagggttcatttggtccccctattttgaaancgcatattaatttcctccatatgagcagaaaatagatgacccaaagaattctctacaagaacttgtccgcgcaatacttgcacactaggaaataagtaagtaangatagcaggacaaaaaatatcgcggaatacggatacaatnnataataatatatangatagttcaaancanccaggggggccgtaccantcccaaa

SEQ ID NO: 83515 - DNA, 214 bp, Triticum aestivum
  unsure (1)..(214): unsure at all n locations
  Clone ID: PAT_TA_83515
agtcagaccaatcaacaaagtgacgcgagcacgagcatccatcgtttccccttcttccccatcgcgtgccctcgccgcagccancttccatggcggaccagctcacggacgagcagatcgcggagttcaaggaggccttcagcctcntcganaaggatggngacggntgcatcantancaaggagcttggnantgtgatgcgcncccntgggca

SEQ ID NO: 83516 - DNA, 525 bp, Triticum aestivum
  unsure (1)..(525): unsure at all n locations
  Clone ID: PAT_TA_83516
cgcagcagagcccctcgcgccgccggcctcttcagccttgcagcacaccgccgccagcccgagtgaccgctgcagcctaggtttccggcgccgatggcgggtaagggagggaagggtctgctggcggccaagacgacggcggccaagagcaccgacaaggacaaggacaggaagaaggcccccgtgtcgcgctcttcccgcgccggcctccagttcccggtgggtcgcatccaccgccagctcaagtcgcgtgcctctgcgcacggccgcgtcggcgccaccgccgccgtctattccgccgccatcctcgagtacctcaccgccgangtcctcgaactggccggcaacgccagcaaggacctcaaggtcaagcgcatcacccgcgcaactgcaactcgccatccgcggggacgaggaactcgacacctcatcaagggcacatcgccgggggcgngtcatcccgcactcacaagtcgctatcaacaagacgcaaggatgatcaaggcctnctctgctctcctaata

SEQ ID NO: 83517 - DNA, 626 bp, Triticum aestivum
  unsure (1)..(626): unsure at all n locations
  Clone ID: PAT_TA_83517
atggactggccgggcagtgggccggaaggccccggcaaggccgcaaggacacatgcagttactgactcctcctccagccactcggatctacaccgtcggtggtctgccggcagatacatgaatggcggtcggccgggctcagtgctggcccaaaagctcgtcggcgcaccgttgccactcattacgtgcgacgactgcccaaagaaggcttgcgccgcgtgtctacaacgccaagaacatcccggatgggtgttcatcaagtgctcaaccgatggggtatgtgctactttancttcggttgtgctccccngattaaactaattgtgctaacttaaaatttaatgggtanaatggatgcaattttgggattggggaaaaagatacatccatatattgagagacgcatttaantaatgttgtacacttcnancancatanaggcaaagatgaacaanncactgttgataaaatagaggcanacatgagacanatgnaggaacatgtcnactcttacctcaagaagaagancaccagataanctccgagntacaagaatgctcanaaggacaatcactaaggcantntganttgaacctcaaagtncctgggccngttctgctgcttca

SEQ ID NO: 83518 - DNA, 200 bp, Triticum aestivum
  Clone ID: PAT_TA_83518
gtctttcttacttgttcctaagaatatgtgtatgtccatgttcatgtaacaacatggctcgagaaagcgtgctcgtatgtgaatgcaatcggtggctatgtatatgcacatgcacataatatattatacaatctgtcgactatgtattcgggtaattaataatgagaaacatctttgccaccgcaaaaaaaaaggggggg

SEQ ID NO: 83519 - DNA, 729 bp, Triticum aestivum
  unsure (1)..(729): unsure at all n locations
  Clone ID: PAT_TA_83519
cgtcgatcccatccacccccagcgctcctcctcgccggcgggcttgctgggtctcgcgatcgtcctcctcctcggctgtgccttctggggcggcggcggcaggaattaggtaagtggaggcaagggaaggggaggtttgaggtagagcggagccgcagcggcgatgccgtcgcacgcggatctggaccaccagatctcgcagctgcgggattgcaagttcctgccggaggtggaggtcaagacgctatgcgagaaggcaaaggcgattctcatggangagtggaacgtacagcccgtgcgctgcccgtcactgtgtnccggcgacatccacggcagttctacgacctcatcgactcntccgcatcggcggcgatccccaaacaccaactactccttaatgggcgattacgtcgaccgtggctactaccctgtggagacgtgtcttgttaatggtctaaaatacttatagagacagaatcacatattgagagaaacatgaaacagcaanaatcaatgtatggctcatataatgctgcggaatatgaaatcaattgtgaatacttaaaacttgttatattgcnccaacnctaaaaacantttcgcaaagggccccccacangataattgaaaacccccctatnaaaangncaataggccatttttttggccncanaccattggggattccaggnngaaattgcantgcaatcnaaagggnntttttngant

SEQ ID NO: 83520 - DNA, 611 bp, Triticum aestivum
  unsure (1)..(611): unsure at all n locations
  Clone ID: PAT_TA_83520
nnaattcctacnncaanattcaagcctatnccaaagccatttccattantnaaaaaacctctacctattccaataatnaagcctatanctgantcagtcccacttgttaancccattcctattccagtatttgagccnatcccaaagccatttccaatggtgaaaaancctttacctatttcaatagnttanacctatnccannagtcattcccagtgggtaaaatgcctcaacctgttcaagtttctaancctattccatagncgtttctcatttttgtaagnaagcctataccaatagcagtccatttgttaagcctaagcctttacttcaaaaacctattcntccttaaatacacntcntagcangnttcaagaaaccactcttaccacctctgctntntcanaagcctaatcnancatcanaagatctcattcatanactncttgngctatgaagttatccgctcaatttgggagacactgcatccaagacaagtatcatacangttnaccatcaatgtacaacctggtatgaattgaatgattaattaactttcccacacattgcaagtancaagatggcaacaatangtctatccggntggtact

SEQ ID NO: 83521 - DNA, 703 bp, Triticum aestivum
  unsure (1)..(703): unsure at all n locations
  Clone ID: PAT_TA_83521
aaaacccgagatcgcaccccttcgcgtggcgatgcgtggaggagacgtaacagcagcggaggcagggtccccgcgctcgccggacctctacgatctctccgacgactccgactacgccgccgccgcttctgaccagacggcgatgcggaccgatcccgcggacagagcctcagaggagactgcgagggtggatgtggtatatgagaaggagcgtgtgaccatccacccgtcgcagtatggttccagtcgtatcagcgggaagctgcgtctgtttctgcagcagggatcattgttcctgagttgggagccaaacgaaggagccggctctttgtcaaccagttcagtcggtgtggaagtagaaaaatatagaaatctgtacactatcaaggncttgcctttaagtgatgtacgcctcatccgtaagtacacccaacgtttggactggactactataatcgttctccatcaaggctggcttccctccattcaattcacaacgtggaatcctgaatgtttcaacacngaaacaacantttnntcacangtcgatacntccaagtttcncgtaaagaanttaaattcctnaaaagtgtcaccttgacctcagataccattcaangcagtaaanaattncaattnagggnattnntccgcnggaaattnaaanggcattaaattattaccancaannacaagttagtgt

SEQ ID NO: 83522 - DNA, 700 bp, Triticum aestivum
  unsure (1)..(700): unsure at all n locations
  Clone ID: PAT_TA_83522
tccaccccggcccggaccccgagaaagttctgccgtccatccatcgtctcgtccccgcctgccattcgcgagcatccaaagctgtagttgctgcaaagctctcgcaaaatcctactcccaccgccgactcgaacagtcgaacctcggctcccctcctccccaatccgtcatcttccttctacacttgtttctgcgggagcgggagagaaggcaccagggaggccgcccccgtcacccatagccaaagtcacgcgccaccaaactttgttctctcacccagtcgctttcgcgttcaagcgcgagccgagcccagccggtgggtcggtcgctgaaggcggagccataaaggcgtcggcgacggcaggatgatgagcggcagatngggcggaaggacggcgaagcggccggcccgtataagataaggnttccacggagcaccttcgcaagtcgtctgccggcgcagctacctccgtgattgaagaggttcttgttaaacnacggcttganctaaaggaaagtctcttcgtggaagngaaatgcaaaaattctcaancggaagtgtaagatgccaaattctcgctnaaaactnccgcaaanaacaaagttaccgtataggtnaactntaagattaggntnccgttaactaatttaagngncnaagggttantgaaaatntncggnaatttgaaaanttcctggg

SEQ ID NO: 83523 - DNA, 616 bp, Triticum aestivum
  unsure (1)..(616): unsure at all n locations
  Clone ID: PAT_TA_83523
ctcgcgtggcactggtcgccgtgttcgccgtgctcgcggcactggcggtggcggagatggcgtccggggcggtgacctgcggcgacgtgacgtccgccgtcgcgccgtgcatgtcctacgcgacggggaaggcgtcggcaccctcgggtgcgtgctgcagcggggtgaggaccctgaacgccaaggcgtccaccccggccgaccggaaggcggcgtgcaactgcctcaagaacctggcggggtcgggcatcagcatgggtaacgccgccaacatcccggcaagtgcggcgtctccgtctctttccccantaagcacaaaaaccaactgcaataaccttcactaattatgtgccagcatcatcataacaccangctacctaagccactcggtgtctaactgtnctgcccgctctctgatgtttcgttgttgttttctnatgtgtcaacctcaactgttgccttgttacaaattaacaaattacgattgatcatcataaatatgnttaactaaattttataagggggccggaccaattncctaaatgatctatacnncnccacggcctntttaaagnctacggaaaacctnngtaccaactancnctgaaaanccctt

SEQ ID NO: 83524 - DNA, 654 bp, Triticum aestivum
  unsure (1)..(654): unsure at all n locations
  Clone ID: PAT_TA_83524
ggcgacgctagtcgcctccgatggcagcccggcgcgggccccacgtcatcaagcttcacgatcccaacccgcccctcctcggacgggcgccgggggccgcgccggccgccgtccccgcgtcctcgcgcgatgagggcctcctcgcgcagcacctgcgcgcctccgcggcgcacccggccttcgccctcatcgaggagcgcctcgccgcccgggaccaggatatccaggagctcctcgtcgacaaccagcggttcgctgccacccacgtcgcactccagcagcagctcatagcggcgcaacacgagctccgggcggtctccgtcgccgccaccaaggcgcgcgccgagcgggagggcgaagtgcgctccctggccgacaaggcggcgcatatggangctgangcgcnggcatcgccgctgcgcgcgcggagattgacaagtcacgccgaantcaagtctcccgcgngcgcacgactctcaacagntcaagtctacggaaaaactcccaaagaagcnaggcantagacgattcgtctccanatnaacatcgcggaaatcagangaaactcgtnattnaaanaagaatcgatactcaaaattacatgnaaatatgcntgcatnattaagtnggaantaatntaaaggcatgntacca

SEQ ID NO: 83525 - DNA, 602 bp, Triticum aestivum
  unsure (1)..(602): unsure at all n locations
  Clone ID: PAT_TA_83525
gcaaactatgcttttctctgctacaatgacagaagaaattgatgaacttgtaaagctttcactaaacaagcctgtacgccttgaagctgatccttctctgaaacggcctgcaacattgactgaagaggttgttaggatacgacgagcacgtgagtcaaatcaagaanctgttcttcttgcactctgtttgaaagactttcaagcgaagtgttatcatttttaagtgggacaaagcaatctgcacacaggttaaaaataatatttgggtctctctgggcatgaaagcagctgaacttcatggcaaccttacacangcccancggcttgangctctgggaactttcangaaanaagaagtagattttttgatgcaactgattcgctgctcgtgggattgatatgttggngtcaaactgtaataaatttcgcatgcccaagagattganaacttacctcangtgtggcgcactgccggcaagaanaaagntatcctgtganttngtaccgacgatnanagatnctcttnaacaattcaagaagnngttaancgaangcgcattgtgngaaactgtgctntttccacnntancatagagnnatttc

SEQ ID NO: 83526 - DNA, 473 bp, Triticum aestivum
  unsure (1)..(473): unsure at all n locations
  Clone ID: PAT_TA_83526
ctgcgcagggccaactgccccgcggcggccggcaacggcgacggcaacctggcgccgctggacaccgccacgcccaccgcgttcgacaacgcctactacaccaacctgctggcgcagagagggctgctacactccgaccagcagctcttcaacggcggcgccacggacggcctggtccgcacgtacgcgtccacgccgaggaggttcaagcggggacttcgccggcggcatgatcnaggatggggcaacatcaacccgctcnaccgggacgcaaggccaatttaagccgcctgttccaaggccaactaactactacttctccccgntaaaactacctgtgcttacttcccaattatccgacgattcaacgtccccacaatgattacactgtaataaggcngtnntccatgtnattnccctccggttttgcttgtacgggttaaaaancctcttcccgatccaaaaaaaaaaaa

SEQ ID NO: 83527 - DNA, 657 bp, Triticum aestivum
  unsure (1)..(657): unsure at all n locations
  Clone ID: PAT_TA_83527
ttttttttttttttttaccacaggaacaaacaaattaagtagccccaccatgaaaatgaaattatgtttctgttctaactaattattgctantttatctgtaatgtatatgcacgagtttccagagccgcaaagctcaatgatctaacactaccaaatgatacagcaactgtaaaaaaagaaaggaacgcacaacacatcagcatctgcangtcagcactcaagcagtgaagcanatgatccacantcngctcttctccgggcatgcccttgccaacacctccttcangcttccaccgacttcaacctctcttccaccttccctttcactgccgcgtcctgctcttgatatccaaagaatgtaaatcgctgcaactccacctgaacgcgtgtttcgccaaactcatcnccaggagcacccaancattctgacangagtgtactcttgggataggaanagtctgcaaggaccattnacaagtggttcctcgcanctgacaatgttgtnccacactgtaaaagaacggtatggtcaaaanactccnccctggnatntctgangagcgtccatccactanttcncntcaattanaaactcgacggaaananggancttcgttncnacancatagcacncaggactccgataaacgattta

SEQ ID NO: 83528 - DNA, 531 bp, Triticum aestivum
  unsure (1)..(531): unsure at all n locations
  Clone ID: PAT_TA_83528
tgatagagaaaaatgcaggtgaaccgggcaggtcactgacaagcacattgagcaggaagatttgcagaaggagagcagatgataggctatcagatatccccgagaagattgaagctcgtggatctaagccggtgagtgaagggcctattcttgttagaggtgagccaatgataacagtggaccatccgacgacggaacatagcgatggaggtggcactgagcaagatgcggtgggagcaaagttgctactcaagacctcataaggattgcgacttaaggtcagcattcctgttcntgtaatccttgctgggtcgatttggttcgggcatgggaccttgctttccgtttaaagatcagtgtccanaattgcaaagggtaccatttagaaatggctgaaaaatatataacaaagacagctgtttgcaatgatataccccaatttgataagatggtccgttaatntgttactnanttaagaacataatgcataattcctgcataaatatgtaaacgttttttaaaaaaaaaaaa

SEQ ID NO: 83529 - DNA, 200 bp, Triticum aestivum
  unsure (1)..(200): unsure at all n locations
  Clone ID: PAT_TA_83529
agccgcccctcacccgccgcctctccgcctcttcctcccctccccctcccatcgtgatcgcccccctcgacctctcccacctgccgccatactgcanttccaccccgaccggcttgtaagttggngaagcccggcaacgagccggnaaccgntnaagatancatctggggnaatntggaatcggcngttgaangggttga

SEQ ID NO: 83530 - DNA, 372 bp, Triticum aestivum
  unsure (1)..(372): unsure at all n locations
  Clone ID: PAT_TA_83530
gcganggcagnctcgactacctcggaaaccccancctggngcacgcgcagagcatcctcgccancngggcctgccatgtggtgctcanggncgccgtggagggctaccgcntcaccggcngcccgctgggcganatcgtggacccgctctaccccngcggcagcttcgaccccctgngcctctccgaggaccccaatgccttcgctggagctcaangtgaangagatcataaacggccncctcgcnatgttctccatgtgcggcttcntngtgaaggcatcgtcaccggcaagggccccctcgagaantcgctaccactntctnacccntnaacaaatcccctgngcttcccannaaattcgtcccgggcaa

SEQ ID NO: 83531 - DNA, 198 bp, Triticum aestivum
  unsure (1)..(198): unsure at all n locations
  Clone ID: PAT_TA_83531
gtttgaccttcctcaaaccagccacgtatanaacctggatcttcctaanacggcaancgactatttgcaccgtgcnggaagaacanggaggganccattctccangttagaattggnatgctgcgtgacaacccttataacanaggaagagcacttcgttctacggagatttcanaatgagctcaagttccanancca

SEQ ID NO: 83532 - DNA, 541 bp, Triticum aestivum
  unsure (1)..(541): unsure at all n locations
  Clone ID: PAT_TA_83532
ccaatctgcccttgccgccgccgccgacggatccaggtctgtagactgctcactcctctacgctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaaganactgagtgtcatccgcaantccccttccaacgcctgtcccgcgagatngcgcaggattcaaagacggacctgcggtccnatcctcagcggtggcggcgctgcaaggagccgcggagcttactnggtggggtcttccnaggacaccaactcttgcgccatcaacccaagaggtcacatcatcccaaggnatcaactccccgccgatcaagggcaaaggctntacttcccctctntcnnccttgtanattngaaatgnggntngtcangtcngtaacctggtggttgcctangtggt

SEQ ID NO: 83533 - DNA, 216 bp, Triticum aestivum
  unsure (1)..(216): unsure at all n locations
  Clone ID: PAT_TA_83533
ttttttttttttttttttttttttttgtatgcaagattactgataanaacacantcacaaggttcaccgaccatgtctttaaatganaaataancaacaaannactantcttcangcattanaagatccaacanactaaganaacatttcancttttgtncttcngccnaacnanattaccancatccancacantccattcacatacccaagttc

SEQ ID NO: 83534 - DNA, 390 bp, Triticum aestivum
  unsure (1)..(390): unsure at all n locations
  Clone ID: PAT_TA_83534
ccggcgagacgctcgcgctgcggaccgtcgggctggtgcttgccacgctgctccagtgcttcgactgggacacggttgatggagctgaggttgacatgacggagagcggcgggctgaccatgccccgggccgtcccgttggaggccatgtgcaagcctcgtgcagctatgtgcgatgttcttcgggagctctaatattctggcacatcctaggtctccgctctataggtgaaanttcatatgtagttccgtagaagtatgcatgtctgatggcctgcgctgaactaaattacattatcatctagtacaaaatatcctacatatacccgcatatatgttaaacaactaagtacccaatttntactatccttttttcccancgtgctttaac

SEQ ID NO: 83535 - DNA, 549 bp, Triticum aestivum
  unsure (1)..(549): unsure at all n locations
  Clone ID: PAT_TA_83535
gttttttttttttttttttttagtagtagtagtagtatattttaattccaaaacatattgcagatgagaaagccaagaacaacagacagaatacacgtttacacgatcactgctacaagctccaaacaaaaaagatgagtacagaggaacaacatataatgatcttcagatcgcaaacgatatgaagcctgcttgagaataccgaaatactcccttctttatttcttcctcgcgcgcgtacggtgtcatctcctcctcttgcgggcttgcctcttgngcaccggtggcgtcctcctcctcaccctcagcagatgggcaggggcttgccgtcccacccttggaggcatcnagcatggggtcgatgacttgccctcgctgagggcaaggaacacttgttgcacccctcgccgggggacttgacttctcgccggtcaagtacactgcgccgaggcctggcggtgaacggtacacgggtacacggtcccttgatctgttggcgtnngcgcgggccgnctcgaagcangcgggcggctcaactcctgnngtggt

SEQ ID NO: 83536 - DNA, 550 bp, Triticum aestivum
  unsure (1)..(550): unsure at all n locations
  Clone ID: PAT_TA_83536
tgagatcgatcgagcttccacctcctgtcatcctcctcttgcaggtcgcagctgagcagcaacaaggccggaaaggatgtcgtggcagacctacgtcgacgagcacctcatgtgcgaggtcgagggccaccaccacctcacctccgccgccatcatcggccacgacggcaccgtctgggcccagagcgccgcattcccgctgttcaagcctgaggagatggccaacatcatgaaggacttcgacgagcccgggttcctggccccgaccggcctcttcctcggcccaccaagtacatgggtcatccagggcgacccggcgccgtcatccgcgggaagaaggatctgggaggcataaccgtgaagaaaaccggggaggcctggtgggnccgcatctacgacgacccatgaccccgggcatgcaacatggtggtcnagaggtccgngactactcntaaaacaaggctgtaacgaatgctcaatcaaacgggatgtttanattggngtcntccggnaaatatttgttggtccactaaaattggtgccttgtggt

SEQ ID NO: 83537 - DNA, 542 bp, Triticum aestivum
  unsure (1)..(542): unsure at all n locations
  Clone ID: PAT_TA_83537
cccaaccaaaccgtcgctaactatcactagtcgccgtgtggtggtcgtcgtcatatccctcgcctctgcctcgaccgcccgatcgcccatagcctgctggcctgctctgctagccatggaccggtccaagtcgtacgcgggcgggcgcatgcagatcgagccgtactacggcggcggcggggcggaaggaaggaaggcgcgcgggcggacttccggtcctactcctacagcgccggcgggacggggccgtcgtcctactccgtacaaccagtacgatacgggaggcccgggncgggtgaggaggaggtgaagcggagcaagtcgaagcggcggtggctggcggacccggacatggaccgcaacgccgcntggcggcgtacaaggcgtacggcgtggagggcaggtgaanggtccctccgcaagacttaagtgggtcaaggacgctactcgactcgtcaaggttggccngatctnaanaanaaaaacgtnccaaggtnttgtttgcnccntaatttgtcacctcccggngattgaaacntggt

SEQ ID NO: 83538 - DNA, 550 bp, Triticum aestivum
  unsure (1)..(550): unsure at all n locations
  Clone ID: PAT_TA_83538
gtttttttttttttttttttatggaggctacatgtgaacaagaaaggagaggaggaagactgtatagatctgaagaacctaaggagaaacaatcagagtacttgctggaacacatatatcttccatgataaaagttagatttcttgtttggtgctcatgcatgggttccatatgttcttcccgtcttattanaacatatctattggactaccatgcataaaaagccgtcgtttcataaactattgggactatacggcaccaatgaactattgatgctggccggcaactgacagcgacgtgaaagcttttcaaaacgatatcccgagtggaagagaaaanaagatanngagaaatagcangtatttaagaaaaaaatattggcccatatgtaacccccgnaactttaaatattagtccagcagcttatccatatatatacatatatcaaattcacccntgaatagtatccnaaatacantntgtttngagtaactanggaaaacngctggcangccaanaaaatccncgtgnggaacancgaacttgtggt

SEQ ID NO: 83539 - DNA, 366 bp, Triticum aestivum
  unsure (1)..(366): unsure at all n locations
  Clone ID: PAT_TA_83539
acgaaataggccgtgttttcttggacaatgatgttaagttcggcaaggttttcctttctctttttttattctactgcgtggtctatgtgtatattgccaaaggcatgcgtgagccatgcgcccggtgctggggcgcagagaccatctgatggtggaaacaccggaaataagagcgtgccgctgtgtgtttcctttgaaggaataaaaatggtgttccgtgttgtgcattgcttattgttgatgttccctttgggattaaggcttgtttaatgaacggtacggtcaattcattactgtacgtgcaaaactgggaaggtttactttaagaattaatcctccngttttaacttcatcaaaaaaaaaaaa

SEQ ID NO: 83540 - DNA, 550 bp, Triticum aestivum
  unsure (1)..(550): unsure at all n locations
  Clone ID: PAT_TA_83540
cggaaaattcatgatcattgtcgacggaaagcccgtcggcaatcctcaagacaatggcgagcccatgatccaagctcagcccggcgaccctgccgccatcttcgagcttcgagacggtcgtctcttctccggagagtgggctctgggccgtctcaactttgaggatcgatccatgacgcccaagcgcgtcttatggcgtaagagagaggaggtccatgacctccancccgttcaggtcgaggactttggtggtccccccgagctcaagttctcangtgctgggtctgggattcatcgagaacaagctttatgcacctatcattgaaggcgagaaccagcctatgcagattcacccctgggcttctaagtagtgttgactgacagagggtcgaaggaggctcatcgggagatccttatcgagaaaattcnttgaaatcataactttaagacaatcataccaagtttcatcatanaaanaaaaaaaatccagggggggcccgtaccaattcncctaaatgatcgtttangcgnctaacggcgtgttgnggtn

SEQ ID NO: 83541 - DNA, 468 bp, Triticum aestivum
  unsure (1)..(468): unsure at all n locations
  Clone ID: PAT_TA_83541
tttttttttaaagaatgctagtatctttgggtccattccggatgcaatgatcgatgcacccattaacataggctaaatccctggggactcaaccaatatgattcaacaaggtatttactaaaatctaaaatgacattaagcctgatggcttctgttgaaggagtactactactaagtctgatggcttgcaatacagaatagcagagggttgngttcgactgcataaaaacagagaacttgtggggcctatatgctagttacagaacttatatgctaataagggtaactagacgtggtaaaacgtcaaaatgaccgaagagataagatgctcttgtcttctctcctgtaccacgaacgattgatcccttgggtcctccttgcacagactacactccgttttggaanatattaagaaaggcggtgtgttgccgattgaancctcntgctcctcaaggnttcctcacccgg

SEQ ID NO: 83542 - DNA, 455 bp, Triticum aestivum
  unsure (1)..(455): unsure at all n locations
  Clone ID: PAT_TA_83542
ctcgtgccgcgaaatcccgttgcgtctctcgcgcgttaccaagctctcaagttttctcgcgccgacggcaatggatgaggtcaccgaggccgtgaacaacctcaacatctcgggcgtaggggccgcgggcgttgccggggcggaagggcacaagaagaatcgcatccaggtctccaacactaagaagcccctcttcttctatgtcaacctcgccaagaggtacatgcagctgcacaacgaagtanactgtcggccctccggcatggccattgcgacggtggtgacagtagcaaaaatctgaaaaataacggnttgctgtccccnaagattacaatgacatctactgttgatatcaaggacgagactaagacccgcctaccaagaagccaaagattgaaatatgcttgggnagacngagaatttngatgactgatggaacgngacngggaaaggaa

SEQ ID NO: 83543 - DNA, 465 bp, Triticum aestivum
  unsure (1)..(465): unsure at all n locations
  Clone ID: PAT_TA_83543
gaaaagggcaatgatgccactataagtaatgcctcagcagacggcaccatggatgaaagcagaactaggaggactattatcttcagtccaaagatatgtaacaatgtagatcttctggttggaaacataattcatatcttcccaccatggaaggaagttaaaatacaagaagagcatgtgattatttgcacctacttctcgcaccaccaccggacttgatactccggagatattctgtgctagctgcaaactagaggcagaccgccagcataaccgttgctgacanttaatgttgatgtactcgcaaggctatcctgtttgttttgtaacacaagtgtactgggctgcaaantatagcagaccgcaagcataaccntcctggatacctaatgctgatgtactgcatctctcctccgttttacaaccacaantactgagcctattcggttctcnaaaggggnnntg

SEQ ID NO: 83544 - DNA, 336 bp, Triticum aestivum
  unsure (1)..(336): unsure at all n locations
  Clone ID: PAT_TA_83544
tttttttttttttttttgagtccaaaccatgcatacaatcaaagagaagcgctcggaaatgagcaagtggaaagcttgttcaccattccctcacggctcaactaatggtggttcaacacaaaaaaaaaggcaccggtgtttgcaaacagtttctgggtacacgttttctttgttccgctgggttttattatcgaccactacgcctcattgccccaaccatacggggggcaagaaaaataggaatcaaacaaaaatgcaaggggcatcaattgttaagaaccgggcaaggtgcctattccccgtgggcaaacttgatacctgtccnaangggggggg

SEQ ID NO: 83545 - DNA, 468 bp, Triticum aestivum
  unsure (1)..(468): unsure at all n locations
  Clone ID: PAT_TA_83545
gataccgaccaactgttggatgcggttgtctctaatgccaatcctggtggcaagcagatatctggtgacagcgcttcttgcaagacttcagtgacagatattcctagcacttcgtattgtcgcttaaaagagccaaagcagtctgaatcatctgctcctcctttgctaatcaagaatgagttagctgtttcaaattttgttaaacatccatctttcccagaaaaggcagcggatggctgtctttctcaaaataatgcaatacagaaatctcaagatacgcctctggattgagagcggacagaacttgaaatgtgaaagtgcctcagcctcaaacagcaagggcgttgatacatcaagcaagntatcnaaagagtctcgaccaggagagatcctaaccacgaccaaaggaccccaacttatcaggttgtataaaggactccgggaatcntactaatggggaaggnnngg

SEQ ID NO: 83546 - DNA, 446 bp, Triticum aestivum
  unsure (1)..(446): unsure at all n locations
  Clone ID: PAT_TA_83546
agcgctacctgcagatgttctacaacctccagttcaggaacctggcaaagactgtcccaaggctgtttgaacatcctcctccgcaagccccagcaggcgcagggcctagtacgatgacggtaacgaggccgaaagaaagaaagacacagactangatccagaggatcatgaccagcttgatggggcaaaacctgctacttcctgaataataataatacattanaccaagggagacgantgggtgtgcatgcgtgatctcctcaaaccaangcctggcggctgcacatatatccatcatccnattgaaaccnggccaaatcaattgttaaatggnaatttgttggggtgttncatgttggtttcaaccngtgtcngttgattggnaaacctggatgatttaaanagattaaaatgcacatggtacattgatanatatttttganagg

SEQ ID NO: 83547 - DNA, 463 bp, Triticum aestivum
  unsure (1)..(463): unsure at all n locations
  Clone ID: PAT_TA_83547
tcgccgcccgcccccagatctagatctgagcctcccgtgaccagacgatggccgacgagcctccgccaccggcgctagcgaggaagagcgcgccggcgcagccgtggtcgcacgtggagaccatgcacctcatcgacgcgtacgaggagcgctggacggcgctgcgccgcggccagctcaaggcgcaccagtgggaggaggttngcgaccgaggtcgccgcccgttgcgccgccaacccgggggtcatcgctcaacgcaagacgggcacgcaatgccggcacaagtctagaactccgcaagcgctaccgcaccgaaggngcccgcccgtcactcgctctggcctacttcgccgcatggtttcctcnaacggggggcctcgcacctacccggccgcggtactcgccgcctncccgacgggacnaanaggagacnaggagattcaggaagaggaagaatgtnnnt

SEQ ID NO: 83548 - DNA, 477 bp, Triticum aestivum
  unsure (1)..(477): unsure at all n locations
  Clone ID: PAT_TA_83548
tgttgaaatcgtgaactgcgtctacgtgcatatgtgaacgaccttgtcgtacctcctggcctccggtcaagcagagcgcgtccattcagtcaatcctctgcatcccggttatgggcggcgtgcttgagcttggtacaactgacacggtgccggaggccccggacttggtcagccgagcaaccgcggctttctgggagccgcagtgcccgacgtactcggaagagccgagctccagcccgtcaggagcaaacgagaccggcgaagtcgcagcagacgacggcacgtttgcgttcnaaggaactcgaccacaataatggcatggacgacatanangcgatgaccgccgcccgggggacacgggcaaggaggaagactaagactaaagagaaccgagccctgtcagacgaccaacctgggacacatcacaaggagnntgaggattctacacctctgcgacaaatggcctgccaggnnntt

SEQ ID NO: 83549 - DNA, 467 bp, Triticum aestivum
  unsure (1)..(467): unsure at all n locations
  Clone ID: PAT_TA_83549
cgccatccttccgcggccgcttcgtccccgccaaggccacgcagcgcgcctcccctacactcatctccgccgcgcgccgcctcctcgccaccgcgctccttgacgaccccaacaaccagttcttcgcgctcctgtcgcagtcctgcatcccgctccacccgttccccaccctctacaacgcactcctctccgacaatgctggccctcatagccaccaccgcagcttcatagagataatggacaacatggacaacgacaccaagctgctgcatgacaggtactatgcccgangtgacgatgtcatgctcccggaggtccatatgatcaattccggggctgggtcgcattctttgtgctcacgagaagnacgccatcatggtcgtganggatatgcgactttggaagaattaaattccctgtctgatngaacgcaggatcaatntaccggagganatacttcgggggng

SEQ ID NO: 83550 - DNA, 475 bp, Triticum aestivum
  unsure (1)..(475): unsure at all n locations
  Clone ID: PAT_TA_83550
aaaccctaaaaccgcttccgcaaccacgtataaaaacaccgcacgcgccgccgccgccgtcctattcctcggagaggagaagccgccgtcgcagcaatcacagcagcccggagaacggccaggtccgacaagatgcanatctttgtgaagacgctgacagggaagaccatcaccctcgaggtcgagagcagcgacaccatcgacaatgtcaaggccaagatccaggacaaggaagggatcccgccggaccancagcggctgatctttgccgggaagcaactgggaggatggccgcacccttgcggactataacatccanaaggatctacgctccacctcgtgctcaagctcccgcggtggnatcattgaccctcgctgcangcgctcgctcgcaagtacaaccangacaaatgttcgcccnaaatgctatcacggcncacctaaggtttnactgccgcaagaaaatttggntntg

SEQ ID NO: 83551 - DNA, 600 bp, Triticum aestivum
  unsure (1)..(600): unsure at all n locations
  Clone ID: PAT_TA_83551
ccaccccttcgccggcggcaatttcagcgtcagcatgttcaagctggtgtggagaacggcgttcgtcgccgtaagcacggtccttgccattttgatgcccttcttcaatgccatccttggcctccttggcgcgctcgcgttctggccgctcacggtgtacttccccgtggagatgtacaaacgacagagcaaagtggagaggttttccaagaagtgggtggtgctgcagagcctgagcttcacgtgctttgcagtgacggtggcagtgaccgtcgcttccgtgcaggggatcacccaatcactcaacaactatgtgccattcaagacgaactgtgaatgaagtatattactanatgagaataaattcatcaacctatgtttgcgcaagccttttgtcgaaaaataaaaantgtgcataagtcatanagaatacacnagtgtagtgttgttgctacaaaactcnattganagcttgataacaagngtcgtctttctnaaaggggatgaaaaangaacacttgtaaatggcccatccgtntcaatntaaggaanccgggttaaattnttanaaaaaaggggccgtaccattccccangattg

SEQ ID NO: 83552 - DNA, 649 bp, Triticum aestivum
  unsure (1)..(649): unsure at all n locations
  Clone ID: PAT_TA_83552
gccaactacacgacacaacctgccttccttggttcctccacccccgtcctcccctgtcccgtcgcgtcagccactcgccgcggncaactaccgccgccgctgttgcagncgcccatctgcttccatcgcgtcgcggnggccgctcgcttcgccgccgcacgctccgctcttccggtgccctcctcngggaccctcggccacgccgcgtcgccttaaaccctagatctgcgctcnccgcccccgcgctggccgcggccgcgtactgacgccggcacgctgccgatntccatacgtcgctcgatnccaagtttagctgcttcgaatttagataanttcttcaatgatcntgttggaaggntgggaaaaanggtgggtcactcgaccganaaaggagaaacgcttanaaaagtgcnaatgaatgctgatgaaaaaaagatnttgaaggaacaattgatggctaactaaaggtctaatcannaaaatgattacttttnacggagtctgatggacctnaaaaatggaattataangggatgaanttccagaaatttggtccaagttaatggtaagtgcatnaattggaaanctgntccgtananaacaaaaaaggnggatttttccagggntttnagatttccaaatcgaaagg

SEQ ID NO: 83553 - DNA, 656 bp, Triticum aestivum
  unsure (1)..(656): unsure at all n locations
  Clone ID: PAT_TA_83553
ctggctcgtcctccacggccaccgcgacgaggcgcgccgcgtgctggagcgcacggtgggggacgcggaccgccggctccaggagatcttgacgtccgtgcaggaggccacgaagcaggcgggctccggcggcggcgacgcgccgtcgtcggcgagcgtgcggcgcgagatcctgctccggccgacgcccgccgtccgccgcgtgatgctggccatcctggggctgcaggtgttccaacaagcgtgcggcgtggcggccatggtgctgtacgccccgcgcgtgttcaaccactcgggatnactccgancgcgacgtgctcggcgcaacgtctcctcggngccgccaaagacgtgggatngtctccctctgttctcgccaanagctccgncgccggncaatctgctcacaacgccggcggaatggcgcgtcgcttcnggtcctcggctgtcatacgngnacgtcggcgcaantgctccccgccgctgggttaangnnacttccgctgggtcgaccgtattgatgtaggtcgaatctgcctgggtcncccaaggactggtcgaagggtaacggtatacccactgggnggcttcccnttaagggggaaggggcttaacttcgaatnccggggnggttccantccnttaaaagggccgat

SEQ ID NO: 83554 - DNA, 184 bp, Triticum aestivum
  unsure (1)..(184): unsure at all n locations
  Clone ID: PAT_TA_83554
nccgtttgatgaacttttcccaanccctgcccgccggnaaanatgaataaaggagttattaattanttgatatcattaannaaactanagaggccnacatatatttcgataatgattgaanttacttgtcgaccatccccttnacgantgcatagtcactatactcttnaagtaatgtgtcaag

SEQ ID NO: 83555 - DNA, 685 bp, Triticum aestivum
  unsure (1)..(685): unsure at all n locations
  Clone ID: PAT_TA_83555
gaattatccaaaccgaaacatatagcgaggaacacagaaagtctccaaagtttgcatatcaatttctgctattgtctggatcgccgctcttgtttgcctcattattgcttggccaaaaagtgactggctttggcttattgatgtattcaattcaatacaagttggcatgacagcaatcaagtacatccctcaggccatcatgaacttcaggcggaagagcacaattggttgggagcgttggcaatatattacttgatctcacaggaggggtgctgaatttttgtcagatgggtgtgcagtctatagatcaacatactttggtgaatttccaagggaaacattggggaaaaccttctttcattgggngacggtttctttgantcctgttcattatccaacactacgtgttgtacctgtcaagaaggacgagaatggtaaggnaacattctgaaaggtancccccttacaggcctcggacaactgaagaantaacnttgatcaacgtagtaatgcgccattgatcaccgcgttgannaggcaccaccatgcaattattgtcaaaggaatgcngcctctgataatacgctaaacttacanttgggaacggganaatnccaaaacagtggttaagngcctttaacggattgangttantcaccgcaaaaaggggcgnacatcccatgnn

SEQ ID NO: 83556 - DNA, 589 bp, Triticum aestivum
  unsure (1)..(589): unsure at all n locations
  Clone ID: PAT_TA_83556
agcgcctgtgggagatgtcaatcctgtgggagaagagcgcgggttggcgatggctggttcggcggacgcgtgactcgaagcccttctttttcacgttcgcggcgctgtgcggcgtcgtccccggcgtaatcggctacggcgtgatgcagctcaccggctcccgcaacgagcagctcgaggcccaccttcgctccacggcccgtcccgagaccacgatgatggggcaagtgaacagggagaggctggcggagtttctcggcgagctgcaacggaaagaggacacgaacgacaggtacgtggccgcgctgaggggggagaccctgaccaaggaagcgctacgagcgcatccagcccttgcctgccgccaacgcgcaagcgaaccaagagactgccggagccagcgcggaggaggagaggccaaggcaaatgagtcatcagcagactgcctcaatcaatttttactgctggacatacgcatcttcggatatgtaacatcacccttgaactcatgcctgggnattgancctttgtttaaccgcgattaactttgncatccctnaaagntntcnacaacgtcaaaaaaaaaaaa

SEQ ID NO: 83557 - DNA, 610 bp, Triticum aestivum
  unsure (1)..(610): unsure at all n locations
  Clone ID: PAT_TA_83557
ctccgccgccaccgccgcccaagccaggtgctgaggctttcgttggtctcttcgccggcgacgagcacccaccagggcacgggcctcaggatgcagtccttggtccggaatgtctgccgagccggaagccgtggagcggcggcgaggctcctggaggccgccgcggttcatccgggggcggcgcanccgtcctcggccgtcagacacctcaggcatccttgcgggttcgctcgtccgatcggggtanatcaacccaagcctgtgcagcgccggaccattttgcgtgatggcggccgcgttccggctgccgcctccgggattcggtctctgcgcgaaagttctcgttgcgacgaggggtctgtcgacngcggggaaatgctgctgaagttgcctctgantcggacgattcaactctcctgcngttgancanccccgcgcatcaagtcaagaggctgacaagaccgctngcncattatgatatctgaacaaaagcgtcgaaaggccgccggaaagngatctaagtgaacctgnngtaaatcaantaaangaatccnaaaaaagggcanccaatgaangattanngaagnaacctgggtaaaaactcaatgnt

SEQ ID NO: 83558 - DNA, 612 bp, Triticum aestivum
  unsure (1)..(612): unsure at all n locations
  Clone ID: PAT_TA_83558
cgattagcgagagtcgttcctccaccaaaccaaccaattcgcttctccgtcaacttcacttcctcgtcgacgcctccgtcccaccaaccatgccggcggccatggcggctgcggcggcgcagaggctcctcgcggcgagcacgaaaatcatcggcgttgggcgcaactacatagcccacgccaaggagctcggcaatccggtccccaaggagcccgtcctgttcctgaagccgacctcgtcgtttctccacgctggtgtggccaccgccgccgtcgagatcccggagccgctcgagtcgctacaccacgaggtcgagctcgccgtcgtcatctcccggcgtgggcgcgacgttcccgaggcgtccgccatggactttgttggaggttatcacttgctttggacatgacagcaagggacttcagtcgttgctaagtctgangccttcatggactttggtaaaggacagacacttaaccaattatgcagtattcaaatcactgtactaacccgatgtnncaactcggtgaagnaaatatactaggaaaaggncacacgnagcatcaaaatcctttcgaaactaacatcacagaataangggggatgaanaaagn

SEQ ID NO: 83559 - DNA, 607 bp, Triticum aestivum
  unsure (1)..(607): unsure at all n locations
  Clone ID: PAT_TA_83559
tcctagtgcattagatcacatgattatctattgtgacaacactagtgccatatcctttgccaaggagccaagatctcacaagaaaaccaagcatatcaaacgccactttaactccctctgtgactatgtcaaggaaggtgacatagagatttgcaaagttcatatggatctgaatgttacagacccttgactaaacctcttccacgagcaaaacatgatcaacatcaggactccatgggtgttagatttgtcacaatgtaaactggattattaactctagtacaagtggaagactgttggaaatatgccctagagacaataacaaaattgttattatcatatttccttgttcttcataaaacgtttatcctccatcccataattttattaaccgggaactcaaatacatgtgtagataataaacaaatattgagtccatagtagcctctactagacnacccgttgataaaatggtaaggtttcaaccatggcatgagtgcatttatacaggcatncattagagaatgatgtatggcagaccaacatagcttacattgatagtgctanttaaatgcanacttctngncaatacgtcctggcagaataa

SEQ ID NO: 83560 - DNA, 346 bp, Triticum aestivum
  unsure (1)..(346): unsure at all n locations
  Clone ID: PAT_TA_83560
cgcccaaggggcgcgcaccggtgtaccacacgggctacgacgcggtcacgctgcccaggggcacgcactacttcatctgcgccatgccgggccactgcagcgccggcatgaagctcgccgtcaccgtctactgatccgtcgtacgtccgtgtgtccagcagctccatcatctcgatcgatctggactacgtgttggctagcagctactctgtgcgcggatcggaagcacgtgtgaacgtcgcgcgctgaagttctcttcatcattgtgacaacaagttgagttcattgggcatatatatatatatatatatatatatgtgatttgccactaaanaaaaaaaaaaaa

SEQ ID NO: 83561 - DNA, 434 bp, Triticum aestivum
  unsure (1)..(434): unsure at all n locations
  Clone ID: PAT_TA_83561
gccgcactcgtcatcaatcgccagatcctcctcaggcnggntanaatnaattctgcntctgcactttcacaaacctgcangcantcnctgtangaaatgggcgcgaggaanttcagcgtcatcagcatcccgccgctggggtgcatcccgtcnnataggctgcnccggntgaancanctgggaacgcanggctgcttcaacncgctcaangacctgtcgctcagctcctanccnatgctcgcggggatgctgcagcagntcagcgaccanctgcccggcatggnctactccctcgcctaagcctacgcgatggtctccntcgtcttccaaagncncggacncangctgggaactncagggnnctggnaggcncgtncancggcgtggcctttngggcggnngtcgcataaacgagacgcnccggttnncccttg

SEQ ID NO: 83562 - DNA, 628 bp, Triticum aestivum
  unsure (1)..(628): unsure at all n locations
  Clone ID: PAT_TA_83562
ttnggtgggaaattacacctaggctacatgctgattcgtgagaaacagaaagaacttcaggagcagagaaataaaaggagaccgggcaaagctgaagatgatagacgatcaagagagcacagcaaggatcgcaacggccggtcgtccagggatagagaaccagaaaggagagacagggttgagtctcgagatggtagaagagattatgaaagggatcgtgatagacgtcatgatagggacaggcgccatgaccgtgatcgggatagggattatgaccgctccccgtggacatgattcaaggaggagagagcgttcacgctccaagggagcgcagcangcgccacgaagagatactaaatgttacaccatgcctgacagatttaggatactgggcggcgtctgttcaaagatatggttgagcttgtgctcgtatcttctgaagaccggtctacttgacctaatcgcatggagtgttancattataaacgcatccgggatcaatgaanttgtcttgcaacggtnacttaaatccgccattcaanatgnaaaaccgngctnaccttactgnccgggtancagttcaaccnccaaatagtncaaanncgtccnaaaataccctttgggnggg

SEQ ID NO: 83563 - DNA, 340 bp, Triticum aestivum
  Clone ID: PAT_TA_83563
ctggtagctcgtcttctcaaggtggtggctgctgcagctaatctgctaacgccgttaacaaatgcatatctgtcgtgtgtcacataccagctgcgctgtgaaaaatagttattgctgctccagggtgccttgttatttgacgcaccaatggatcctgtgcctgatcgacttgagagattcagtttatttacgtcaggtgtttataaactccctgtaaatcactagattcttcactgttttcccgtcattaggcactcaacaatcgtgtgtccgtttgcatgtgtaaataaggcacatctacatattgtttgatatgatattaattgtcctgttcgaataa

SEQ ID NO: 83564 - DNA, 534 bp, Triticum aestivum
  unsure (1)..(534): unsure at all n locations
  Clone ID: PAT_TA_83564
gcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtangctggccaggaggggcggcgtcaagcgcatttctgggctcatctacgangagacccgcngcgtgctcaagatcttcctcgagaacgtcatccgcgacgccgtcacctacaccgaagcacgcccgccgcaaagaccgtcaccgccatggatgtcgtctacgcgctcaancgccaaggccgcaacgctctacggcttcggcggnaagccgcntcccttcgatgctttgatgtnacngcgttgtcagttttgtcnagttggcggtctacggtntttgtctgtactcgnttcaagtttcatttcancccattggggtatattnctgctatanaangaaaccctcgtntncccaaaaanaaancngaaaaaaaaaaaa

SEQ ID NO: 83565 - DNA, 208 bp, Triticum aestivum
  unsure (1)..(208): unsure at all n locations
  Clone ID: PAT_TA_83565
cagcgctccatcaccatatgacaacaaaggattccaccttgatccttgaagtggacctccagtgcgagaaatgttacaagaagatccagaaagttctctgcaagctccagtccaaggagaagatcaacaagatcgactacganaacaccaanaacaaggtcaccgtcntcggagccttcggncccaagaaagctttccaanaagcnga

SEQ ID NO: 83566 - DNA, 551 bp, Triticum aestivum
  unsure (1)..(551): unsure at all n locations
  Clone ID: PAT_TA_83566
cannacatccaacgtctaacatccaaacaccaaacatcaatcaaaatgcagttcaagactctcttcgccgcctccctcctcggcctcgctgccgccgcccctgcagaggagtgcagcagcaccaagaccagccccgccaagtccggcaactctcccgtccccaagaccttcggcctcgtcgctctgcgctccgccagccccatccacttcacacacttcagcgccactgaagaacggnttcttgcttggtcttccagcggataagcagaacgctacctgctccggcaagtctgatggatcagctgtcttccgtctgagcganggtgagctgtacttgtncaacaccggcaagancagcagcgcgcttacactgatcgctctggaatggggcanngtgttcttcagtacncactgttagcaagaanctctccccgattcttctggaaatggcnggaaatngacaagtctggaaactcacttnacaaggtagcgtttacggctgccttaangccggaggtctggacgttggttntacggngcatnncctggaa

SEQ ID NO: 83567 - DNA, 203 bp, Triticum aestivum
  unsure (1)..(203): unsure at all n locations
  Clone ID: PAT_TA_83567
gttccggggagganacgacgaggacgacnacggtggngctcatctcccatcgccgttatctgggaacgggaagtggaacgagctcttctgggcggtgcacccatctggccgtcagatcctggacaacatngacaaggtgctccagctggagccggagaagctgggcgcnagccggcacgtgntccgcgagtaccgcaacatga

SEQ ID NO: 83568 - DNA, 450 bp, Triticum aestivum
  unsure (1)..(450): unsure at all n locations
  Clone ID: PAT_TA_83568
ggcaggaagagagctgcctgaagcggtgcctgaaggaggagaggaggagaagccacgaaccagcgacagcgaggatgtacaacgcgccgccaccgccgcaggacatgtcctactacgagcactgccagaggcggcacgaggagaagggctgcctctacggatgcatcttcactgcgctgtgctgcttctgctgctacgagacctgcgagtgctgcctcgactgcctctgctgctgctgcaactagccggggctagctccggaggacggtcgagacgcagcagatggaggtcgcctccgtctcttctacctacctaccaatctacctantgatgatgattcagttcccgtttaatccggtggtgtgcaagtgcaaacataataacgcaccatgtcntacgtnntacaggaganatntttactcngtaattccaatttgacatncctaacca

SEQ ID NO: 83569 - DNA, 661 bp, Triticum aestivum
  unsure (1)..(661): unsure at all n locations
  Clone ID: PAT_TA_83569
atccatcgcaatggccgccgccgccgcgctcctcctcctcctgtgcgccgcgtctctcgcgtccgcagccgccgacgacgggttgacgaccttcaaggtgtacttccacgacgtcgtggcggggacgaacccgacggcggtgcgcatcgcgcaggcggcgtcctccaacacgtcgtccaccaacttcggcgcggtggtggccatcgacgacccgctgacgacgggtcccacgcgcgccgcgggcacggaggtgggccgcgcccagggcacctacacgttcgcggaccagcagacgttcggcctcctcatggtcatgaacttcgtgttcacggccggcgagcacaacggcagcacgctctcatccctgggccgcaacgaagtgctcaacgacgtccgcgagatgacatcgtcggcggcagcggnaattccgcatggcgcgcggtacgtcaagngcacacatcnactccggngcaactccgggacaacgtntcaatacacgtcaagtaaaggctaactactgttacgaccctgctgcaatccggccgggntcngtagtcatcantcncggggcttgnnaacttgnggctcttacggaatcgnttnaaaccanttcacaaantcaatttaanatttggcaaattatttaaaanntacncatttt

SEQ ID NO: 83570 - DNA, 192 bp, Triticum aestivum
  Clone ID: PAT_TA_83570
ctacgacaagagcagaataattgggaagggaggccatgggacagtctacaaagggatagtcaagggcaacgtgccgatcgcgattaagcgatgtgcgcttattgacgagaggcagaagaaagagtttggtcaggagatgctgatactctcccagatcaaccacaagaacatcgtcaagctcgagggctgttg

SEQ ID NO: 83571 - DNA, 616 bp, Triticum aestivum
  unsure (1)..(616): unsure at all n locations
  Clone ID: PAT_TA_83571
agaaaatgtaaagactaccattaaagcagcccaagcgagacttactatatccatctaaattatgtctcctatttctatgaagggattattctactattgatcaataatcatagtggaatcaagggtacagagtcaaaaagggattccgccctaaggccatggatcaatcagttcaaggaatttactcctaacaaattcttataggaattctggtagaattagagagcattaaaaatacgatactatagcccttttttccttaaaaaagaaagagtacgggaatgatgtcctgaatagaagaagcgggaataggaagattttttattccttttgttacccttttttttaagcaaaggacgcccgaatataccataaaattatcgatagataaatatttattggatacctaccttacctatgttattttgactaaacctgcagcttgcttgtatcatccatgaaagaatgaagagacttacacaactctaaatgattttgatngaccnattaaccgatcncgttngattaatagcctacttatgtagtaggaacatagagtcataaaaaatgtnaatataataatctgaatctcgngagtctctgaactaatgaaaaa

SEQ ID NO: 83572 - DNA, 544 bp, Triticum aestivum
  Clone ID: PAT_TA_83572
gcaaagcaaagcacaacgagaaggtgagaaagagagagagagagagagagagagctatggggcagtgttcgtcctcccagcacccagaagcagagcagcagaagcagcagcaggcggctgcctgtgttgacatccagaaaaggcaggagcagctgcggaagaaggcggctgcgcacatgaaccagccataccaggcatctagcaatgacgagctggtcctcctggtgtcgctggattcaatcaccaagattgggtgaattgttcatctgcggataatcatctctagcttgctgctgaccattacggtgaacacccacctcgtctctcctaaaatgaaggatgaagttgacaggccctctttctctttgcttgtgtcatcaatatgtaaacactcactagctaataaagctaaaaataagactgcctccattgtcgatttacgaaaatttatcacttaaacctgtcgtgtattcaacaaatgttttttgtaacgtcatgtatatttgagaaatatcacgggacgccttcgttcaaaaaaaaaaaa

SEQ ID NO: 83573 - DNA, 595 bp, Triticum aestivum
  unsure (1)..(595): unsure at all n locations
  Clone ID: PAT_TA_83573
atagaaactagctatccatgtgcctgaaccatgacttgtggtttctattggtttttttaactctagcctacctcatattgctcgggataaaatgctttgttgttattgttgtttggtagatgataagtcaatgatgaagcccggtgattctgatatattattgtctgtctggtttgatgtatgcttgttaggtagtggatagtttcagccctcgctattgcagatgctaggatattgatactgttaccttgattctttgttgggtgataaggaaatttgtccaactaatttgctttgcagcattttgtggctttgtttgggatatatgattgatggctacgttttttggaagtgagtgccangttangtgaagggtacctggtgtacatataacttttggtcgaagaacaatgtttgaaaccaatgctggaatgttccccgtatccatattctgccggaatgttaatggggtttgtggtgaataagcaattaggatcagatataggactgagtttgatgagattcctggggaagtgctgcaacaatatcccctacattgtaataccgttgcgtggctgcaanctatccgcaattg

SEQ ID NO: 83574 - DNA, 244 bp, Triticum aestivum
  Clone ID: PAT_TA_83574
gttggcgatgatatacgatctgattctgaaggtgaagaggaacatgaggattgattgagctgtgtagagttggaagataataagtaacatggggatggattgagctgtataagttccaaaggcgaaaaggaatacgtggatggattgagctgtgtaaattctgaaggtgtatcaaatcattctgctgtttttcttctgtccttgttcttgataagtaacaataaattagtgcaaaaaaaaaaaa

SEQ ID NO: 83575 - DNA, 602 bp, Triticum aestivum
  unsure (1)..(602): unsure at all n locations
  Clone ID: PAT_TA_83575
gtcttgctcagcaatcatatcgcacgagatactattgactccaagtacagaccagtccagtactgttgtacggcctggttccgtggaacagagatgggcaagcaaaagattgtgctcaagttgcccctggatgacaagaggaagaggaggaaggccttcaaggcagctgtgggaatgaacggtgtgacgtccgccacgatggagggcgacaagatcaccgtcgtcggcgatggagtcgaccccatcacgctcacaaccatccttcggcgcagcctcggctacgcggagctgctcagcgtcagctccggcgacgacaagaagaagggcgacgggtacggctacgggagcgccggtggcatgatgtacggtggcggcggatacgtggtngcaaagangggaaagagagcaangagacaacggcggaaaanttnggcgcggtgggggctacggggcattacaggcatccgtcgtctctncctgccgcctacagngntcacgcatccgccnacccgcgctatnctaccgcagataccgngaagaaaggccngntcacatcagtgaaaaatctcagtatcgagattggtaagnggcacnatgnatag

SEQ ID NO: 83576 - DNA, 594 bp, Triticum aestivum
  unsure (1)..(594): unsure at all n locations
  Clone ID: PAT_TA_83576
ctcgtgccgcgagttttttttttttttttttaagagaatacaactaatatataacggtgatgttaaagaaggactaaaatattacaaattgatggcaaccaagagatgttataaattttggtggcaaccaaggaatcattaattataagtttcaatagcaacaagggcattctgtcttatttcaatgttgcgatcgtgggcgggagatcacatacacattgcctcctccatcatcccacgcatcttaagacacgtaaacacaataattaaaaaagcaatatataattaatcggacgaataacaatgatagatatagatccgggtgatcgcacagcgtgcggctaaggaactgggaccgaggagggtatccgtcaaccggttcaatcggccgggatgacttgctggccacancgtctgccggatccctccggaccccacgagaaggcggcccaacggccttggtgtccangcgcaaacgggcccaagacactnnacgggtcaaacgccgtcggctnccggtgnctgtcgcncacaggcactcacacgggcntcttccgctangacacacgcaatatcggttggccactgaccgat

SEQ ID NO: 83577 - DNA, 393 bp, Triticum aestivum
  unsure (1)..(393): unsure at all n locations
  Clone ID: PAT_TA_83577
tggcgctgtagctcgcatcaagcaattcgctgaagagactggcgaggagaacttaccgggagagacacaccagcccccagcccagtggcctgacaaaggagctatacagatcaacaacttgactgcatcgtacggtgacggaggcggggaagctattaaagctcttgatgcaatcagtttggagatcagaggaggtgagaaggtaggtatttgcggtcgcacaggaagtggaaaatcatctatatttcttgctcttctgagactactagagtctacgtctggcagcaccgttatcgatgggattctctcnaccttccgttccccngagaaacattcgttggcgtnctcaacantctgacgcaagacaatttcgtattccccggnacggttcaa

SEQ ID NO: 83578 - DNA, 567 bp, Triticum aestivum
  unsure (1)..(567): unsure at all n locations
  Clone ID: PAT_TA_83578
ttttgctgaactgaaatgccgaagggggctagtaataacatggtgatgggggtgcacaataatacataaggttcaacggcaccacattggccaatgtcgcacagttgcgtagaagtacagaaccaaccgcgtggttacatagcaatcaaactcagtccaagtcttctggatagattaatagcaactgctacgtaattcagcagatcaggcgcaatatataggcgtctcccaaaagcaagctgaatggcagcagcgatactaggcatggtgcgcagaggacaggactgcaaaacgctaggggggctcacggactgtttcttaagggcgctcataagtgaattagagtttttgacggctgggctgcaacctcctcaatcctgccaaacggagatcctgatggagggatnaaagctanggttgcatgatcctgtccgcctatttggcgtgcccaagctgccccggggtcatcgcattgtcccctgctctgaggaatttcgcaaactacaataaaattgggaggcntaaacattggaattcggtgtggcaatggataactacagggtatcc

SEQ ID NO: 83579 - DNA, 604 bp, Triticum aestivum
  unsure (1)..(604): unsure at all n locations
  Clone ID: PAT_TA_83579
ctcaactaccataagtagatcctctcctgttggaattacacctgcaggattacaaagcggccaccacgctcttgatgagcacatccattcacttggaaagatgaatgtacagaacaagggacgaatggattgtggatttcaagagagtactgctttccatcctcattctctccctgacttcaatgacagactaagaaatggtatctcctataactgctcaatacctcccatcggtgttaagagcaatgctagagctgctgaagcaatggatgtcaggcacatttacaaaggaggttgtgggcatctcaacaatcaatcttctgctcatactgaagcacttgggttttcaaagaactggtaactgcctctctatggtcaacaaactancatggagtaattctaataacctacacaaacagccttcctctcccaagatatggcctaacatgggccaattacaataatatcatctcgccattgatcaaatgcatggaattcaagacacattgccatgcttaaaataaanccaagaacacaacatgtggatnggccaacntaancacaattggataacactgattcaggganatatgaaccagatcac

SEQ ID NO: 83580 - DNA, 532 bp, Triticum aestivum
  unsure (1)..(532): unsure at all n locations
  Clone ID: PAT_TA_83580
caccaagcaaagctgcaaggatgttttcaggaacacaagacaagtgtgcgacttgtggtaaaactgcgtatcctcttgagaaggtaacagtcgaagagaagtcctaccataagtcatgcttcaaatgctcccacgggggctgcgcgattacaccttccaactatgcagccttggagggcatcctctactgcaaacaccatttctcccaacttttcaaggagaagggaagctacaaccacttgatcaagtgcgcgtccgtcaagcgcgctgctgaagcacagccaagaacaaccggcctctgattcctcctcctgaccacgccatttaaacagtgggggtttggaggcgagagattgggaagcctccctgtttcnacttaaaaccgcgtgatgtatgttatccatctaagccccgaggatactagactacactcaatttggtacctctgcgtgcaactggtnatatcaangaacaaggnattgcgtcatttcaatgaaacgttgtgacaagtatgaaatctcactgaaaaaaa

SEQ ID NO: 83581 - DNA, 614 bp, Triticum aestivum
  unsure (1)..(614): unsure at all n locations
  Clone ID: PAT_TA_83581
ctcccccctccctgcctccttccccggcgccccgctcttcctccttccgctccggcgatgggcactggccgccgcggcggcggcggcggcggcgtgttccaccgcctcctcgccctctcgtcgctgctgctcctcgcttccggcgaggtcgtcttcgaggagcgcttcgaagatggttgggagactcggtgggtggaatccgactggaaaaggagtgaagggaaagcaggaaggttcaagcacacagcggggagatactctgcagatcctgatgacaaaggaatacaaacaacaatagatgccagacattttgctatctcagccaagttcccggaattcagtaacaagaaccggacgcttgtgtccagtactccattaaatttgacaaggatattgaatgtggcggtggctatataagcntattccggttatgtcaacaagaaaaaattagtggggacactccgtaagctgattttggacanatatatttgtaccaaacaaagaactcatcttatanctctacanggnagatatcatcaaaaagtnanaatgtagaggcanttaaaacngtnactcatctaggcnangatctaaancgctgtanacgtnaaaaa

SEQ ID NO: 83582 - DNA, 353 bp, Triticum aestivum
  unsure (1)..(353): unsure at all n locations
  Clone ID: PAT_TA_83582
taaaaagtggcggccgctcntttttagtggatcggcngggggccccngaattnggnacaaaaggcacatatggttagaacgcaacgcctgcaccttcagagaaaagcagccaaacgcancacatgtcactaatgcctgcaagcgcgacatggtncaatggcgaatggccggggctaagtgcattgagctacccttcggggaagtgacgtgaaaatattgccataggacctaggcccagctagaggggcagttgtaatttccccttcttgatcacttgatcgccctttgtcactctcccttctgctaaaatcaatganatgccagcaatgctggncgcttcaaaannagagagt

SEQ ID NO: 83583 - DNA, 449 bp, Triticum aestivum
  unsure (1)..(449): unsure at all n locations
  Clone ID: PAT_TA_83583
gaatttgataacgctggtgccatgatgagtgtagatgagacattgatgtgctccttccaaatactgaaacctgcgaggaaggtgttgggtggttcaactaactaacaaatcaggcttcaagtcatcgagaggatggtgacantggcaancctgatatcangttggttggtgagcagcacgccagtggtcgacggggggttgttccatcataatcatattacaccgnctgcaactgacaggcccaatgcatcttctcttcaatgttggttcaacactcttgtanagtattanttactgngccggatctgaaaggatgtcaatgatttcatttgcgtccncaagttcaaaagattcacgancgcntgcttaaaataagngntcccaganaacatgcaaggtgctcaacgacgnaagaacgggatttcaacngttttcttttggntacctac

SEQ ID NO: 83584 - DNA, 425 bp, Triticum aestivum
  unsure (1)..(425): unsure at all n locations
  Clone ID: PAT_TA_83584
agcgaacaggagggagattaccgccatggcgaggagcctgcgtcccgtggtggacctccgcgtaaccaagaatcccgagccggccgaagaccctgcgccatcgcctatcgtctggccgaacgctttggcgccctcgtcctcctcgacacctcctccgtcgcgtccagccatccatcgatccgctgaccgccgggccaccgccgccatggggtttcatcgcgccgctataacacagcgaggtcacgtgccatctgaagagcaagttggtacctggaatctcaagtcccaagtcaagagcaggtaccacangattgangcgccttggangatgctgtgatgagttcntgaanggtccaaggcgtcgtctcccantcaactttggggttgctggaccgtttcnccttaanaaggaattattaatttgt

SEQ ID NO: 83585 - DNA, 665 bp, Triticum aestivum
  unsure (1)..(665): unsure at all n locations
  Clone ID: PAT_TA_83585
gcatttcttcttcttcttgtcagtagctgtggcctgcacagctagcgccactgtaccgccattgttttgttagcatggccccgagtaacatcgtcgttcagagcagcagcactccgccggttgccggcggcgacgaggagttcgcgccgtctgtatggggagatttcttcgtcacctatgccactcccgtctcacaggcatcagagcagcggatgagtgagagagcggagctgctcaaggcgcaagtacgtcaggcgttcgatgctgccagcatggatgttgcaggtctgatcacgtacgtcgacaccctcgaacgcctcggcttagacaaccacttccgcgacctcatcggagctgccctggaacgaatcggagctgangagctgccggancacggnggcgggctgcaatcgtcncgcttcggtttcncctgtccgggaaanatgggatanggtatcnaanatgnttcnacgccttaaaaaagacccgggggttttgcccaacctctgnatnacaacctaagggtccccnaactntaaatgnggtcaatggaatncccggnaggtggcctcaaaancatcncttccaagggcnccnctgaaacacacaagggaggtaggcnccgtttaanaattaacanccccaatcccnccaaattnnagggg

SEQ ID NO: 83586 - DNA, 677 bp, Triticum aestivum
  unsure (1)..(677): unsure at all n locations
  Clone ID: PAT_TA_83586
aaaagagggagaagaggggatctcggagaagagtcttcgcctcggagagacgtgctctgcctagcatatatagccacgaaagagagtgctggccctgccggccttcgtctagctatagctaactagccagcagcagcgtgcgtgcgtgcgttcaaggcagcagaggtagagaggttttgagagagagaatggcaagcaggcaaggtgtagccgcctccatgttcgccacggcattgctcctcggcgtctttgcatccatcccacaaagtgctgangccatcggggtgtgctacggcatgagcnccaacaacctgccggcggcgagcacngtggtgagcatgtacancgcgaacggcatctcngngatgcggctgtacgcnccggaccatgcgcgctgcaaggcgtgggcggaacngcatcaacgtggcgtnngcgccccaacgacgtgctgtcaatatcgcggntancccnccgaggcgcntctgggtgtcancaacatcaaagcgtaccgtcgtgtcnttcgctactntncttggcaacaagtgccgcgngcgtgcaagactngngccgcaatgnaactttaancggnctgcggggccggntggcaaataaggtacactcgtttcagcaactggctttancccttcgnggattacgnaggccgnaatgnccttnnt

SEQ ID NO: 83587 - DNA, 657 bp, Triticum aestivum
  unsure (1)..(657): unsure at all n locations
  Clone ID: PAT_TA_83587
ctcctctagagccttcgcgtctcggcggcagtcatcggatcggaacctgcacaagtagaagtgcgcaacaagccttgccactaacatgccttcagtcgaggtcgaggtccaggtgggcggcgccggcgggtggaggccgaagcagcagcagaagcaccgccaccaccaccatccccttgagatccgtcaggtgtgggcggacaacgtggaccgcgaattcaagctcatccgcgccgccatcgagcggttcccctacgtgtccatggacacggagttcccgggcgtcatccaccaccctcccccggccgtccaccactccacgctcaccgcgccgcagcgctacgccctgctcaagtccaacgtcgacgcgctgcacctcatcaaggtcgggctgggccctggcgccgtcccctgggctcccgcccgcgctcgccttcagattaactccgcggcttcaacccgcgcgtgaacgccaagcgccggatcgtcgcctgctcgccgcaacggctcactcgccgcaacgcgcaaggggtccgngcgngctcgcggctntcctctcggctatngaaccgcgtcctggtactantcgctagattgcactctaactgcangacgantcangggtccgnttcggcantcgncattngcncttaataa

SEQ ID NO: 83588 - DNA, 669 bp, Triticum aestivum
  unsure (1)..(669): unsure at all n locations
  Clone ID: PAT_TA_83588
tatgagtgtcccaggtcaatgctcatcccagccacaatttatcaccagcgttgggaggagtaaccgctccaatggccccggcactcctcttatcgaaagcatagatgttgatcaaattgttattccagagaaaaacagttggaagaacttattctcatacatagggcctggatttctcgtctcaattgcatatattgatcctggaaactgtaagattaacggattcacttttcttcgattctcattgagtatttcccttccatctattgtgtattcttcacaaattttttggtgtgtcttgcagttgagacggatctacangctggagcacagtacaaatatgaggtgcctgctgcttaatcctaagttcccacttgtgcgtgtgtgtgttgtgtttttttccttttngttctccatcaattaagcaagcttcctctaacaaagaccctcaatggaacttctttggatatacttgtgcatcctgtgcgctctatatcaatcactgcagcaagctagggtgtgacaaggaaacatctgcaaacaatgcaggctgagtaccaagncacaanttgcctaaggntctgaaaacttcggtgtgangnganatccgaanaatggaangnttgccaanangngtaaaaccatangggtggtcaaanggccaaacca

SEQ ID NO: 83589 - DNA, 161 bp, Triticum aestivum
  unsure (1)..(161): unsure at all n locations
  Clone ID: PAT_TA_83589
tgctgccgacgggcanttgaagcggtcgccgagccantgcancgtggtcaccgccgcgcaaccggacncggnccccgaaaanccgcncgcgcccaaggcgnaagccgtggggtngccgccngtgcggtcgttccggaagaacatnctggcggcgagncngg

SEQ ID NO: 83590 - DNA, 494 bp, Triticum aestivum
  unsure (1)..(494): unsure at all n locations
  Clone ID: PAT_TA_83590
aagaangaaacaagggtacaagaacagcccgctaaaggaaanaaacaagggctacacaagaacagcttgagagctcctctccgatcccgacccaccgcctgcaactcttcttctctcctacgtgttcgtcagcccgctaagtgttaagatggcttcaagtgatggtcaaacagaagctgcggccccatctgtccccaaaaaccctgctatggcatcatgccggaagaagaaaacagatgatgctaccttcctcgaagatctgaaagaccacatcnatgagttcatccatgcctccatggatgagcacaagacctgctttaagaagacgatccagaagattttgggatgtcgaagntgttgcanaganattcgcggcanaagcgaaggaactggagttaaaatgcttgcaattaagacaatgtctcgcattanaattcacgttggaattcctgctnacccggcntttttaacaaggtttgttcccnttttcgaaa

SEQ ID NO: 83591 - DNA, 373 bp, Triticum aestivum
  unsure (1)..(373): unsure at all n locations
  Clone ID: PAT_TA_83591
gcaccttcgtgctcgtctacaccgtcttctccgccaccgaccccaagcgcagtgcccgtgactcccacgtcccggtgttggcccctcttccgattgggttcgccgtgttcatggtgcacctggccaccatccccatcaccggcaccggcatcaacccggcgaggagcttgggagccgcggtcatctacaacaaggacaaggcctgggacgaccaatggatcttctgggtgggcccactgatcggcgccgccatcgccgccgcctaccaccagtacgtgctgagagccaacgccaccaanctcgggtcctaaccggagcanccctaataagtccggcggcgggagctgtgggcgccaacgattgatcaaatgta

SEQ ID NO: 83592 - DNA, 163 bp, Triticum aestivum
  Clone ID: PAT_TA_83592
cggcaatgctgaatgtttagttagaagtagagaagattttgccaattacccatcatgttgagtttctcgtcgcaccttctgttcagttttgaggcactttgtcagacacaagaatatatatatacctggtcatcacggcttttgtcctgctaaaaaaaaaaaa

SEQ ID NO: 83593 - DNA, 558 bp, Triticum aestivum
  unsure (1)..(558): unsure at all n locations
  Clone ID: PAT_TA_83593
tccacttcagcttcattccacttccacttggatcgatcgatcgcatatggcggtactgtggtggtggncatcgtcctgcttgtccncccgcgccgtcnctgctgcgctgctttgcctgctggtggctcacggcancgatggaacnaggcacaacagcaacaatggcngtggtagtggtatgttccagcagcagcaatagccacangcaangcngtgggggacgagcccatgccncnccgaacgacaccgtctccgtatncntctcngtctccggnggctggcaacaacagcagnagcnacgacgggtggntgaacgcccgtgcgacatggtacgtgccccgaacntgctggtccggacaaaacggcngngcgtacggttcaaaggcgttnacatgcaaccttctcngngatgacgtctncngnaacatcaaacttcaaggnggaaaaggtgcggtccngcnaaaantcggggcaaggcaaccggntttccgggttgcnggaagggttanccagggaagananaaccgggggcccaaatttactngngggaactttggc

SEQ ID NO: 83594 - DNA, 604 bp, Triticum aestivum
  unsure (1)..(604): unsure at all n locations
  Clone ID: PAT_TA_83594
gccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgcccgccgatccgatgattcatgataacttgacggatcgcacggccttcgtgccggcgacgcatcattcaaatttctgccctatcaactttcgatggtaggatangggcctaccatggtggtgacgggtgacggagaattaaggttcgacgagaacgaccagctgcagcaagtctccgtccaccgctcgccgccggcaagaagncatcctcntcggcgtcccggngccttnacccgactgcagcaaccaacatgtgcaagctcacacacagctgacactcaaagcaaggggtaacaaatctgctancagcgtaacacccttctcataagggtggcaaactanccgagacacactnaattcncccacgnttggactaacaagnccgn

SEQ ID NO: 83595 - DNA, 338 bp, Triticum aestivum
  Clone ID: PAT_TA_83595
ctctgctcttccttgttggcaatagcccaaggccccaagacggcagcacgcacgatgaagccatcctgtgcagcacttgttccaggccttcttcttctagccactcttgcagttgcagctggcgcaggtgccgcctcttcatcatctcctccgtcgtcttccctcggcaagcatccagcagagctggtccttcttggtcgcaaaggccgagaacttggccagctgtcatcatcatcatcaggataccgttattaccagcaccagagcaagcagatgcagcaacctgaggaagctgcggctacggaggtgaagcagcccgaggagaaggaggaggaaga

SEQ ID NO: 83596 - DNA, 620 bp, Triticum aestivum
  unsure (1)..(620): unsure at all n locations
  Clone ID: PAT_TA_83596
gtggcggaaatggagcctggggagcagctgctggtggctctgatgacccagggttgggtagcgccaaaaaggtcgtcccancacaggatggtggaaccggctgggggtcagaaggtggcggcggcggtggtggcggangctggtaactgggctgtgccctgcgttgtagtccagacaacagctactagatgaaaacagtttcctcgttttaactcctgtcctatcgtactgtggacgggagaaatctggcacttatnagtcttgcagctgctgcactctgcanatgttgcattgcggacagcgttatgtttcagtgcatgtncataaaatccaatatgtcgggtcacactttcctgcncaaatttgattctncngctcaatggtnaggctatccgcaattangcaattctctaccccanttgggaancttttgtgttgaaantttacanctacatttggttnccnaccttcacataangnagnccaanaaaaatccagggggggccggtaccaattggccnaaangaatntttacncgnccaagggcctntttaaagnctaatggaaaaccggngtacaactatncctaaaaaacccttccaggggttaaaannggcncc

SEQ ID NO: 83597 - DNA, 610 bp, Triticum aestivum
  unsure (1)..(610): unsure at all n locations
  Clone ID: PAT_TA_83597
cggccgcccgcctaacgactcgcggtcaccgcctgcgggccaccgtccgcccccagctcgcttacgatattgtacgttcgtggcgcggagcaccgtggtgttggcctagtacgtcgatttcacggtgacttcaccaccattgccgcccagtggctgcagaagctccccgccagcaacaagttcacctacaactgcgacggccacaccttcagttacctcatagagaaaggatttagtgagtagctttcatcccgtcgctccgctccgccttattccatcggaatctgcaccgccgcgggctcgaatcgggttcggcttgcttggatctcgcggggttcgcctcgattcgctagatgtatcangtgtgggattaatccggacttggataaatgaantataatgcaagaaatgtgggcaaataaaccttggtgtgtggtggagaacangngtttgaactaanggtcttacttacagttgggtttcttaaccttgacatgaagtaattggttcaaattgttaancattangatccattanttacgcggcacattaaggnaaatgcggctaaancttgtaaccgatacggggaaatncatgggaaatcacattt

SEQ ID NO: 83598 - DNA, 454 bp, Triticum aestivum
  unsure (1)..(454): unsure at all n locations
  Clone ID: PAT_TA_83598
ttcctgttggacgaatccaccgtcagctgaagcaaaggactcaggcaaatggccgcgttggtgccactgcagccgtctactccgccgccatcctggagtacttaactgccgaggttctggagctggctgggaacgctagcaaggatctgaangtgaagcgtatcacccctcgccacctacagttggccattcgcggagacgaggagctggataccctcatcaagggcaccatcgcangtggaggcgtcatcccgcacatccacaagtccctgatcaacaatcctccaaggagtgaagactaaggaatgcacattgttagtttaaactggacatttctgtgtgctcctctggaatccttgtctcntgtaggtttaattaaccgtcaggttggagtgacccttctccgtgtaaccttgcctggnacgcttaattnaaaaannaaaanaagggtttt

SEQ ID NO: 83599 - DNA, 169 bp, Triticum aestivum
  unsure (1)..(169): unsure at all n locations
  Clone ID: PAT_TA_83599
cccagatccaattcncaagttctccctcctctgcngcnatggcnctctctgtngaaaagacctcgtcnggacggnagtacaangtcaaggatctctcgcaggcngacttcagccgcctcganatngaactggccgacgtcgaaatgcccggccncatggcatgncgcgc

SEQ ID NO: 83600 - DNA, 529 bp, Triticum aestivum
  unsure (1)..(529): unsure at all n locations
  Clone ID: PAT_TA_83600
aacgctactcgatagcctacttcgtggaaccaagccacgactgcgtggtggagtgcctgccgacctgcaagtccgaatcaaatcctccaaagttccctccgatcacctgctccgcgtacctgtcccagcgctacaaggacactcacgcggatctgaaatcctacgacgacagcaaggcctgatcagaggactgccctctcctctctctgtctcagcgatcagtacgtacgacgtgtatcctgcaataacactgggtggagggcggcagtaccagtgtaccacagtatcagtataggtatagagagttctgttggtgccaccgtgccaccgtccatgtgttcatgtaagatgacgagaagaatcaagaacgggggccgcgttgagtcccggccttaatcnaggcntgttgttgcgtcntgttgtgaggtnaatccccgagctaaccttggtgctgtttaaagtcaaaatcccctcgtccgtttgttttggtttgggacacaagagnatttgttgtggttgcaaaaaaaaa

SEQ ID NO: 83601 - DNA, 537 bp, Triticum aestivum
  unsure (1)..(537): unsure at all n locations
  Clone ID: PAT_TA_83601
ccacaccacacgatcgccctcaacacgggagctagaagctacacggattaagtaaggtctgtgcttaaagactcgattggttaggacttgggagtaagctactagctagaagctccagtagtcgatcgacaacaatggccaacttcgctgctcagattaaggacaagttcctcggcctcgtcgaccgtgtcgccggccgcggccgcgccggaggcggcaaggacgacgtacaggagcccactactaagctgcacatcgtccagcgtgtcgaggttaggtcgcgaggccgagcagcagagcccgtcgtggacggaggatngacggcggggcccaactaatgccgcgcgcccggttcgtanccancagactgcgcgatagatgagactgctantgttctgaaatctgaatgtttggntgaaagnatccctttatcngggaactggtgcaactaactgttatgactatgggtacaatantttcgggnaantgttaacccgnagattataaaacatacaataaattgtgaaaaaaaaaaaa

SEQ ID NO: 83602 - DNA, 320 bp, Triticum aestivum
  unsure (1)..(320): unsure at all n locations
  Clone ID: PAT_TA_83602
ncccagatccaattctcgagttctccctcctctgccgccatgnagctctctgtngngaagacctcctctggacgggagtacaaagtcaaggatctctcncaagcggccttcngntncctcganattcagctggccgaggtcgaaatgcccaggctcantaagtgccgcgccgaattnggcccntctaagcacttcatggcgntatgattcngggtctcnccaaanctacatccanattancatccncagacgacactntcatggcncacgncgntcacgtcancagatncacctgcancaancacgncaatcatgcaaac

SEQ ID NO: 83603 - DNA, 508 bp, Triticum aestivum
  unsure (1)..(508): unsure at all n locations
  Clone ID: PAT_TA_83603
ccgagatccggagcaagatgaaggcggacggcacgttccagcagaagcgggagcaggcgacgcagcaggggatccacgagtcctactaccgcgacatgaccgtcatgttcggcaagtgggagttcgaccccatggngctgccggagccgccgtgccccgtgcacctctggcagggcnacnaggacngnctcgtccctgtcgtgctgcanagggaantcgccggcaagatcggatggatcaactaccatgaactccctggcaccggccacttcctgtcgtcggtgcctgggctcggagacaacgtccttaggacccttttcagtgacaagcagttnacaaacatncanacaatcntccctcaagacgtatcgacggggctaagctttcaacatggtggtggtggtggcgcaatagntaatttataatgtaaaggccttggtgtcgctgantaacatgntaaatatggggattnnatgcaagaccttggnttaagtgaatacaaacaggg

SEQ ID NO: 83604 - DNA, 599 bp, Triticum aestivum
  unsure (1)..(599): unsure at all n locations
  Clone ID: PAT_TA_83604
gagatccggagcagccgcagtcccaccgacctcgccgccggtcgccctccatctcctcgccgctgcctctcgatacgagcatagactacaggctcaaagttccaattccaacccacccgacgtccgacgacagctggtccgggtctcctccatttcccggggacccgtccgatccgatcccagtcctcaacgccaacggtgggagatctagatcggagctagccagccagccggccgacgctgtccgccggccgccccggcgattctgacccgagatggcggtcgtccctgctgcagagaccctcgacgggctcaaggacangttcgatntcggggtcctcgtaagcgactcgccctcgatgaggaatcacaagtgacgacaatccctggangggtgcaacaagacttgacaactgcaagaatgacaagaatccaaaattcanccagtgnataaacgccgagtacaaaagggtcaaaataaataccaaatcagctggtccacaagatncattaggaagnaaatcaattccngaagataattggaatggananttgttnaatggaanatcgacggtccaaanaatgtcanaattaanaaa

SEQ ID NO: 83605 - DNA, 593 bp, Triticum aestivum
  unsure (1)..(593): unsure at all n locations
  Clone ID: PAT_TA_83605
agcttagcttgcttccccaatgccaatgtcatcgacagcacaaatggcttccctcgccgttctcatcatttccctcgtctttgcggcgcttgcctccgacgccgccgcaggcgtccgcgtcgagctcacgcgcgtccacgccgaccccagcgtgaccgcgtcccagttcgtccgcggcgccctgcgccgcgacatgcaccggcacaacgccaggaagctagccctagccgcgtcgtccggcgccacggtgtccgcgccgacccagaactcgcccaacgccggggagtactgatggcgctggccatcggcacgccgccgctgccgtacaagccatcgccgacacgggcagcgactcatctggaccantgcgcgccctgnactcccagtgctccgccanccgaagccgctgtacaaccgtccanctcaacaagttcgccgtgctccgtncaacaactcctaacgtatcccggngggctggccgggacgggacggccgccgccgggggccctgcantanaagtcactncggaacggtgacaagtcttanggtcnaaactnaattcggcaancngcgtaatcncgcctganncttng

SEQ ID NO: 83606 - DNA, 525 bp, Triticum aestivum
  unsure (1)..(525): unsure at all n locations
  Clone ID: PAT_TA_83606
cctgtcttaaaggttgctgcaaaggtcattggtgaagttcaggcactgatancttttccacttttgccgtgcctgatcctttctatcttgtatatgttctggttttctgctacactccatctcttcanctctggtcaagttgtccgaaatgattgcaatactgattgttgttcatatgatctgaagctgggaaaagtaaattgtgacaactgctgtgggtacagcatccattanacccctcatatcagcattgccattctatttcacttatttggttgctactgggcgactcaattcantctcgcatgctcttcaactgtggttgccggatnagttgcntcatacnactgggcgctggtgaaatacacatgatataccatttccaacngaatctctcactgaagcgacnaagcnctacagcctggatcgttgccccgggtcaattgttgtnccgtngttgaanggngcngttaaacaaaaagcctcgnccaatttaancaattgatctgcccaaaanccgcttgg

SEQ ID NO: 83607 - DNA, 494 bp, Triticum aestivum
  unsure (1)..(494): unsure at all n locations
  Clone ID: PAT_TA_83607
cgtggaagagctcagcaagcaccataacttgagacaactggaactgtattactatgctactgaaacgcctgggaatgagaagcaaatcaagttccccgctgatgggctccagactgtgaaacaactgtgcatccggtgcacatcaccatcggtgacatttgagccccgtgtactgccaaaggtccaagcacttgtcctgagattcgagaaaggccgtgctgatgacacgattggcgtgtctggcttagagcatctgtcgagcctcaagcatttggtacttgagtttgagcagcatgatgcgggtgccatgggcgacagttactgcagtgaggatggctgctgaggggctccatctagatcatcaatatataactctaaaggtggatgggaaaaattactgaggctatcttcagcaaaggcgtgtatataaacgtanaaagcacgttttacaatatatattacacggtttacaaagtagaatatgaaatatgatc

SEQ ID NO: 83608 - DNA, 597 bp, Triticum aestivum
  unsure (1)..(597): unsure at all n locations
  Clone ID: PAT_TA_83608
agggggcagacagagagtaaaggaggcaagtaggcgactccggcgagagaagtgcgggtgcggccatggcggacaagccgagccgcgcgctggtcgtctacgccgccggccacgccgcggcgctcatccccccgccgggctccgcagccgcggggagccacctcgacgcgttcgcctcccgcgcctgctgcggccttctcaccctacgctccccgccgacttcccatcctacgaccggcaccgaggataatagcagcacgattttggaactgggcgcagctgctcgacgtttacgatcatctctaccccggaaagaatgaggaaagtggtcaagaattgcccaagtggttcacaggactcgtggttcccaactgtttgagaggttatgggcctgagactgccttgggcacaattgcccccatgtaactccttcgcancgancctgggttcatgttttaaaacaatgatttgcccanaatctggtctcaacattactaaagaggatggttatcaaaagacatttgtntgcnagatcncggatgggattncaggaacatctaatccatnaatctcancatgtgccagganacnaacaca

SEQ ID NO: 83609 - DNA, 385 bp, Triticum aestivum
  unsure (1)..(385): unsure at all n locations
  Clone ID: PAT_TA_83609
gtctgaagtagaggggtttggcactatcaagaattccgagtccctttgcatcttcctattagagaaagcacaggttgcccttgtccctggtgacgcatttggggatgacaagtgcattcgtatttcatatgctgcatccctaactacacttcagactgcgatgtcaaaattaaaggaagctgttgctctgctcaagccctgtgttgctgcgtagcaagatcactaaattgcaataaggagtgaccaaggcacctttaactaacctttcacattattttaaacacaatgttcgaattgttgggcagacttgggtctgttgtttttanatgtaacattatggatttatgatgtgtacatgcaaataaaatgttttgtttagaaaaaa

SEQ ID NO: 83610 - DNA, 531 bp, Triticum aestivum
  unsure (1)..(531): unsure at all n locations
  Clone ID: PAT_TA_83610
cgtacatggactcggagatcatgtccatcatgtcccagtacatgccgctggacagccagaacaacgagaaccagcctctgcggcagcacgattcggaggctctgaggtaacttcaactctgctgctgcacccatgttgaggacgacgagcgaatggcaccggattctgatgcccagatgcgtgcatttcaggcactaaaggggccccaatgcaagatgcgcacatgatctcgacagatataatctgctccggtttcgacgacgatggtttgcttcgcttttgtatagcgcgtagaaaacaaaaaggaggacggtttgtactgtgccgaggacagagttgagctctagagagtttagacaggtangcatttcgctcggctctcctgggagctagtatcctgtgggtcaagaaccgtttaaagcacacaaacagcatgtnnaaaaaaaagngtatacnactgctatacatgtncattgtcagtagacaancctactacggcaattgttacggcatattggtaaaaaaaaaaaa

SEQ ID NO: 83611 - DNA, 406 bp, Triticum aestivum
  unsure (1)..(406): unsure at all n locations
  Clone ID: PAT_TA_83611
tccctccctacgcatcctctccccctcgacgctttccccacccaatccgaccgccggggcgggcgattccctggagattcggcgcggattcggggctcctctcggggtttctcggcgaatcagcggggatcgggactcccggctgaaggttttgcgtgcacatcacgatgaagtgtggtttattcaattctcaaataatggaaagtatttagcctcagcgtcaaatgataaatctgcaattatatgggaggttgatgaggatggagagctattactgaggcatacattgagtggcatcaaaatcaatgatgatggttgcatggagcctgatgattgtcagtcctcacatgtgggcaagaaganacatcngacctgggaggtanatctggaagtgtcgtcatgttta

SEQ ID NO: 83612 - DNA, 574 bp, Triticum aestivum
  unsure (1)..(574): unsure at all n locations
  Clone ID: PAT_TA_83612
cggcggcggaacccggccacggggacgacgtcggtgagcaggccccagatgggtttgacgatccacggcgcgtccgtgacgccttggtanaactgggccaccgaaggctgcacgcgctgcacgtccttccagtagtaccccgcggcgactccgccgatggcgttgccgacgccttgacaggcgccgtagaccgtagacggcggcgaccgcgagcacgaaggtccagtgcagctcgcgggacagccgcccnagccacccgcagggaaacgcgacacaacgcccctgtttgggttcaacttctggggaaattctggcngccagaatccggaacctgaaccaaacacanttctggaagntctccgaangcgcttccccnnaccggtgttccnacggcgggaangaacnggaaaaagtcatttcctcttcaaaacgntccccgctgganaatccctccccttttcacaatgtnggngcctttcccccaaatgggtaaggggttangcnccaacccnggncancaaccctttgncaaacnnccnggaaaccgtgaacccgnaagncctnaagacntttc

SEQ ID NO: 83613 - DNA, 638 bp, Triticum aestivum
  unsure (1)..(638): unsure at all n locations
  Clone ID: PAT_TA_83613
ttttttttttttttttttttttttttgtgtagaggcgcttatatatcatccaaaagacaagtcactcacacgcaaattcncattggctaacagaagctatttggaatgcagttcantcnactaacaacgtangtacccccgtctccttgttttgccgatgttggcgatgccatcatatgtcancagcaaggnanttgccanacaaggaaaccttctcgccaggcttgaatggtggaanacctctgtanggacaggttccacancggaaggcatcacccaacccacaactgccacangctgactgagggttattgatctgctccgcaatgagctccaancttcccaaccttctcctcggcctcaaccctgccacaagtaanttcttgcatgcntccttgccgcccccaactcanagtcccaacancggaantgtggttctcaagtcctcctcatcaananatgcctcaacaatcagttagagtctcgtcaaattgaacctgggaaaggctttgtgtttctaaggggaaagaagaccatgtcaagtaactcttgcctaacgtaaaaatgcccaaccggactnagaaaaatgnctnacaatcacacatactnnccaaanagtcggtcganggtagggaggg

SEQ ID NO: 83614 - DNA, 614 bp, Triticum aestivum
  unsure (1)..(614): unsure at all n locations
  Clone ID: PAT_TA_83614
gcgggttcaggctcgcctacatcaacgtctacgacgacatggtcgacctcatccagcaccccgagaagctcgggctggagaacgtctccgaggggtgctgcgccacggggaaggtggagatggggttcatgtgcaacgacaagtccccgctgacctgcgacgacgctgacaagtacttcttctgggactcgttccaccccaccgagaagatcaaccgcttctttgccaaagggacgacggcggcgagcttgagcttgctgacgtanggatnagctcccgtatactgancgaatattaaaagggaatgtnagctgtactgtgatcagagtgtcntttaactggtgtaatacataacatgcatttgttgggcgtgggcgattccntgtnaacacgtctcacatgaanccgtcactcnttgggtttcaanngagaaagattaatttacagactncaatgcatgttgggtcttnaatgtnaacnatgcattcagagtaaaaaaaaggggcccgtccaatccctatatgatctataccngccacggcgtnnttaaactctaanggaaacctgggtnccactaaccctganancccttgcagtgctaaacaaagcnccct

SEQ ID NO: 83615 - DNA, 612 bp, Triticum aestivum
  unsure (1)..(612): unsure at all n locations
  Clone ID: PAT_TA_83615
atcctttgagcttactaccttgctattctttgtcacctgaatacccctacggataattcttgcacttatcgagcatccgctcattccccattgatcatgtgtttcgccaaagacttcaaaatatcattcgatcttctgaaaatcccgagcagcctattgctcttgaaattctcgcttgcttgcattatggttaatcccataagtttcgtaatcttattggcctcccttgtctttatcattttaagtccgttgattcaatatgttgaggatgctcgcattcctcggtcgaatcataggattcatccttccggctcagacgtcatttgggatatgagctggttcntgaccaatcaatgccttggatcgtttgggcttctaagtcnaatgaacttatcattttcgatnaaaacgatgctccgatccttgggttggaaacataaaattcntgcataancttgatagcantgttcaaaaccgatcctgggatcctctccttgatgntacgaaccaataanccatttgggcgcanaccgtccggntatancgaattctcaacaaatctgggtctaccgaaaaaagcctggaatgaaccacttgacatgccacttggcn

SEQ ID NO: 83616 - DNA, 319 bp, Triticum aestivum
  unsure (1)..(319): unsure at all n locations
  Clone ID: PAT_TA_83616
gagatatccctggtgtcaggttcaaggttgtgaaggtatctggtgtgtcgctgctcgcgctcttcaaggagaagaaagagaagccaaggtcttagatcactgtcgatagtctagaatggagtaaactgacaggctctactatggagtaaactgccaaggttttagatcactttcgatagtgaggttcaaggttgtgaagtttagcgacagagctgttaattctgagctgtactttttgttaacattgctatcgagactcgagagttttgttcccattttgaagtattaaaatanaaaaaanaaaaactccaaggggggg

SEQ ID NO: 83617 - DNA, 632 bp, Triticum aestivum
  unsure (1)..(632): unsure at all n locations
  Clone ID: PAT_TA_83617
gtttttttttttttttttgaagcaaatgatcatatcatatctgacaatgttcaaacgatgtgaaagaacccccccttatttattagtaattactgtagtggagggttgtttccaccacccagacccagccccgctttctgccccagttctgcaagttgctcgatgaactccaccccgttgacaatctcagttgctccgtatatgacatgcttgggaagaaggcggctgcnagcattctgccagctccatcaagctcctgtactcaatgtaattcccaccaccaatcatgaacacaattgcttctctgaatggcctttgaactgcccaccgcttcctgatctangggcacgtgggtcaaacagcagatagtgtccactccgggattcggcttcccttccatgagacttcgacgtcctcgtcaancaagctgcctcccacgggacaagagatctcaaccctgcgtnacgcgctaatggatgccatacactntcngccaacaacatgttcncccnttgcacgctgacacagnacaaacgcgttcaacgattgatctctcaaaaaggaagcgaantcactcgatcaacaagcgctcactgccaaccgggtcaaaaagngaggcancaacaactncc

SEQ ID NO: 83618 - DNA, 613 bp, Triticum aestivum
  unsure (1)..(613): unsure at all n locations
  Clone ID: PAT_TA_83618
gcaagatggaacacccgttgatatggtcttcaatcccttaggagtaccctcccgaatgaatgtgggacaaatatttgaaagctcactcggattagcgggggatctgctaaagaaacattatagaatagcaccctttgatgagagatatgagcaagaggcttcaagaaaacttgtgttttcagaattatatgaagccagtaaaganacaaaaaatccatgggtatttnaacccgagtacccgggaaaaagcagaatatttgatggaagaacaggcgaccctttgagcaacctgttctaatagggaatcctatatcctaaaattaattcatcaagttgatgagaaattcatgggcgttctacnggccctacccacttgttacanaacaacggttaaaggaagancaagcaagggganaacaatagganaaaggaatttgggctttaaaaggtttggngttgcccanatttananggatctactttaatccgacatcttatacncccaanaanactaatgcaccattggggaaaaatnctaacatnggtcncaaaacttcggtgngtcaaaatanatttgctcaaatgacttctntccgaaaaatcacctaaaggn

SEQ ID NO: 83619 - DNA, 626 bp, Triticum aestivum
  unsure (1)..(626): unsure at all n locations
  Clone ID: PAT_TA_83619
tctctctctaacccgcttctccacctccctcacatcggctactctccgcgcgcctaccgttccgcgccgcatcggattgggtggtcggggcctagtcgaggtttcgcgggacagcgtcggtccatggcggagcttgtgggaccgcgcgtctacagttgctgcacttgccggaaccacgtttgccttcacgacgacgtcatctccaaggcctttcaggggaggaatggccgtgcgtttctgttctctcatgccatgaacgtagttntgggggcgaangaggatagacacctcaagacagggctacacacagttgctgatatctactgtaatgactgccgtnaagtgttgggctggaatatgtngngaacatatgaagagaccagaaatacantggaagaaaatcatatcnaagaatcaaagatgtgaagggaaactggtatgncccaaattgcaatcacaaaattctggtgaagatgaatggcattaangtgcttttggatgttgggtctggtaanactttcccgtggatgaatgctaagggcccagtnaacctaatacatntaagnacactgtaagtcantggtaataggactattgtattgaagangcncaagtanaatgggncn

SEQ ID NO: 83620 - DNA, 317 bp, Triticum aestivum
  Clone ID: PAT_TA_83620
ctattattcactcacatgtgatgctgcggctgcgactcctaaaccttaaatctagaaatagctggggattgggtttgcattgcatcgtgttcttgccggtctagcaagtgactataagaataatggaataaacgatgacccagtgtgtgtatgatttccgttctgaagaacaacacatcccttgcaggattgttgttcagtagattctacttgtaccgcggctttggagttccgcaaaggactttacttgttcaagaacttcttctctgacaggaaataacatgtgaagtgcagtccgtgcttttaaaaaaaaaaaa

SEQ ID NO: 83621 - DNA, 606 bp, Triticum aestivum
  unsure (1)..(606): unsure at all n locations
  Clone ID: PAT_TA_83621
cacggcccacctcacagtcacggacgccttcgcggtgagccgcgacggctccctaacgtaaacgccggcggcgcgcgcggaaagctgcacggcagcacgggcgcggcctcgtctccgcgcctgggctgcaagggcggcggctcggcgcggtgggaggcggggggcggccatccggtcaggtccagcccaggactccaggtgaccaggtcggcaggtccgcgctccgcaacggttctggcgttctgcggctgagtacagacgacagaggaattggggatttacattagcgatttacaaggcaacttggaagacaagcagggtttcatcccgcaatgtcaagctcccaacagcgatagcaacatgcagcagctagtccctatagcacaaccaagaaagcntctggtggtgacaatgagaaggggctggttgtggtggttctgcaagtaagaatcangagtgtaaaactacganaggatgaggaanactggaagtgaactcagngcatcatggaaattcctgtgntgnaatacaataggtctctctggtcngtccggtgattcacagtacgcaatgaggagnaaacagacgntacncatgntcnacaca

SEQ ID NO: 83622 - DNA, 612 bp, Triticum aestivum
  unsure (1)..(612): unsure at all n locations
  Clone ID: PAT_TA_83622
ctctcgtctccgccgcgctaggaacttccaactcccaagcccagccgcctgcctagggttaaggtcgcccctccgccccctcgctccgctcgtgaccggcagggttcgtcgccgccgttggatatgtcgcggacgctggtgcagccggtggggcagaagcgcctcaccaacgtggctgtggtgcggctgcgcaagcacggccagcgcttcgagatcgcctgcttcccaaacaaggtgctctcgtggcgctcccgcgtcgagaaggacatcgacgaggtgctccagtcccacaccgtctactccaacgtctccaagggcatcctcgccaactccaaggaactcgccaaggccttcggcaccgacgaccttacccaaatctgcatcnagattctgggagaaaggggaatccaagtctccggcaaggagaaggaagcgcaactctccagcagttccgcgaatccaactattgcatggagaagacatcaaccanagaccgccgccctanacatcacatatngaacgctcatgacaaataactcgcgtcaaccaaactaactcaaggaaggtctaaatntaagaagnaaaagattccataaactgacgctaaggggg

SEQ ID NO: 83623 - DNA, 626 bp, Triticum aestivum
  unsure (1)..(626): unsure at all n locations
  Clone ID: PAT_TA_83623
aatctgcaggttttttggtcggcgtacagcaatgagcttgagctggtggtggacacggtctgtcggcgcagtcagagagcgcaaagatgagctcgccggcgtgcctgagcattccttccagagcgtggccctcgtcgttggctccaccggcatagtaggcgcctccctcgtggacatcctcccacggtcggacacccccggcgggccatggaaggtatacgcgctctcccgccgtccaccaccgccctggtccctgccgtcatcctcctcgctgacacacatacacgtcgatctcaccgacttcgccgccgtcgccgaggccctcacgccgctcaccgacatcacgcacgtcttctactcgcctggtccccgcgcgccactgangcggagaacaaggaggcaatccgccatgctccgcaagtcctctccgtcgtctcccaaactgccccgcctcgcccangtntcgctcaaaacggcacaagcatactgggacgttcaactcattggnaaatccantccggaccgcccaaacgaggactgcgcgctgacggcaaacttaatagacaaaggagtctctcccggaatccccgggcgggnccttaatgncgtnacgccaactanctcgt

SEQ ID NO: 83624 - DNA, 586 bp, Triticum aestivum
  unsure (1)..(586): unsure at all n locations
  Clone ID: PAT_TA_83624
gtcaacgatgctccctctctgaagaaggctgataccggtattgccgttgagggtgcttccgatgccgctcgctccgctgccgacattgttttccttgctcccggtcttggtgctatcattgatgctttgaagacgtctcgtcaaatcttccatcgaatgtatgcctacgttgtctaccgtatcgctctgtctctccacatggagttcttccttggtctctggatcgccattctcaacaagagcttgaacattgagcttgtcgttttcattgctattttcgccgatattgctactcttgccattgcttacgacaatgctcccttctctcagactcccgtcaagtggaactccccaagcnttggggtantccgttctccccgtgttgcctggctggttgggaactggattgccctacacaagtncgcaaatcnaagacggggtaatgtcaaaactcggtanatnaaaagtccctcctnaatccccaatgaaannggtaactaaaatcgngcaaggnccttcggcttcancccctggaantnngggcatccatncaaacctgaacccttcgaccttggggtntggggga

SEQ ID NO: 83625 - DNA, 308 bp, Triticum aestivum
  unsure (1)..(308): unsure at all n locations
  Clone ID: PAT_TA_83625
gtcaaggaaggtttcctttccctctgaatctctgatgcgccccagccatgtgggactcgggaggcatcatcgcccttcgtcttcgtctccgctgcttgctagttcagccccgcagctgcggctgtgctcctcaggtttttggaaaaacactgtgatgttaacatttatgtagtgcttggttgatcatgtgacatgaatgatccttgctggctgaagatcctgctgtatatgggaatttatgtttcctaatacccctcctttgactttgtacaccaattttgagtactacatgaaaancaaaggggggg

SEQ ID NO: 83626 - DNA, 254 bp, Triticum aestivum
  unsure (1)..(254): unsure at all n locations
  Clone ID: PAT_TA_83626
ncnctccttcgcctcctccctccgcgcgtcnccgctgcgctcccgcgcctccgcctccgccgccccgccagccgagaccctcaccgacgacctgccctccganacnccnccggttggggaggggtcgggaantcngatgccgtcgtctattggggaggatggggaggagctggcacccaancagaanatcacaatcangctgangtcttactgggtgacantgatcgaggactcctgcaagcagatcattgaag

SEQ ID NO: 83627 - DNA, 607 bp, Triticum aestivum
  unsure (1)..(607): unsure at all n locations
  Clone ID: PAT_TA_83627
aaatatctttctcttagatcagaagttgatgaggaaaaggttagcaagcttcaatcctgtgtcgactatggcacttgcagttgcagggatatgttccccctggagtcactgccatgttcatcatcttcacgagcaacaaagcagctgattatcagtcaagtgcccgaagattctgtgcattcattttctacgcgcttcagtcggtcttgacggcgagcccatcaaacatcagggacatatttctttccctttgcttctcaatctgtccccgtttacgggaggcgcgtcnagtgctggacctttagcaatgaatgcgcaaagagatggccagcaagctctccatctataccggcaactgaatatcaggctaatgctgacgtgtccatnattcatcatcacaacgcaactacaaggacaagttatacgtcccgcggcgtctggacatacgggaantttggaggaggcacaccatctaaggaaatcnntcaatccgacccgatgntcagcaaactnttgcagccttggaacggggttaatcaaanggtctntaaattcaagagantcgcccgnggcanncttcaaaaattaccctgtntcnaggnaaaaa

SEQ ID NO: 83628 - DNA, 515 bp, Triticum aestivum
  unsure (1)..(515): unsure at all n locations
  Clone ID: PAT_TA_83628
ggcctgttcctggcgcatggtgcacaggcaaaangaggtggttcagtgatccttgctcccantggagcaacgtcaacattgtnagacccggtcctcaagctgagaagttccgaacatatanaaaccanattatggaagaatcaaagtcaagcaacaactcttgcangcaatagcggtagaatccgagcacgaggcttcacttcccgcagttgaagcgttgancttgtctcattttgcgcctaagagctctccatgtctcgagcacntcctgacatctgcttcacgagcaacatttttgcacctgttgtatgaactgancacacggccaaggtgatagatggattatcntcccanattttttgggtgacatggcttcaanggcttngngacactatgntgttggnagccaaaanacctactgtggggantacagaactatanncatgtattagnncatcaattgaaggncgtccttgtcaaanatntgatggnatgttgggctcaaacaaattgca

SEQ ID NO: 83629 - DNA, 358 bp, Triticum aestivum
  unsure (1)..(358): unsure at all n locations
  Clone ID: PAT_TA_83629
agcaggccggcggcaagcancgcaagcacagcagcaaatggttancatcancgccgccgcggcgaccaccgtcgtcgcccgtgncgcnatcnccagnccgcangccctaggtctgccccagctgaggacnaagagcnagagggtgaggtgcagctactccanngacgccanggaggcgaccccggcggccgccgtccgcggngcnggcgngtccctgntcgccgtcngcgggcgctgttaccgcatccgcggggccngcttcgctctggtntacgaacggnttgtcgactgaagggaaccggnctcaancctgngggtgaanaaanaacctgcttgggtgggttctccctggggctct

SEQ ID NO: 83630 - DNA, 497 bp, Triticum aestivum
  unsure (1)..(497): unsure at all n locations
  Clone ID: PAT_TA_83630
ggagcgactagcgcgagcgttcagggattatttactgaaagagagagtgttcagggattttagcacttgttcatggctgctgcgtgcatcagccatcgctttcgccactccaagctcccggtactggtcctggcgctggcgacggtggtggccgccgcacgggctcagctgtcgccgccgacgttctacgcctcgtcgtgccctgccgcgctcgtcaccatcaacgccggcgttnaggggctgccgtgctgctggaccgcccatnggggcgcctccctgctccgggctccacttccacgactgcttcgtgcaaggctgcgacgcgtccgttctgctggacgacaacggcataccggggggaaanaaagancncnggccccaacgcgggctcgctcaaggggttcgggtcatcgacacatcaaagcctgctggaagcgctntnccccggacgtgtctncgcngnatctcccgtcgcgccctgatcttcgtcgccccgg

SEQ ID NO: 83631 - DNA, 499 bp, Triticum aestivum
  unsure (1)..(499): unsure at all n locations
  Clone ID: PAT_TA_83631
ggctgtcagtgtcaagcagccaggctcaggggtaaggtttcagcaattcagctccctcgcctccgccgcggcaccggcactacgagtgcttcgctaccagccagccagcacactctacgagtcgccatcttccactccaccgaggcagctccaagccatggccatggagaaaggccgcctccttcctctcctccctcttaaggcggcggcggcggggagccggcggcgactgtgaaatctacttcatataccctatcaatcctgcagggtcttgccgtgtcacaagcgcccatcactccactgggttcccggtgggattcgnaatgggtggtggttnaacccaaaagggcgacatacacccaaanggtgggacccaagcttgctctggtccaagtggantnccgcccggagccttccctgagaacnggaaccaagcccgacacaactggtataanacacccggatggcacctgaagnactcnaataacggaacacacat

SEQ ID NO: 83632 - DNA, 168 bp, Triticum aestivum
  unsure (1)..(168): unsure at all n locations
  Clone ID: PAT_TA_83632
catcggtncgaggcanaacgcangggcgccctntacnactanggcgaccagcatgncggcgtttcttcaatcntcctcatcatgaggagggngtctccagtcttcttgctcctcctgtccnaanatnacgcgntctgncaccgcatanccagcagttcnacttctcag

SEQ ID NO: 83633 - DNA, 614 bp, Triticum aestivum
  unsure (1)..(614): unsure at all n locations
  Clone ID: PAT_TA_83633
cggccctgtgtttagagcagaaaattcaaacacacacaggcatctatgtgagttcgttggtcttgatgctgaaatggagattaaggagcattattttgaggtctgtgacattatagatggcttattcgtatcaatatttaaacacttgtctgaaaactgcaagaaagaactcgaatcaataaacaggcagtatccatttgaacctctgaagtatctagacaaaaccttgaagctcacttatgaagaaggaattcaaatgttgaaggaagccggaacagaaatcgagcctatgggtgacctcaataccgaagctgagaaaaaacttggtcggcttgtccagggaaaattatgacacagatttttcatcctgtaccggtatcctttggctgtactccgttccacaccatgccttgttatgacaaccagcgtacacaatcctttgatgtctccatccaggcnaggagatatatctggacacaangntaacaccctgaactggcggcaacgccgaaaatgtggacnacgtagcacatcnggccanatgaatctnaacaagggtccncaaacgggttcggtggttgaaagtgggatccgtcgtnccnaaaaacagaaac

SEQ ID NO: 83634 - DNA, 656 bp, Triticum aestivum
  unsure (1)..(656): unsure at all n locations
  Clone ID: PAT_TA_83634
ctcccctcaaagcccaccgccgctgcccccacgccacccaccccaccccgcccccgcccctaccgcgcggtgcccgagacccagaggccagacccctttcttcaccttccttcccatcgcaatcgcaagcccccggctccggcgctcggcggtcggccaggttcgggagatcacttcgtcgcggcgaggagggagggggtcnccgttagcgcgcggcacttggatgagaagggcagcggtggaggaggatgcngaaggcgtacagggactccatcaaggtgctcgaagctgacatccancacgccaacaccctgggcctccgagtttccccggggactatgatggtgcgtgctgcanatgcggctgtcgtacagtcccgcagctcatataatcctcttctggtgcagtggacggactgaacctcncaagggctcttggtctgctgataatctcatatacangtttatgttgatggaaaacaacatgnnaccatgagaggaaagcacanaaagatcnagcgnanatccttcttgcggaatgcaangggatctattnagacataacaaagcattctgnaataagaagaaatagtgncggaactannaatatttaaggaaagtttgattntggataanaatnntcacgaccacanttat

SEQ ID NO: 83635 - DNA, 646 bp, Triticum aestivum
  unsure (1)..(646): unsure at all n locations
  Clone ID: PAT_TA_83635
cgagtttttttttttttttttttgatagatagagatatcgttgtattgaattgataatagcatacactgcattgcttggtcgagcaaaaaaaagtttgttctttttttaaaataaataaataaaacgtattcaaatcgagaaagggagaatatatgataaggatgatccatcgtcgtggatcaattgatctgtgacgatacatacatgaatatataggatgggagggcaaataactactaccaagtagaattgctggtccctgggtangagatccagtgngaccaccaggcggggatggcgtcccccgacgacgatggcctccgcggcgcctgtaactgggcanccctgacgacgangcctgcgcgttgccnaacgcggcgaaaccggggcgtgatcccaattntgcgacncggnactnactcatccngtcgccggcctcttaacgggaggccgagactccccctgcngggggccngtaccaatcgcccaanatgatctatangcggccanggctcgtttaaactccgacnggaaactgggtaccaataacgctgagaancccttccacnggtaaacaaagcccacatgcctccaattgcaccnaangaatgaccccgtcggntaccgnggttngaccactacnan

SEQ ID NO: 83636 - DNA, 548 bp, Triticum aestivum
  unsure (1)..(548): unsure at all n locations
  Clone ID: PAT_TA_83636
ccccgaccgacctaccctaatcggcgatggcgacggtggcgatggacatctcgaagcccactccagtggcgtccggcgacgaggccgcggcggcggccaaggggaggagcggcggagggggcgaggggctgcggcagtactacctgcagcacatccacgacctgcagctccagatccggcataagacccacaacctcaaccgtctcgaggcccagcgcaatgacctcaactcccgagttagaatgctcagggaagattgcanttgcttcangagcctggctcatatgttggtnaggtggtgaaggcatggggaaatcaaaggttctgggtnaaggtaaaccccgaaggcaaatannttgttgatataaataanccattgattcncangttnacacctncaacaanancgccttcgaantgatacnanngcccatctgttttaccaccaaattnncattggcaaccccatgaanttaaaagtcctgatcacataaaanctttggggcctgccacccttnagaaatanngttcttgtttcaanaaaacgg

SEQ ID NO: 83637 - DNA, 293 bp, Triticum aestivum
  unsure (1)..(293): unsure at all n locations
  Clone ID: PAT_TA_83637
gtgcttatgtacgtacgtatggtcaattaataaaactggagtgggatgatgatggtgagaatttcttgtactggatgatgacatgcatatgtcgttggttcatatagacgaccacttgcaaaataaatgaatatatggtgatatgggaacgctgccatgtgagcccaccatcagcgtcgtttgaaataacagcaatttgcggcttagactatccgcancggtgtcnactaaatttttccccttaaatgttattatgcagtcacgttagcaagatacangtanaaaaanaaaaa

SEQ ID NO: 83638 - DNA, 461 bp, Triticum aestivum
  unsure (1)..(461): unsure at all n locations
  Clone ID: PAT_TA_83638
cgtggccgcactggaatcggaaatttggtgcaaattgggctcttcgaagatttgaccaattgagcccatgtcaccttggagtccaacatgcgctgaattcattcactaatttagtcaagggcaggttttgtgaaatacgcccaattgccagtatggcgtcttcacattatgtcgaagaaggaaatcgattgagttatgtgtggtgaaagaaagtgggtagacaaatattactgactgggtgaaagctaccaataggccatccgcacattaatgaccatgtttaggattgttgctatgtactaacagaactgcatgttttgttgtgtggccccattcngacttgtgaaatgaacncncggnaatcatanggatttcagtttgtacagnattagttaactttcgggtagtaccaaatcaaanacactgtancctattggtaacagtcttggtcattagtaatt

SEQ ID NO: 83639 - DNA, 592 bp, Triticum aestivum
  unsure (1)..(592): unsure at all n locations
  Clone ID: PAT_TA_83639
gcggtctggaaggagtccatgctgtagaactgggcaggaagtcaaccagcaaacttgtgcattggtgacccattattccacatgcgaatcatacaggaagctgtttgttgttgtattaataggtagaaaaaacaacggtttgagtacatgtcaatcccactgcttgccctccaagccatgcacttatgatgtgggctctcgaatatgatcctggcatttgctccacttatgaagaggataatactggggctgtggtccacaaaattgaaggaaaggtaaaatcaatactcatttggtaagtacgagagggagaatatgaagaagagggcaaacgatggtgatggcctgtccctattcgncctcccgggtgctaatgtcctaaaagaaacagtacaaacttctgcaanagtccaaggattgatgacattattaggatattgaataatgttaatgganccggacccaaaagactgcgttgtgcacaaactcataggagncacaaaantncaggaaagatctacacatatggcagatnaccacacacacgggactaaaatgctgttcgtcctcattccaccacgtacgaggaaag

SEQ ID NO: 83640 - DNA, 637 bp, Triticum aestivum
  unsure (1)..(637): unsure at all n locations
  Clone ID: PAT_TA_83640
gaataacttaccgtctattcatcaacaaacgtggcagtacggtgaacacgagacatgaaaaatagtaagtctacatgtgcgtagaccacctagtatgactactaggactagagcaagccgaaagagcgccgccgtcaccccctccttatcagtgattggaaaaccttttgttttacacaatcgagaagtcatcgtgctactgccccacatgctcaacagttgaatataatgtagatccaagtttatggaaacaagtatcgataatacatatgtatctccatacatatatctcttctcttataaaataccgattggtgatgatggtatgcctgccatcttgcaatatagaccgtctgatctatatctgaggatataaattaaactaaaagataaccgcacgctctctccanatttgcagataaggctccctcggtcaagcttactccaaaactcatcctgacaattaaaaagganctcngaanaacggcaggtggcncgccggngtctcaacccagctcaacatcggcacaanacacagccatctctactacncccttccangggggcggtccattcccaaatggctatacccccangcgctttaatcgcnggaaccgngttcactacctgaaatcct

SEQ ID NO: 83641 - DNA, 653 bp, Triticum aestivum
  unsure (1)..(653): unsure at all n locations
  Clone ID: PAT_TA_83641
ttagggttcgcttcaccgccggcctctccctccgacgcggcaccggcccccgcgcaccgggcccggatgctatgctgctgagctgcaggaccctctccacctggaggttgctttggatgctgtgctaagccaactccaataatagcagtagacgagccttccaagcggttgaggatccaggggcgatcagtaaggaaggctagcctctcggaggacttttggagcacgagtgcgcatgagatggagaacagcgggatccaatcgcagaggagcatgtcttcgatnaagcacgttggctcagtccaagcgatcaagcatacggcangaagtagcagcaacccgaatgatttatgaatcaagncctatgctccgggaacaagaccanacaacatgggttggnagcaaaaaacgcatctagtntcaacaacctcnaaggggggcccgtaccaattcgcctanatgatctataccccgctcantggcgtcntttanaantctnacgggaaaacctgcgttncaactaatccctgcacaaacccttccaactgggtatacaanagcccacatgcctccaanatnccaactaatgnatggaccccntacggatanccggggntggtaccaannacgtanttcaagccacccgccttctt

SEQ ID NO: 83642 - DNA, 607 bp, Triticum aestivum
  unsure (1)..(607): unsure at all n locations
  Clone ID: PAT_TA_83642
cgaaggcagcgaagcccgagccttcccttccctccaatcgatcacccgctccgatccgctagctagctagcagcgcgatggcttccctcaccgtgtccacgaagaccgcggcggccggcggcaacaagcagcgcgagggcgcggaggtcatcacgggcgcggaggcctgcttcgcgcactccaagcagatgctccaggcgctgggcttcccgggcggcgtgatgccgctgcgggggctggaggagtgcggctgggtgcgcgagaccgggttcgtgtggatgcggcagaaggcccctacaacactactcccgcggcacggcaccgggtgcgctacgacccgaagtcacgcgtactngaggacggcggtgaacgcatgaccgggtgcgcacaacaagcatctctggtgccatcntcaaatgactccacggganagccgaaaattatnaaancaactcggatngcgtcgtccgctcgcttcctacangacacaacggngaggggganananagataaaaagngagaaagganacacgcgcgcncatccccgaataacgnacaanccctttttcnccgtattccgtnaggactncanatccctaccctaan

SEQ ID NO: 83643 - DNA, 450 bp, Triticum aestivum
  unsure (1)..(450): unsure at all n locations
  Clone ID: PAT_TA_83643
ccgcggtgaccgcgctctcggcggctgtcgctttcgtcgcggcgcttcacctctacgcgcggtgcctcctgcagcggcgcgtcgccctcgcggaaggcagccctcgcgtggtcgcgctgcancggcagcgcccgccggacggctacntggtggaggtcgtccgcatcgtcgaanacgcaagcgtgtgcggccancaggctgcggggctggacnccaangcgctgcgcgcgctgccggtgttcacnttggagtccgaacatgccaaggaagaangnggcgtcgctnccgagctgcacgggcagtgcgtngtgtncctcnggggagatggaggatggccaactggggaagctgctcccggggtgccgccacttttccacatttgagtgcacgacactggtcngggtganntcgaactgcccgtgtgccggacggnactaccctgcgtccgtc

SEQ ID NO: 83644 - DNA, 510 bp, Triticum aestivum
  unsure (1)..(510): unsure at all n locations
  Clone ID: PAT_TA_83644
attcgttccaactcctgagcactttctcctcgtccccgacaagccaatcgaagccgagatacggccatggactccaccggcaccggagcagggggtaaggggaagaagggagcggccgggcgcaaggtcggcgggccaaggaagaagtcggtgtcgaggtccgtgaaggccgggctccagttccccgtcggccgcatcgggcgctacttgaagaagggccgctacgcgcagcgtgtcggcaccggcgcccccgtctacctcgccgctgtcctcgaatacctcgccgctgangtctgggactcgccggtaatgctgccanggacaacaagaagactcgcattatccgcgccaagtgcttctggcgattccggnacgacgaagacttgggaactttgggcggctgactaccctcacgnggttgctccccaatanaacctgttctgctcccaanaanacgnggaaaagggtcaatgtgggaacaaggagnaaatcccaagaagcgcaatccca

SEQ ID NO: 83645 - DNA, 169 bp, Triticum aestivum
  unsure (1)..(169): unsure at all n locations
  Clone ID: PAT_TA_83645
ctccctccgcacactccgccgcctcaccttctccccctctctctccccgccgccgtggtccccgccgcnnagctgtggtccttcntcggacgccntctgcnccgacaccgccgtcaccttcggctcactcgtcgcgcttcacntctacctttganaattcgtcngcctt

SEQ ID NO: 83646 - DNA, 426 bp, Triticum aestivum
  unsure (1)..(426): unsure at all n locations
  Clone ID: PAT_TA_83646
ctcgtgccgttttttttttttttgtcatcactttattctcgataaatgttataaaaattgcgtaagagaccagtacaaataccaccactaagaggacttttaaaacacacgcatagcatgggggccctgcataatgttcaccattaggagcttattgcacgcacatatgccgccacataattcagttcaggtacttgttgaaccagtggctcatgtcgcgcaaagttcctccgcacccgtgacagccgctgcgtcgtcgtcnctgtacctcacacccatccatgcgctacgccaggaaaaaccttggncaaagtgattcgacctcggggttcgctgaaagaacttgctcaaactgctttancattcaagcngggctgactgtcattcnactccaanttggaatgggcacttgcatcttcanacaac

SEQ ID NO: 83647 - DNA, 618 bp, Triticum aestivum
  unsure (1)..(618): unsure at all n locations
  Clone ID: PAT_TA_83647
ctacgatccaacagttctagagcaagagagaggaagacacaccgcagagttagcaggctaataacttgcaggagcagcaggaatggcggcgacgcgtcgcctctcttgctttctcctcgccgtgcttctggcaggagtggccgctgccaccgccttcgacgaagcggctgctgccggcttcgggcttggccacngcgcgcgtttcgcgcgcaagcatggacgtgctgccgctgagatgccccagccggagccacaacctaaaactaagccggagccccatatgcagccactgccccagccagaacctaaaccgaaacctatgccacatccagagccaaaagcctgaacctcaaccaaacccaaccctgaactcaaccaatgcccaagctcaaccanaanccanaccagagcattgcctacacggaacctgaactaacccgaactaagccagagctaaacccgnacctaaaatanacaaagcaanactgaacaaaacagactaagcaaagataactgaccaaccagngctaacccaacgaacannccaagcaggcanacaacagnnnagcaggcaaccaacgaacggcaanngnccactagcaacaacngcnacanaca

SEQ ID NO: 83648 - DNA, 632 bp, Triticum aestivum
  unsure (1)..(632): unsure at all n locations
  Clone ID: PAT_TA_83648
atctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactgggtctggacaagaagaaagcttgtgtctttttcaagactaatgctgatgggaacacaacatgtgccaaggaaatgacaaagctctctggcatctctggaaacatcccccgagatggaatctgcgatttgacttcnaaccctgtggctactccatgaaatgcattcaatggtcctgcattctccacatccatgtgacgcccgangacggttcaactacgcaattacnaggttatgggctnggatgcantgctcntctaaggngacttgtcaaaagncctccggtgctttggccccaaaatttccgtgcctnacancttcggnggggtggcatccggaatgggaaaggactngngaaaggccatnctgnacantgtggacaagactctgaagggggncnnttaaaaantcgtctgcgaaaccgtgaaccccn

SEQ ID NO: 83649 - DNA, 379 bp, Triticum aestivum
  unsure (1)..(379): unsure at all n locations
  Clone ID: PAT_TA_83649
gcgctttaggaacggtatactgaacgtcaagcatcttctggcgccaccgaaaccatcaggcaaggacatgtcggaaccgaagatgaggaaggacaagcacaaggggaagggtaagcagaaggggggcagaaggaagagacgttgaagaaagcacacttctgtaacctgggtttgctattaagaatttaagatagatggttgatgaaacgtttaaatgacaacacctttttgtgtccntcctgaaattaagacgtttcctttgctctgctgganccttgaagtgatccttgaaacatgttatttccaccttgaaacgaaacgatgtnatctccaagatgcngtcaagaagagcttattggtcaattttaaaaaaaaaaaa

SEQ ID NO: 83650 - DNA, 666 bp, Triticum aestivum
  unsure (1)..(666): unsure at all n locations
  Clone ID: PAT_TA_83650
gttttttttttttttttttttgggtatgacacgcaaattatattgatcctttcaagcaatacttaaagcgccaggatacttatagtagtaccaccattctgaaacatagtagcgccaggacgaaatataggatcgtccaaaaacatactcttaacaaaagtttaattcaataaaacctcggtgccagaacctagcagacttcacaaaagagcatacttagaacaccctgtatggcttccccatggtgctcttgacgtagaggcatctcacattctgccagttcttcttcagaagggaaacaaggaagttgacgctcatctgggatgttctgctgggttctgcttctcctccatcgccaagttgccaacgggcaacacccatgcaaagaaccttccttggagctggnacttgacggtgccttagctcgttcaccttgggactcnanggatcctgggtgagtaacaaggtcnggaactgcctgcctggttgagacaagacaagggaacggggaatcngctngagatggctccgatccaagaaacatggactctgggaagctctaanagctctgtctgtcattctganaccaaacaagtatcatccactntnggcnctaaaagcggnacccaaganccactnatctggacaggattggaattanagncn

SEQ ID NO: 83651 - DNA, 333 bp, Triticum aestivum
  Clone ID: PAT_TA_83651
gaattctgaagatcctgctaaacaggataatctgttgataatctagtccttagctgggaccatgttattgaagcaagcataattatgtaccttataacgaagattctggtcacttggttgggaatgaaagaagaaaacatatgtgtgtgtacataatattaggtctgtaagcaaatcaagtgcgcttgggtcttgtagacggtagcatttatttttcattgtgtccagtattacccctccccaataattttgggggtaaacatcagtgatgtaaaccccatacttgtgtgtacgtttataaactgtcccgggtaaaatgttaaaaaaaaaaaa

SEQ ID NO: 83652 - DNA, 362 bp, Triticum aestivum
  unsure (1)..(362): unsure at all n locations
  Clone ID: PAT_TA_83652
gcaccgtctactgcctgctctgtcgccggagaggcggtgaagtgaaataccaaagcagttgatagttatgtgggcttgcagaaaacctttggagtttggaaataaatacttttgaaagtgggtttctgaatagcacgctgaacaaaagaaggcgtgtataacacattcatggttcttgcccaaaattaaaccgagtagagcttccatgcaacttgtaaagtatccatccgttcacaaatagaagatttctaacttttttcccgaaccggaagtatgttantccgtattgaaatatccaatatatttgtgaacagagcgagtattaattataataagaatttaaaacaaanaaaaaaaaaaaa

SEQ ID NO: 83653 - DNA, 574 bp, Triticum aestivum
  unsure (1)..(574): unsure at all n locations
  Clone ID: PAT_TA_83653
ggaaactatcagacacttcagccttctaccagcaggcggtggtggaatcctggcacatactgttgctcgagttgcttcttcaatcaagattaaaggcgataactctggagatggcattgagtcccctnacnacnaaantanaaaggttgattgtggatggagacttgattacagcggccgatgccttggagcaagggttacatggaactgaagcagaggagatagctaccgagtgggtgaagcaancaggaaacgagcgatcgccgaacagaccttgctctccttcangcgtgttgctcctccgaccacttctccatgatttgggcaaactttttttttcctcccttttgtttgcttggggtttgccggttcnataccctgtgaaaaacttgttttcccaaacaagttgaaangcntggatggtgaacgagaaanccagatacaatacatacaaccaccaccacgggctcaaaatgggggccncctaattttcaccgntaaacaaactaaatttgcccggtacactgccgtcntgaattnangtcaattaacagttttaatgaaaaaaaaaaaa

SEQ ID NO: 83654 - DNA, 620 bp, Triticum aestivum
  unsure (1)..(620): unsure at all n locations
  Clone ID: PAT_TA_83654
cgcccacgggctggagagctccggccaccggttcctgtgggccgtgaggagcccgccggaagaaccggacacggacctggggaagctgcttcccgaagggttcctggacaggaacagagacagaggcatggtggtgaaggactgggtgccacaggcagaggtggtgcggcacgaggcggtccgcgcgttcgtcacgcactgcggctggaactccacgctccgaggccatcatgtctggcctgcccatgatatgctggcgctgtacgcggagcaagggtcaacaaggtttcatggtggaggagtngaggatncggttggactgcgcgggttacgaaaattcctcaaaggcggangactgnnagcgaagtcaaacnggtgatggagctgaggaaggaagttctccgggaaaagtcccggttggcnaggaaaaagctttggggctactaagaaagcgtctcctaaatggatccccgattctttggaatttgacaagacatcncntncgtaaacggnatccatgattataatggtgtctgtntgcaaatgactcaactnnaancttaggatcatacatatattgcatncaacaaatatcacgtggatgaaaaattgttacaanc

SEQ ID NO: 83655 - DNA, 495 bp, Triticum aestivum
  unsure (1)..(495): unsure at all n locations
  Clone ID: PAT_TA_83655
caaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagaccccgcggcgtgctcaagatctcctgggagaactcatccgcgacccgtcacctacactgagcacgtcgcccgttaagaccgtcaccgccatggactcctctacgcgcttaacgccaagccgtacctctacggttcccgcggtagcctgccgcccgcgctcgccgtcgctgcgttctgtgttctgcattccaanttttgtttggggaatttcctaatacggtaaacgcatnccgtatctcaatgggttttttcngaaaatttncatnccggttccccggancaaatcccnttgtttc

SEQ ID NO: 83656 - DNA, 503 bp, Triticum aestivum
  unsure (1)..(503): unsure at all n locations
  Clone ID: PAT_TA_83656
tttccttgcaaccgattgcctatccccctcccaacccaagaccgatggcgcccaaggccgagaagaagcccgcggcgaagaagccggcggaggaggagcccgcggcggagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctgaagcaggtgcacccggacatcggcatctcgtccaaggccatgtccatcatgaatccttcatcaacgacatcttcgagaactggccggcgangccgccaactcgcgcgctacaacaagaacccaccatcactcccgcgaaattcagactcctgcgcctcgtntccccggngantcccaacaagcctctcctgagggacaaggcgtcacaatttactctcctagntngacccccctttnagnaccctg

SEQ ID NO: 83657 - DNA, 657 bp, Triticum aestivum
  unsure (1)..(657): unsure at all n locations
  Clone ID: PAT_TA_83657
caagcacccgccaatcggccgctgccgaacccgcaaccggaacctgcctccaggctgcttccaccgggcgagggcgagggcgaggcacacgccgcaaaccgcagtaacgcacacgccggggcacgccgcacggcacacaacaaacaacgtgccctcgccctgcagtctacctggttctattgtgccccgacagaagatcctgagagctagagctgtttttttccctacatatagttaagttaaattatctgcacagccgaagatgtccgcgatcatgttatgtacctgcagcggggaccagtccaagtttgaagatcttcctagatcgccaagaatctcttgcaacacgtgacttttcagcgaattgctcttcttcaaagatggcaatcgagaaacaatcctggatgacagcaagtaaatganntngaatcagnctaaaagaaaccnttcacnaanttttaggaggcncaacattttaggtaacggaaatcaagagggaattnatcagattgcaattctcaggggattgtttaagaaccnagacagaatgacacgnnatgcnaaattaaccnaaangcccagcctnagacaaattcaaatgaangatntntgaagncangatcgtacttctcaaggcaacggtaanaatcgggacct

SEQ ID NO: 83658 - DNA, 282 bp, Triticum aestivum
  unsure (1)..(282): unsure at all n locations
  Clone ID: PAT_TA_83658
ncttgcgttgtcctcgccgcgggctcnccctgattcggttcnccngttcctcacctctgtcancgtctcctcagncccaaattgagccaancgaagccgtggncgtgatccggtccaagcncggagcgtggtanccggattctancgccgtcgnntccccttcgccggtattttcnagtcgccgggatnagccganttggntctcgangcatnaancgttgcnggcgcccggngaggatacnatgcctgcggngctcgccgcattcgcnacccttcganacg

SEQ ID NO: 83659 - DNA, 555 bp, Triticum aestivum
  unsure (1)..(555): unsure at all n locations
  Clone ID: PAT_TA_83659
cagaataccatggagatacctaccacctcatttccaagaactgtaaccactttacagatgatcttagcaccagattaacaggaaaatcaattcctggttgggtcaatcgacttgcaaggctaggcgccttttgcaattgccttctaccagaaggcttgcggcttgagtcaactgaaacaaagcatcttggagactgtcgtttctcagatggttccaataccaccagcaacgataactctgacgaagatgaattggaagataaacacctgcttccgactacttctgttggtgaagacacaantgttaaaggaatcncaagtgaatttctngggaaacctnnactgattnccccaggngtncccaaannaatgggngtttcaatactcatgnncactggcngtcataagtaaatggcatgggatttaaaannaagggcccttcggttgggccgaaatttgggtaaattggggggaaccgtttaaggnggantaattcctgtntaaggntnaaaaggggttaannaaaanaaatctntnttaagccaaaaaaaaaaaa

SEQ ID NO: 83660 - DNA, 646 bp, Triticum aestivum
  unsure (1)..(646): unsure at all n locations
  Clone ID: PAT_TA_83660
gtgnttacgcgcagcgtgaccgctacacttgccagcgccctagcgcccgctcctttcnctttcttcccttcctttctcgccacgttcnncggctttccccgtcaagctctaaatcnggggctccctttagggttccgatttagtgctttacggcacctcnacccnaaaaaacttgattagggtgatggntcacntactgggncancgccctgatanacggtttttcgccctttgacgttggagtccacnttctttaanngtggactcntgttccanactggaacaacantcaancctatcncggtctantcntttgatttataacggattttgccgatttcggcctattggttaaaaaatgagctgatttaacaaaaatttaacgcgatntttaccancntataacgcntacatttangtggaattttcngggaaagtgcnntgaaccctattgttatttcaaatanatcaatatgtatcnctcataaaaatancccgataatgctcatatatganaangacattngtatcaaatcgtgtcgcctaaccctttgngaattgctcctgtttgcancaagaaccgggaataaagnncaaaataantggtcnaatggtaacaanggtnaaaaggnaatnntgagtttcc

SEQ ID NO: 83661 - DNA, 649 bp, Triticum aestivum
  unsure (1)..(649): unsure at all n locations
  Clone ID: PAT_TA_83661
ttttgaacctctccctttcacatctcgatatcgatcaatcacgatggcttctccgccgtacgcaacctctccatcaggaatgtcacctccctacccatcacccgctcagattcccaacaagaagcgcccatcaactctcgacggctccgcacctcctcacaagcgccgcaaaccctcccagacctccgtctcaaccagctccgcagcgcatcctcttcgccaaacatccttccctcccgaagcacgatctccattcccacgctctccatccgtagatgcccaatcccaatttanncggaancgcaatgagcaaaacagcaagggaacaccgaagaagaaacgcggccgcaaggggaagaacgccaaggcagatgatgctcgtgaacagacgccantcttgtcggaggacggcgcctantgctgtnaaccgacaanggggttagaaggaggttacataagatatnaaaaggtgaaatggcccggaggatcnttcaaaaccaagncaaaaacagggggatccacnnnaacaagctttagggtttgntcaacattnaccnattaacncgggggnaanaattgnggaagnccnaanattttaaacnaggtccaaaggttcaaaattaagggttaaaaggaaacncccgggann

SEQ ID NO: 83662 - DNA, 430 bp, Triticum aestivum
  unsure (1)..(430): unsure at all n locations
  Clone ID: PAT_TA_83662
cgancgangaggccngcngtgcnctgncgacgaangcgantctggtggcngcggtgatggagctggagctgctcntcgcnggcttccaccatcntgtctagggcggcgctcgacatgggcgtcatnaagatngngttcctcntctacnggaacgccnnatccctgctcgtggccgccccngtcncctacttcctcaacaagaaacataggccgcccttcactctacacttgcngatggacttcttcttgctggctgcantcggggtaaccttcacacangggctctanatcctcggcctgtactacctgtcaccaacctactctctgtcatcaagaactcattcctgcattaccttctcatggncgctagtttnngtcatatcaangggatgactttgtttggattacananaatctcccaaattaaatt

SEQ ID NO: 83663 - DNA, 630 bp, Triticum aestivum
  unsure (1)..(630): unsure at all n locations
  Clone ID: PAT_TA_83663
cttgcgttgtcctcgccgcggcctcgccctgattcggttcccccgttcctcgcctctgtcatcgtctcctctgacccaaattgagccaagcgaagccgtggccgtgatccggtccatgcgcggagcgtggtagccggattctatcgccgtcgcctccccttcgccgctattttccaagtcgccgggatcagccgagttggatctcgaggcataaagcgttgcgggcgcccggcgaggatacgatgcctgcggtgctcgccgcattcgctacccttcgagccgccgctgccatcgcctccggggactcctccttcccctgttcccatcgtctcaagcatcgttttagtaatagtaatttaatagtagtaattgtcattaactttgcgttccctccgtcgcgcaagctctcggtcggtccnaacttcgcattcggtttggnccggtgtgctccattcgangctactttggtttgcggttccccctngtcaaactggngtcgggatcnactgaaatnggaagaanaagnggcatacactaaagatananaattccttgaaattggataaccgtggtggacaacccggggactatgcnaagggtnaaacaataggccncaaanacgttaatcnt

SEQ ID NO: 83664 - DNA, 363 bp, Triticum aestivum
  Clone ID: PAT_TA_83664
caaacatgtacgctgcagcgtatggcacgtacccgctatatggcaaccagcagctagtgagctagagagctcccctccgacgtgtcccctctgacgggaaacaaaggttttggtccggtgagcatagtagcgtcaggtgagaaggtgcctttataaggctgtcctaagaagtgggcgagatatgttgttgcatcgttatcgttatggtgcctgtaactgttgtgtgtgccgtgtgcgtccggaagaattggatggaatggaactcgtggcttgttgtagtacatcagagagtcatgttattctttcaagaaattttgacttggtaataaattaaactattgtttgtgcgtcaaaaaaaaaaaa

SEQ ID NO: 83665 - DNA, 568 bp, Triticum aestivum
  unsure (1)..(568): unsure at all n locations
  Clone ID: PAT_TA_83665
gaaaaacaacggggcatttgaagccataaatatgcacagacattatatttacaggacctgagcagactgtacacccacacccagttagatagactgaaaaggtctgtcgtcagagtccgcaccccggtccaagcgtttagccacgtcctagctaggacgaggaacaccctctactcctctgcatgaagaatcgataagccatgcgtcatcactctcagaacacagcacagctagctccagctattttacatgagaatcgtaggcgtagaagatgttgtccggggcgacgaggggcagcttctcgacgtacatgaacagacgcctgatgttctccctcgtcaccgtcgcatgtcgacnactcccggnatcgtgagcatccaaagtccccggagtcantcgtttaagntgtccgacanaagggcagattgcatcttgatccccattggggtaacactnatgcaatggnatggctgcactgggaacacacctngcgttaactcancaaatgcggaatctccncccttcaattcggctccnaacggctcttgctctccncgnccccccgggc

SEQ ID NO: 83666 - DNA, 337 bp, Triticum aestivum
  unsure (1)..(337): unsure at all n locations
  Clone ID: PAT_TA_83666
gtggagcggccagcgcgggcacgccgtcgaggcggcgcggcgttggctgcgctggtgcgccctatacgcgtcggcacatcgaacaatctgacttcgtgcggctcctgaccctggttggaagtgttcgcttcagctaaaacagctccagctgcggcctctctctgcagatcattgtagcagcagcagcgctgccaagggattagttgttgcatcctatgatgcaacataatatgttcatgcagcaactcaagttnagttgtactgtttgactcnagaaatgttacaagctgttactgtttaaacaagtgattccnattggnggtccaaaaaaaaaaaa

SEQ ID NO: 83667 - DNA, 564 bp, Triticum aestivum
  unsure (1)..(564): unsure at all n locations
  Clone ID: PAT_TA_83667
cttttcctcgtatccatcctccggcgtccgcccttctctcgcgcgcgccgaccgccgccgccaggtgccaggaagtcgtgggaagtcttcttcggcgacgagcacccgccaggccatatctctgcaatgggtgactacacaatccagattagcaccaagctcattgaccagcttgctcgtgatgacgagaaggtaaaacggaaagccaggaagcccaagcctaagaagaagcccaccgtccagccacatgaagagcccctggaattcccgagagaaccaaagacgacaagccttgctactgctcctgggtggctctgcagcctccccctatgtttctgcnantgacccctgctcccccgcaaccccnggcaaaatgccggaggtggaancattcttccgtcctgaaagaaatgaggcgttccaanaactgggaaaccagaaattggggcacccangactcacangaaacaagggactgcacnaaaggatnaagcncatccagaaccagcctgnccaagaanggaggtcttganntaaaacataanggccncaagttctaaataa

SEQ ID NO: 83668 - DNA, 249 bp, Triticum aestivum
  Clone ID: PAT_TA_83668
tcaagatcgtactataaacgcgtcggtttgcaggatatagattttattttctaagtcttgggtgatttgatcatgggcaccgggtaccggatccgtggactgatgtacagtgggtctattggaagcgggaagattttgtttgtttagatcggacatgatggctgcacgtaaagccactattgaggggataaataacaggaaataaatttacttaaaagtactttttttgcggtgtgtaaaaaaaaaaaa

SEQ ID NO: 83669 - DNA, 251 bp, Triticum aestivum
  unsure (1)..(251): unsure at all n locations
  Clone ID: PAT_TA_83669
gacaccccccttcccttcctccgatccccccgcctcccccaaaatccgacgcgtaatcgccgccatggccgccgccggcaagctcctcctcctggccgccgccatcctgacggcttccttcgtcgccgacgcgcgcccgtgcggccacgtcncanacgctcctcgtcnccttctcctccgtcctcaggacgaanccgggacnntcaccaacatcgactcccgactcancatnaaagtcatntnngtcctcc

SEQ ID NO: 83670 - DNA, 369 bp, Triticum aestivum
  unsure (1)..(369): unsure at all n locations
  Clone ID: PAT_TA_83670
gcggagcgtaaggcgaaggagtagcagcagcaggcggcgccgagtagcggctccccatctcgagcttgccaacatggctagaaggattgaagaaacatttnaagaagntcaatggccccaaagcaatggatgctngacaagctttggcggacttttgctcccaagccanccttctggaccttaanaantccaanggaattgcctgcaaatggttccncaacnccaggaanagggccaattttgcccctaaaaaccgtnaggncaattccaacccgatcaancccaanttcctnttnaaggnaanggcngggacaaacaanacctaacccggcnggntcaanggtttcnattcanncccaagancaatga

SEQ ID NO: 83671 - DNA, 353 bp, Triticum aestivum
  unsure (1)..(353): unsure at all n locations
  Clone ID: PAT_TA_83671
cgacagcaccacaccacctccaactacccgagaccatcgacgagcatcttcctgcatctgcaatggctgccgctaccgtgtccgtcccccgcatcaagctgggctcccaagggctagaggtctccgcgcanggcctcggctgcatgggcatgtccgccttctacggtccgccaaacccgagcctgacatgatnaaactcatccaacaagccgtcgccgccnggggtcaacctcccttganacctccganatntacggcccgcaaaccaacgannttctgctaggcaaggggcttcaagggggtttaaagggaaaggtccaactggcacnaantttgccgtcccttcccnaagg

SEQ ID NO: 83672 - DNA, 311 bp, Triticum aestivum
  unsure (1)..(311): unsure at all n locations
  Clone ID: PAT_TA_83672
ncattgantcttgaacnagatcgagcttcttttgcaccacaaagtccaggatgtcttgcaactgcggatcaagctgcggctgcggctcaagctgcaagtgcngcaagaagtaccctgacctgcaggagacancaccgccgcgcaggccaccgtcgctcctcggcgttgccccgganaanangccgcncccgagttcgtccaagccgccnnnggagtccgggcganggccgcccangntggaagtgccgttggaaactggaaattgcgaaccctggnactggctgattnacaattatnggacgnncaatggg

SEQ ID NO: 83673 - DNA, 265 bp, Triticum aestivum
  unsure (1)..(265): unsure at all n locations
  Clone ID: PAT_TA_83673
gccaattcgctcgagttcagatcgagcgcgcgccaagcaagtcttccggccggccgcgaagagcgcaatcaagcaagacaagatggtgaagctcgccttcggaagcgtcggcgactccttcagcgccacctccatcaaggcctacgtggccgagttcatcgccaccctccctcttcgtcttcgccggcgtcggttccgcaatcgcctangggaaacttgacaaatggcggcccctggacccggcgggcctgttggcattnccatt

SEQ ID NO: 83674 - DNA, 577 bp, Triticum aestivum
  unsure (1)..(577): unsure at all n locations
  Clone ID: PAT_TA_83674
gaatacgatgtgctcctgctcattggactgggcattggagccactccattgattagcattgtgaaggatgtgcttaaccacacccagcatggaggatctgtttcaggcacggagcctgagggcagtggcaaggccaagaagaggccattcatgacgaagagggcctacttctactgggtgaccagagaagagggatctttcgaatggttccgangggtcatgaacgangtgggctgagaaaggacaaggatgggagtcattgaactccacaacaactgctcnattgtgtacaaggaagggatgcacgttctgcactccattgtcatgctccaagactccaacaatgcaaagaaaggggtcgacatcttgncnggaactaatgtcaagacgcacttcgcgcgtcccattggcnaacgtctccaacatgtngcatgaaccatgagaacaacnctttgggtttcnacggggtaacccgncttttncaaagntcggaatggcacaaattccccnaagncaacnaatttgntccaagggaatncaanganacggaaaccgggcgggcccaaggttaaatgat

SEQ ID NO: 83675 - DNA, 267 bp, Triticum aestivum
  Clone ID: PAT_TA_83675
ctggtcattcagtatccgagaccgatagctgaggctagtggcgatggaggactgtgttattactactataaactggtggttgtgtttctgtaactggtgaatgatcaagttggaagcttttagtctatcttagatatatcagtggatagtgttttttgtattttcgttttcttttccaatgtgtgttgggtcttgtggattatcctttttttctaatctaatacaatgaagaggcatgtcttttgaagcttccataaaaaaaaaaaa

SEQ ID NO: 83676 - DNA, 618 bp, Triticum aestivum
  unsure (1)..(618): unsure at all n locations
  Clone ID: PAT_TA_83676
cgccgacggacgtgttcagagtcttttacgcggacaggctggtgtggaggctcgtcgtgaaggcggcgggggcgccagggcatgggtcgaggatgttggacggcgccgccgttgacaatttgatggattgcgtggagaccatcgctgcgttcagggatgcgcagttcaggatggtgaagtccggggagaagggtcctggggaggtggtctcagtcaaccctgtgtacatgaaggccggcataccaagccccacgggtttcgtgatgaacatgcaaccttcagaagcggaggtcggctttgacctccgccttcctccaaccgaagacatcgagcagatnaagcggagggtcnaanangaatgggcaccatctcacaaaaactgactacgagctggtcagaaagnccggcgacggatgtgtccggactccctatcaaagcgacaacgcgtcaaccgtggtgctgacgtccaaanggcatncctcgccggtgggacttctaanctnaatctgtctcacacgnccancctncncggaactggnncctcctcggtttccnatacagacccatcngtaatacatananttcggaaaaatntcnagggancatnacanantacaa

SEQ ID NO: 83677 - DNA, 581 bp, Triticum aestivum
  unsure (1)..(581): unsure at all n locations
  Clone ID: PAT_TA_83677
gtttttttttttttttttttgctcctctttcgaactatataacatgcaagaataacaattaaaagtacaaattcttggttccagtttatttcaaaatcgactaatatgatgtggtatttacaattacatagtgccgtgaccacatcttattctgctggaaaccagcacgccgattttcacagccatgcgtagaaatgtggaaacgaaacctttctgcattcgcaggctcactcttgtatcggagcctgcttgtgcatgtgtaaaatcaacacttattcagaaaactgcatattcggtcatgaacgtccattatgcttcccatcatggaattgggcgttcctanatgacttgaatgtttccaaagaactctccacccttctgcagctccgccttcntccntgccttgtccacttgtgctctgaagcaaaattcaaagatcngggaatgcncacancanatctggtaaggaaacaaccggancccctgaanaaacacganatcaagnccaaagagaaatagcactactcaaaaggtacananangggtccaactctcgggaaaaccttttacaantanacagc

SEQ ID NO: 83678 - DNA, 626 bp, Triticum aestivum
  unsure (1)..(626): unsure at all n locations
  Clone ID: PAT_TA_83678
aaactacctcgccagctccctctgcctccccctccctcctcccgtcgccgcagcacgcagctccgccggttttcacggcttggagcagatctgccacgccaccgccgcgtagaccaacttggtggagggatcccgtccgaatctgattcctattctccagctcgaccgctgtagcgagaggagagagagaaaggagcagtggcgacgaggtctatggcatcgatggcagcgtacctggcctggctcggcgggcggcgcagaagaagtgggtgcacctgctttaccacacggcgctcaacttccaccgccacctcttctaccaggaaatcattcccccaatcctcccctcttcgcctcccttttgatctcgatctgccttcctgctcgcggacgggactggcttgtgttgtctctcccgcgcagcgtcagatntcctcgacagtttgagacaatgcaagtggttccttangggatcactngaaggcacactgatngtaatcataatgcaacatangggaaatcactcatcaaataaggcatgcttctcaganntcattactattgtatancctccacgacagtnatattgcaatctgataaaattgcagtcgtgaaaagatttacat

SEQ ID NO: 83679 - DNA, 327 bp, Triticum aestivum
  Clone ID: PAT_TA_83679
cccctgcacgttgctgtccagctacggtcgctacccttcacaggacattgctccggctgctgcttcagcagtccaagtgcccacctgtgtccgtccgagttccttcgcccgtgctccttcgtgctggagcttgtgccagcagcggtgcacgcatctgaagatcgggctgatgcgtcttcagcaaacactgcgacgagcaaccacctcttgcagcaatctctctctatgtccctccgcttgtacagcaaaacaagtcgatgcttttcttcagtttgatttaagcagtttgaaaaagatcgacagtggcattctttgaaaaaaaaaaaa

SEQ ID NO: 83680 - DNA, 358 bp, Triticum aestivum
  unsure (1)..(358): unsure at all n locations
  Clone ID: PAT_TA_83680
gtcaggatcgtcatgagaattgcactatctctcatgaattcttgacgcagtaatacttcttgccatcattgttcattcctaggtttccgtgttattgtgaccggaatgccgacaagtgaatcgcggtgtgtgaaattaatactgctagcaactccgttgcttgggtagttaaatggacgataacctcattcttagcgtgttgattattgaatcgtcaccctaaggttgattgtgctacctagtccctatttcccggtgcactcttcggtccgttgagtttaggattttgtcaatccctcgctcatttgatcatattgtctttcccccgnaaaagcaagattgttccnccaaggggggg

SEQ ID NO: 83681 - DNA, 631 bp, Triticum aestivum
  unsure (1)..(631): unsure at all n locations
  Clone ID: PAT_TA_83681
gtttttgagaaatcggagcagagatacacaataatggaggcggcaggtggagagcagcacgaaacacgacgacgtgcaggtgcaggcctcgccctcctgggcgtcgtctactcatcgctgctcctgaacgccatcttcgtcgcgcaccacttcctctcgccgtcccggctgctgctccgtgacgacgggtgcgggtgcgggctcacctggtctctgcaggcggccagggaggccgaggcggtggccgccgtgggagtgctccgggccacgggcaggtgttccgtccnatggcgtcgccggcgaagacgggcggcccgggtgcgagtgcaacactgcttccngcgggccggactgctccctttcgcacgcccaactgcaccgccgacgcccgacagcggaacccgttgttccctgagccgtactggcgggtcaccccgcggcaacgccgtggtgttctccggggtggaacgcatgactacacacacgggcggttcaatcgtggactggacncaantgggctgacgggcctcggtacncgtccngacanagactgtctccaaggtcctgaaccataacccggtaacccttcccgncccangcgctccactcaaatgcccggccccttnacggg

SEQ ID NO: 83682 - DNA, 571 bp, Triticum aestivum
  unsure (1)..(571): unsure at all n locations
  Clone ID: PAT_TA_83682
agagatacaacgtgtgcatcaaaaaacccttaaacccaaatcttattttcaagtttccgccatacctacctatggattgagtcagatccttcaagtaagttgtcatcggtgcaataaggcaataaaaattgcttctaaaagtgtgagatcatttagtgtaagagaaaattcagcattgtacaaacttcgatggcaaagaataaaagcgatagacgcataataaaggttgccatcttaaggggcaagacaacgtgatgttcttttgcagtaagggattgagcatataaacaaataagcgcatggcaacctctgcttccctctgcgaacggcctatcttttacttttcagtatttatatttatgcaaagagtcaaagttagtctctctatttgtttttataatctcttttggcaagatcaagtggtgaggaaagtctagcacatatgtcagttgaatatgggtacatgattacaatgttgacatcaccctgaggtgaatacctgggaggnaaacataagccctatcttcaagtgtcggtgaacttttgccangtgtancgtgatgtacaacat

SEQ ID NO: 83683 - DNA, 578 bp, Triticum aestivum
  unsure (1)..(578): unsure at all n locations
  Clone ID: PAT_TA_83683
gcgcgcgacaggccggcgcgccgccgctcaagggcgccgtgctcatccacccctggttctggggctccgaggccgtgggcgaggagcccagggaccccgccgcgcgcgccatgggcgtcggactctggctcttcgcgtgccccgagaccaacggtctggacgacccgcggatgaaccccttggcgcccgccgcgccgggactccacacgctggcgtgcgagcgcgtgatggtgtgcgccgcggagggcgacttccttangtggcgcggccgcgcgtacgccgaggcggtggccgcggccaagggcggtgacctcggggaagccgctggcgtcaactgttggagacatgggagaaggcactcttcttctcctcaaaccgactgctacaaggtaaggagatgatcacagatggtccctnatcaaccccctgaagcntaagtcttggttccntctnaaatatcntgcgtggtaagtatcncacctgtcagcattacgtacactgcaaataaagctggntcgtaaaaatggctaanaatagttttaattggattaatttaaattaatnaaccnctaantttt

SEQ ID NO: 83684 - DNA, 640 bp, Triticum aestivum
  unsure (1)..(640): unsure at all n locations
  Clone ID: PAT_TA_83684
ctcaactctcctcattctccacaggctgagcagcagccgccccattctgcggttcaatcaccgcccacgcagaacccctccgccctccgctccttccagctcgctctctacctgcaccagcctcgctcgccctttgctcgccgccgccatggggaggggaaagttcaagggaaagcccaccggccgccgcaacttctccacactagaggagatcgctgctggtacttcaggtcgccctcgcacctttatgaanacaggcaattgaaaaagagaattgatctttttatgggcgaagtgttgaagatggctttggtgaangaaatgtcttgttancatcangtaagtggcaacatcacaacccctanaaagcttgtgccttaaaacaagaggatacaagaagttggagtgcttttgtgaaaggctttgagatcacttgaacgttagtaactttgngnatnattttgnaatggttggnaattgtgcaaacatataanagtgtagnttgcnaaganttgtgggggctgttanggttantnagtggttaacnatggncatacnattaattttactaaanaaaaaaaccagggggccggacaattccaaagatcttacccccnaggcgntttaaagccgaggaaac

SEQ ID NO: 83685 - DNA, 649 bp, Triticum aestivum
  unsure (1)..(649): unsure at all n locations
  Clone ID: PAT_TA_83685
cgacagcgttgacagcgatcacccagttgacgcaccacggcatggtgttcgtgcctgtgggctacaccttcggcgccaagctgttcggcatggaccaggttcagggcggcagcccctacggcgccggcacgttcgccgccgacggctcgaggtggccgagcgaggtggagctggagcacgccttccaccaggggaagtacttcgcaggcatcgccaagaagctcaagggttcagcctgatctacacatatacccttgtcggatatcataaaaaacacttattacagattcgtcttacccatcaatagatcggtctgttctctcgtggtgtctggatgttgtgtggctcaagtggaactttcatgctacggtgactttgttgtatcctggagttggatangttgtttcgcataaatttcgatgatttgccaagtaaacgtttgtttgggtcaaaaaaaggggggccggtaccaattcgcctatntgatctattaccncgctcacggccgtcgtttanaagtcctacnggaaacctgggtaccaacttatccctgcacaatccccttccaactgggtatacaaangccgacgntgcctccanattccacnaagggaaggaccccntncgggataccgggttgngtacccac

SEQ ID NO: 83686 - DNA, 312 bp, Triticum aestivum
  Clone ID: PAT_TA_83686
gggaactctgcctgtcagggtgagtccttctaagactccggtgaagccacgtgtaaatcgaatgggatctaactgactctgcctaagctcaaccggaaggcatggccataagctgaaggcttccgcggtcctgtgcatcatgatgcatctgcttacattcttacaaacactctgtttgtacccttttgcaaacctgttggaagggaactggttaggtcaggcccttttgccttgcatttcagacatgatggaaccattgagaatgactattcggcaatcaaccatcaagtaacttctgtcaaaaaaaaaaaa

SEQ ID NO: 83687 - DNA, 615 bp, Triticum aestivum
  unsure (1)..(615): unsure at all n locations
  Clone ID: PAT_TA_83687
gccgccgtcaccgtcgctcctcgcgggcatcctctccgacctcgccgagatcggcggctccttccgcggcggcttctcccgctcctcgccggcgcccgaccaccccgcccccgacgcgctcgagtcacagcaggccgcctcgtccccgtccccgcgtccgcctcctcctgctgctgccgaccagatcgcagatgatgtcgtgggagcagcgcgtgccctcgccgcgcggcccgaggcgtggatngacttccccgtgctcgccctanatgagggttctgtaatttctggtatccaaagagatcatatggatccaattgaaaaacttgtccaagatttagcatctctacggggtagctctgtccttctacatggatgaagactattcnggaagattacttaaggttgctnagtaancataaatgncatattcnangaaatatccggaggtgcaaattcgtaatacacatganatanatccgatccaactcagtcggnaaaaanaatgtgaaanaacaagangnacaactcgaaggnggcttccaaaaaagntgacnacatgcatggtttgnatcaaattgaaaacagttanggcnaaacttaangaacctaaaagna

SEQ ID NO: 83688 - DNA, 570 bp, Triticum aestivum
  unsure (1)..(570): unsure at all n locations
  Clone ID: PAT_TA_83688
gttcgacaccgtcaacggcggccgcgcgctcacgtcccggcggccacgggccgtgacagactcgagcccgtccgccgccttcgccgcgccgcctccgcctcctccatcgcacgccgactccgctgcctacatccgcgcacgtccgcctccactgcctccatccgctcgggagccgccgccctccgcgctaggcctcgcctccgtctggtctggattcttcgacatctggccatctgggcgctccgcgtcgccgacttctcgcaggcagagagtgagcatccttgatagacctgatggctatcgcagagagctgtgttgatgcggtggtcatggagatggtggcagtctactgcggtggctctacaccgccaaacaagagcttgctgcccgccgcatcgaggcatcggcttcaagtcgggcacagctctctgaaaatatacatggagcgcctcgattaatgatatcttgaacaacaagttatctgaaaattttggnagactgttaagaacaaatnacatctgaaacaanaaagggtacttgnctcaaanacgtttcgtgntanctgttcca

SEQ ID NO: 83689 - DNA, 351 bp, Triticum aestivum
  unsure (1)..(351): unsure at all n locations
  Clone ID: PAT_TA_83689
gnggcgtccgggatggagtcntcgtcgggcctcantaccgtcaggaactttgacctcaacctggcgccantgncgganaatggcgacgccgggatgatgaanaggtgggccgangaagaggaggtgcacantccgttgccgatcaacaancgcangttgtnngactgactactcaccgatgccgtcntgtctatcgtttcatgtaaaaatggatctacgccatcgttgtgtcgttaatttaatttgttttaattangttctgttttttctggacanaaattcgttcaattcantgattcgtcacttccnttgtttccacacctgttaattcatcaacngaagctttaatta

SEQ ID NO: 83690 - DNA, 631 bp, Triticum aestivum
  unsure (1)..(631): unsure at all n locations
  Clone ID: PAT_TA_83690
acttaccctgggatgctatctgattcggtgtttgctacagtagacaggcaaagtaaaacaagaaaagccattgctgtaccaatgaaaatactgatagaagaagaattttcaaatgatgtcaattctaggcatatttcaccaggtgctgtaggaaggctcatgggtcttgattcgttgccctcatctggaatccataataagcatagacataccaaaagtcatgcaccaaagacttcacctagtagttttcatggtcgaactggtttgcatgacattccacacaggaggagtgtagataccattaatgtttttgaaggtatgggaagcacaaaaacaaatatgcaccggagtccaagatctaaaattggaagtacaacttccagatnaagacaagggtgttaatgctgatatcgattcataaggnaaaaatttatggtgcnaagcgcctttcatgagaatccctcanttcagaagatttatgaacactnagcccggtacaanatgactttgtggtttctcaaatttgtccgcgtcaaaggactannaacaggtcccacctcacgaaatgacaatatgancaccaaaacatttgcaggnattncccagaaagacnacctacacatggaggaat

SEQ ID NO: 83691 - DNA, 487 bp, Triticum aestivum
  unsure (1)..(487): unsure at all n locations
  Clone ID: PAT_TA_83691
tgaagcagaagcaggcaaaccctgaccaatcagagcatctgtactctagaaacgtggatttcctggcgcacatagctgaatcttgcaaaattgtttcctcatcgtacggaacattcaagaagaaagcaagggaacagggttggataatgtcagaatctttgctcaaccctggcaaggctcgattatgtgcagcaaaaccacaatgaatctactgtttcagttcagtgtcgatgagatgataccaatctcatgtttgtaaagactaacttttctaaccagacaggatgctcagttcttaggagctgaactaacatatgttggttcccagcaataggcgtgaatctgaaactaccaaattctaggaagagcaagattttactatttgtaagttcatctccttcgtgtcnagnatcatatttgtgantgacttaaaatttcattttgaataaatatttgaataagacgtcagagttttgaaaanacaaga

SEQ ID NO: 83692 - DNA, 622 bp, Triticum aestivum
  unsure (1)..(622): unsure at all n locations
  Clone ID: PAT_TA_83692
atattaacttggaactttgttcagtcttatgaaagctttactgaatcctattaacatgtgtatatatgtagggttagtcacatgtcatcagtgctttgtttggtctctcatccactaaatgttgtttactttgctattactactacaaagtcatagttcagttactcatttttaatcacatgtccatcacanactcctgaatctgacantaaggttttaatccacacataangacatgtattcnatgtattagttgccacatcaatatttgcgtttatgctcaaaatataccccgtggtatacntanaactgttgccctacaagctaacttgcatcatgtagtatctctaatacgtatcgtagtanaagacagttcgaaatacattccctgngatgntccatgatactctggtactccttaggtatcctatatcttaattgtgcatcatcacttgggtaatccactgcgttgacactancgacacttctttcgtgtatgggcattttcctatccacanacattccttcgctgctgccccaatatcctntcatggtgcattagtagaagttccaaggccatgtgttgctccaaaagngcncatttgantnggatactgtaaaa

SEQ ID NO: 83693 - DNA, 439 bp, Triticum aestivum
  unsure (1)..(439): unsure at all n locations
  Clone ID: PAT_TA_83693
ggtccgcaangacttccaagtggtaagtttattccagggaatancaacagttatgacaaatgtcgtcgaanatttgacctgggtgatgcagactatcttaggtatcatggtatgcaagagtttgatcaggcaatgcaacatcttgagcaaaaatatgaattcatgacatctgatcaccagtatatttcccggaaacatgangaggataaggtgattgtgttcgaaaaggganatttggtatttgtgttcaacttccactgcaacaacagctantttgactaccgtantgggtgtcgaaagcctggggtgtataaagnggtcntggacncgacgctggactattggggggattaanaaggttcnatcangcaatcggaacantnaaccgcngactggttcgcatgataataggcaaaatcaatccccgtttataccaatg

SEQ ID NO: 83694 - DNA, 599 bp, Triticum aestivum
  unsure (1)..(599): unsure at all n locations
  Clone ID: PAT_TA_83694
tgatcttcagcttctccgatccctacatacttacgcctctcgaaaaaacctaagtaatgtggtaaacagtgctaagatccatcatccgatttataattggaaaaaaaagcacgctacctgatccccgtgcgcgtcgttgccgccactcacacgatccagcgaagcaatgcatgccctacgctgcatgctagctagagcatacacatgcatgcatggagcacgcatcatcttgttctgctgccgatacgatggagctcacgatctggttcatgatcatggcctccacgcgctcgtccacaccacgggctgctccttccacgcgaggaacaccccggccgccgcgccgtcgtccgcgcctgggctcgcgcaaggtcatccctcccggtacgggcgcagcagcgaccgcatgtcgtcggcacgtctcgctgaatgcacggaaagaaccggcagaccgatgcgggcgccaacaangccccgtntccgctccgaaggttcggcccgggaggcaacaggtcanaangnaccccgccgccttcangggagcncncttgcccccttgggaacnccccaggggggcggtccattccccaaagatcttn

SEQ ID NO: 83695 - DNA, 575 bp, Triticum aestivum
  unsure (1)..(575): unsure at all n locations
  Clone ID: PAT_TA_83695
ccagaaccccgcgcgtcccctcgcatcgtccctctctccgccgactccaaaccctaacccgcgcgcttacctcctcgtcccctcaggccatggcgtcgtcccctacccccaagaaggtgctggtcccgatcgcgaatgggacggagccgatggaggcggtcatcaccatcgacgtgctccggcgcgcgggggccgatgtcgccgtcgcttccgtcgagccgggggcgacgtccgtagctgcctcatggggcatcaagcttaccgccgacgcgctcctcgcnganctcgcggacgatgagttcgatctcatctctctaccgggagggatgcctggttcttcgacttttggagantgcaaagttttggagaaaatggtcaaaaaacatgtngnagaagggnagctttatgctgcaatttgcgctgaacaagnatgatctaggactgggggttgctcaatggctaaagnaacatgtaaccttcgtcatgagaaactcctcaaaggtaatcgtggaacanaatgcnattgatggaaatgttaacattcnggacggganagcaagggatcgttattggta

SEQ ID NO: 83696 - DNA, 556 bp, Triticum aestivum
  unsure (1)..(556): unsure at all n locations
  Clone ID: PAT_TA_83696
gacctgcgctcgccgctatcattcgtttctggacacccttctagccccgccgccaccacaccaccaccaccaatggcaggaatcggatcaaaggccctcgccgtggtcgccgtcctggcggccgtcgtcctctcggtggcctccgcggccgaggcgcccgcgcccagccccgtttccgccgccgccggcgcgtcggcgccgttcgccgcggccctcgtcgcctcctccgccgccttcctcttcgccgccgtccgccactgagccgatggggcccttccaccgccgcctangtctatttattggagtggtattcagtagtactggtactagggagatttctttgttgggtgtcgtgtcgtcgtcgcattttggtcggatctggtgtccttggtgggtggggaaggtttgtaccgcgtcgtggtgtcngttgtgtgatctgantctgatcccttgtnnatatcngctactcccgtgatngtnagtgatgatccgtcnggtncaactgataactatgtccctatcgtcaattgagaaagcttgttctaaaaaaaaaaaa

SEQ ID NO: 83697 - DNA, 570 bp, Triticum aestivum
  unsure (1)..(570): unsure at all n locations
  Clone ID: PAT_TA_83697
aaaccctcccatctcttcccctccgccgccgtctctgctctcaagatcgccatggcgtcagaaaagaagcagtcgaacccgatgcgggagatcaaggtgcagaagctcgtgctcaatatctccgttggagagagtggagatcgactcacccgcgccgccaaggtgttggagcagttgagtgggcagtctccggttttctccaaggcaaggtatactgtgaggtctttcggtattcgtcgtaatgagaagattgcatgctacgttacggtcaggggtgagaaggcaatgcagcttcttgagagtggcctcaaggtgaaggagtatgagcttctgaggaggaactcagtgatactggctgctttggttttggtaatcaagagcacattgatcttgggatcaagtatgacccgtctacgggtaattatggcatggacttttacgtcgtctggaacaactggtaanctgtgcacttcggccaagggnaatcccgnnttggatccannaaagggnacaaanaaanccanaatggtccagttaattcaaggggtaacccaaaaggcaaaaancccg

SEQ ID NO: 83698 - DNA, 610 bp, Triticum aestivum
  unsure (1)..(610): unsure at all n locations
  Clone ID: PAT_TA_83698
ggcggccccgcgttctccgtctccgtctccgtccgcccggcgtaaagaaaagcctccctcaccacagccgccacgccatggccgaggagaccgacaccaggcctgcctccgcgagctcccgaggccgccccgcgcccgaggacgacgacagggaggagggcgagatcaccgacatcgcctgcgctccttccccgcccgccacgcacccgctcgagcactcctggaccttctggttcgacaacccgcagagcaagtccaagcaggccgcctgggggagctccatccgcccaatacacaccttctccaccgtcgaggaattctgggggctttacaataacattaatcaccctagcaaattgatcgtgggagctgatttcattgcttcaagaacaagatcgagccaaaatgggaagacctatttgtgcgaatggtggtaaatggacatcantgtggaagangaaatctgatacttttggctgcaactctgctggtataatggtgaacattcacnangtgatgaaattgtgcgantntantgtcgtggaacaggaaagatgtattgncaaaatgtgcaanaactgccaagtagatcggaacatgaagactccgg

SEQ ID NO: 83699 - DNA, 599 bp, Triticum aestivum
  unsure (1)..(599): unsure at all n locations
  Clone ID: PAT_TA_83699
ctgtgccgaagggtattgtctatggcaagcccaagcaccagggtatcacccagctcaagttccagaggaacaagagatctgttgctgaggaacgggctggacgaaagcttggtggactcagggttctcaactcctactgggtgaatgaggatagcacctacaagtactttgagatcatcctggttgatgtggcccacactgccatccgcaacgacccaagaatcaactggctatgcaatcctgtgcacaagcatcgtgagctccgtggtctcacctctgcaggcaagaagttccgtggcctgcgtggcaagggccacactcaccacannaacaggccgtcgaggagggcacctggaagcgcaaccagaccctgtccctccgccgctaacgtttgagcacacacatcttgaattcttgatgctctgctaccgtgggaaccgcccaagcagtccngatagattggnaatttggtgcnttgtaatttgctaccgtgtcnttcnnacccttaacntgntgcatgtccgtgagaattccnacaaatngggtcaatcatnaaanattgttgtgttaaaaanaaaanaaaaanaanncggggggcg

SEQ ID NO: 83700 - DNA, 290 bp, Triticum aestivum
  unsure (1)..(290): unsure at all n locations
  Clone ID: PAT_TA_83700
caanccantagcncaaaaccctatagctctcgcctgctcgcctccgccgccggagngagctcccnatcttcatccgtcaaccatggngacccanatcngcaagatnaagaagttcgtcagcnacggtgttttctacgccgagctcaangatatgctgacgcngganctggnggnggacngcnantctggcgtggaggtgcncgtcacgccgatgcncaaggtgatcatcatccgcncnacacgcacgcagancgtgctcggcnanaagggccgtaggatcanggagctca

SEQ ID NO: 83701 - DNA, 600 bp, Triticum aestivum
  unsure (1)..(600): unsure at all n locations
  Clone ID: PAT_TA_83701
ccgccgccagcgacctcgcagggtgcagtattcaatgtggttgattttggagccaagggtgacggagttacagacgatactaaggcttttgaaggagcgtgggctgctgcctgcaaaaagggggcatgtacagttctcgtaccaccagaactagagttcctagttgggccaatctcgttctctgggccttactgcaaatcgaatattgtctttcagctggaaggaacaatcctagctccaaccagtgctaaatcctggggttcaggcttgctccagtggctcgagttcaccaaactaaatggaatggttattcaanggaacggcattataaatggcagagggcaacaatggtggacctactcagacacagaagacgaggatgatgatgacacgtacgatgtggagtttgaaagaatgccacagattaaacctacagcattgaggtttatggaattcaagttgtatgggctggntcacatgtcaacagctcaaatgtcanctaagtttgcacgtcangatgatgtcatgactngacaaacctccctgagaaantccaaacnacggataactgaaaatcaagattagatcncaaaacctgct

SEQ ID NO: 83702 - DNA, 613 bp, Triticum aestivum
  unsure (1)..(613): unsure at all n locations
  Clone ID: PAT_TA_83702
caaaaaggagctaatctttgcggtagctggcatcctcctgctcttctttctactgttctgctgcgtcttcatcttctggaggaaagacaagaaggaaagctcgccccccaagaagggcgccaaggacgtgaccaccaagactgtcgggaagaccggcactggcgcaggcaaaggcaccgacaccggcggggacggcggcggcaagctggtgcacttcgacgggccgctctcgttcacggcggacgatctgctgtgcgcgaccgcggagatcctcgggaagagcacgtacgggacggtgtacaaggcaaccatggaggacggcagctacgtcgcggtgaagcggctccgggagaagatcccaagagcagaaggattcgagccggaggtgaacgcactcggcaactccggcacccaactctcgcgctcaaggcctattacttgggaccaaaggcgagaactctggtgttcgactantgccaaaggaacttgctcttctcaatctcgncacgganacaaccggtgactggcgctaggataaatcccatggtctgcccgggattnacactaaacgaccaaatgtgacggaaataaacacaatcnctgacagggnagg

SEQ ID NO: 83703 - DNA, 211 bp, Triticum aestivum
  unsure (1)..(211): unsure at all n locations
  Clone ID: PAT_TA_83703
gtttantttattttgggttgcttgcattagcaactttatacccanataangcgtttttttttcntaaatggntaaaccctgcanctgtataacaatatggncatttgtcaattcttttctctactgatatacanntcnttgctacgtgttccatnttntatatagaggtttatggattcagcatctcangtgctgcagaaaggntttgggc

SEQ ID NO: 83704 - DNA, 545 bp, Triticum aestivum
  unsure (1)..(545): unsure at all n locations
  Clone ID: PAT_TA_83704
ccatcccgacctacctatactaacaacgaccacccaaaatccacctccaaacgaagctctccatcgcaacccccaacgcacaactgtatttgcttcgcgcaatctcaccgatcacactctacgcggcgctgccagagcagctaataataattcatcatgttcagaaacaactacgataacgattccgttaccttctcgccccagggccgaatattccaagatcgaatacgctgctgaggcagtgaagcaaggttcagtcgttgtcggtatcgccagcaagacccatgctgttctatgtgctgtcaagcganacgcanaggaactctcatcctaccaagaagaagctgttcactgtcgacgaacatgctggtatcgncatcgccggtcttacttccgatgctcgcgtcctcncaatttcatgaaacangaagtgtctangacacgactcaactacggccgtgcattccctccgatccttggtnaatgatcggnataaggccanatgacatcaaatgtacggaagngacttatgggttggctgcaat

SEQ ID NO: 83705 - DNA, 662 bp, Triticum aestivum
  unsure (1)..(662): unsure at all n locations
  Clone ID: PAT_TA_83705
tttttttttaagcaaatgactctcaaaatgacaatttagagtgaattttgaaagacttccggagatgctcttatcaggtctgcactccaacgaattcactttgatactagcttatagggaggagcaaaagggcagtttaagtaatcgcttgaatgggcagatacgggatacaagtcaccaaagcatcttgttccagaatagacctggtttttatctccatctgttcttctccggtgttgtaacagggcccagtatccttcgtactgtacaatcaccatatcttgttcttgagccaaaacaacatcaatactaccccaatgacaatggcgacaggagcatacttccgaatcaacgcctgccggttgaggtccttagccttatctgcgtatattcttgtatcagaagtcaacctgcttgacatttcactgacctggtctagcttttcacaacacaagaacctcctgaacattgcgatcataatttgatgcacctcatagagtcaacatcagtttgcaggtcctttgagtcctgtatcaaatananttccnatctccgganaagtncaacttataaaacataggcttnagaattcaattggtgcatgaccccaaatcatttaanttcaggacggaagnattctcggaaaangcaaaaacaganna

SEQ ID NO: 83706 - DNA, 600 bp, Triticum aestivum
  unsure (1)..(600): unsure at all n locations
  Clone ID: PAT_TA_83706
cgacgtcgtcggcgctgacctggttcttctggctcctcgccgccaacccgcggtgcgagcggcgcgcccacgaggaggccgcgtcgtgctgcggtgacggcggcgacgtgaaggggatgcactacctgcacgccgcgatcaccgaggcgatgcggctgtacccgccggtgccgttcaacgggcgggtcgcggtgcgcgacgacgtgctgccgagcggcgcggctctgcgagccggttggtacgccaactactcggcgtacgcgatgggccggatggagaagctgtggggcaaggactgcttggagttcgtgccggagcggtggctaagcgaaggcggcgagttcgtgccggtcgacccgcgcggttcccggtgttcaacgctgggccgcgggtgtgcctccggaangagatgcgtacgtcanatgaagacgtcgccgcggcgtgctccggaggttaagttggacntggtggcgcccgtggtaacatggaggcccgcgntacanatacgnaacataaataaagaggcgttggtcgtctcaatcggaaacancctnnaacatgcatgggggtttccttactaatnctggaaacccaaataca

SEQ ID NO: 83707 - DNA, 452 bp, Triticum aestivum
  unsure (1)..(452): unsure at all n locations
  Clone ID: PAT_TA_83707
atggagtggtgtgcttctaaaggcaatatcccttattttgaaacttctgcaaaagaggactacaatgttgacaatgctttcctgactgttgccaagcttgctctagagcatgagcgcgatcaggacatttacttccagagtgttgcggatcctgtccctgagactgagcagagaagcngatgtgcatgctagtagttagtcatcatccttgtcccttccagatcttgcttattgattgcggcatactttttctgcgatgccgagcaggcattccttccatttttcccaatgtacactaatgttccaaccgtccaacactgttcttctatccagctgttatgatagtactgagcatggtttttttttttgtacncgtctactgattggtggcaaccaatcttgggtttgggcaataanaatacacgggttagactttannnaaaaaaaaaaaa

SEQ ID NO: 83708 - DNA, 537 bp, Triticum aestivum
  unsure (1)..(537): unsure at all n locations
  Clone ID: PAT_TA_83708
gcanggcaatctgggatgggcgctgatgcanaangagaactacacannggcggagggggcgtaccgtcgtgcgctgctcatcgggccggacaacaacaagatgtgcaatctgggcatctgcctcatgaagcagggccgcgtgctcaaggccaaggatgtgctcaagcaggtacgccccgcgggggtcgatggtctgcgcggtgccgactctcacctcaaggcctacgagcgancgcaagagatgctgcgggacctcgagaccaactcctcggccgctccgcgcgctgaccaactcgacacgaactggctctacgatgcgctgctgctgggatngtcctcnngcatctggcaccgcagcctgcatcgacatttgctgcaactccggtccgggatcatccccagccctggcccggcgccgcncgacactttncgattaaacgccgnccaacaagaactgnggntccaagcgaaatctaatgggncccaacctttatcncncggtgccncgcttcaagaactcaaaaagtgcnanaaaac

SEQ ID NO: 83709 - DNA, 533 bp, Triticum aestivum
  unsure (1)..(533): unsure at all n locations
  Clone ID: PAT_TA_83709
gttggaagaggattccttcaggccagttttgcaccactatgatggcccaaagtttcgcctcgagctctccatcgcggagaccctgtccctgctagacctatgcgagaaggaaggcatctgagctgttggctgcctcgtgaggttctaagtaaatatcaatcatccttgtatgttctgtagatggtggttgggcaatgttgtttatttttcaagcgcaagctgctgccggctccgttttccctgtcctgggatggaagcaaagggacctgggtactttgaaggcccccctcaaaacataantgtgagcctgtcaattcacgtttccgccgttgtcctcaaagaacaaaccaaaccatgaaccttgccccacngaattttggcctgtatgtttttgcaccccaaccacattcccatnnatgggtaacctggggccccaaaaaaggggcttttttaacaactgtaaggtaagggaattnccttaggcccaaaatggatgggatttgtgcactnaacgattgctagcttttangcgc

SEQ ID NO: 83710 - DNA, 228 bp, Triticum aestivum
  Clone ID: PAT_TA_83710
gagcaaacgagctgatttgtatgatctattgaatgagctcaactatgtttctatgtaacggaattaggtttgagaaatgaaagattgtatgtctcctaatttagttgctcatgtactttgttcttttaggaaaagttgctcctgtacttctggatgattcattagattcgggaactggtgtaacattttaggcccagacaatagacatccctctacaaaaaaaaaaaa

SEQ ID NO: 83711 - DNA, 638 bp, Triticum aestivum
  unsure (1)..(638): unsure at all n locations
  Clone ID: PAT_TA_83711
tttttttacagccataagaatgaagttaggaaaatagatggtcgagtacatagagctccaagggaagtaagaaaccaaacaatttacaaacctgtgttgttcttttttgagggggaaatggcaggtgctctgcctttgcatcatagattaggaatgtacaagaggaaaacacaatggagaaaagagagggaggaagcataagaaaaacgaagaagcatcaccccaggcgctgcctgtacatggatgttcagctaatgttccgctacattcaagccggatnaagctgcagttcactggataagaccaccaacaacaaagctggggcatgacccttgtttgtgtanctgtccttcaacaaagtatgcccctatatcctaaaggcttgctttaacaattatttaaccttggaccattttacacaaacttaagtttaaattgaagtattgtgcaacggtacatagatgttcaatttaccattcccactaactntccatttanatnggaaccaatgcatcncaaggtnccttcaactnactcaccatgcnngaaacttnacaagccaataactcccaanttacacatnggaggtaaaaatcaancaacgcacagttataggcccccanaacgtancaaanttt

SEQ ID NO: 83712 - DNA, 519 bp, Triticum aestivum
  unsure (1)..(519): unsure at all n locations
  Clone ID: PAT_TA_83712
gacagggtgttctaccagacgttcggcgccatgcccggggagcagctccgcaaggcctacgcctgctacctctccacctcctcggggcccgtcatcggcacgctctacctctccacggcgcgcctcgccttctgcagcgacagcccgctctgctaccagggccctgccggccagccgcacgagtgcatgtactacaaggtggtgcttcctctgagccaggtgacatccgtgaacccttcttccagcatgcgcaaccgggcagaaaggtacattcaaattaaggaccaatggataacaacaattctggttcatgggttcgtgaactangacaaggcctcaaagatctctacaagccctgcacaccgcaatttaangcccacaacgctgctgatctgattagnttgggttagtccgacatcctacggcacttattctccaagatgaacgtgatactttaccaancgaagttcttgatataganaacacgaaatcctgggtgtncctcctaaaaaaaaaaaa

SEQ ID NO: 83713 - DNA, 273 bp, Triticum aestivum
  unsure (1)..(273): unsure at all n locations
  Clone ID: PAT_TA_83713
ntttntttttttttgtagcgaacaccctgggtatcattccaatttatttcataaaagtgcacanccaattagtcantccaatactctatatgatacaatatacaaaacatctcnactgaattgaacatgtttacatganncactttggatccatatatttctgcaacatattacaacagtctaataatctactatccanggctgaaatcccacntctgcgtcaaaatttttgctcacaccactacatcttgaattggnacngnagaattttga

SEQ ID NO: 83714 - DNA, 440 bp, Triticum aestivum
  unsure (1)..(440): unsure at all n locations
  Clone ID: PAT_TA_83714
ccgcctttcgtcncagcccctaaaccattctccattcctctcatcagtttancacaatggcactggntaanaancttggtggtctgctcaagaaagccanaagttcaaatctgtctgtcnaccaagcaatcagattcatgtcatccaanctctttgttggagggatttcttatcaaactgangatcacantctcanggacgantttgccaaatatgggcaagtcattgaagntangattatcattgaccgtgaatctgggangtctagaggtttgngntttgtaacttacacntcttctgaggaggcttcagctgccattactgccttggatngaaagacctcgatggacggacatacgtgttaatcatgctaacgagaagacagtggctttcgttgcggaggtggtatggnggngcgtacggtngtggtggngtagntg

SEQ ID NO: 83715 - DNA, 524 bp, Triticum aestivum
  unsure (1)..(524): unsure at all n locations
  Clone ID: PAT_TA_83715
gctacatctccgggaacgtgtcggcggcgccgccgtcgtgctgcgcncagctgggcaaggtggtgcagtcggacccgcagtgcctgtgcgtggcgctcagcgcggacccngcgtcgctgggcctcaccgtcaaccgcacccgcgcgctgggcctccccgacgcatgcaaggtcacgacgcccgacgtcagcagctgcaagggcngcgccnccgccgcggggggagcgcctgtngcnacgcccgcggggcagactgcgccggccacggggtctaagacgacgcccgccacgtcgtccgtgcccggtgccgccgngtcgccnccgggctcggctgcncgtctcgtcgccggcttcntcgtcnccgcgggcgtcntcctggcntcgccgcgtgattngaagctagcttcggtacgtttgtgcgcgtaagaatcncanccgagtttgtgttgtntgttcanccntgggggtggncattttgatccttagtggcctntanacancgtnctatnatgattnatccattct

SEQ ID NO: 83716 - DNA, 393 bp, Triticum aestivum
  Clone ID: PAT_TA_83716
aagtcgctttggctgtgctctcttgtgacaagccccacgagatggtctcccagagctgaaggcctaccttgtttcattctgcttgaagtctgtcaaatattatgagaagatctaagaaagttttatcggtattggtggttcagcatggcgttatctgcttttggttctttgtgtaggtcaatgttgtcttaagatcatattttgtttgaattgctgactgtcgtgtttttttgctatctttgaacgtcttaaccgttccactaagagcatgtttggatgagttaggttttagttactaagttgagctaaggctatctccaaggacattttctatttcaaacttttctctgcaaacattgttaactgttaaacagtgttattaaaaaaaaaaaa

SEQ ID NO: 83717 - DNA, 464 bp, Triticum aestivum
  unsure (1)..(464): unsure at all n locations
  Clone ID: PAT_TA_83717
gccacctccaccacgtcggccatcacgaacgacgaccaaaccaagtgccggtgcctcatcgattggcggaagaaagccaaaggcttcagcaccacaatggcactgatgcagtggagagcggaaagcgcttcagtacagtggcccgcagagcatggtggatctgagggacgtcagtaccggccttcctttgtatggtgtgtactcccgttggcccgtgcagagcagctcccaagtgtagtctcagtacaacccccgttggcccgtcccttcctttgcagagcagcagtctagtgtatgtagtcgcgcgtatcatatcccaccgggtgcctaatttcgtcgtccacaaggaacttagaacattgtaaatactggaaataattgcagcttactctaaagtaatccaacccaagatttgtgaacaccagtnntcattancaatggaanccttgttatccaaaaaaaan

SEQ ID NO: 83718 - DNA, 482 bp, Triticum aestivum
  unsure (1)..(482): unsure at all n locations
  Clone ID: PAT_TA_83718
ctttgctanccagcatatacttacacgtagctagcttaataatcagcagctggtgcagcaagagtaacagctagcgacgacgaccatatggcggcgaagcagccagtcgtcgctgctgctgcctccggccaccagaatggggggaaggnagaagctgatcatccggccggagaaggtgcggttcatagacgtgctgtcgatgctgctcctgaggcgccccacancaagctacgcattcgtnngaggccggcgaccggaccgccgccgaccttgggcagcacgcccggcgactggctcntcgcgctcaagcaagtcatccaagaagcgctcgccggcgcctatacccggtctcgttgtccgcgccgtcgtccattcctcctcaacttcgtcgcgctcaacaatgggatactcggatcttctcaactcttcagattaactggtgttcactgaaccgggaggcccacttccgnccatatcggatt

SEQ ID NO: 83719 - DNA, 633 bp, Triticum aestivum
  unsure (1)..(633): unsure at all n locations
  Clone ID: PAT_TA_83719
cagatgggaatttgctaatgaggagtttctgagaggtcagaggcacctcctcaaaaacattaggcgtcggaaacctccacactcatctccaaatcaacaatctcttggctcttacctcgaggtaggacactttggatatgaagaagagattgatcagctgaagagggataaacagtcttgatggctgaggtagtgaagctgaggcaggagcaccaaaatactagttcagttctacaggccatggaagagaaattacaagatacccgagcaagaagcagcagcagatgatggcattccatggcacgcgtcatgcagaaccctgattcatgcgtcagctgtctcccagccggggagatgaggaaaggactcccaggatccatctccgaagnaagaaagcgccgcatttgaccaaggacatgaacttgtacatgggacggtccnaccnggacaanggccacaggattttngacncaagaccggnggacatccccacgttgcaccgtncggaantctctgnaggcaagatggantccacagtttctcangggtcnacactgaatgnagccagcggataatatattcggagactcggcaggggattggaatnggatctttgngtgaatantgctgccn

SEQ ID NO: 83720 - DNA, 625 bp, Triticum aestivum
  unsure (1)..(625): unsure at all n locations
  Clone ID: PAT_TA_83720
gttttttttttttttttttttttttttttcttcaaaatccaatcaaaaccacatgatttcatccacacatttgtctgcccgacacttatttactttattttttcctctaatgttcatggatcctgattcacaaggaccacagctcccattgctacctcgtcttctgtacatcagagctaacacatgtaagcttggcatgtcatgctgttcagtgttttacacagacctantaagctctctcaccatgggcggtgcacctgcnggatctatgctttggcantggttgttggtcnggcantggacatgctctccaggtacctctccanancatccanngccgcagagctccttgaacatgggatcgtcccgggnacgtccactcgaactgatggcagatttgcnggacaatgcagaccggagaatcctccgtggcggtctganggcctccccatgngaatgcacgaggaancanaaaagggagccccccgatgcttnggaaaagganccttcngcacgggcgcgttgntagcacgtnnacgcttggagggncacgggggnctgctcatggcacgggnngaacccagatttnggtccccttgtaaaaaccacctgggaagccccaggg

SEQ ID NO: 83721 - DNA, 519 bp, Triticum aestivum
  unsure (1)..(519): unsure at all n locations
  Clone ID: PAT_TA_83721
cacttgttcatcatcaaagtaaacgccgcagaaccctagcgaggcgttcctccaacgactcacctcccacccactcacccaccccatggcgaccaacccctccaacggcgccggcgccgacgtccctgcagccccggcggcggtgcggctctcggttgcggcgcaaggcggccgcgatncagcctcttccccgcgcttcttcttctcctccgcttgccggggaccaacccggctccccgcaccgtcgcacgccacgccgtttgatttctccgacgatccgccttnngcatcaaatngggcctgcnaaatactccggcccgggggacncgttctgctgtccaactncgcccactttcgtcctccnaaangngccgacngggtccaccccgnctccgtttgcttacnaagacacgctgcccaagnccgcgccncgcccaaggngncctccgaggaagactgagaaaaacggaggngatanagcttaactcaaaaagggaagctccgaacgtggcnagcaat

SEQ ID NO: 83722 - DNA, 544 bp, Triticum aestivum
  unsure (1)..(544): unsure at all n locations
  Clone ID: PAT_TA_83722
tctactcgctgctacaacagagtttgcctgttgccttgcttccacctcccggctgcagctgcacctgctgctcgatcggatcggccgcgcgcggcatgtcgaccaccacccccaccaacgccgcctcccagcagggcgacgacgctgcggctggccgcgcggacaagaagccggcgcaagagacggtgacgaaagacggtgcaagacggtggaggtgcggcctccggcagggcacccgacgagganggcgtctccaanccctttaaggtggtgcacgaattccccgcccaagacantccggcgtccaagcangactaagactactaactgcctactccattcattatctactagattcatctgctgctgctaactgattgattttatgctgctgcggtcaaatctaacctcatttcaacccccnacantttctaactatattgcaaataacatttgctttgttccnaagtgattaatatttgtncggctgccctcatttgtnacatgtccaataaaccctgattgtgtcnacaaaaaaaaaaaa

SEQ ID NO: 83723 - DNA, 600 bp, Triticum aestivum
  unsure (1)..(600): unsure at all n locations
  Clone ID: PAT_TA_83723
cttcggctccggttgtcggttggcccccggtcagatccttcaggagaaaccttgctcatcatcatcatggaagctcctccaaacaacccaccgagccacagaacagcgaagctagcaggaaggagaagcctgcctgcaagaagaaccctctcgtaaaaatcaacatggacgggatccccatcggaaggaaagtagaccttgcagcctacgacagctacgaagaggctatcactggggcgtcaaaganttttccacggtttcttcnaagctcaaaaaggtattctccaactgctgggaaaatattctctcaatgttgggtggtntgggcgatatacctggtcctacgaaagacaacgaaggaacagatgctggtaaggactnccctggnattantcctcttcatttacgccaaccnacctacaacaaaaattctccnaaacnacctcaaatacgctaacactaactngaagaatgaatatatacagctacttgttgacancngaactcctttggagtgtcccgcatgtgttgtgcaacggnaaagnnaaggttgaggancggactncaaggttgtaggaaaggcacnaattgggacncaaa

SEQ ID NO: 83724 - DNA, 608 bp, Triticum aestivum
  unsure (1)..(608): unsure at all n locations
  Clone ID: PAT_TA_83724
tctcgtgccactttctcagtcccctctagccgccgcctaccgctcgcgctctcctcgcgttcgggaaggtcgtttcgccatggcctcggagacggagacgttcgccttccaggcggagatcaaccagctgctctcgctcatcatcaacaccttctactccaacaaggagatcttcctcaagggagtcatctccaactcctccgatgccttgggacaaattcaggtttggagagtttggacggacaagaccaagctgggatgcacanccagagtgttcatccacattgtcccccgacaaggccaacaacacgctgacaacatcggacagggattggtatgaccaattcaaccttggtgaacaaccttgggtacatttccccgtcaagcacgaaggattccatggagacttnctgctggtgctgagtgtcccatgattngcatttgggngtcgtttcnatccncctacttgtttcaaaaggttgtcctgacaactaacacatgagatacatctnnggatccaagcggnggcctaangtccactgatactcggggacactggaagggtaaaaatacctcaccaggtgatattggtacttagacccncccag

SEQ ID NO: 83725 - DNA, 628 bp, Triticum aestivum
  unsure (1)..(628): unsure at all n locations
  Clone ID: PAT_TA_83725
tcgaattcgtgaagctggcagagctgtactacgccggcagccacggcatggacatcaagggccccgccaaagggtcccggcacaccaaggccaaaggaggcggcgttctctttcagccggccagccagttcctgcccatgatagagcaggtgcacgattctctggtggaaaagaccaagtgcatacctggagccaaggtggagaacaacaagttctgtgtgtctgtccacttcaagatgcgtcgatgagaagagctgggtcacgttggcggatatggtgaatccggtgctcaaaggactacccgaactgaactgacgcagggcangatggtgttctangccccccaccatcaaatgggacaaggnaagccctggattctcctcaatcctcngggtaccccnactgcaccgactnctgccgtgtaatcggngacgaccgcacnncnagacccttcaagtgtccccaacccggcaggcgtggcacctcgtntcaacacccaaggaactcgctcctancgcncaagacccctagnataaccngttccgtctaaaccgcgcncaccntgnctctaaancnaatctctctggnctntcaggnatgattcncgcgntttcatggcccccaagcc

SEQ ID NO: 83726 - DNA, 467 bp, Triticum aestivum
  unsure (1)..(467): unsure at all n locations
  Clone ID: PAT_TA_83726
accagtgcccacctcgcgcgacctctccctccagccggngcgcccggccagacacaccgccgcttcttcttcttcccttcttcctcgcttctctgaatccctgtctgctgctccttctcccccacgctacttctgctgctcgtctacaactctccctgctgctatccttctccaagctcgcctcctctctgaatccctattgctgctgctcttctattttcccctaccacgctgttttctgctccttctncatntccaaatccaatcatgctgctatcnatcttcctttgcccactgtccttctccctcctctcactcccntggtangcttctctctctcaactccaggcgtgccttctntctctctctntctntctctctcctgaattcggtagtaatgganaatgtttaagacttgtaaatttaaatttgaaataatgtnaacgcgttggcctattagtactggt

SEQ ID NO: 83727 - DNA, 588 bp, Triticum aestivum
  unsure (1)..(588): unsure at all n locations
  Clone ID: PAT_TA_83727
catcagcctgcctgtccactgttggcttggtgacttcctccgctccgctccgctcccctccgctcccgaacggtcgatctttgcatggcagcagcagctggctccaaggggcgggcgatcgctggaagcttcgtcagccgcgtcctcgccggcaaggccgcctcgccgagganggccgtgcacgcctcggcgtacgacaagaacctgggaggacnagtgcgcccgggcttccntgccggacatttatttggnagcgccgggancccgacaattactggacccccaccccaaaaccggctcttcnggcccggcggcgtggaccccaagctggccctggtggcccccccggaccccggcgcgganctgcaaggagcacggtctggacaaaagtgtgntccncccctccangacttnaaaaccccccnncnctttaccnccggttnttangaaccnaatgntctcctcaanaaaggnggggaaactgnatgaaagntctctntctggcgggcggccctgctaaacacgaattancacaaaggggtttaaaatttggttaaaacataaaaggtcanaaaaaattaagaggtt

SEQ ID NO: 83728 - DNA, 609 bp, Triticum aestivum
  unsure (1)..(609): unsure at all n locations
  Clone ID: PAT_TA_83728
gcctgatccgcttgctcttcaccctcgccgcggccatcggcgcggcctcgctcctcgtcgcctcactccgccgccgcgcgccgcctcccgggcttcccgccaagctcgtcccctcctcccacatggcaggacgcaaccggagtttccgtgctgtggctgcacggcctcggcgactcaaggccctgccaacgagcccatccgcaactcttctccgccccggantccggtcgccaagtggccttccctccgtccccgcgccccgtacatgcaacaaggtttgtcatccncctggtcnatatcnacantttccnanagcgcggttctccgcaagatgaacggggttccnaagcgtncnaaaagtgcacncatgataacaaggaattaccnatgaaccaacccnaaaaattgtttgngggtcattcaaggggtnncnaaaatactaanttttccttaaccaaaaattagggaggaaattaantggggggcttaattaanatccgnnaggttaactaaacaagaaacnttttggcaaatgaaggtgnaatantgttaactgcagtggcacttttnaancnggtangtattagaaacaattggatcnttcaaana

SEQ ID NO: 83729 - DNA, 583 bp, Triticum aestivum
  unsure (1)..(583): unsure at all n locations
  Clone ID: PAT_TA_83729
atgagctagttgacaagaaaggtgggccggaagatatgtatgagtttgctggtgaagctaacattgttatagcatgcatgaccttaaccagcgagacagttaatgcttctcttggtgtacttagttataaatattccttcaagatggcctctacttgaccttgattaggacgtgaccatcttttacagattggaattgtggatcataagtttgtttcatcaatgaaaaaggtacatgcttgtttctgtcatactgggtctccatgttatcagatctgtgggctcatttcgctgactccatccttttggttttagtgttgtgcataaataatagagaaggaatgatccatgatcatggtatcagttgagaacatttttactagaaaacattttcctgggagaataatgttattgggttnactngaattgcctcaatcctaataggggcataccnggcaaaatgcncgggaaccctgccggannaaaggcgtgttgntaccgggaaccggcatcaacgggccggattangtgctggtgggcattgnccgagaccgtcgaatccaaantatcaacccagtgcnggt

SEQ ID NO: 83730 - DNA, 304 bp, Triticum aestivum
  unsure (1)..(304): unsure at all n locations
  Clone ID: PAT_TA_83730
ctatacagactggtgtcgctggagatgccatgttagtgttatctgtttctcacttttttagttagtaggtaagggtgaaggttgtatctatattcattacatgtgcacattccctaccgtctgaatgggagcgcccgtcccagtcctgtacagaaatgtcaactcacagcagattgtgcacattccttttgtactcccatggggcgggtgctggcctgggaacatgcagtgtgttgcaccactgtcactgaattgggacagttaagggtttgggatacaccgttgcatgttnaaaaaaaaaaaa

SEQ ID NO: 83731 - DNA, 351 bp, Triticum aestivum
  unsure (1)..(351): unsure at all n locations
  Clone ID: PAT_TA_83731
atgatccactaccaccccgaggtcctcacgagaatcagcatgtgagtatgtgatgtgaccagacaggcagcaatgaaacatgtggacagaggtctgctgcgccaggatcatcacatgttcgcccttcttacgagcttaactgcgattacggcaccgagtccgaggtatcactacatgtatccggaaccgtcaggcggctcttgtgtaaatatgcgctggaataaatgtgtgggcatctcctgttttttggttgtacatgggccttgctgtgtacgatccgtgaagtggacctggtactaaactgttatttcagaccctatccgttgtatggatcctgaagccttgancccc

SEQ ID NO: 83732 - DNA, 633 bp, Triticum aestivum
  unsure (1)..(633): unsure at all n locations
  Clone ID: PAT_TA_83732
ccctatcgctgttgcgacaagcttcgcgatggcttcgcttggatacagcttgctgggcgagcttaccaatggcgagcttgctgctctgagccgaagccaggatacttgggcagaggtttcgcttcttgccggatggagagtgattgaattgacattggggatggtatggcaagttgacagctgggatgctgcgatgctgaacttctccgcccatggcctcactactacctcctctcaaccttttaatgaactcaaactgggactattccggttccgtccttgctattgatatcctctcnatccgctgtcctttccttccctggcttcgcccggntctcctactaccaaacaccttncngtgcccgctgctgcagncctnccnaaccgcanttctcgattttcctctccaanactncacggcgtcctacnaangcaccacacgttcctctcctnccttcatcatctgctcctatccnggtttcactancangatgcaaattgacccgctanatgcnnaatgcgcatcnccctgagaccttcggancgcgcaaanttcacttgnccttccacacgaatncaaaggcanagtacanttgtnctgtgaacccccgaacttcgngaatttggtancgn

SEQ ID NO: 83733 - DNA, 541 bp, Triticum aestivum
  unsure (1)..(541): unsure at all n locations
  Clone ID: PAT_TA_83733
cttcgagctcgaggagaccgaggatgagaagaaggcccgtgaggctgaggagaaggagtacgagagcctcgccaaggccctcaagaacgttctcggcgacaaggtcgagaaggttgtcgtctctcacaagctcggcacctctccttgcgctatccgaactggccagttcggttggtccgctaacatggagcgtatcatgaaggctcaggctctccgtgacacatccatgtccagctacatgtcttccaagaagaccttcgagatctcccccaagtctcctatcgtccaaggagctcaagaagaagttgagactgacggggagaacgaccgtactgtcaatctatcgtccaacttctcttcgagactctctccttgtctctggcttcacattgacgaacccgctggttccgcccgacgcatcacaagctngtcagctcgggctcaaatngaggaggatgntctcccctgctgaggtnatgcacagggatnccncnccgccgcaanggtgaaacccangangaggtgctaatgncnccnggta

SEQ ID NO: 83734 - DNA, 622 bp, Triticum aestivum
  unsure (1)..(622): unsure at all n locations
  Clone ID: PAT_TA_83734
caagaacggcgccgcgttgtacaggcgagggggagacaccgcgggcgaggagatcgacggcgaggggtccaacctccctggtggcggttgcaacgacggggagttctggatcgacnttcccagcggcgaacggggccgcnccgtgtgccgcggcagcatcgacagcgcggaactctacgcncacgtgaagccggccatgggcggcacgtgcaccgacgtggccatgtgggtgttctgcccgttcaacggcccgggcgaggctcaagctgggcccgatnancctcccgcctgggcaagaccgggcggacttcngggactggggagcactcannttccgcctnaagaactcaacggngactcatggcgttntctatccncaacacancggcgggactggttggacnctccgcattggntaacccncgnaaccggctgttgntaccctccaagnacggaacccaactaccctacctggcgttactcagggtccgtggcctcngggtcggatccgaacagccnctcgacaactatctngatccnccaagtaccaccttgcgcgggtantggcaaggncctctgacccatggtgantaatngnatggtccncngngtaattgagaac

SEQ ID NO: 83735 - DNA, 411 bp, Triticum aestivum
  unsure (1)..(411): unsure at all n locations
  Clone ID: PAT_TA_83735
atgctgaagggggttacacctgagctttcttgccccattgttcttttcacatactataatccaattctgaaacgtggtgtgggaaacttcatgtctactatcaaacaagctggcatacatggacttgtagtgcctgatcttcctttggaggagacagcgttgctgaggagcgaggccatttatgcacaacatagagctgggtgctgcttacaacgccaacacgcccgacagttcggatgaaagggaattgcacaantttcagaagnttcctcctaccttgtgacgctgttagggttacaggtgcacgctccaaatgtaacttacgtggtaaaacaccttccttnaggagattnnaagaagnttacaaacaaacccgtactgntggttcccgtgttaccgaccccaaacatt

SEQ ID NO: 83736 - DNA, 617 bp, Triticum aestivum
  unsure (1)..(617): unsure at all n locations
  Clone ID: PAT_TA_83736
ggcgttcctgtccaactaccacaccagcgccgcggcgcgggtggtgttcaacgggcggcgctacgacctcccggcctggtccatcagcgtgctgcccgactgcaaggccgccgtgttcaacacggcgacggtgagcgagccgtcggcgccggcgcggatgagccccgcgggcggcttctccgtggcagtccgtacagcgaggccaccaatccctggacggccgcgccttcaccaaaggacggctggtggnacacttcaacataactttggacaantccgactacctngggacaccacctnagttgacatcaatcccaacanatttctttaattcccgggaatttgcccanttacatctatcctgcngcatcccccngaagtttnctnnaagcatttctaaggccttttnttggggtananaccccaactnacnanacggtacttaaatttgcaangggananaattccaccttaaccaacattgctcctnacaaggaccactacaacttgaactcngatgccgtccgtnaccntcggcnnacnagggaacggactacacaaaatgccacaattgctcaggaatcctgnttaatcttccgaaccnctcatggaannga

SEQ ID NO: 83737 - DNA, 360 bp, Triticum aestivum
  unsure (1)..(360): unsure at all n locations
  Clone ID: PAT_TA_83737
ggcgagagctcgggggcacgtagctgtcgtcgcttgtctacggagtctcgtagagctcatgagagccactggacgcccaagagtcgctgctgctggaggagccgcaggccgggcgcgcatcgtcctggcgcaccccttcagggcagcactccaggcgacggccctccgcatcgaagaccttgaagaacagcgtggaggcgccgtcctagtcgaagtggatggcgagggcgccctcancacggcaaaccgcgcgacctcaccgcagccgcgggtcatgaagatcttgccggaggagaccacttcaactctgtccggncgccggggcatttatcagcatgctgcaanantcccaaggggggg

SEQ ID NO: 83738 - DNA, 643 bp, Triticum aestivum
  unsure (1)..(643): unsure at all n locations
  Clone ID: PAT_TA_83738
gttcaacctcgcgaatacacataaacaaacacaaaacaacatgtcagctcaagattactacagtggtggtggaggtggctacggccagcagcaacagcaaggtggtggttacggacaacaacaaggttatggccaacaacaacagggctatcctcagcagcaacaatactctcaaggatccaactacggctccaaccagcccagctacgacaaccgcgatcaatcgtacggccaacaccagggtggacaatacggcagcgggcctgggtcaataccccgacggtgcaggtggtcccggcggtccgggtggccgggaggccggacggggagcgtggactgggtgctacactttcaggaggcggtgcanccggctgggccgcgcacacagtggtacggcttctcngcatctaaccaatgccgctgctgggtccattggcgcaaattcctccgacacatnaaagaacacaagaagngaagacaagaacacaccgcgacggcgcctcnacatcaacgggancgatacaacattanccancnggggatancaactcacaaagncatgattggccacggaatcaattaaanctccnaacggntgaggngttcatgaggcaacnaacgggagcgttggggccaatngcnt

SEQ ID NO: 83739 - DNA, 666 bp, Triticum aestivum
  unsure (1)..(666): unsure at all n locations
  Clone ID: PAT_TA_83739
aaaatgaaaatccagagcttatctcatttacatcctctacgcctgccaatggagttcttgaacaatgcatccattctgatgttccagaggcagttcctattatgacatgtgaggatcttgagcagacgatgttagcacaggttagcaatagcagctcaactcagataaatgctacaaaggagcaactgactgttatggatgaaccagttgccatgcagaaagtaactgtagataatcatgcatcacaacatcttctttcattgttgcaaaaaggaacagataataagggagcaccttccctgggnttccaagagagaacaactggatgaacctcctgagtgttngacacaaatttaatgggcaaatggtggnatacctggaagtgatccggttnacagtgtttgaaaatntccctacttccngggaaagactttgacattgggagcttatcccgggctgcattttatgaatgactccancccaaaatcaccatttccatccaagaccacactggtggcctacngatttgcanaatngntaaacccgtttcaccaaccatgaaggtacacctgtngacanacgtnactnaacatacaaagngcgctgtcctaaaaacagtatgacatcacatacngncaatcaggatgcantttgaaaaggatgaat

SEQ ID NO: 83740 - DNA, 622 bp, Triticum aestivum
  unsure (1)..(622): unsure at all n locations
  Clone ID: PAT_TA_83740
caccggccaccagctctataaattggtgcaactattggctgcccccatcatatcgatcagctcttgcaaccttatctccattgcattgcattgcattagtagagggagatccatggccagagaaatggagaaggcaaagaaggccgcatcttcccctaagagctcaacaattagtactgggtcccaagagcccggtgatggaatggaggaggatcgtctccccctcataagaaaaacactactactaccgaggcacctnngacggaaacatgagcagcaaaacttcnaaaaggaggaacacttttctcaatgacgacanaaaccacgccttcctccacnaactggcngcacaacctcancccaagaatttaccggagacacgaacaacccctggacttacaacagtcccacactgaaggagagacaattaggcnacctggtacattaccagttaccttaccgccgtccnatctcnaccatttaaaccaaagatngcnactactgnnnaaggccgggggctncngctaataatccagntngaagcaagataatnccaggaatnttccantttaaaaaactncaattatggggacccaaataactataaggagggttgttcngg

SEQ ID NO: 83741 - DNA, 221 bp, Triticum aestivum
  unsure (1)..(221): unsure at all n locations
  Clone ID: PAT_TA_83741
cctatccnccatatctcacgatccactcnagcaccaagccgaggganngtnaggagcgatggcncncggcgtggagtcggngantggcngtgcggtctcgggcancaanancgggtcggtttccttcacgatcnactgcaccangccantngtggacaagatcatnggggtcgccncgctcnagaantcctgcacgntcgcatcaaggtcgccgagcggca

SEQ ID NO: 83742 - DNA, 462 bp, Triticum aestivum
  unsure (1)..(462): unsure at all n locations
  Clone ID: PAT_TA_83742
cgggtttccagggaaacccacccccagatccaaatccagcgaagcgacagagatcaaggatggagctggaggtgggtgcgccttcgccggcgaggtacctggtgggggcagcgatcatgatggccggcgtggtgctcccgctggcgtacatgatcttccgcagcaagcgttcgccgtcctccgcctccgccgcggggccctcctccttctccaagcagacgttaggaacaaagggctcatctgattctggagcgagtgggtgaatcgattcgtcttcccctggatgcttgtcattctgtctgttttgggaccgccgaattctcccaactgcttctccgagactgggatcatcacttcaaatactactgattatatcantccttttggaccttgggtaattcaatncattgcttgtttggccatttgatacattataacagggttacttttgattcactaann

SEQ ID NO: 83743 - DNA, 418 bp, Triticum aestivum
  unsure (1)..(418): unsure at all n locations
  Clone ID: PAT_TA_83743
cttgttgatgtttagccatcatgcggaggctgtggagagtcgcctgggcacgtgaagtcttgccatggtgtcggcttgaaggaaggacatctgtgctactgctattgctcatcggaggaactccttcgccgtgaagctactgcatgctagggataatgcgtgcctgtgagtctaattgctgcgcgagattacaatcacctgaagatcatcctgggtacctgggaatctcaancccaggtcaacaacaggtaccgccaggatgaggcgcatggaggatgctgtggcgattccgttgagagtcctaagccgtcctctcccagtcaactttgggtttctggccattgtctccttataatgttattatttactaattttgtataaacccctgttaagtngtnaagatttacatccattccaa

SEQ ID NO: 83744 - DNA, 556 bp, Triticum aestivum
  unsure (1)..(556): unsure at all n locations
  Clone ID: PAT_TA_83744
gcgacgccggcccgggcgtggcgcggtcgctgctggtgctggaggtggtggccttctcgtccttcctcttctccagcctggtggcgcagggcctgaagctggcgctcaacctcatcaactccaaggacccgcacgacgcggcgcgcgcccacatcgacgcccgcgtgctccgcctcggcatgctcgcctccgccgtcggatccgtcgtcggctgcgtcttcctcatgacgtccatggtcatggtcgtgcaggtccgcctcggcacgctgagctgccccaccgaccgcgccgccgccaaggccgccgcgggcctcntcggcctcgtcaccaccgcgctcgccttctacgtgggcacgtcttctaaacttcaccatgatccattccagctccgtncgctgatccaaacaactacgttgcttgcttgcaaaggcaatncatcatggttccgtttcaagaaattgaaagagactgcatccggnttataattgatcgatcccgtccttttgtcgtacnaantnaaaanttggtatnatttaaattaatntnctaatnattn

SEQ ID NO: 83745 - DNA, 608 bp, Triticum aestivum
  unsure (1)..(608): unsure at all n locations
  Clone ID: PAT_TA_83745
cgtccccaaacaagcaaccaccgcctccccgatctcgtcgagaggaagcccaatcccgaaaccgccgccctattccaatggcgcccaaggccgagaagaagcccgccgccaagaagcctgcggaggaggagccggcggcggagaaggccacggcggggaagaagcccaaggccgagaagcggctccccgcgggcaagtccgcaggcaaggagtggaagaagnnaaagggggaaagaagaaggcaaagaatcggtggagacgtacaagatctacatcttcaaggtgctgaagcangtgcacccgggacattggcatctccgtccaaggcattccatcatgaatcccttcatcaacgacatcttccagaagctggcngcggaagcggcaactggcgccgtacaacaaagaacctacatttacttccgcgaattcaaactccttcgcttctccttcccggggantcgcnaacangctntccnanggacaaaacctcacnatttacnactcctagngacgatcnactgatctccctcttcantataaatntatacgtaggtttccccgtggaattcccgcttntngggccgtgatcttttttaaatagnttt

SEQ ID NO: 83746 - DNA, 639 bp, Triticum aestivum
  unsure (1)..(639): unsure at all n locations
  Clone ID: PAT_TA_83746
tttgattggcaatgcagtatctgttcttattcagggtaggaaaaatgtaatattaagcagtggtctctcttttttacaacatccaataatctgcagaaagagaacatgggattatgtatacttttctctcgattattaacagaagggtgcactatttcctcagaaaagaagcaaagaattcttgttgggcaacaatatgagagaggaaacgttatcccatgggttgtcaaactcaatatgtcacaataaatgaaggtctgattgaaggtaccactcaatttgaactgctggatagaaantaggtaccatgatcccgaataccctttcnggatgtccacatgaaccaatggncagattanggagaacgtgaatgacacttccctacatcaagcttggncctctccccgctaagctttaacctttggaacncancanggaccaccattacntctccgcctgcacaatgcaactccnaaccctaaggggtgttccaacacngacaatacccttccctataagacaaacagtcnatggaactgaaatgaaacccagtcnaagtcgtgnctctcaantacgccgtcatcgaaaaaatcaaatcaggggacantggcaaaccattctatgatgaaaaganncccc

SEQ ID NO: 83747 - DNA, 329 bp, Triticum aestivum
  unsure (1)..(329): unsure at all n locations
  Clone ID: PAT_TA_83747
cacagactctttctctctcctcccctctctcgtcctttctctctcgtccgatctgcatctgcttttctccccccttgtctgtctccctcctgtccgtggcgtgcgcaaagatttgatttttttttctcggggaggagccggagtccgagcagcagtggctggctggagggaaggagatcctgatntgttganccttggggagaaggngaatgancggangangaagatggntgcgcaggngcatgagcaggagaagcancacgcgatcgacnagcacnaagagctccgctgccctgcaacagcnagcgctcctcaactnantngcaaaa

SEQ ID NO: 83748 - DNA, 247 bp, Triticum aestivum
  Clone ID: PAT_TA_83748
cggcagtggagcgacgttgctacgaggggccatgtggatgcgcaatggtcctcatgtgctggcgagtatgttgttctctggtggtgctagtcgtcgatcggctgttgtcgtcctagccgttatagcctgcgtcatgtttgtgtaatccgaccgggctgtgttgggccattggtattgttctccccttttgtaatctccgttctgctttgtgtaatcctacggcccattttgagccaaaaaaaaaaaa

SEQ ID NO: 83749 - DNA, 566 bp, Triticum aestivum
  unsure (1)..(566): unsure at all n locations
  Clone ID: PAT_TA_83749
cttccctcggggatgctcaaggtgttcctggggttcctgctgctggccgtggggctgtccgccgtcggcatgtacatggcgcggcacgcggtggcggcggccgcgcccgcgctattccgcccgtgcctgagcggctcctccgcgggaggaggaacccgnagggggctggagcggtggacgcggcccccagcgcgcgtagagcacgcgatgacggatcaggagctgctctggcgcgcgtcgttccgcgccgcgggtgcgccggataccgttccgcgccttcccaaagtggcttcattttctcacgccgagcccgttgccgctcncgccgctcctgggagcaattctttcnttgggcacgaagggcgctatccatctaactgcacccttccatcctancatccaantnacctcctgatccgtcttctatcggngccaattcccaattaggttcaaaatgggtcaaatacantttgatgctganaaccctacttccaacctttgctggaatnccaacaatggttgtctttgtctatcntgatcccaanatngnttaacaaanaaangat

SEQ ID NO: 83750 - DNA, 547 bp, Triticum aestivum
  unsure (1)..(547): unsure at all n locations
  Clone ID: PAT_TA_83750
tccgagtgtctcctcctccgccgccgccgccgccgcttccgtcgtctccgcccgccgaggccatgccgtcccacaagaccttccggatcaagaagaagctggccaagaagatgcgccagaaccgccccatcccctactggatccgcatgcgcaccgacaacaccatcaggtacaacgccaagcgcaggcactggcgtccgcaccaaactccggttctgagcggtggaagaaatgctgggctaatgacgttggggggtatagggtctgcaaggctaggaactcctgtttaaattttttgcttgtgttatttgtcattgtagtaccatgttttgtcctgatggttaaagaaccnctttatgctanggtgatttatttnaccttgcaacgccttatcatttatttcctacccanaanaaaaaaaaactnccaggggggggcccngtaccattcncctaaaggancctattaccncnccaatggcnccttttanaactccttacgggaaacctgggttaccaactnacncttgaanaacccctttgcaagg

SEQ ID NO: 83751 - DNA, 263 bp, Triticum aestivum
  unsure (1)..(263): unsure at all n locations
  Clone ID: PAT_TA_83751
cgacgctcaccggcgcctgtggtccctggaccgtcgcgagtggcgcggctgctcttccggcgcgtcctgctcgcgctcgcgccgggaggacgaggacggccgccgcttgaagtgctgctcctcgtcctcgctctcctctccgtccgtgccgccgtagtagtcgccaccggaggcagcgggcctaggcttctcctcctcggcggccgcgggctcacggtggtggcggttggccgcggccgtccccgccctctgccgcntcttgg

SEQ ID NO: 83752 - DNA, 506 bp, Triticum aestivum
  unsure (1)..(506): unsure at all n locations
  Clone ID: PAT_TA_83752
cagccgttctcgccgtgcaactagctcgtcttgttggcctaaaggttgctttggtcgttgataacgcgaagcatggagttcgaatttccgagaatcccgttcttcgaccagatcttctggttgacagccatgatcccgagcgagctgttgccgttctccgcgccaacactagaggaaaacttcgcttcggcatcgacacaagaggcaaagacacagctgaagttttgctcccgcgctctcgggcctgcagaccttcatcgaaacgcggcgagtgtcacttcacctcctaacactccgcctgctgacctatagtgcccgctcatcttgtcggtatgagtggatccccanaacgggacatcaacnggcgtcacntcgatactncccttcaagctgtacacgaataccanaggtgggcgaagtgcaacnanaggtggagaggtatgtcaaccgtgncntgtacccccaaaaataacgatttgaggaggctcaaaactgaacaagggcgg

SEQ ID NO: 83753 - DNA, 384 bp, Triticum aestivum
  unsure (1)..(384): unsure at all n locations
  Clone ID: PAT_TA_83753
ngtccgacaagatgcanatcttcntgaanacnctgacagggaanaccatcaccctcnaggtcnanagcancgacaccatcnacaatgtcaangccaanatccagnacaaggaanggatcccgccggaccacgcagcggntgatctttgccgggaagcagctggtggatggtcgcacccttgcggactataacatctgaaaaggagtctacgcttcacctcctgcttatgctccgcggtggcatcattgaccctccctgcatgcgctcnctcgcactttacaaccaggacaanatgatttgccccanatgctatgcacgantgcaccctanggctgtcaactgccgnaagaaaatnttggccacagcaaccancttannggccaa

SEQ ID NO: 83754 - DNA, 564 bp, Triticum aestivum
  unsure (1)..(564): unsure at all n locations
  Clone ID: PAT_TA_83754
nanagttccgcctctcggaacctcantcnttcctctcccagtccccancttcaccnangcatacggcataccanaccggcancggcagcgagcagtcgggagccatggctccgccgctcctgctcttcttcctcctcctccccctcctcacggncctcgctgacggacacnagcacctgtcctcctacggctcctccgcgctctccgattggcgccccgccaangcatcctactacgccgccgaccccgaagacgncatcngtggggcgtgcgggttcggggatctggggaaacacggntacnggatggcgacggtgngggctgagcacngcgctgtttgagcgcngcgcggagtgctgcggatgctacnngtcaagtgngtnaagactcanatatgctctccgggnactccancgtcgtcacgcaaccaacttcggcgcccanactacgnntncgccgacncngggggcantgnaaccccccaacacaattctctcnnatcaatctttgaaaaatncgcccggnangcggatatgcnatcatacgcgtntagtctcgcnaagt

SEQ ID NO: 83755 - DNA, 579 bp, Triticum aestivum
  unsure (1)..(579): unsure at all n locations
  Clone ID: PAT_TA_83755
aactccgagaagaactcaagatttctatatctgaaaatgtgataccagcttaccgtgcctttactggaaggtatggcagtctagttgatagtggaaggaactctggaaaatacataaagtacactccagaggatttggagaatcacctgtctgatctatttgaagggtcactagggtctgccaaccattccaaggagaagatgacgattctcatggatggagatttgggctacaggtatgcttttgggtacgagggacaccatatccatccaaacagtattagtgaatgttgtttgaactgcccatatccccaatgttatttcaagaatacacccctttgttttgccaatccaatatatgtgttatactaantgatgtacatntccttttttccccaataaatccctanatttgcctttgaaaaaaaaanaacacncccnaggggggggccccgtaccaattcccccaaatgagccctattaccncctcacngcgtcttttaaactccnnacngggaacctggggttcccacttacnccttgcagaaccccctttccaacgggttatacnaaaagcncc

SEQ ID NO: 83756 - DNA, 400 bp, Triticum aestivum
  Clone ID: PAT_TA_83756
atctggcgcacctggtggcggccaagtggccgggcgccgggaccggcggcagcggcgacccgctggaggactactgcaagaccgaccccaacgccgtggagtgcaaggtgttcgacgagtgaagtgagagctcggaggttgctgctggcttgaccggtcgaggctgatcagaaaacgcaacgaagcaactacattattatcctctatctatagtctataaaatgtaccagctgggattgtgtttcattccgtttccgagattgctcgccaacttgcggcttgggtgctcctatatatcaagacaggattccgggcacaataaatgaccctccttccgtgattgtactgaactcccatatatccaatgtgtccagctttcccctttgggaaaaaaaaaaaa

SEQ ID NO: 83757 - DNA, 291 bp, Triticum aestivum
  unsure (1)..(291): unsure at all n locations
  Clone ID: PAT_TA_83757
ctccggcgaggcaagttgttagaggcgacgtgccagatggccgggctcttcggtcagcgatcgcgattcgcgagctgccagtagacggagaaaggatctgttgatctccacgacaccgaaagacgaacgaacgaacgaactgatggncnaagggnaggganggggggaagccgtccacattattgcttgtatttttttttccactcttttgtttattgttgagaataataatgaatcangtgggggatgtaaactctgtgggttgttgttggtgtgtcgtccagagggaga

SEQ ID NO: 83758 - DNA, 193 bp, Triticum aestivum
  Clone ID: PAT_TA_83758
gcggcgatgctcgcctaggccgacgatccccgtcgatcgggccgtgataatgcgccggccatgtcaccctttttttctcttttcgttttgtgtatgtaattatttacgaggggtgatggactttgggtccttttctttcctgtgtggagtagagctcacattgtcgggattcttttgctttgctttctgtgaa

SEQ ID NO: 83759 - DNA, 263 bp, Triticum aestivum
  unsure (1)..(263): unsure at all n locations
  Clone ID: PAT_TA_83759
catttacntaatatttcttgtcantcgctgttaantgactgtttggnnataantcaacaaggagagaanctttccaagnttcagaancatgtagaacaacttgtgtcgttctttctatcnttggatcaaattgntgtatgcaaaggtgaattatggccactgggaangttagcatanccantggttgagnaanctttgcnanctatcaanttcatngtaaaatcanacnctcaattttagagatgaccattangtnntcaacc

SEQ ID NO: 83760 - DNA, 478 bp, Triticum aestivum
  unsure (1)..(478): unsure at all n locations
  Clone ID: PAT_TA_83760
ggatttctgcagcttgcctattcctcctcgccttggagggtttggtggccangtcatacttcctctagcccacacgtttgaccctgaagaattcctcgaggttataaaagtangaaatgccggtaactaccaagacgcgctcctgcaccgtgatctgtttctgttgcagatgtacaacggggtagacgagaacatggcaggcacttgttcagagctcatctttgcccctatagacgcatcgttcaacgacgactcgccactgctcccatccgggctttcgtatcatcccgatngacctcctcttgacactccaaccccaagtgcacgctggaccttgcctccancctcnaaagcgggaactcccancaagcagggacaanccgganccggngcccctggaatgcncngccgcttttgccgggctccaaggcctnannaccattntttcaatttgccttcaaaacatctgcaggaagtt

SEQ ID NO: 83761 - DNA, 617 bp, Triticum aestivum
  unsure (1)..(617): unsure at all n locations
  Clone ID: PAT_TA_83761
aggatctgaagcgtgggtatgtggcctccaactccaaggatgaccctgccaaggaggctgctagctttacctcccaggtcatcatcatgaaccaccctggccagattggcaatggctatgccccagttctggactgccacacctcacacattgctgtcaagtttgctgagctccgttaccaagattgataggcgatccggcaaggagctgggagaaggacccaaattctcaaagaacggtgatgctgggtatggtgaagatggtcccaactaacccatggggggtgggaacttttctcnatatcctcctccttggtccatttgctgtcccgtngacatgaagcaaacngtggctgttcnganccnccaagagtgtnngagaagaagacccaactgggaccaaagtgacgaagntgctgcccaagaagaagtcnactgtccgggtgctgtgcttgctgttgggtactccctggaacttaaanactctctgttganccttgcatttcncctnganaattacnaagatggaagttgctggcatgaattatactcgtaaactgancataaactaattttagacancattaggnaaangtagatttgcaccttatggtccgt

SEQ ID NO: 83762 - DNA, 547 bp, Triticum aestivum
  unsure (1)..(547): unsure at all n locations
  Clone ID: PAT_TA_83762
gcccaaccgaagcccagctgctccaagcagcggcggaagagacctcgtgatggcagccggaaagacaagcagtgagaccccagagatactggaactcatcctccatggaaggcgttgcaagagcacgagggcgaagattaagctatgtattttaccatttcatgcaggagctgcttgctagtagttgctaggctttgagctcttgcaagcttacctctatatgttagtgtaccccgcaaatcttaccgtgctccgctatgcgcctgtcttgccagagaacctgtccgatatccatggagttatacttttttttgtttaatactccctgtgctacccagatatgtttaaaatccannnaaaaaaaaactcccaaggggggggcccngtaccnattcnccctaaagnatcctattagccgctcanngcgtngttttaaactcctgacnggnaacctgggttaccacttacccctggagaatcccttttcnacngggtaaacaaaagcccacntnctcccaaantccactaaggaaggaccccttcggca

SEQ ID NO: 83763 - DNA, 553 bp, Triticum aestivum
  unsure (1)..(553): unsure at all n locations
  Clone ID: PAT_TA_83763
ccaagagctagccaggggacagagcagcagcttgaagttggtcaccaatgctaaggatgggccgcgccagcgccacagcaggtgtgttgcgcttcgtcagggcgttcgccctctgcgtggctacggcatgcctcctcctggcggccggcatgccctcgcctgtggcggcgcaggacccgtccgaagctgagcctgcagtactactccaagacgttccccaacgtggagactcgtccggacggagatggagttcgcggtgcgcgcccgacacgcgcaacgccgcgctcatgtccgcctccatttccatgactgcttccntgcaaggctgcgacggtccgtgctgctccgacgacacggnaccatgattcggagagaagcaagcggagcaaaacttaatccnctgaaaggttcattctggttgacaaatttaaggagaacttgaacccatgnccttgaactttcctgggcaaactgcngngatgcaactangatcgttttccgttgnggctacnggatcccattggaaacgnccaanaagnactgactacaanac

SEQ ID NO: 83764 - DNA, 624 bp, Triticum aestivum
  unsure (1)..(624): unsure at all n locations
  Clone ID: PAT_TA_83764
agagagaccttatgaagggtaaatagaagttgacaaaatcacgttgtggtgattcgtaggtaagaaaacgttcttgctagaacccaattgcagccacgtaaaagatgcaacaacaattagaagacgtctaacttgtttttgcagcgattgatcatgtgatgtgatatggccagaattgtgatgaatgatgaattgtgatgttatgagatcatgttctttgtaataggttccacgacttgcatgtccgatgaatatgacaacccggcaggacccataggagtgtctttatttttgtatgacctgcgtgtccattgaataacgccatgttaactactttactttattgctaaacgttanccatagaagtaaantancctttggcgtnacacttccatggaaacacgatgaggagattcaggatgaggaatnaaggtgttaacccggtgacagatattaaggccccnnaaatnaattaagggctatatgatatggccancattccactataatgcattgagttataagttancactgttactagacacgtataataagatgtcctacaaaattcagaatgtccccacggggccttcaattcttctcagacagtagtcgggtaggtct

SEQ ID NO: 83765 - DNA, 349 bp, Triticum aestivum
  unsure (1)..(349): unsure at all n locations
  Clone ID: PAT_TA_83765
ggggcgttgaagcttcaccggcgctgcaatggagcgccgccggggcccgtcgatgctaccatggagctgcttcatgggactaccatggcagctactcgagagtagtagtgttgcaacccagcaacgtcgatggcggtcgctggtgttgacaggcagcagcacatgtcgaactgaacatgattaaaggtgagaagacgcgagctgcttgatgagatcgtgcggtcacctgcgccagatcaaacggctagctagccggatgattttctagaaaatcatccggatgatttgtaacanccccaaaaatcccttgattgtatcactatgataaagagatcccaaaaaaaaaaaa

SEQ ID NO: 83766 - DNA, 394 bp, Triticum aestivum
  unsure (1)..(394): unsure at all n locations
  Clone ID: PAT_TA_83766
gtcaccgcccgcaacgaacaggttgaccttctgaagccagatacaacagtgatcttccgcaatgctaagattgacatgttcaagggtaccatgaggctggtggtggacaagtgggggcggattgaggtgactcagcctgctgatttcaaggtgaaccaagacaacaacatgtcgctggtggagtacgactgggtggatgttggacgaaagaggagtgaccaagaaacgaatccnggctgtggcatatatttggttatggaggcggtagcgttagtccctatctactattgttancctggaccgctggcgattgggactttgttttaatttanccttgaagaancattccattatttncagcacacagctctgtctgacngantttattcccgtt

SEQ ID NO: 83767 - DNA, 615 bp, Triticum aestivum
  unsure (1)..(615): unsure at all n locations
  Clone ID: PAT_TA_83767
ggtcagtgtgcgataatcatgtttgatgtcacttcaaggctgacatacaagaatgttcctacgtggcacagggacttgtgcagggtgtgtgagaacatccccattgtcctgtgcgggaacaaggttgatgtgaagaacaggcaggttaaggccaagcaggtgacattccacaggaagaagaacctgcagtactatgaaactctgccaagagcaactacaactttngagaacccttcctttacctttccaaggaactggtggtgattccaacatcacttcctccnaagctgtggccttnacccccngaagtgaccttcgacctggcatgcaacaacacacgagctgacttncngctgcaacggacaccactgcctgatgacgatacatttgattcaattaagaaggttatgatcttgtctgtctaacatcaatacttttaaaccaaaacttgcatccntttaagtttaaggttgatttggagtatcaaccggtttttccgtcgcctgctntcnggggggctcaaacgttgttgcatgtcnnacagtgcctcaangattttttgncacttangtncanatatanccgntgccatgttggtatnttaaaaaaaaaaaa

SEQ ID NO: 83768 - DNA, 515 bp, Triticum aestivum
  unsure (1)..(515): unsure at all n locations
  Clone ID: PAT_TA_83768
cgctcgtgcgggcatcccgtgcctgctgcgttgagaagtgcttgcgtgctgctacccgtcccacgggaagccgtgctcgatacacgttgccttcgtcgagctcaccccccggggtgcggctccgtcggctcgagagcgcccgcggcgtttgcctccgtgccgccgtcagcctatggccggcggcaccgaggacacctcgctggcgcttttggctccggatgttggtccacgctgaaaggccggagacgcctttggcgtcacgcgcccaaaaatcggtccgcccgaacgaacgaacggccaccccggnacaccctccgcgccntaagccgcgctggccgtctgcnaagacttctactggttgattctgccattatcanatctttctcaaaaattaccatcatttcaatangacattcnactgtgaactgcaatgtcaattatcattaatttgtttganggaanngcacccggataaccttntatncaagactaatctncaaaaacccgatccngga

SEQ ID NO: 83769 - DNA, 221 bp, Triticum aestivum
  unsure (1)..(221): unsure at all n locations
  Clone ID: PAT_TA_83769
gagagaacgaagccagatgactgcggctatggacggcgcaacatcttatatagcaatggtgggcggcaagggacggatgggtggcgccggagtagccacctcgacaaccgcatatcattaatgtgggcagaagacgaacggacggacatcacttgtgttgtttgaacacagttcaatcgcctacactggggaagcgggctggcggcgctgacncttcgggg

SEQ ID NO: 83770 - DNA, 472 bp, Triticum aestivum
  unsure (1)..(472): unsure at all n locations
  Clone ID: PAT_TA_83770
ctctcctccgctagtccggtaccctctcgacctcggcgtcccaccgaagacgacctcacgcggagctgggaatattccttcgcctccgtgctccctttagcaccaactgtcacggccgcttccagcacgcatcattctcgtctcccgtctcgagagattgcagggggcggcgctcgaagctggaggaagcggacgggttcgcgatggggtccgagggatcctcgggtccggtcgtccgttcccagaaactttaagctgctagaagaactagaacgtggtgagaagggattggtgatggactgtgactatggatggatgatgctgatgacatatatgcggccctggacaagactacattggcctccccaatacntttaacaaggacaatctaccaatttaagtgttttgtanacggnttnccaaataacacgacatcccatccaaatcgttnatatacatgctgaacaanaac

SEQ ID NO: 83771 - DNA, 412 bp, Triticum aestivum
  unsure (1)..(412): unsure at all n locations
  Clone ID: PAT_TA_83771
caagaacaagcccaagccgcccatcatcgtgacgcgcgacagccccaacgcgctgcactcgcacgtgctcgaggtcgcggccggcgccgacgtcgtcgactgcgtcgcagagtacgcgcgccgccggggccgcggcgtgtgcgtgctcagcggcgggggcgccgtcgtcaacgtggcgctcaggcagcccggcgcgtcgccccccgggagcatggtggccacgctgaggggccggttcgagatcctctcactcaccggaacggtgctgccgccgcccgctcctccgggcgccagcggctcacggtgttcctctccggcgggcaaggccagtcatcggcgggagcgttggttgggcccctggtcgccgcgggnccgtctcctgatggtgcttnttcgcgaacccgtgtacgac

SEQ ID NO: 83772 - DNA, 176 bp, Triticum aestivum
  Clone ID: PAT_TA_83772
atcgtctgcaagcccctcaaggcctagaaatcacctgcacgcgcctcccgccacatcaagcactattgtaattttgtgcgtcttctctgttatgtgttgtgtccttgaaaacttctccaaaagttatagtgtcataaacttcaatttaatcaactctgttgcacaaaaaaaaaaaa

SEQ ID NO: 83773 - DNA, 606 bp, Triticum aestivum
  unsure (1)..(606): unsure at all n locations
  Clone ID: PAT_TA_83773
gcgcaacgaacctcgagtcctcgacaagcacccaaatcgacgaattcttcccccctctccgatctcgacgcgcaccgatgcgggcgatgtcgtcggcggttaatggtatgctgcgggcacggctgcgcggggcagcgcgcgttcgccgcggccgcggcgaagggggccgggcggtggacgaccccaaggtcacgaaggagcgccccaaaggggtacctcttcaaccgggcgcgccgcctccccgggggaactcgcaagttngggagatttggggagtgccctgctacgttactccttccctcaccgtcctcatccctccgcgttcngcttnaacgcgaacccgaccttacaatccgagacgtgggccaccanaagcctccgacgcctcccaacagcaagantccccgctgccgaaccaagcgattattcggctctcaagcctctcantctnggtcctcnattngtccaataaatgcacattncggcctgaattcngatcngtatgatgacacactgacatagcgcgttttcgtcgtttgaatnccgtatatgcattctatatnatattaatttacgtgatacactacctctttcaaaaaaaaaaaa

SEQ ID NO: 83774 - DNA, 387 bp, Triticum aestivum
  unsure (1)..(387): unsure at all n locations
  Clone ID: PAT_TA_83774
cccagttggatatggtatcaagaagctgcaaatcatgatgaccatcgtcgacgaccttgtctctgtcgacactctcattgaggactatctgtgcgctgagccagttaacgagtacgtacagagttgcgacatagttgccttcaacaagatctaggcgtgactttccgatcatccttcccctggggtgctggcgatggtggtggctggggcaatgcaccacctaattatccatactatatgtctgtttggtgttggcaatggatattgccgttgagattttttggttcccnattccgatccnatgtnccattaccaagattatttgcttttaattccnaacaccgttcccattngattccgttaccgtgtcctttggcttgccagttn

SEQ ID NO: 83775 - DNA, 274 bp, Triticum aestivum
  unsure (1)..(274): unsure at all n locations
  Clone ID: PAT_TA_83775
gtgcaactcatggtcacgggagaaaagcaattctcccangcatggctcaaccgttgaatttagatggagatttggatgcatgcanacctcttctacttgtatttcacccattaatgaacccacactctcccatgcagcanactacacncatgctttttcatgtcatttcaanntttggaatcattttatcntatganccgaaatcccgatttcacttttcgtttgcatatntagtgttcctggtgacgngganttttcacaagatcactcntca

SEQ ID NO: 83776 - DNA, 518 bp, Triticum aestivum
  unsure (1)..(518): unsure at all n locations
  Clone ID: PAT_TA_83776
accaaaaccagagccaaagccagagcctaagcccgaaccaaaaccagagccaaagcctgagcctaaacccgaaccaagaccagaaccagaaccaaagccagagcctaaacctgaaccaaaaccgaaaccagaaccggagccacaaccaaagccagagcctaagcctgatccaaaaccagagcctaaacccgaaccaaaaccagagccccaaccaaaaccagaacctaagcccgaaccaaaaccacaagccagaacctaagcccgagcccaaaccaaagcctgaccctccacacatcccaccagcagctatcaactgangaagtggctattaacaantattgtagtgtttaaataaaatgccatgttgcagcgtgcttttgtaggtgctgctacttgttgtatctatcctatcttttcttgtcattttttgtagtaagctattatatgatcttagtgcagttagctaannnaaagggccnnggaanaaaaaacccagggggggccggtccaattcccca

SEQ ID NO: 83777 - DNA, 628 bp, Triticum aestivum
  unsure (1)..(628): unsure at all n locations
  Clone ID: PAT_TA_83777
gaacaacgacgacaggggagatgtcntggagatagacacctgggtcgcgtcgtcagggaagaacggcatgcgcagggactggatcatccgcgaccgcaacaccaagaacatgatcgcaagagccacaagcaactgggtgatgatgaacagggagacccggaggctgtcgaaaatccccgacgaggtcaggcaggaggtgctccccttctacctggacaggagcatcatcgccgccgccactggcggcggccgcaagatcgagaagctcaccgactcnacngtggatcacatacgatcanggctancacccacgtggagtgacatggacgtcaaccatcacgtgaacaacgtcaagtacatcggttggatctcnagagcgtgccgctgggncttctggacgatnccactgncgagcatcnggcnagacaccgcgggagtgcgtcagtcgcnctctcagtcctaacatcatnagaactctctnagcccggcnagcccnctnactccaccttgcngtcnanctttcaganaactgancggaacaggtgaaggcnanatnaggttnnccaanggtccagggcancacgtnatgacncntaaaccgtggtaaaccgtttgatncntttgttnn

SEQ ID NO: 83778 - DNA, 430 bp, Triticum aestivum
  unsure (1)..(430): unsure at all n locations
  Clone ID: PAT_TA_83778
cgaccatgtagcccaagtataaaatcctgacctcgcccgagctcgccacagcgtgctctttaccatgccggacctcgccgtgctctttctcacttgcctcaccgtgaccggcactccctgagtgtggagtccagaacatcgtcgcgccgcggcaggccagcgccgtggacaacttcaccttgaccgatcaacctgtatcttccccgagcggtttagtgcgcgcaccgagaacttgaacacctagacgaggtggtacttgacgaagtctactccagtgcctactcatcaagtggatggagctatctaactaaaggttaggtagaaggatctagaacctcttcactgcaaaaaggcaagccccggtgtatttacccttccttgtgtttttaaaagattttatacactttaagtctaaaanaaaaaaaaaaaa

SEQ ID NO: 83779 - DNA, 603 bp, Triticum aestivum
  unsure (1)..(603): unsure at all n locations
  Clone ID: PAT_TA_83779
gcagcgatgcgtggggaggggaaggcagaggcggtggtcgaggcatggaagtcgatgaaccacagcttccagcttggggagtggagggtctcttcggaggaggtgaggaggctgccgatgctggtgctgtggtcgggttcttggtcagatatgtggatcgacgaggggaagaaagtggcggctgcattgcctgacgccaaattcatctaccactccggcggccgatggcctcaggtcgatgcctttgaggaaatttcaggggtgatcaccgagtttgtaacctcagctgaggaagctggaagcagcaagtggtgacgttgagtangatatatacactccttcgaggatcgttgagcaaatgtaacctggagcagttttcanaccttttagttggtgggtgcagtgacaagtgcaacttgagatttttgttcctggagaattctgcttcacgtcgtaccaantctacttaacaacgtgttttttaacttaattgtgcaaatggtgtactgttgctnctcattgtaaactgtncacnaancatcaatgntacattannattacntccttnagnactgtcgataacatntctgtaaaaaaaaaaaa

SEQ ID NO: 83780 - DNA, 500 bp, Triticum aestivum
  unsure (1)..(500): unsure at all n locations
  Clone ID: PAT_TA_83780
caaagaaccagcatcctggttgtgaaaatggggggtgtgcgtagctacttcttcatcatcgccgccgcggtcgttgccgtcgtcctcgcgcttctcccggccggcgccacaggtgccggcctcaaggtcggcttctacagcaagacatgcccgtcggcggagtccctggtgcagcaggcggtggctgccgccttcaagaacaacagcggcatcgccgccggcctcatccgcctgcacttccatgactgcttcgtcaggggctgcgacggctcggtgctgatcgactcgacggcgaacaacacggcggagaaggacgcggtcccgaacaacccgagcctgcggggcttcgangtcatcgacgccgccaagaaggcgtggangcgccgtgccccaagacgtgtctgcgccgaatctggcgttcncggcgcggaacacatcgnctggcgggaacaaccnaactacaagtcccnccgggcngcccacgcggtgtcaaggacagg

SEQ ID NO: 83781 - DNA, 282 bp, Triticum aestivum
  unsure (1)..(282): unsure at all n locations
  Clone ID: PAT_TA_83781
gtgtttgttcattcccgaataaaaaagaaatggacttgtatagatgatggtgatagaattacggctaagaagaatgtaacttacgagaaaacggagattcatctgggttcctgcatccggtcttgtgttgtgtaacatagcagtttttcttggtacccacctccattgtgaccttcgaaattatggcaatcatgtggaaagatgtatacactttttactgtgttgatacagcctgtattatatatgtaaattgtgcagaatgtttcaaaaaaaanaacaaaa

SEQ ID NO: 83782 - DNA, 630 bp, Triticum aestivum
  unsure (1)..(630): unsure at all n locations
  Clone ID: PAT_TA_83782
aaaaggaggagacacgttgtctcatgacgagagcaaaccacgccgttcctcatcaactgcggcacaaacctcacccaagagatcaccgagacacgaacaacccctgagctacaacaggctccacactgaggagagagcaataaggcgagctggctacaattatcaggttgcaagcaagataaatacccaggaaatcattcgcagatttgaagagaagcttgcacagttgatggaggagcgcgagataaagctgatgaggaaggatatggttcccaaggcccaactgatgccagcatttgacaagccattccacccacaaaggtcgacgangcctctgacggtgccaaaggagccgagtttcctgaggctgaaatgctgcatccgtggggagttccatcgccatttttgctacaatggagccaacaacaaggcatcaagtcgtatcatacatatacatgcatcagagagtatcacacatgtcctccctaactacnttaccggaacaagccagtgtcgaantcataccgttacatcttttccgcgcgttcaacttcaananatacgttaccagcatccagctnttaannaatgcctttnccaatttnctcttcaaaaantgtacctgcangt

SEQ ID NO: 83783 - DNA, 347 bp, Triticum aestivum
  unsure (1)..(347): unsure at all n locations
  Clone ID: PAT_TA_83783
aaaaaacatgataataaagtgttgtacatactgcacaggcaggcaggcagccagctagagccaggtgaggtgaagaacagaaggagaggtatgggcgggggacagatagacacagctagatagtagttggcaatagtgggattggtattggattccttatttccgttggatgtcttgttctcttttgttggtgtcgggtgcaagtacatggcatttttcttttcttcttgcctgttgttctttgggggctttgatcggagaaaggatcaaaactggagtcngtgggaagccaccaactagtctgcccctaaataccataataagattgtatttgtaaaaaaaaaaaa

SEQ ID NO: 83784 - DNA, 546 bp, Triticum aestivum
  unsure (1)..(546): unsure at all n locations
  Clone ID: PAT_TA_83784
gccaccgctccgcctgatgccgccggacgggagctccaccagcccgccaccggccgccctttggttgtctagactccacgccggttctcgcctccgggccgtcccactcctcgcgatggcccgcctcgccgcctccggacgggagctccgccaaccccgctcctcacgccgccgccggacgggagcctcgtcatccctgctcctcgccacgccgctggacgggagctccgccaacccgccaccgccttgtcgcctcaggccaccctacctagacgcccgccggacgcgagctcctgttcgttgactgtctctcttttgcctcctctgtattcttctgtttgtttctctgtcaatatctangtgaatatatgcatgggttgatgaataaacaatactgggtaatggattgatgtttgtttgantgtttgaatttgtanctacggcttgataattcaatttgcaaanttgcttgataattcgtacgcaactgtgctggnaattttggantgttgataaaaatnagtagtattgctgaaaaaaaaaaaa

SEQ ID NO: 83785 - DNA, 390 bp, Triticum aestivum
  unsure (1)..(390): unsure at all n locations
  Clone ID: PAT_TA_83785
ccttcccttcccttccatcctcacccacattccattcggatcgattccatccccagccccaaaccctaaccctaccaccgccaccatgtccgagcgcatcgacctcaacaacacgtcccaaaccctggcgccacccaagcgcggccgcggccgcccccgcaagaaccccccgcctcccgctcacccgcgccctccggatcccgacacccccatggtcagcggcttcgctccgggcgacatggtctggggaaagaagctcaaccacgccgcctggccgggcctcatctactccgccgggagggaacagcaccgggcacgaaggccagctcctcgtctcccaattnggggacaaggcctcgcctggtgcgacgcanccgaactcaggcctaa

SEQ ID NO: 83786 - DNA, 614 bp, Triticum aestivum
  unsure (1)..(614): unsure at all n locations
  Clone ID: PAT_TA_83786
ctccaccaganccttggaggggctgttggtagctgtcagaggcttcagtatgcatatgatgaggtgtccacaagggcatcacatcttgagatacttaanaggagtcagatggagcagattgatcagctagagcagaanaacacagaaactgtggagaaacatcggcttctggaagaggaaaagttatctgcaaataaggagaatattaagctacaaaagcatgtccaagaccttgaagttcagctccagctagcaagagcagaagcttaaagttactgaggcagaaagcaaatgcaaagaagagagatatgaagcgtcagtggaagcactgcgggcagagatctgtcatcttgaacaattagtacancagttttcaaggaagagtcagcttgctggaaggaactctcatgcaggttaaaggacatgctgaatcantggtctgtaaatgggctgacaattggatgancnagaacatccgnatcagaantttgtgctctcattgaccgctcatcgctgtagtgacanctaaaatccgaagaagaagtactgatatctaataacnaagaactgcaatcaanacnactggtttagtnancnaaagaangggttcaaaa

SEQ ID NO: 83787 - DNA, 437 bp, Triticum aestivum
  unsure (1)..(437): unsure at all n locations
  Clone ID: PAT_TA_83787
ataacaaccgacgggttcaatccatatggtttgatggctgccatatacagttgttggccagtatatgttatccccctgaatctgccccctggcgtttgcatgcaacgacatcacatgttcctgacgttgataattccaggtcctaactatcccgggaagcatatgagtgtgtatatggagccattggtggacgacttatttgttgcttggaaaaatggggtccggacatacgatgctgtttcaaagaagcacttcaatatgcatatctggtaccacacatcgctacatgacctaccagcacntgcatatttgtgggttggtgtgtaaaggggaanttggccttgcccaatgtgtcnanaantttgacttcatttggatggcaaagggtcaaaatnaggtntccttgaccaaaaatcggtaantccctcacctggtta

SEQ ID NO: 83788 - DNA, 585 bp, Triticum aestivum
  unsure (1)..(585): unsure at all n locations
  Clone ID: PAT_TA_83788
cctgaaccctactccacgtcgcctcgcctcgccggtaatcgacttccttctcttggcccttatgcaatcggttcgtactccatgctcggattctccatctgatccctatataccaactgcgccgattgtattgtcttaggttgggttgtggctgagccgatctgacccgatcgggtgggtccttgcgccgccgctgcgtgggctcatctcggtcccccgcctgctcggctcgatnggccggggacggcggcggcggcggctagatctgcgatggagggcaacaaggacgacgcggncaagtgcctgcgcatcngcaagggcgcgctcgaaaccggggaccgcgcgcgcgccatcaaaatttattcaaggaaaacgcctcgaccctcgctgccatcgataactgctcactccctctaaagcgcaagacnntccccggctcctcacatatcgcggctcaacaacggaaatnccgcagaagggcaccgagganctgaaacnatggctaaaaaangaacacagganaanaggaaggagagagagnannctgctcaagattacncgggnatncangggggcccgtacaat

SEQ ID NO: 83789 - DNA, 260 bp, Triticum aestivum
  Clone ID: PAT_TA_83789
gaacagcaggggcttcaaggtctaagtggccactgccttgccaatctagtgccgttttgctcgtgtcagctcaatattaccgttttggtgtcatagttgtaatgttttagttgtcggaatctcgtgtcattatcggatatcgaaccaatcaaatttcgctccttttttgtttttgccatgagacttgcccgtcacgaagatgctcacatatcattgtgggccgtaactatgtgaaagtctagctgcccttttgctttgct

SEQ ID NO: 83790 - DNA, 486 bp, Triticum aestivum
  unsure (1)..(486): unsure at all n locations
  Clone ID: PAT_TA_83790
cagctctcccgcctccggatccagatccgccgccaccaacgcctgctcctccccctcccgctgcaccaccaccatcaagaggtccagcagggcggcagcggcagcggcggcggcggcgacatggggcgtgacggcggtggcggtgtcgccggcggcatgtctgactcggtgctccggaaggtgctcctctcctacttctacgtggcggtgtggatcttcctctccttctccgtcatcgtctacaacaagtacatcctcgacccaaagatgtacaactggcccttccccatctccctcaccatggtgcacatgggtttctgctcatccctcgccgtcgcgctcgtccgcgtctccgcgtcttcaactcccaaatcgcctcaatgacccgcanttctanactcctcgttgtcccatgggcgcgtctagcattcctccngtctcaatccgccaaatcnacntccgtgtaataaccaaatctcaangggc

SEQ ID NO: 83791 - DNA, 646 bp, Triticum aestivum
  unsure (1)..(646): unsure at all n locations
  Clone ID: PAT_TA_83791
tttttttttttttttttttaaaacaatacaccatcaagcttataaaaaaatgaatgcggctgctcgacataactcagccgatgctgtaccgtgaccgtgagtggtcatgtgattcaaccaagcctcaactccctactacatcatgtgatccaagaacaacacatttattaatgccaaaaaagatcagactcagacatctcatggcaaaaacaaactacttgcaccaagatgcaggcagcaggctctccggttgcaaaggcgatgtgtcatggaactgatacgccgagagatttcaggctagtaaatatgtaaaagcaacgcgaatttacattaaaattcaatgggatggatttaaccggttccnanccttcggtcccaaaaacngaacggaantaacttcccaaaacagaatcattanccaaatggaaaacaacacatttgccattcccttaaaaaaccgatccccctcgttcttnaggccaatcntttgaaaancaccgtgtacaactnctnaattctancatanattcgccggcaaccctggntaggaanaacctgggcccaccngnagcatganctcaaaccttaatganactaanagcntgaattaaaaatcaaaggtcacactttacnaaancggggaaan

SEQ ID NO: 83792 - DNA, 589 bp, Triticum aestivum
  unsure (1)..(589): unsure at all n locations
  Clone ID: PAT_TA_83792
tttttttacatttcaaatcatctatctttttgctatcaatcattcaagcaaaggtcgagcaactgttcaccgttcaaaacctgagctaccggtgcgcgctctctttttcctctattcgcgttgtcggcaaggctccactcgatggcaaaatctatcaccatcccctcgctacacacgagaatttgggtgtgggccacgacatcgcaatgcatgctacacacgagagcagtaactattatgcagggttcaccgtaacctanctgatctggatgaattcaacttgggcaacaacatattagaaccgttataaggaaaccttttaaacacaggcatgcaaggcacgtcgcaaaagtccgtncatccgttacacgttcaaggaaangccttaaaagtgcgtggtaatcaagnatgacctcacttccaaancttgccaaggaaatntctcncgtgtcttctnnacaacttggcaatgcaactcaatccccngntaagtgacctntccacggggagcaaatcanctcntnaacggcttacnaacctaggccatacttngcatttttnatatcanntaantattctanggttaaaa

SEQ ID NO: 83793 - DNA, 631 bp, Triticum aestivum
  unsure (1)..(631): unsure at all n locations
  Clone ID: PAT_TA_83793
cgagtttttttttttttttttttttttgaaccaaagttaatgtctagaacatcattcattcactggtcaaccggtacagtatagcaaaaatgcctgttcagattaagctaaactttgacggatttctctagacagcgatgtctccccagatggccagagacacgagctaccaattcatttactcttgcgctcactgttgtagtcatcaatcagcttctcgacatccttccagaacaggccctccacaagaactccttcctttgtaaaccactttgttacctcctantgaaatgaactgggcttgtttgcanagatagacggtggntcgcacttgctatggtgaaagtgtncattccganaactgggaattnanaanaaatatgaggcattctgctgaaagaaccaataggagggtgcntnnaataggatggaccttcccctggggttccnanggttncancaccaatncgcaccanatnagggngatgcaccagggggaacccgtcgcngaactctngggaaacgaccnggngggaaanaacangggggncgttcanntcantgcaacccntcccggtncctacctanacncgnaggncccaaagggttngtcggccggaatgcctcttgg

SEQ ID NO: 83794 - DNA, 582 bp, Triticum aestivum
  unsure (1)..(582): unsure at all n locations
  Clone ID: PAT_TA_83794
agtcactgtcacttggtgagatcgatggcccgcgtcgccgccgtcctcgttgctctcctcgccctctttgccgtcgcggccacggcgcaggcccctgccgcgtcgcccaagcgcgccccagcccctgcgccacccaagatggcccctctcccgccgccgccgaccagggcccccatggcctccccgccctcgcctcccacgatgtcgccggcgtccgccccctccgccgacgctccagccacgagccccgccggtgcgggatttggcgaccgatggcccggcgggagcctccgctctgatccgggcgccgcgcccgtcacggagaagacacaccgcatctgctccgccataacttgtcgccatcgccggngctgtggaaccgccgccgtcgtgttcnagaatccggaatggtttgaagactgcaactgcacttaaccctctgcgttgttgaaaatcctcgtttgccgtttacgatcaatggtaataataattgttgttgtaattaaagtctaaannaataggagtnaaccanaatttcgaangggtnttcntgncgaacaaaattgaatnaaaaaaaaaaaa

SEQ ID NO: 83795 - DNA, 628 bp, Triticum aestivum
  unsure (1)..(628): unsure at all n locations
  Clone ID: PAT_TA_83795
ccgccgcccgccgcagcagcacccaccgggcaagatgaagacgatcctggcgtcggagacgatggacatcccggagggcgtcacggtcacggtggccgccaagctggtcacggtggagggcccccgcggcaagctcacccgcaacttcaagcacctcaacctcgacttccagctgcaggaggccggccgcaagctcaaggtggacgcctggttcggcacccgccgcaccatggccgccatccgcaccgccatctcccacgtccagaacctcatcaagggggtcaccaanggctaccgctacaagatgangttcgtctaccccacttcccatcaacgctccatcacaaacaacaacaccgccatcgagattagaactcctccgggagaagaagncangaagtggcatctttatggctgacatctccgtccnanaagncaaggntgactcaaccctntncggaacaanncaactntatcncntcgccgcctaataaccanaatcctnntanaaaaggtnccnaantttggcggatcaatnacnanaagggtctcaaagggcattccaaaattccaattccgnaaaaaggnncctngttcattntaaagaangancctttcacctaantng

SEQ ID NO: 83796 - DNA, 641 bp, Triticum aestivum
  unsure (1)..(641): unsure at all n locations
  Clone ID: PAT_TA_83796
ccattattggcgcagtttcctcgtgcgcacttgtgacttgtgatgagtggcctaactaatcaatcatatgcagcaaccggagctttcattagggttatccgtgcaccgtgacaaaggttagttatagttaggtactaatgacacccaggtggcctaactgcacacaagccaacaacccggccggcaactcaaaattcgaatacttgtggactgggattcatttggccaagcacgccggattatattcgttggagttcaaaagaaacattaacttaagacgtcaagcanaatgcancaagccggcgcctttaaacaactccancctaaccgttcttaaccnaaattcaaacccngtgataantaccgggaacccgggggaacaanggtccncggcgccgaaccccctcaatcccttttccctcncggtnaccggaaatgcccccggaaccttnccggncccntaaaggtggcggaaagtncgggcncacccctccgagccttngttctnggggggggccaaangaaaagggtttccggngtggnggttccaaggggtggnattncttcccccgggngggtgtttgaacnccngggcaaatnccaattgggtaacctcggaaccccccccgggggtttnttnc

SEQ ID NO: 83797 - DNA, 504 bp, Triticum aestivum
  unsure (1)..(504): unsure at all n locations
  Clone ID: PAT_TA_83797
cgcaaaaataaaatctgggcacggttcactgttgaggccaacagaaatgtgactagaatggaaatcttcctttccctaatgcgcatgctggaaccgagttgtggagcaggagagaattctaataacaacataaaaatgcctcttgggattgtgcagtatcccataatccctgcgacaggtcatcttaggtgagccagccagcacaaagataacaggatgcatctttgaaatgctaganccggggggaagtccacccacttctgccatgactagcattgccaacccaagacgagctgggaatctcgtgacatgcggtgcatcgtccctgcagtgtgcattcngaaacctaacagttnacgggaacatcnacatggatattggttcnccngatgatcgacttttgactgtatcctaagttaagtttgttgctgatgcttaaccttttgttaatcgcanataatgaatgaatttgtaagttccgccgccnaaaggaattccgagttt

SEQ ID NO: 83798 - DNA, 523 bp, Triticum aestivum
  unsure (1)..(523): unsure at all n locations
  Clone ID: PAT_TA_83798
cccagctctccctgaggagaccccccaggagcttgtgttcatagtacaatcatgctgggttgaggatcctgccatgcgacccagtttcagccagatcatccgaatgcttgaaactttcattatgacaatacatccacctccgctttcagagccaaacgaaggcgaggaatcggaagaaacgaggtcgtcactgagcagtaggagctcctctggctcctcgctcgtttctcgcgcgacaagcaagctctcggtcgtccgccacctcttcgtctcaaagaagacangcaatgggaangcgtgatgcgccatgccctgagagctttcctcngtgctgttaagatgctacctaagtgatgcgcaatacaaagagggaactgttcaatgttaaattactgttggaattgatttncaaaaagggaaantnaantgcacttttgcaagctatgtnnactccaactcctttacttaccgaaattcctatnttccntcaaanaacgngtnttattaatcaanacngcttatc

SEQ ID NO: 83799 - DNA, 648 bp, Triticum aestivum
  unsure (1)..(648): unsure at all n locations
  Clone ID: PAT_TA_83799
cccccctgcctgcctgcgcgcgctctctgcctcgtagcggcgacgacgccctcctccaggtggccaggccatcgtcggatcgtattcctcggccccttctccggtgatgagcacccagaataaaaggctcaaggatgtggaggtcagtttcccaatcgtctacggaaccatttccttctggctcggcaaaaaggccagcgagtataactctcacaagtggactgtatatgtccgctcggcaaacaatgaggatctgagtgtcatagtcaaagcgcgcggtgtttcaacttcaacccgatttccaagaaccccgacgagattcttggaacaaaccgcctttcaactgtccgatccgggtgggganatttntagataaccataacctttaattccanaacgatttctgtnacaacgcttggtntgttcaacaactaaacgtntcaaaaaaagaactggactcaatcnacaaaaaccgttgtccttgnaactncaanaaattctccccnacctaaaangcttttccnancctggaaatatcacanctaaatgccaagttcnctggaaaactgccctcagnccaangnattttcttaaaaaacagggaacnaggtaccttatntgtncaattccagnaaantttanacgacc

SEQ ID NO: 83800 - DNA, 528 bp, Triticum aestivum
  unsure (1)..(528): unsure at all n locations
  Clone ID: PAT_TA_83800
cccaaagcctacgcatccagagctccaaaccctaggcgaggcgaggcgaaggagggagaggccatggatcccgattcggtctcgaaggcgttcgtgcagcactactaccacacgttcgactccaaccgcgccgcgctggtggggctgtaccaggacggctccatgctcaccttcgagggcgagaagttcggcggccccgccgccatcgccggcaagctcggatntctccccttccaacaattgccagcacaagatnnacaccgtcnactgcaaccctccgggcccaaaggcggggtctcntctcgtctccgggaacataacaacgggccccggggaacaaccctcaagtttcaaaaatgttcaantngcngcaactggagggaactttaacttcaaaacnaaanttcgcctgaactatggttaaggaaggnaacgctctggnggnaaaaaactttcaaggatttagttnaacaatgacatcaaatgagatccgaaaccctttttntccaactntgaatttcnaaaaat

SEQ ID NO: 83801 - DNA, 639 bp, Triticum aestivum
  unsure (1)..(639): unsure at all n locations
  Clone ID: PAT_TA_83801
ctcgccgccgccgccggccgcagccatcgccgtgatgctgtccctgtcgagggcgatcgggaggcggctcttctcgtccgccgaggccgcgtcgacggctgcggtgaggacggcgcagaacccgctcgaggagttcttcgaggtcgagcggagcaccgaggagggcaagcctcctccccactacggtcgcagctgggaaggcttctgaactgcgactaaaatcttggggatgaccttcaagaaattgtgggtatgttcctcctaaaggaaaagaacatgctaatgacacagcgtcaaatgctgcatttaanagacatgaggtccccaancccagaacgantttccaaggtaaagaacaatgtgcccggatnaacatttctngactgaaaaggctataccggcccctttcnaggaatnttccggaatgaaccgatgataatccctgtgatcaatcaanagatcccccttggactttganggactaattagaantttgctctccgtgtaccttacccatagacgttaacaatcttcaatccatggatgnacaaattanctaacgatcgtcaatatttcgtgactaaaaaaataanttccgtccnaaatnantaaggttnactagaattgcagcctttaaat

SEQ ID NO: 83802 - DNA, 581 bp, Triticum aestivum
  unsure (1)..(581): unsure at all n locations
  Clone ID: PAT_TA_83802
ctcgtgccgcgccggcgtcggttccgccatcgcctacgggcaactgacgaatggcggcgcgctggacccggcgggcctggtggcgatcgcgatcgcgcacgcgctggcgctgttcgtgggcgtgtccgtcgcggcgaacatctcgggcggccacctgaacccggccgtgacgttcgggctggccgtgggcggccacatcaccatcctgacgggcgtcttctactgggtggcccagctgctgggcgccaccgtggcgtgcctgctcctcgggttcgtcaccaacggcaaggcatcccgaccacgccgtcgcgggcataancagctggaaggctcgtgttnangtctcatcacttcgcgctctcacaccgtgtagccaacgccgccgacccaagaaggctcgctcggaacatcgcgccaatcgcatcggcttancgtnggngccaaatctcgccgcngggccctnancnggggtcaataacccgccgtccttggcccgccgttncgcggggaattcccggaaatgggtcacgggtcggccgtcttcggggnggccccnggctcttaagggactnttatggggg

SEQ ID NO: 83803 - DNA, 458 bp, Triticum aestivum
  unsure (1)..(458): unsure at all n locations
  Clone ID: PAT_TA_83803
tgngaggacnttcgacacgtacgtcntctcgctgttcgacnacaaccagaancccgggccggtcncngngcggaacttcngcatcttcaacacggatctcacacccaaatacgacctgnggctgctncgccaaggaccgcattctggatctcnaanccnatctccggngccctcgccgtcggtccggcggntgcaagttgggtgcatgnnccaatcncggcgcgancgcaaccganctgccagaacaacattaactacncctgtgcntacttngactgtacgccgattcaagagctgcngncgttcttggaccccnaacacatccactcanatctttcggtacgttcangaacgcnttctatcaagnccaatgcatcacgatatgacngcacttcnaggcccccggcgttngccactccaatgacccaattttcgggagcnganatanaacttcccct

SEQ ID NO: 83804 - DNA, 324 bp, Triticum aestivum
  unsure (1)..(324): unsure at all n locations
  Clone ID: PAT_TA_83804
ncgnctcccccttgtcgctcctccacaccncacatncacgcacgaanncgctcccaccccctcccgccgccaccgccgccaaaaccccggcccaacttggcgtcctccgccaacctcctcctgggcagcgcnngcngggggatatggcatcggaggacgtgntggncaacatcaagggcganaccgncntcaccaccatctntcaatctggcggangaggctaaactnttcncnaggncgtcaagctcccagccannatatnctcaccatctgnaatcnctccgtcgncngaggtgttacaagcagnnttctcctactgctgtt

SEQ ID NO: 83805 - DNA, 286 bp, Triticum aestivum
  Clone ID: PAT_TA_83805
ctcagagctcttcgtgccctcctgcaagcgccaaggaggaagagaagtgtgcgtactgcgtagttccatagacccggacaaaccagcgccatcatacaacaccagcaactgttggtttagttgtatatctgccttgcagccgtattatctgtatcaccctttttgtgtcgcgatggctggcctatctttgggaacatccttgggcgttccgccttcggctcctaagcaacgtcactccttcatgaccttcctacccccgataccgacttctaccgcatctacaaga

SEQ ID NO: 83806 - DNA, 523 bp, Triticum aestivum
  unsure (1)..(523): unsure at all n locations
  Clone ID: PAT_TA_83806
gccacccgcaacctcaatgccatgaacaagctcagcaccaagaagccgtggtccctgtctttctccttcggccgtgccctccaggcgagcaccctcaaggcctgggctggcaaggtggagaacttggagaaggctanagctgccttcctcgccaggtgcaaggccaactctgaggctaccctcggcacctacaagggtgatgctgccgccgacaccgagagctccacgtcaaggactacaagtactgattgcttctctttgcgtgcccgttttggaacccctgcctacgagctanttgcccgagtgtggttgctccttaaagcttattttcggacatccaaaaacatctcctaagttggatgatggtactttaatttgtatgttaattatctcttgccgttaattcctgtaattggcctgccnatggagaccacacccctttttttgttcnacaactatgcntatccggcatgtntcggnaaaaatctatatctattggatcggaaaatcatagngaaaaccc

SEQ ID NO: 83807 - DNA, 531 bp, Triticum aestivum
  unsure (1)..(531): unsure at all n locations
  Clone ID: PAT_TA_83807
ggatgtttcgttgctcaagcgagtggtggatgagcgcctatcattgagcaagttgcagccctcagctatgtcaagcctctcttcttcactgcattcttctcatcacaagagctggacttcctctgataggaccaccgaagccaatgggtctctagataagcacacccttgctgaacctgcaagcccagcgcgcaaagatctgaatggcgacgagtgcactgtgcaggtgtcagatggcaacgacactgggtaaaggcgttttgaagcgtgtggattccaaggacggcgatggatgggagctttgctgaaggtgttcaagaatagcgcggttgcgagtggatgctgaagcatagaaattactataaactagtaataatggtgaataaacgtttactagtgcgttgctaatctaatcgtaatgtgggaactgtgtcntggaactgactcactaactcaccgcagtantattgggatgggtccaactgcacttgacnggtatatataaattnaagaataactgccaaaaaaaaa

SEQ ID NO: 83808 - DNA, 581 bp, Triticum aestivum
  unsure (1)..(581): unsure at all n locations
  Clone ID: PAT_TA_83808
gttttgtgcgtgatgcagatgcaggcagcaggcaaggagcctgcggccgcggcggtccctgccgccaacaagccaccgagcatctgcgacaggctccaaagggccttcgctgcccggccggcgttccgccccctccgccgtatcaccgtcggccgccaccaggacggcggagctgccaagcctgctggtgccggtgatggagtcagcgcagcgtttgggccagctcctaataaacacagcggcccgccattgccggctccgccggccacagtagcaccgcagtgttgagcagccggttccgtgcgttacaaccgtcgccaacaaggttgcggcgggcggcgcgccaacggggcccccggtgccngtgcaaccgccggacttatggccggggaaatggggccacaagttcaanggaanacanggtgggtccaggtccgaaccgnagggctcncaagtttananagtgacncgtgccgtggattntgaaaactangttcnggcgtttgcannaggntcttaattgtntgtacaggattgtaacccgnanatcttcgtactanaatnaancaacantttcgaaa

SEQ ID NO: 83809 - DNA, 657 bp, Triticum aestivum
  unsure (1)..(657): unsure at all n locations
  Clone ID: PAT_TA_83809
ccttgccgtccacttcttcctccaccacagtcatcagtggcgttatcctcttcgttctcgcctccctggttgttgttggctgggtgttggcgagctgggagtagagaccgagaagtggagcggccatgaagatccagtgcgacgcgtgcgagggcgcggctgccacggtggtgtgctgcgccgacgaggccgcgctgtgcgcgcgctgcgacgtcgagatncacgccgccaacaagctcgcgagcaagcaccaagcgcctcccgctcgangcgctctccgccaagctcccgcgctgcgactctgccaaggagaaagcgggttcatcttctgcgtggaaggaccgggcgctcntctgccaagactgcgacgagccatccaanttcccgggcaagctctccgggaacaacaacgctacctggcaacggatcgcgtcggctccctcggcttcgcctgaacgancctggannccacaatccgacacaagcccgccaaggcacatcagcacgaagcgcctntcgcgcgtgaanagtgcctcccgccgnattctgccnanggtggcctnanaactcgnatnccgatacatcagnanactaaangaccanccggtnaagactgatgtccnnatacttcanagaggcaanacagattggggggng

SEQ ID NO: 83810 - DNA, 441 bp, Triticum aestivum
  unsure (1)..(441): unsure at all n locations
  Clone ID: PAT_TA_83810
ggcaagctcaatgcagtgacggacctgggacttgtcggggacgttttccgcgatccggcgcgcctcgccaagctccccggaaacgccgccatcggccacgtgcgctactcaaccgccggcgcctcttcgaggcgcaacgtacaaccgttcctcgccgcgtaccgattcgggcagttggctgtggcacacaacggnaacctcgtgaactaccaggcgctgcgcaaacaaactcgaggcgcaagggttccatcttcaacacctcnttcggacactgngtcatcctgcanctcatctcaanctcggctctcgcgtccgctgctctcgtcgcatntncnaagcctgnaagcgcctccccgtgcgtantccctgtttgntatgantgccganancttttgccnttngcnatcgttnggcttcgggnccttgtnattggcnnagaac

SEQ ID NO: 83811 - DNA, 571 bp, Triticum aestivum
  unsure (1)..(571): unsure at all n locations
  Clone ID: PAT_TA_83811
ataagattagccatgaaaaagaggttattgctgcagccgatgaggttgtgggcagtattgataaagaggaactggctaagtatttatctctaaattcagatcctgaagatgaagaagcacagaaattcaagaaaaaaatagaagaaacgcgagatcagttggctgatgcactatatcaaaagtgtcttgcattggctgagattgaatcactgaagtctgatgagtcaattgaggtatctgctaaagatatttttgaggagaattacanagaattgattaaatgggttgatgtcaaatctgcaaaatatggcacttcgactgttttgcgtgaaaaacgctgtggaagacctggtacagcattgaagatctaaatgatttgatcaaaatgaatccgnacaaagaaaaagcttatgatttgaagatcattgattgaggaatgggatgnacatgtccaacctacgaaaaacantggatcaatccgcttccccatgtcgcacatttgntgtgaccatttanatgggncacaccggtcatantgcattcatgcgggtggtnatcatattccacgcaa

SEQ ID NO: 83812 - DNA, 437 bp, Triticum aestivum
  unsure (1)..(437): unsure at all n locations
  Clone ID: PAT_TA_83812
ctcatcacacgcacggaccctaccccgtccccgcccgcctcggaggccggggcaaaacaccgccaggcagcccagccccagccagccatgaagcgaaccagagcgcancagtccaaggcggaggagccncaggacccctccgccgccgccgcggccaacccaaacccaaaccccaagccgcagcagcgccgggccaagcagncgatgnagcccaaggcatgcgccacggcgatgcccgccgcngnaaatgccgcgccttcttcgcccgggccggagacggcgcnggcgtgccggacgcgcgcgccgttggactgctgggacctcgacgcnggctgagcgcggcgcggnctattggacntgggggcgtcaacaaggacanctgctcggctggttcccntcnttgnagaggactccggtgctccggcgnccggcgnccg

SEQ ID NO: 83813 - DNA, 630 bp, Triticum aestivum
  unsure (1)..(630): unsure at all n locations
  Clone ID: PAT_TA_83813
ctcccaggtcatcatcatgaaccaccctgggcagattggcaacggctatgccccagtgctggactgccacacctcccacattgctgtcaagtttgctgagctcattaccaagatcgacaggcggtctggcaaggagcttgagaaggagccaaagttcctgaagaacggtgatgctggtatggtgaagatgataccgaccaanccatggtggtggagacttctcagcgtacctccccttgggtaggttgctgtcccgtngacatgaggcagacggttgctgttgggattatcaagagtgttggagaagaagacccgaccggcgcccaaggtgaccaaaggcggctgccaaagaaaaatgatgcgattnctgcgcctgcttttacaatacctattttcanccatcacattttgtttggtgattcttgcnttaacntgttaacgttgaatcngttacatgtgcactttaaccatttattgggacanctgctattcacttttgcaatananatcccnanactatagttaaaaaaangggggccgtacaatccccaaatgatctatancccctacggctctttaaantctacgggaaactggtnccataancctganaancccttcanngtaaag

SEQ ID NO: 83814 - DNA, 381 bp, Triticum aestivum
  unsure (1)..(381): unsure at all n locations
  Clone ID: PAT_TA_83814
gtttacaagagccttgccggaagtaagcaatttgaggaaattgtacgcaagcaaggaaggcaccggaagaatcaaggtgttggttttgaacgaaagttcaatgccaatggagttgggtgggaagaagatcaataccacaagacgaatttgttcctccgacaagagaagtatgatcctacttccttccaaggggacacaagatcaagatgatcttccaaccacaagaccacaagctggaaacgccaaggacaanttccaagaggagattgatgcctttngaagaantcccaaagccttgggcaattgggtcccaactcctacacaantctacttccaccaatttgactacaaccccaagatccccattnagatgatgtggtt

SEQ ID NO: 83815 - DNA, 257 bp, Triticum aestivum
  unsure (1)..(257): unsure at all n locations
  Clone ID: PAT_TA_83815
gatagagaaaaagaagagcttgttctttttggtagaaattcagattggttacgtggtggggggtttggattctttttggtcgaggtggacgacattctaggggctggttgccaattcgctggattggtggcggtgtacaattcgttgataagtgctaggaaagactggggattttggtcctgttgttaattgacgatccttcattccataataacctatgtgttccttgattctgnaaaaaaaannaaanggggggg

SEQ ID NO: 83816 - DNA, 627 bp, Triticum aestivum
  unsure (1)..(627): unsure at all n locations
  Clone ID: PAT_TA_83816
ccgccatgtcgtccccgccgcgggggcagcccgccaccgccgccgtgccggcggtcgcggccgccacgtccccgcagttgcctgcggcgtcccacacgctcccccgcgcgttcctcgccacatcctctccccgtgccatagtgggcagcaccggcgcccccgctattcaccggtcggccgctgaaccctaacccaccggccacggtcctcccgtgccccnacggatcctctacccctccctgaatccgctccacttcaatcccgcngccgcggccttgacangcactccgcgcntcctcccatggccgttgggtacctccngacccacgcctttgccatccctattgcacagcacananccctgggtgcacgcncaacccngtccttcgcggcttcctccggccntntnactgcgtttccacgggtccgacactccccangagtcctaatagtccaacccaaggtatccatacaactgttggcatcaatgacanattaccaaaagnaggaaaagacangaagactacatgtgngataatacgaaattactgcngaatantcgatcttagcccgcanttgttcnagggtcaataatacaacttgaanggacattttcaaacttcgtat

SEQ ID NO: 83817 - DNA, 391 bp, Triticum aestivum
  unsure (1)..(391): unsure at all n locations
  Clone ID: PAT_TA_83817
atgaacctgagtggtggaaatttggagattcaaaaacgtattttcgacacgcttcnggttctttgtttatcctcncaaaaaatttggctccgctacatcaacataaatagtgcgtcactgcagagttnatcacacgatgatatatcaatnagttcaatggatgatggggactgaatgcaacttaacgtnggatgatgaccgntntgcctgcagcnatttccagaccaagagaaatcctttccaatgcctttanccggaagccttgctgctggctgttgccgtacaccctgatgaaattttgcacaccttccattttgtancactgcttcccnngaacccggaaaagctactacccaaattanaacgnttnccaccaattttaggacttcca

SEQ ID NO: 83818 - DNA, 636 bp, Triticum aestivum
  unsure (1)..(636): unsure at all n locations
  Clone ID: PAT_TA_83818
gccaactacacgacacaacctgccttccttggttcctccacccccgtcctcccctgtcccgtcgcgtcagccactcgccgcggccaactaccgccgccgctgttgcagccgcccatctgcttccatcgcgtcgcggaggccgctcgcttcgccgccgcacgctccgctcttccggtgccctcctccgggaccctccggcacgccgcgtcgccttaaaccctagatttgcctccccgccccncgctggccgcggcgccttactgaccccggacgctgccgatttccatacttcgtccatttccagtttaactgcttcccaatttaatatttcctcccatgcatcntgtttngaantgctggtaacacgntggtcnactccnaccnagaaaggagaacgttcacatattgctcnaatggatgctganataaaanatngtgcangancatngcaggttaccaaaggtcnacncaatanatgatactttttacgggatcctaaggactntaaaaatggataataagggatnaantccagnacttgatccagtatggtaagagcataattgnaaactnttcgtaaaaacaanaagncgattctccagggttannatttccaatcgangtntttnggggaaa

SEQ ID NO: 83819 - DNA, 635 bp, Triticum aestivum
  unsure (1)..(635): unsure at all n locations
  Clone ID: PAT_TA_83819
cacagctaaagccttgtgcaaaattatcattaagctgtcatcaatcatcatggctgccattacggcaggtctgctggtactcctcgctgctgccgtcgccgctccggcgcacgccacggactacacggtcggcgactccgtccgggtggagcagcggcgttggactacgccacctggggcgagcggcaagaccttcgctgctgggggacaacctaatgttccaattacagcgccgatgcacacggtggtggaggttanctcccgcngactacggcgcgtgctccggcaacaatccatccaatccctacagcgaccagacacaagattgcgctcaanangccccggacgcgcaatttatctgcggaaccccggccaactgcggaaaggataactcccnttacgtccccgctgaacgcaacaacaacccngggtatcccgcccgcggtaatccctccaaaaaacaaccntcggttnaccccaagggaanantccttngggccaaaacaacccactcaanaaatggctcctcgntggnagccgtccatgggntttgctggcccggcccccggtcccnaaggttgaaaagatttntcctcaactttcgtgaggttttgccttttaacaatacccangga

SEQ ID NO: 83820 - DNA, 438 bp, Triticum aestivum
  unsure (1)..(438): unsure at all n locations
  Clone ID: PAT_TA_83820
gagatggtgagcctgcaaagcccgctgcagcaccagctgcgaagcccgcacctgctgagaaaccagcaccggcagctgctgatgtagccaagcagattccagctggcattccaggtagccgggcgaacaactactacccgtgcagatggccaagaacacgggcaacttcccttacggaccgtcccttcaaaccaaaggtcatgctgctccctggcggtggtcctcccctgggctacttgttttngcggaaattgatgtttaatgatgctgctttaatgaacgaacgatgaatggctgtacctccgttatccatgttgggtgaaaactggaatgtttggttccacattttacaacctgcgtcnattnccccgtcccgtangtcattgttccnagctgactcccggcttggaaccactncctaaactgtccttttaaact

SEQ ID NO: 83821 - DNA, 663 bp, Triticum aestivum
  unsure (1)..(663): unsure at all n locations
  Clone ID: PAT_TA_83821
cccgatctgagtcaagcgtcttcccatttcatcgcctggaaaaaggcgagaaaccccgaagtgaaggaacagcagcacgagtgctagcagcagcagcgattccttcgccataccgttcgccgcgctcgctcactcggatcgaaccctccctagggtttcgcatcgtcctcccgccaactcctatccctcccccctccctccgccgcgcgcgcgcggggagctaccaaaccctangacggcaaatccggtgcgatttcccacngtggagcctccttcngccgcccnagaggaccgctccgggntccgggtcaagggttccngtactntgccnggcgcctctgggttggnggggacccgttgatggcattgggaaccaacggtcccaacttnnaaaaggcctccggaacatttccnggaaggnaacgctactncggcttcnaaanttngggaaacttgtaacncaacatgtcctttaagaanttattttccttcatcaaggacattacggatatatcantaacaaaatcaagtgagtnaggaaatcttgactgttggcggcnttttgagtancnccaagnaanacgngtnttcccaaantttgtaaatnaaanaaangattnttcacaatccagtgcacattnaatttttagatttgattcgnag

SEQ ID NO: 83822 - DNA, 460 bp, Triticum aestivum
  unsure (1)..(460): unsure at all n locations
  Clone ID: PAT_TA_83822
ctcctaccctgccccgtctccggtccccccgcgccgtcggcgaggcagccggccgtcacagaagcccgatccggaccccgcgagaaatccttgttatacctgatggctatgattgatgagcctctttatccaattgctgtactgattgacgagctcaagaatgaagacatccagttgcgtctaaactccattagaagactttcaacaattgcacgggctcttgggagaagaaagaaccatgaangagctgattccttttcctaagtgaaaacaacgatgatgaagacnangtgcttcnttgcaatggctgaagaattgggtgtgttccattcccttatttgggtggtgntagaacatgtcaanttttgctcccaacctttggaganatnnttttcantgganggaacttnttnccgtgnaaancattgatcccggtccctnttggncaaaantnaaggaa

SEQ ID NO: 83823 - DNA, 597 bp, Triticum aestivum
  unsure (1)..(597): unsure at all n locations
  Clone ID: PAT_TA_83823
ctcttacnaaaccttgancttccnatgtgcttttnctggaaaataaaggnaaantggatgcnatnctttgttgtangttncncaagtanaatggcctcaaccgtgccngatccaataaacttcccggcaaacttgggtgtcccggatgtactttanctgggcttaacctggagatactcccaaaaggaaccactgactgggacttaaagggtgattcccaatggatgactttccctcccccaatttaatcccaaactggcaatgaaccatttacgnccctgttgncaacctgttttgatagctgttntttttcaagnccaagccctttggatcncctccccnatacaattctaaccaaggttcaaanaaaaggaccttgcaaaggtctttaagaaggttgcggtnaaagctggtanaaaangccccnccntggcaaggacccggaaacgnaattcntgtacaanaccccctaaagacaaggttgcccccaagttaaacccgacttgtctcggnaagggcttcattcacnacaaaaaaanttcnantccttttccntctnccgaggntatggaantttcaccattttgaccaaaaaaa

SEQ ID NO: 83824 - DNA, 300 bp, Triticum aestivum
  unsure (1)..(300): unsure at all n locations
  Clone ID: PAT_TA_83824
tgcaacggtgccgattcccaagatgtccattatactccacatgaaggacgggctcaaggtgagggtgcacaagagacaggacgatgcactaagtacaatctagagctacgtacctattcccaagctcccaagtctaatatactccatctgcatatagcgcctgaacatgtccaggttagctttattattgcatgtnccaaaataatcgcccagaaacgtgctcctattcacgttgcggtttgtctgattgggatgtnnaattttgtttcnatgttaatttctttccccggttaaaaaaaa

SEQ ID NO: 83825 - DNA, 675 bp, Triticum aestivum
  unsure (1)..(675): unsure at all n locations
  Clone ID: PAT_TA_83825
gttctaagcaaatttgtatgtgacatctctaattttcaaaataaacttctcttttgtgtgttcgtaccgctcgcagagcggtgaggggtggctaatattttccatgctagatgtgttattctcacgatgagtgtttattcacttgttattgcacgagagtaaggcaaaggtattagggatgcccatccccgaaatgaaaaatgaattactttacgttgtccaaataataaatgcttgaaagtgttgggtatggagggcaccctnggatacggttaaccatgggaaantgaaantatggtgggaaaaaaggaataactttatttcctgtttgggnaccgcctatgatatacctaccctggaaagtgtttggaaccctatccttttccttgggtgggaaaacatacctcccccaangttttaccccncatttttgctttnactcccngnacatctacaatccctacttcctccgcnaaagncttcctttacttggtcattttattccatttganccccnnatcccctataaacaccaacaagnggacnagatgtactgaatatgggtgtacnatacaatgtttnagaatgntaanatgacnagatggcagganactattncatgaatttaanaatgccctgtggaactatattagtncagcaacaacatttttacaa

SEQ ID NO: 83826 - DNA, 396 bp, Triticum aestivum
  unsure (1)..(396): unsure at all n locations
  Clone ID: PAT_TA_83826
caattaagcaaccattacgcagccacaacagcaacgcagcaagctaagctagagggagtagtggttgggataagagagaganagagatnaatgatgccggnaagngttggtagtgtggtgccgacnangacggtgttattggttggccgcgggncgtcgtccctgtgnagcgacgcccnncgctntatctcntcctggggttcgcnnnaatgatgntcctcatctcggtttcactggtcctnctcatgtgttcgcgcttnatngnctcttnctcttnntcntcgtccgggnatcggcggcnacnataagccgggntcggnttgntccattatgcnnctcgtncgnttncccttaaggtccttgttctnctggcggntcaacgccggtncctccttt

SEQ ID NO: 83827 - DNA, 436 bp, Triticum aestivum
  unsure (1)..(436): unsure at all n locations
  Clone ID: PAT_TA_83827
agcagcacccccacgcgcccgcgccgccgtcgcccacgcccaggcccgtgccgcgcatcatcgacaccacgcccttccccaccaccttcgtgcaggccgacaccgccagcttcaagcaggtcgtcnagaggctcaaccggctccgacacgccggccgccgcccaacaagcccgtnaaagagtaccccaacaacaacggcagcgggccaaagaacccggcttcaaactgtnacgaccccggtttnggnaagagcaacctccaaatgatttcccccgctgggatgggccgggnggcgccgcgccgccctgagcgcttnccccaagctgctccactttccgttccctgggctcccggagccccttaaacccgctgctgcccgacccctttaaacngtcccaaggcccggaggaagacnaaggaggcnccnacccccgca

SEQ ID NO: 83828 - DNA, 553 bp, Triticum aestivum
  unsure (1)..(553): unsure at all n locations
  Clone ID: PAT_TA_83828
gaccagtcccccggcaccagggccagcatccccattgtccaggttgatccttccttcgaaggcctggatggcggggccggtagcttggtcaagtggaaccccgtggccaacgtcgacggcaaggacatctggactttcctgcggaccatggacgtacctgtcaacaccctgcatgctcaagggctacgtgtccatcggggtgcgagccgtgcaccaaggccgtcctgcccggggcagcacgagcgtgaagcggttgntggttgggaaaggacgcccaagncaaaggagtgcggcctccaanaagggcaacattngacaaggacgcccaagccgcggcccccaagtccgcccaacggaacggtcctngcgggcgcccngaatcttcnanaccccgccgttggttccctcaacccgcaccgggatttaaaaactgctgcccctgganaacnccccaaccttggtccctggtgctgaccccccnggtgccttntgcaaagcaatggagcnccanntttaactggcaaanntgggggtccgggtnaaaggggcaaat

SEQ ID NO: 83829 - DNA, 496 bp, Triticum aestivum
  unsure (1)..(496): unsure at all n locations
  Clone ID: PAT_TA_83829
tggtacggccgctgaaagatcttatcgagtttccccggtttttcagttactctttggagcataggatagagcctcggcacaaggttctggtggccaacaggataaacatgaagctgcggtacatgctgcctgggttccgatgaggagtttgcgcaagagggtgcaagaggccgtcnaagaggagagcgagattccgaagccggagttgactactccgggagacatcangtgcgccccgaaacacccaagcggcaatggaaatggcgttagcagcaacaacaattaccatttccaagagtttnnaggcaagattaaagnnattacctttgccaagaaacaagaatccatgtcccttggcttgtacgtacatacttttacatgtttccacntttggtggttgggtgtgcccaactgtaacctaattgatcctttngggacnccaaatcccnnaaccaattcnacggggnttcctccgggaccaanccaacanaaatgc

SEQ ID NO: 83830 - DNA, 340 bp, Triticum aestivum
  unsure (1)..(340): unsure at all n locations
  Clone ID: PAT_TA_83830
cggccgccggccctccgtcgcattcaacacgtacgccatggcgcgcctgctccgcgccgccgccgtcctggcgctcctggccgtctccaccgccgcgctgtcggcgccggcgtggggcggggcggcgtgtccgccggcgacctggcccatctggggcgccgccgtcgtgatncggcgccngccggcgggcggggcgttccgncggcggtacaacgtgggcgaatgcattggagtactggactttgnttcnnaatggccaaggccgacgtcnccgggaatggccacagggcngaannaagcccnggtgtgnaaagggcngctcncggtnaatccggtacaa

SEQ ID NO: 83831 - DNA, 180 bp, Triticum aestivum
  Clone ID: PAT_TA_83831
ctgatgagtccccggtgcagatttgtagccttgcccagcggtttccggagctcaagactctcaggagctgcgacctgtctccggcaagctggatctccgtggcgtggtacccgatctaccggatcccgaacggggccaacgctgcgcgacctggacgcctgcttcctcacctacatccct

SEQ ID NO: 83832 - DNA, 341 bp, Triticum aestivum
  unsure (1)..(341): unsure at all n locations
  Clone ID: PAT_TA_83832
gcaatataatggtcttggaaaccctagatgattgggaagcagagtgtgagagagctcttggaggcatagcaggagaatataatctacatgctggttgggttgatggtctagttggagggagtcagtgattttatcttgttgctatctgtgtgtgtgtccgtacataagtatcctactgtcctacctaattaaaatacgtcctagatacattcatttnctgccgacaantaatccccgaacngagggantattatttagcacatgttttactactagtatgggatggtttggttttgtttaactgactgaactggcttgccgtaccatccattttgattttt

SEQ ID NO: 83833 - DNA, 558 bp, Triticum aestivum
  unsure (1)..(558): unsure at all n locations
  Clone ID: PAT_TA_83833
ccgaaacgattcataccattgaagaagggcaagcatagctttcctgccgacacccccagacttcgaggagtggnctttgacatggatggtaccctttgcnaacctnaaacgtaaatgtcnaaggaaatganaatgttttnaggaatnccaaaaacacaagacatacccaacaacatcgatactcccccctaanccagaacaagggactggtccttgatccnatacgcataattgacnccnaacccatgaagncccaaccctccaacaagtccggatgacccctgatggcgtactccaccccaatgcatccccaaagngatatcaccccaactttngatgtccccnttcnaaaccttaatggaaatttcccccaagtcccacttnaacccaancgtacccaacttcgtnnaaccaacctnaccctgcggtacctgcanacccccaanattgggcttaaacgggaacctgcaaggtgacccatgnctaacangggggngaccatnacaaatacccanggaaaagggggccngtacgtntgcctaaatnatnaaccacatg

SEQ ID NO: 83834 - DNA, 613 bp, Triticum aestivum
  unsure (1)..(613): unsure at all n locations
  Clone ID: PAT_TA_83834
cgacacaataattaatcagggctcatcatctcgcaatctctatctaggtcaaccatgacgaacggcttcctgtttcgggagtacatcggcgcgcagttcaccggcgtccagttcagcgacgtgcccatcaactccaagctcgccttcaacttcatcctcgccttcgccatccgactacacgccggtgaaccagcatcccacgccggcgcccaccaacggcgtttcaaccctttctggggacacngggaacctgtcccccggccgccgttgccgccatcnaagnccgcgcacccgaacgttgccgtcaatggcgggctccggcggcgacagcgttcaaggaatcgtcaagccttcttaaccccgactccatcaatcctgggtggcaaccctnacntcctcaagggatatcanactncggtcacggttcactcattagaatttcccncggctactnaacttctcatgnncggccnccnaccataagaaaagctggtacactcaangcctcangacntggcaaatcaaacgttgggaatancggtacanantaatcatnagtcgaaaacantccattntatnaacaatcgaaaccggaggcccatttagaaacgtt

SEQ ID NO: 83835 - DNA, 367 bp, Triticum aestivum
  unsure (1)..(367): unsure at all n locations
  Clone ID: PAT_TA_83835
gtcncgtcagaagcctgtgcatactanttctctctttgttggncgagatattcatantgatgcggttgtatggggaaagatttcaatgatagatgcaganaagatgctattagcaaatgcnctggnagacgcggataatcaattttttgtcttgctttcctgatagctgtgttccgcntcaatcattccgactatgtcgttanttacctggatggggaacaaacatcaatttcaattgattgtttccaaagttccctggtccacaattggaaatggaaggattccccttgggaatcttcccggnaattccnnggaaaaagnttcaaaanagggtgcccaatggtttgcaatcncnccaagaaagctt

SEQ ID NO: 83836 - DNA, 616 bp, Triticum aestivum
  unsure (1)..(616): unsure at all n locations
  Clone ID: PAT_TA_83836
ccggcgccggcggtggactgtatctcccaggccgccagcctgatcgactgcatcgactacgtccagaaggggagcagcgcgcgccgtccgtccgctgcctgctgcggcgaggtcaaagaccgcagtggccagccccgtcatccgtgggctgcctctgctccctcgccggctccaactccaagtaacctgggtttcccatcgacattaancgcctnctggcctcccccggcgcctttcgggcgtncnaacgccgcctttnacaaanncaaattttccngcttccccccaaacccgaanacctgcacctttcgcccccccgggggtcanccnancgttngcgccgcggatctttaacgcgcccccgccggggcactctcctcccnatgacgggaccgcccntttnntgccgttgcgtcccctgtcgcctactacgctgtactcctcctaggttccttctgctgctgtgcgtcnangtgatgactatccaantaagtgacnatcaatttactnttgacccgtnccctgcttttgctgtgaatccacgtgcgtgtctcanaccttactaaggggttttgacggttactgcccctctcacaccctcnnctantaaaaaaaa

SEQ ID NO: 83837 - DNA, 484 bp, Triticum aestivum
  Clone ID: PAT_TA_83837
cgcccacccgccgccgccgttcgccatgggcctcctcgactcgctgtaccgcgtggtgatgcgccgcaacgccgtctacgttaccttcgtcgtcgccggtgcctttgcgggcgagcgggttgtagactacggagttcacaagatctgggagatgaacaacctcgggaaaaggtacgaagacataccagttttggggcagaggccagccgaagaatgatatactttggtcgccatttagctccggtttaaccgtttcattttcgcacaataataagctgtgtaaacttcttactctgctgctgagagctgcttcccattcattttactctgaacatgctgtgagggaatttcgtggtgcatggctgaaatctgttatatagagcatatgcaaatacgtctagaggatcctctctctgccagttcgacattaccgtcactatctgcccttcaaaatgacaaaggttctacggctaaaaaaaaaaaa

SEQ ID NO: 83838 - DNA, 344 bp, Triticum aestivum
  unsure (1)..(344): unsure at all n locations
  Clone ID: PAT_TA_83838
aaacagcaaaccgactgactccagtccacacaaggcaaggcagacccgaatcgtcttcgtcgtcgttgttgcgaagagacatactagtggaggagtaggcggccatgtccaacgtgcccacctccctacgcgactcccccctcaccgtcttccgcctcgccatctccagctccgacccgtggcccttctcttcctgcctctaaccaccagccctccgatccncccttccccttgttcttccttgcaaccgagcagcgaccaaccaancaagcgacaccgatttgagantccaccgtttttggcgaccgtcatgccccggaaagcaccagcanacatnacgcggg

SEQ ID NO: 83839 - DNA, 591 bp, Triticum aestivum
  unsure (1)..(591): unsure at all n locations
  Clone ID: PAT_TA_83839
atgatgcgcgtgtatatatgcatgctcatcgtcctagatgtctgaccgggtaatacggcgcggtggcgaccacgcgggccggtggcgaggcggcggcggcgttggcgtccggggagagcgcgtgcaccagcgcgttgatgagctgcgtggagccggcgccgaacaccaagcgcttgccgtccacgactgcgttgcccgacggcctgttcacccgccggatttggtctcgantccacggattggaagaggcgtccntggtggcgttactcaanacgatccatcccgggcactacacgggctggcgcgcttccgcttccaattaggtccaagacacggcccccgtgcaccaacggcaacgtttcattataccgcgacgnatccatttacngccanaaatggaaaattnactgatgatgtcactggtacatcgcattcattngtttcggtttacatncgccttcaacacgattcatccaccaancccgtctcccganancctcaanaactccctgccgacattcttgnggaagctcgatctgccccnagncantacccatgcacacgaactganggcaagattttncagaacct

SEQ ID NO: 83840 - DNA, 625 bp, Triticum aestivum
  unsure (1)..(625): unsure at all n locations
  Clone ID: PAT_TA_83840
ggagacgcggccgcagccgaggtctgcataaaagcgcaaaagatctctcgctctcggctctcctcctctccccctcacccccggtgcgctgtctgtgtcccgtctccgcgagaccgcgagcaagttctgtcttcgtccgtccatccgtgcccggtcttactgttggcgctccttgattagcttacccccgccggcgagttcaccctgacatggtcggccggatggagcggcagaccgcgtcgtcgtcagcttcgtgctcctcctcctcctcttcctcctcggtctgcggcggcaagaagcgccctgatatcctcaacatgatccggaatgcagcctgtcttaattcgtcatctactgataccggcaagggaaggagtaaattgtcaaccaacaaattacacatggatccacctggtggaaggaantccggcatggcatggaagatacatgtggagatacaatattnaanaaccatancttgncnctcncaacttgangcattnagananaagngcaantactaaacaacttttacaacatatgaanacncctcggcatcnaaacataaaagatangncaaanatttcggaangaaattgcatgtaaaattnntttncagaggatt

SEQ ID NO: 83841 - DNA, 288 bp, Triticum aestivum
  Clone ID: PAT_TA_83841
agccgccggagcgccgcgccaccatgtaccggcttttccgccgcagcttctccatggctgccgagggttccgccgccgccgcctcttcctctccacccccctccacctccatgtcctcgaccccgcggcaacatctgccggacgagctgtaccgccgcatcatgaatgtcgggcgcccaagcatcccgttatcccccgtcctggagcaatggaatcaagaaggccataccgccaagaagttcgtcatccaggccatcgtcaagaagctcgtcggcctccgccgcttcg

SEQ ID NO: 83842 - DNA, 356 bp, Triticum aestivum
  unsure (1)..(356): unsure at all n locations
  Clone ID: PAT_TA_83842
cttctctcaagaacatggcaggggaaactgggaaaaggttgacatcgatggcatccaacatcatcactgatcttcaggaccgcatcctctaagcttaagttacagcaaagtaaacttttacgttgcttcagtggctggtcccgtcaaccgggtgacaaactggcctgccccgcagatctgtctaggagttcgagttcgtaggcgtctgaaaacttcctggcatatctgtctaggagttcggaagcatctgaaaaaagtgtaagctatttccttaatatgaaagcaggaaggattgccgctctcacgttagtccacgtcggcaagaaatctttcgccgttcgatnaaaaaaaaaaaa

SEQ ID NO: 83843 - DNA, 442 bp, Triticum aestivum
  unsure (1)..(442): unsure at all n locations
  Clone ID: PAT_TA_83843
aaaaataagagggtactcatggagagcatccacaagtcaaaggccgagaaggccagagagaagactctctcggatcagtttgaggccaagcgagccaagagcaaggcttcccgtgagagaaaatgaangggaagggaggagagattggctcaagggcccaagggaacctgcggcagcaccagtatcagctactgctccgtttgcagctgcaccaaagaaggcgaagaattgaaaaaggtggcttctattcctagncctaatttttgggcccccaatcctttttgctgttacatatcccaactttcaaatatccggtaatacatctancncctttttccaagtttggcatgtantaagtttttnccccaagtgtattttggacattttccanaaaccncttatgcttccggtgaaccattccggttttgccaaaaaaaaaaaa

SEQ ID NO: 83844 - DNA, 340 bp, Triticum aestivum
  Clone ID: PAT_TA_83844
agaatgtgagaacatgcaacctgagccatgagggagccgtcactttaagcgggcatagtaaatgtttctgaaataagacgcgtagccagcatcagtttgctccacttggaatcatttggccatgctcactctatcctttcgctagcctctatgaccggacctaaactggtgtgtgagaaacatccacgactgtcctcccaactgctttcctaaagccaaacgataacactctcaataattgtctatacgattgaagctgatttgattggtaattgtaaacagcttgtctttggatctttgaagtcaaacaaagtcagttggttgaatcaaaaaaaaaaaa

SEQ ID NO: 83845 - DNA, 376 bp, Triticum aestivum
  unsure (1)..(376): unsure at all n locations
  Clone ID: PAT_TA_83845
tgcaggtgctgtcaatggtcttggatcacggggtgccgccggacgtggtgaatcggcacaagcaggtgctggatcccgtcccatcgacgcttttttttctttctttcttcctttctttccgccctttgccgctcgcaaggatctctcgtgggctaccagcttcaaaaatctcacctattttttttcttaccctcttcaatcaaatcaacaaggtaaaaaatctcatctctctaccggcttgctatgcttgtttttctctgtccanacgccgctgatgctccgcggcgatcacngcaagaccgactgcgtnctgaactcctgcaggcnggcgccaatatcctcaagttcgancccancatnggcggaccgcctgaac

SEQ ID NO: 83846 - DNA, 493 bp, Triticum aestivum
  unsure (1)..(493): unsure at all n locations
  Clone ID: PAT_TA_83846
ataatttgggatattgccaggcaggatctaatgtaccatatgatgattcgatgaatttgcgcaatgtactttggttagcacctttgccatcaaaggagacaaaagcttggttagcaccaggagtactagttgtcttgggacgcacatcctgatggaattatctatcaagagatgatacgtgactatgttcaagattgttagaacagtatacgaagatgatcttgggggagaacacagttgatgtccaatancctgaatgttggcaaatgcactcccccgttagataaattacattttggtttgaanccatatgtaccgctatttgntttccccangggntgatttgattttgatttccngagaacccgactccangcacacctccatgtccaaccaaanattgtcccgttcccaagaccccggccggnattcacagttaattggttaaattnaaatgcccaacnaannacattntttnttnaaaaaaaaaaaa

SEQ ID NO: 83847 - DNA, 403 bp, Triticum aestivum
  unsure (1)..(403): unsure at all n locations
  Clone ID: PAT_TA_83847
gttggaagctctgaggtcgtccaaggccagaattaacggatgtgatgaccttgatgaaccggtacgcaagtgactaagaagaggatgctgttgatgcaggacattcgacaaactgccattttagttacttctaccgctacttgcaagttcaaacatgatgtccgttgccatccctctccttgttttacttttaacaaaaactttgggactgtaataactataagggcagtgattccagatggggaattganttgtaatttgggttaaaacctaaccgccactactggactggttggcactacttccntgtccaagaaataatgccctagctagatccctctaaattccgggcttgtttgtgaatcnatggattttgtgagttaaaatatgtaaaaaaaaaaaa

SEQ ID NO: 83848 - DNA, 379 bp, Triticum aestivum
  unsure (1)..(379): unsure at all n locations
  Clone ID: PAT_TA_83848
cgagaacaagatgcagtggatggaactgaaagccgccgagtctcctactgtgctatcacccaaccctccaaaaagaaggaacctgagcgcagcaggttccggcgacaaggctcaccagccgcctacacgttcagcgttcgccggatcttcaagagcacggatccttcccaaatacttacagccgtgcagcgcaggacggagtgatgtcgccccgatgaaccaatgccaagaacggcttnggaacagcaagacggacgccaaagactatccgacgcgaatttctggacgccggaagcgttgtgtccncaagcctgtctcaattggctgaancatcctcatcctcccgccggatgacgcacccccgacgacggacactggg

SEQ ID NO: 83849 - DNA, 631 bp, Triticum aestivum
  unsure (1)..(631): unsure at all n locations
  Clone ID: PAT_TA_83849
ggcaacaggagagtgcccacaacaatctacgtgcaaacttcatcaccccaccaagaagacaatcaaacctaagagaagcagaccagacaccccccaaaacagtagctggggacggtattttgacaccagcattagacatgacagcgagacaagcaaanttcctccaggccaaagatgacagacaagaaacagcaacatgatatttctcaaggtgggggactccactgactttatcacacttngacattngatggtgaagaaagcgtttgatcccctnggcagcatacagagtttngatncccccgacacatacagatgtttgatatgcccaacagcatacagatgttttatcccccaaacgnatacagcttatggactggnncccagggaacttttgacggagctgatattcttgatgcactanccaactccttcngtttattaaaacgnagatttacagctaacgcgctnnacttggccaaggaattcacattcaacaagnggctcaaaacttgtgcaaaacaaaccctcggtnatagggnaaattgntgcgatggactncaagggtccatttgcatcaantgggccactaccgcgcaaaaanaggtttaattttcgncccgnccnttaa

SEQ ID NO: 83850 - DNA, 236 bp, Triticum aestivum
  unsure (1)..(236): unsure at all n locations
  Clone ID: PAT_TA_83850
gttttttcttcttttctctcgcccataccggttcacttgacttaagccgagggactgcgggttgaacacataaaaagaaagggacatttctgtaaaattgatgacgacgtacgggccgaaacccaatctctttattatatatatatatataatatatatatataatataatatattaaggtaaagataaagatgatggtcccgttgccgantatgtttccctttaaaaaaaaaaaa

SEQ ID NO: 83851 - DNA, 608 bp, Triticum aestivum
  unsure (1)..(608): unsure at all n locations
  Clone ID: PAT_TA_83851
agtaacccaactgtttggttgacagaatgggctccagaacctcgtgatgtgtactgggataatttgtctattccatttgtctcccttacagttcgaaggctgataattgcagtggcattcttcttcctgaacttcttttatgtgttcccaatagcatttgttcagtctcttgcaaatcttgaagggattgagaaggcagcgccgtttctgaagcctctgattgaagagcatactattaaatcattcatccaaggtttccttccggggaattgctctgaagatcttccttatattgctcccaagcatattaatgtttaagtctaaggttgaaggattgacctcaatatcttcactggagagaagtttgcatcaaagtatatatttcatatcctcaatgtgttcctggnaacattatgcaggatcgctttaancantaaaaagtatatcatcatcagcaaatgaaatacaaggacatggtgaacaatccatgaagnaacttttatacatatcaatggtnatggttggctgggaacngtanaatnaattaancacaggattcactgaaaatttctgncagacnaaaaaaggaaagnatggcctgattggtt

SEQ ID NO: 83852 - DNA, 513 bp, Triticum aestivum
  unsure (1)..(513): unsure at all n locations
  Clone ID: PAT_TA_83852
ggtgagggttcttcccgagagcacgccgctcttgagccccgtcaccttggcggtcttgccatcattacccgatctttcgcccgtatccacgagaccaacctgaagaagcagggtatgcttcctcttaccttcaccgaccctgccgactacgacaagatccgacctgatgacaaggtccgatgtcctctgcactcaactccgctgttgggaancccttcccctttgttgtccacccgcccgacggcanccactttcgaattcctctncccanaccttcaacgagccanttnganggtcnaagacgtccgcccctgaaaccatggcaagcaccaagactaaagaggatgattaattnagaaacaattaattttggcaatacgctaaccnaagtcccatggtttccnaggaaaatnaaggttttaaangncgganttcnaaagtnacccaanctttanaatnttncaaggatacctgtttataatgtanaatcaatgtcaatnnaaaaaaaaaaaa

SEQ ID NO: 83853 - DNA, 479 bp, Triticum aestivum
  unsure (1)..(479): unsure at all n locations
  Clone ID: PAT_TA_83853
cgatcctcggctctctagccaggcagcaggagatggagcacgacgtgcaccaccagcaccagcaggccatggagctgccgccggggttccgattccaccccaccgacgaggagctcatcacgcactacctcgccaaggaaagggcgcccgacgcccgcttcgcccccgcgcgccctncggcgaaggccaactcaacaaagtnccaaccatgggaacttccatcccgggcgaacaanggccaaaaagnattgtaactcctcctgctnaaagaccgcaagttacccnacgggctnaagacaaaccgggcaacgaattccgataatggaaaggcaacggcaaaggcaaggaaattttcaagaacaaaggcctncttcggaataaaaaaacnccttctttnaaangggaagggcccaagggaaggaaaaacggttggtatccnattacncccaaaggaacanccaaaaaaacccncangcttt

SEQ ID NO: 83854 - DNA, 624 bp, Triticum aestivum
  unsure (1)..(624): unsure at all n locations
  Clone ID: PAT_TA_83854
agagccgccgccttacgtccagctgccacggtacttcatcgggccctttgccggtgcaggcggcgcagcacccaccgcaccaggattctgattgctcttcattaggctataaatggcaggaaggcaccgggcaccccgacaataccatgatgaacctccgaggataccgtngatggccaccacctccacttcccacgaccaaagacctctctcaccgcgtccccatggcaagaggaactgtcctaagcncctngctgaattccgttagaatcccatgaggacatcagcgtctgggcggatgaatttttatcctccaancaaccatgccgcgttttgccaaaaactcccgatctccaanccagctnttccnaagtcccnggcaaagaaaactcccancccagggacttactccaaaagaacctgaacctggactgactgcttccttanaccctcaagcaaagtctcatctcattttgaccantaatgaccccnagcaaatttntgcaagnaaggctncaaagactgaatcaaaatctgaaccagaaatacgcttgtactactnatcccgttcanaagccagcnggnaactnatttaaaagnaaccaactatgcagttagaaggna

SEQ ID NO: 83855 - DNA, 621 bp, Triticum aestivum
  unsure (1)..(621): unsure at all n locations
  Clone ID: PAT_TA_83855
cgcgcgcgcaggcnaaggccggttcggcggcctctcagatctcgccggccgccgtgagacagagaccgaagggggggttgaccggtgctcgggaggaagatgtttanccgggacgcaancagaagtgcaaggtgtgcaccaaagacggtgtacccgatggaccactctcccaccgacggcgtcctcctcccaccgtccctgcttcnaatngccaacactgcaatctaccctctcnactgacaaactatccctcccttcccaaggatgcccttactggcaaacccattttccnacaactgtttcaaaggaacccggganttacaacaaactttcccatccacanccacctgccaaattacccccggaaatttggcccctgactgaccaatttaccaaccaactgcaagatttttnccangaacacaacatttgcacttnttggnaacgctncccccttaaagtacatccaaaantcctacatancagctnnaatcccaacggggtgccnataaactcaactatcacctgggggactcacgaaaacattcccacttcagnnaggaactcacactatattcctctaancctgtacnacaaaacgcntnattcnctcncacatta

SEQ ID NO: 83856 - DNA, 620 bp, Triticum aestivum
  unsure (1)..(620): unsure at all n locations
  Clone ID: PAT_TA_83856
ttataaccacaccgcctagcgccactccccacgtcactcgctgtctgttgtagcaccgcaccagtcttcgccgccggtccgcgggcagatcaagagatggccacggcgatttacctctcctccccggcggcgccgtcgtcgtgtgcccgccagcggcggcagactaccagggcgaccgcgtcggcgacggaccgtccgcgcgaggtcgtgtccccgaagcgtcggctcccgctgcggaaggtgccgggcgactacgggccgccggtgctgggcgcgattcgcgaccggttcgagtacttctacgggcccggcggccgcgacgggttcttcactcccgcgtgcgcgcgcacggctccaccgtggtgcggtcaacatccgccgggccccttcgtggcgcgcgaaccgcgcgttgtggcgctcctcgacgccgcctcttcccggtgtcttcanaactcgctcgtcacaanacggactctnaanggaactcatccgtcaacgactnacggggtacgctgcctctactcnaccgcgagccaacacggcgtcaanannctctcactctngacgggaacatnatcaattccagntnaggacctcgcnatgaaaanccangtgangga

SEQ ID NO: 83857 - DNA, 628 bp, Triticum aestivum
  unsure (1)..(628): unsure at all n locations
  Clone ID: PAT_TA_83857
ggcaaaagatgtttgcagactcttcaatcttgaacctgacaaagtcatcatgtttgtcgagaacagaccttttaatgaccagaggtatttcttggacgatgagaagctcaagagccttggatgggctgagcgcaccccatgggaagaaggcttaaaaaagacaatggagtggtatgtagcaaattctgattattggggtgatgtttctggggccttactgcctcatccaaggacattgatgatgccagggtgcaaggggtctgaggagattaaaggaatactcagccggtttaataacattcaaacaaaggtcggttcaacatcagataatgctccanaaccgcatgccttcanttcntgatatatggcaggacangatgnntcggggacttctgggaaaatatgttanaagaanggattccatatgaatatggaaatngcncttncaanangttctcacnctccaaactcaaactttanncaaaaatntctnaanccgctgtntacggaagccatnttnatggtgtaatccanagcggaacatcgacatntgtngcccttaccacanttttnngaactgttttnnataacanccnggtgattttatcancacaccgaggnggncgtn

SEQ ID NO: 83858 - DNA, 600 bp, Triticum aestivum
  unsure (1)..(600): unsure at all n locations
  Clone ID: PAT_TA_83858
ccgatccatccaagccaagccaaggcagagaagaagaagaggaggaagaagaagcatcggcagcatgtcggaggggactgccaactgcgtggacatcctgatcgccatcatcctgcctccgctgggggtgttcctcaaagtacggggtgcggcacgattctggtntgctcctcctcaccttcctccngtacacccccggcatcatctacgccatctacgccatccaccaaagaacacctactanccacccttngcccgacgacattcattccctgtaccgtgtccnntcatatgcctgatccgacttnttctgtatgtattgcttattcatcctgttccctgttttaaaaaaagggggccccgtaccattcncctatatgancctataccccctcactggcncctttaaacntncntaacgggaacccgggtncccacttataccccttcanaaccccttttccaacgggcttataccaaaagcccacgttcctcccaaatttcacctnaagngaaggacccctttccggcataacccgngtntgngtacccactacgtaattcagccanccgccttcttttctctnncattgcggttnc

SEQ ID NO: 83859 - DNA, 554 bp, Triticum aestivum
  unsure (1)..(554): unsure at all n locations
  Clone ID: PAT_TA_83859
cagaatttcaagccaggctacacaatgcctcccaagaaaaccccggtggttgaaacggcggtcactatcagtgaacacgaggacatgcaacatttggaacctccggagggcttggttgacggtgcagattacaccaggtgctcctacgccgcaagttcaatgcgccacatgngtgccggtcgctggcgatcacgttcaaccattgtgacgctccgccatggcatccnggttgccagtnggcgacggctgaagcaagcagacactgcgcttcatctcctccacaatgtactttacttccntctgctggtacctgctgccgtctaccttgtccatgcgaatgattggcgtcctccaaaatgggcaanagcattaccgntncactgccggggnggaacaaagaagaatcatcaactatatgattatagcctgtcccaagaagagaccacctattattaaatcattaccatcatttaatatcctatggaagtgtnttaagggaaattnaaacngacacattgtaacttnanaaaataantggggaatgaacacacatt

SEQ ID NO: 83860 - DNA, 628 bp, Triticum aestivum
  unsure (1)..(628): unsure at all n locations
  Clone ID: PAT_TA_83860
ctcgcagctagctgacacggccgagaagcagcttgcattgcaggcgtagtacgtacccagcagcagctagcactagcagtccatcggagcgacgatggtgagaaaggacggtgctgggcggcgctgctggtggcgccgccctcncccggcngcgcgcgggcgcaactcaaaggagggtcctacgactactccctgcccaacaggcggagaagatttctccaagactacctttaagggcacatcccccnacncgcccgactnccctccaaccctntccggcaccactttcnacactgttcctcnaagggctgcgaccttcatnctgtcnaacccaaccggcgcaaccaagcggagaagacccgcgcccaacctacgctcgcgcttcggtttatcnaccgcatcaaagcctctcccanaagattcccccgcttgttccctgcnccnaatttccctngccgcccgcanccnttggntcatcggggccntcntgaccttccaacggaagcccaaggaccttcataaacagaaggctggcaattccngccacatgaantnacaatcctcatcctcaaaaannctaactcccaacntnggtncaggccaaattgatncatnanccttaaacctt

SEQ ID NO: 83861 - DNA, 622 bp, Triticum aestivum
  unsure (1)..(622): unsure at all n locations
  Clone ID: PAT_TA_83861
cgcacgccgacccgcagccgccgccgttcgccatgggtttcctcaacgcgctcnaccgtgtggtgatgcgccgcaacgccgttcnacgttnaccttcgtcctccgcnggcgccttncccgggcaagcggccgggttggactaacgggcgttcaacaaagattctgggggaagattgaaacaaaccctccggggaaaaagggtacgaaagacatatcggttttgggggcaagaaggccaagcctgaaggaatgataaattttgggtcaacaattttgcttcggttttgacccgtttcaatttgggcacaagttaataaaacgatgtaaacttacgctgctccctatgacctcccttctcaattcgtttactccgaaaaatgcttttgtggggatttcgtggtgcatgattgaaaccgttanggcttgttcggttactctcaatccaatccatgtggattgagtgggattggataattttgaatcccaaacaagtcaaactcttccaattttttcaatctatccaaccatatgtnttaggaataaccaacaagccttatttgacatcaatacaaatacttggggatcccttgtaccttcccgtccaatttgnaaaaaaaaaaaa

SEQ ID NO: 83862 - DNA, 668 bp, Triticum aestivum
  unsure (1)..(668): unsure at all n locations
  Clone ID: PAT_TA_83862
cgagtacccgacgcgctagctagttctattgccgcaccccagttctcnagnagggactctttcnttnagcnaactanactgcacgcaatggcnacnacggcaacngaggcggcgccggcgcaaggagcaagcaaggcaaacggaaanggcgaagcaagaaagaacccggaactccnaaggtccnggcaacaaagaagctngtcaaagaacgaacgaacctctaacaatnaatcctnggacaacaacctttnacccccgggaagcccggagaagatgaaaggantccgccgaagattaacggccaaagcaaccaatggaacctgatgacaactccggccgaacaaaggggaatttcctgaacatgctcatcaaagctaatcggcgccaagaagacatggagattngngtctanaccggctatccctcctcgcaacggngctcgcctcccggaggacgnacatnttggcatggacatcaaccgcgagaactacaactggctgcctgatcaaaaggcggntccccanaaattaattcgcaagtccgcctcccgtctcaanactcatccggggaaaaacaaggtctnnattctttntggacccaaaggaatactaanacaaaaggnctaactgnaacnggggccacggtaaaaaactttgaagnctttnccn

SEQ ID NO: 83863 - DNA, 524 bp, Triticum aestivum
  unsure (1)..(524): unsure at all n locations
  Clone ID: PAT_TA_83863
tatcctcaggggagttcttagggtgaaccagaagattgaagttcgccctggcattgttatgaaagatgagaatggaaacattaagtgcacgccaatctactcaaggattgtctcactcctatgctgagcaagaatgactccaatttgctgtccccaggagggttattgggtgttgggaacaaccatgggaccaactcctaacgcctngcttgatangctggnttggcanntccttgggtgaanttggtccactacctgatgttatgttagacctttaattcatttccttccctacccccggagctgttggtnttttaagacgaaaggtncagagaagcaggaaagtntcccaactccaccaagggcganatttctccatgccttacatagttcaatgttccaaaggcccctttanccccccntttaacattnttgccaactacactcaacggccttnttgcacaacccaggaaaaagtgccctacctcctntttaaaacatgggnccancccgatgggcatcaa

SEQ ID NO: 83864 - DNA, 382 bp, Triticum aestivum
  unsure (1)..(382): unsure at all n locations
  Clone ID: PAT_TA_83864
ctcaactgttcttcagctgctgttatcgcttcaggcccttgttctcaacgaaaaaccttacttcaacgaggcgggatacgacaaatttgtgggcaaggctgatggagagaagaactccatcacgtacaatgagaatgccttccttctgtcatgcaaatccatgatgtatgttttacgcaaacctccaaaagcattttgagacttggtcagggacatttcacctgcnggtgccccacacatcctgggatcctgcnangttatctttggggcgatttccttcggacacgngcacgacaaacatacttnncaagaggacgggaacaaaatgcccaaccggtttnaaaanaatgcttggaacttctgcccaacccttactgccttc

SEQ ID NO: 83865 - DNA, 536 bp, Triticum aestivum
  unsure (1)..(536): unsure at all n locations
  Clone ID: PAT_TA_83865
attttgtgtgctttcatcatcacaatgccatgatggaagagatcatgcagtccgtggttactttaacagaggaccagtatggtaattatgtaatccagcatgtcctgcagcatgggaaaccaagaagagcgttctacaataattacacaactcgctggacagatagtgaaaatgagccagcagaatttgctccaatgttgttgaaaatgtctacttttggtatcctgacaactcaatccgatcactgaatgcttgggacactgataaatnaccgttacaaggaatgatgaaacattcgcaacaagttgggcaaaggtccngnaaanttatnccaaaccnatanccttccccgtacaggccanttaagccctgaaaaaccctangaacaaccnggacntttaaactttgctcaggaaaggcattggccccccntgccganaggaaaactttaaggccaaaaccntnaaaacggaacnggcantttacatacattccggattnccccgnngtaangcccancttttaaanacccggga

SEQ ID NO: 83866 - DNA, 164 bp, Triticum aestivum
  Clone ID: PAT_TA_83866
tttgatttcttcgtctttagttactgcatagaaattaataagcccgatatagatagatatatgtcctagcgttcttgcccgatgccccgatcgatattgttcgttgttctttgtacgtactctgtatcattctaagagtttcagttactcctaaaaaaaaaaaa

SEQ ID NO: 83867 - DNA, 463 bp, Triticum aestivum
  unsure (1)..(463): unsure at all n locations
  Clone ID: PAT_TA_83867
cttggactataattgatgacgttgaatcattgaaggcttcgtctcaattttattcaagcctttgttgagggaagttgggcatgatctgtcagtgtgtgcaaagcgcgtaacttggacattgccgaggcccgctaaggtgcaagaatttcgtggatcataatagatgatttaggccccttctgcagatcaaccgccatgttatctatggccggcttgaaattgaacagcaccttgcacctgaccaacatccatcaacgagtatagtgctaattgggtaagaaaaataggttttgtcaatgcattaagtgattttcaaaacaaacacacatggtttattgttactttgccccaaagaaagttgatctcccaataggcgtataattgatggatgattttttggngaaaatattttgtactggganagtnaaagttccgggaactttacngacaaaaanaanaaaat

SEQ ID NO: 83868 - DNA, 540 bp, Triticum aestivum
  unsure (1)..(540): unsure at all n locations
  Clone ID: PAT_TA_83868
cgtctccgttgtctttgttgcagatcggtgctcctctcaccaccaggccgccacagctcgccggctttcccctccctgccatcgagcaccacctgagcaaacagagcaaggaaatagtttaagaatggctgcgcggagcagttctatggttgccgaggatgactacgagacggatcagaagaagcaagctgctgcagatgttctttttcnactattcacaattgttatggtttgcattgggtgaggatgtccgcctactgatctcnagttacatcttaatgaagaattttcaaggaatggcacttctcccnaaaggacctcnaacaagntgctgctcaacngtttccaattggggaacttctcccccngggacatnaagganttcagactatnnatacaacaggccaatgaaccggcgttttgatanccctccactttggaaaaggatttgcaangnatcattttgnaaaacgttcccttnaaaaacaacaccancaaacaaaaacntcaaattctttacgtcgnaatcatcggtncgga

SEQ ID NO: 83869 - DNA, 640 bp, Triticum aestivum
  unsure (1)..(640): unsure at all n locations
  Clone ID: PAT_TA_83869
gacggttagcatatttcattgagttgatggaggtgctaaaccctaattcaagtacagaggtaattgttcctgctccaagtcctgacaattatgaataccatgagaggtgaattttgttctgagctaattgcttacatgggggcatagttactatttcttcattacatcaattgttagggtgtatgttgtgataantcacttggatatattccttacatcctgagtgtgttgtgtcccccaattataaggaatcccaagagagtncatatattttggtatatgtgatggtccnactttaanccngtaccaacctatttccatttatttccataatcccttttctgcttgtgtttgccccnaaatngttccctccctacctggccccggngcnccttancanggcacccgnagggaaannggctaaatttcntnacctaccccaaancctcancaatgagcttccncaattcnccgaccccaaatctgggacccatttacncngacncaanatggttcaaacatccggaccnatggccacaaaacggacgaggaacgtcatncaatngaggaancccggggtttacaagccggtgaaaanttcagttctctcaaactgggaaggaanccantaggcncccnc

SEQ ID NO: 83870 - DNA, 290 bp, Triticum aestivum
  unsure (1)..(290): unsure at all n locations
  Clone ID: PAT_TA_83870
ttctcaaatgattcaacttcactttgtatttatataatcttgcagtatgcagtgtcagaccttgcgacctactaacagcaaggcgatgagaatttttaaaggaacctaatcatctcccgcgcttcctctggtcatctcatttttacttatgaggcctgtctgacttgattccgatctcagccgcgcctgcctgcgcccagccggcgagttagagcggaagagatcgcgggcggagancggagaanggaagggcatgccgacggcggccgcgagccgcaaacccggggggg

SEQ ID NO: 83871 - DNA, 585 bp, Triticum aestivum
  unsure (1)..(585): unsure at all n locations
  Clone ID: PAT_TA_83871
gtttttttttttttttttttgaaacaaacaaacaatgttctttactctgacaaccaattacaagcaatagtacaaacgcgacgccaaatcctctacgccaaattaaatcctgaacgtgtcacgtctgaatccccaaacgccgtgggtaacagagatagacgagccaagtctgtcacatggccgatatggcatagacggtgacagccgcgaatgctagcgccaggtcaccgcgccccggactgacccccgccggacgttaagaacggcgccgtcngctcgccttccattcaacgcantcctgcgctgcgtccctgnaccccgacaacgggcgccgctncccgggcccngagnctgcccaacaananattgactgccccccgggggtcttaactgcancctggggaactgaactgaancccttcnntcaatgnaaccacnngggaaanatccnntaaccnggcaaagnatnggcgttgaaaaccgggaactnaanacaaaggggggttanantgcccaannttaggaggtaaggtatactgctgaccgatgncaaccagccannccccgcagacncagaccancagg

SEQ ID NO: 83872 - DNA, 611 bp, Triticum aestivum
  unsure (1)..(611): unsure at all n locations
  Clone ID: PAT_TA_83872
attttatgaagcctgcgcccaattagacacanaaatacgttgtacatgttgcggacgagctgtaaatagttgctctcttttggtagctgatgaagtagctgatctgttgtatatatatattgtttcacgcccaaacagtacgggttttttctttgaaattcagaagcatatgtattaccacatcatgtntacccggatggccggatgccacagatcctcggtgtgtccgtagctttgctctggtcagcgagcacgcctaagtgtttttganagttgttttgccctcctgttgagaagtttggccaanaaaagngacaaaaaaaccnttngggggggccangtncccattcccctatatgganccgattacctccncactggcgnnntttaacacttgtgacggggaaaacctgngtgacccaangancgcttgnacaatcccctntcccactggntaaaacgaagagccgcacgatgcctcccaaaattccacctgatgggaaggacccccgtacggccataaccgnggttgcggtagccanttaccaaattcatgccgacgcnctcttcctntnatcntccgcntcgcggttcctaancnatcgggccct

SEQ ID NO: 83873 - DNA, 591 bp, Triticum aestivum
  unsure (1)..(591): unsure at all n locations
  Clone ID: PAT_TA_83873
caccagttataaatgcaggcagcctagccaagcagaagtcgcctgttcggcctgagacatcaacatcgaaagatgctgtgttctccagttcgacttttttgggacgttcaagcggatcgtcaaggcggcctgctgtatctagtagccgagagctaagcactgaagcggagcaaacacgtagccgcacaactgacgcgagcccaggggcattcccagaggtctgggantccacggtgggacccgcaagatgcctgatccctccggacggcangcttcctccttccnacnaggcncatcatctaacccccaagaactacgatcctaccattaagggcatgcaaggcctaacttnnatgggatgacaggtgcactattacatctcatcntcctgggagggtgacgctcccctccccaataatggtgtnccaaggacggcaaatataaangttgggttaatnaccccacatccggtgatcccctaagacgtgtttgctgtaacnccgttgttnanagntgcaatngttggtcnnnctacgtaaggcccctgtcgtnacannagggttataaaggntctagggtaaaaaaaaaaaa

SEQ ID NO: 83874 - DNA, 423 bp, Triticum aestivum
  unsure (1)..(423): unsure at all n locations
  Clone ID: PAT_TA_83874
ccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttccgccggcaagcagtccgaggacggtccgcaccctccgcccgactacaacattcaagaagganccacctccacttggtgtccgcctcccgcggtggcgcccaaagaagcgttagaagaaacgtacaccaaccccaagaaatttagcacaagcacaaaangtgactctccctnctgcatttctataagggggacgacccaactggcaagtaccccctccgcnaaggangccccaaacanat

SEQ ID NO: 83875 - DNA, 427 bp, Triticum aestivum
  unsure (1)..(427): unsure at all n locations
  Clone ID: PAT_TA_83875
ggaacgccttctgtcgcattcgattctttggagggcacactggcttcacggccagctggatgagaagctcaagtaggaggaacactgcaagaccgcgtctgcttatccaaggacaggtcacaggtatatcgcccaggacgcgattattagctagggtgagaacgtgttaattgttcgcttgtgcatggcatgactgcatgatgaaagatagatgcatgagctgcaccgagcaccaccaaatatagttaaccgcttccnaggtctagcatatggacggacttcaacgataaaatgctggctgtacctccnattcaacatgtttaatggtcacactacttcatccgcgccgcttttagggatgtcatggtgtttaatgtggancccctaaagngtttaaggggttatttgtaaaaancctaaacctctc

SEQ ID NO: 83876 - DNA, 416 bp, Triticum aestivum
  unsure (1)..(416): unsure at all n locations
  Clone ID: PAT_TA_83876
ggaagaggaggagcaaggagcacgacgcgatgggccactccaacgtgtggaactcgcaccctaagaactacggccctggctcccgcgtctgccgggtctgcgcgaaccctcacggtctgatcaggaagtacgggctcatgtgctgcaggcagtgcttccgcagcaacgccaaggacattggtttcatcaagtaccgtttgaagaggcactgtgctgctgtggaaactccctacatcaaaagaaatggnccttcattaagaagcctaatttatcgctttactttttgttcaaaacttngaaccatgtgttnaacccgacttgttaaatttttgatggtactttgtgcttggttngccaactatanccagaaattgaatttctcactccatgatgttttgtcctttaaaaaaaaaaaa

SEQ ID NO: 83877 - DNA, 684 bp, Triticum aestivum
  unsure (1)..(684): unsure at all n locations
  Clone ID: PAT_TA_83877
ggcgaagaccttggaccagtactatagcagagatgcctcccactgaatcactgatcgttgatcagtgttccaatagtttggcaagtgttgaataaattgaacagattggcttcatggccttttccctgtatttatgtgtagtcaggtccaatcttttctgttgatgagcgcaatttttccgtantgactccccggtcacggcaatattttgtgatattgttcatccgtggactatggttaaattccattatttgtttctttcaccttccaaaactgtttagcaaganatttctggaccaaggatgctcnaacacaactggctgtatgtanatttgtgaagggggaataaagaagggcaaaaactgctgcgaatatgtnaanaaaaaggggggggccccgtaccatttccccctatangagcctataccncnncacggcgtctttaaaactctnacggnaaacctggngttaccaactaacccctgcaaaaaccccttcgcaacggggtatacaagagcccacgttncctccaaantnccnacctaatgnaatgaccccctgtacgggataaccggggtgttgtgtanccactgccgntactncaccctagccgtcntnntttcctcttncattncggttncgaacnaangggncctnggtcatntttngcccccaaattttngg

SEQ ID NO: 83878 - DNA, 623 bp, Triticum aestivum
  unsure (1)..(623): unsure at all n locations
  Clone ID: PAT_TA_83878
gttttttcttcttttttggcttgtagtgtgtctaccacgtacgttttgtttgatttgacgagagtgatgtttgccaaagactacatatgaaacgattataatttgtatgtgattgtttcaacaactagaaagtatatgcttttgcctggaaatatatcggtgtggtcttcttacatgtataatgtattacaaaatgaggtaaaaaaaaactgaggtttgtatttgggtttgggttattcatccttaatttgtgcatttttgggctgatgtatgttaggcattttgggccgggtaaccaaatcctggaaaccacaacaggaagattttgaaacctgcatatataacctccacctcccaacgttccgnaacaaaccttgggacacatggatacacctccngaacaaccttggcacacactcctccccaactgtccaataatatttcaatcnaccctnccgttctgtccttgncctcaacaaacgacttgcggaacgcacatgacacacaacccaaggaaccaanactgcncaagataaataaatgatcaaangcctacattccggaanagttatttctcgatcggaacntaccgaaacaacagatncactgantgttcngcaaac

SEQ ID NO: 83879 - DNA, 670 bp, Triticum aestivum
  unsure (1)..(670): unsure at all n locations
  Clone ID: PAT_TA_83879
ctcgtgccgctttctgaggctcgcgaaccccgacaatggccgcaaccgcggtgtcggtcgacgagaagctcgacaagcttcgcgccgaggtcgccaaactcagccagatcagcgagaacgagaaggccgggttcatcagcctccgtgtcacgctacctcagttggggaaggcggagcaagttcgagtgggagcaagtncnagacccccgacccgatgaggtaatgggtgcccttacgataccctcaacgtcgcctccctgaagttntcccaaggagacgaaagaacttgctgggcaantcctttgtgctccaactcnaacnggaggctccnggacgaccatnggctgcaccngcccaattctntcatttaatcccgcatgggttnaattccttgaccttaatggngattcnaatcnanccccctggaanaaaattnggattaantcccttanttcnggagaccctttaaaacccntgtgacccaaaattttttgaatatccnacccaacatngatcaaattcaacanaaccattcnccatttnacngggatctgcaattcaacaanggaattggaagtggnggtccncagcaagggatnttccccttaaaatgaaaccaatntatggcnggagntattntctnaacaaaattgngaacaanantttacan

SEQ ID NO: 83880 - DNA, 629 bp, Triticum aestivum
  unsure (1)..(629): unsure at all n locations
  Clone ID: PAT_TA_83880
ccccgttcccgcaataaaggcctaccctacctgatttgctcgtgccctcgctcggcatcacacagattcccgcgtcccgccgtcggcgactcggcgtcctgctgattgcgtcgcgaggagtgctcgtagccgccctcctctctcagattcagtcgtcgcccatggcgaggaatccaggccgcaccgtcttcatcgattgctggtcatggcaaaccgtcttcaaatgacaataatcggtactgctcaacctgtacctcttcaaatgccaataacccagtaatgcctaagtcaaccctataccgtttgccaaaaccgatcaaatcatgcgttgtaatgatatgcctgtgcctcatatcccaacatatccgggtggtaaacnggaagattggaggtaanggtttccttcaatccttaaccctaaanggttccaaccngcaantttacgggtggccaattcaaaccatggnaaggttaacaacatactttgctnaaataggnaagatttggtcgttccgaaatgccaaaaagccgttataatgcttgccatagnncaaaancatattncaccagtgaaaaanttttttnatagagtcaaaggtttaaccantncgnatcagtgttnacccacc

SEQ ID NO: 83881 - DNA, 550 bp, Triticum aestivum
  unsure (1)..(550): unsure at all n locations
  Clone ID: PAT_TA_83881
gctggaagccggcaatggactccttgctcctagcgactgacgcccccatggctggggatggtgaaccttctgcggccgtggcagttgcgttggcgactccggcagaggaagggtctccccctgcttcgctggttggggaaggtgaaccttcctcggccgtggcagttgcattggcgactccggttgaggaaagattctccccctgcttcgctggatggggaaaggtgaatcttccgtggctgtggcattcgtttggcactcgttttaaggaaaggttctccccctgcttcgcatacccccttgctgcggcggttcnaaggtgccctgtctccggccgttgtccncngcaactgcaatggcaatcctaccaaggctanaatnnaactttataaatgccatgtcctgtaccntcaatcctcnaaatacacatcaagngcttaggaaaaattncgactanctctcntnaatatttcccctttcaatacccttanaaactccgattaatcactccggttcnaatttnaatnaccataatcacaatntaaaaaaa

SEQ ID NO: 83882 - DNA, 564 bp, Triticum aestivum
  unsure (1)..(564): unsure at all n locations
  Clone ID: PAT_TA_83882
tggcaaactcgagctgtctagtcctcggttcgcgaatcttccacagagaggcagacggcaggactcgcttcaagctcctcatctcgcgcagggggggtcgcctgagatcacagcgacaatggtgaaggcagttgctgtcctcgccggcactgatgtcaagggcaccatcttcttttcacagggagggggaatggtccgaccaccgtgactgggaagtatctctggcctcaaagccaagggctccatgggttccatgttcacgcgcttgggcgacaccaccaaacggctgcatgtccgactgggcacacttccaacctgtttggcaaggagcatggccaccgggaagattaggaccgcatccngtgatcttgggaatgtnacaacngagaaatgtgttgttaatgtccatattactgacaccaaaactcttgctgncccatccntatnggccacttttttncaatgctgntccggatactttgcaaaggggcattactttcaagacacngaatctggggactttncttgggacattggcccaaggtaaacngttacnccaggaaa

SEQ ID NO: 83883 - DNA, 381 bp, Triticum aestivum
  unsure (1)..(381): unsure at all n locations
  Clone ID: PAT_TA_83883
ctcgtgccnaggaagggtaacacattccnccgcctgnaaccantgnctatganatctgtttcctgcgctgccaagaaggatacggnggacaaggtttgtgaaattgtgaaaaagcagcttnctcttccngaccacactgaantttgtgcgtgaatcnaaattctctgaacttggtgcggattcgctgnacacggtnnanattgtgatgggccttgacgagcanctcgacattaacgntggaggagtccaacgcgcagacaattgcaccgttngaagaccccggtgaactcaattaaaagntttttnccgttgaagnataggcgatcncttcatcnatggctanacccaagtttcaatggcnaaacttttncccnacncgtt

SEQ ID NO: 83884 - DNA, 530 bp, Triticum aestivum
  unsure (1)..(530): unsure at all n locations
  Clone ID: PAT_TA_83884
aagaagttcaaggagttggttgaggagatagctgagtcgcttacaaagaacgagggcaaggaaggtgaagatggtggttccacggctggattgctggcgaagctcactgtgagcgagggcaaatctgagggaagtggcaagtctgagtccactgattctggcaaagtgactgaaaccaaagccgacacagccccagctgagtattgggtgtggttgcacttgcacgcaagatcccctgggtgctgaactatttgtcctgtccgcgtccaagtggaatttgggtccctttaccatggaatacgattgctacattttggggcccgggccgattnggaggancccaagtgttccgtcctggttgggccccggcttgatttgccnaaaactttggatccatgggggtnggaactttgaatgttanccccaatattnacgcatggttcttggtggtgccgnaatcataatggcccaaaattttattcctcaatcacatcanacacnatgattaaaaggatgccgtgggagaaaaa

SEQ ID NO: 83885 - DNA, 634 bp, Triticum aestivum
  unsure (1)..(634): unsure at all n locations
  Clone ID: PAT_TA_83885
ggagaactgtcctgaatagagcgattttgatgccacaaaacaaaatttccaggttatacataatttcatgacaccatgataaacgatatataaaagcggctacaagtattcaaggctaagtaagcttttggtgcaggcttcactaagtcctaacccagaaccgctgcccaaatgcttggaaatcccttgcctccaagcgttcatcatgtgccgcaaaccattcctcctttctcctaatgggaaccagntcctctcccttggaatgatttgctgcactccnaaanaaactttatcctttaactaaaaacttgtccaaganacttccttgcaagaagacgtgggcacagcgctgaccgcaacgaaggacattgtattttgttagangggtttgcaactaggnacatanactctttccatgcttctccncttcggttagatttcccccaaaaatgaataggaananattcaactgactccccnccctcaaggaaaatgccggggngngacnacttacgtnctaagattctaaggaccaaagctnagtaggggntcctaaanaagnctaaaggtcgncagaacatctctgaacangatatganggaaanccagtttggtagacancctctcgatantt

SEQ ID NO: 83886 - DNA, 634 bp, Triticum aestivum
  unsure (1)..(634): unsure at all n locations
  Clone ID: PAT_TA_83886
tcgagtttttttttttttttttttttaaatggcataaacatttctataatcgactcagggagtacatataggctacaaacacaagaaccacaacatctgcgtgcgtaggcagagactcaaaaggccagccctgtatgaaaattctaatgatacaatccttcaaggtgatcgaagaaggtatattccgtttattgggaactcaaattccgtaatgaaatgtgggccacgaataatgacaagccaactatgagtatgctccccccgtggatatcctcccccaccgcaaggcatttaagcttggtttccntgggcacggcaagcgctccccnggaacacctcccatgacaccaacctccttcaagacattttggctcccaccctaaactcccttgcctggggagtccggttccccnggcgggattacaagatgttcncngcatcncaacngttanaccnggttaacaatccttanatctcaacaattcaacaggggatcactggttcccaattaacggccatgtgttccttnacaccaatagcacaccattcggantaaaaacccatcgttccggtcggnataggtccaccaccnacatgattcaaaaggaactaagttactgccaagttaaccgat

SEQ ID NO: 83887 - DNA, 495 bp, Triticum aestivum
  unsure (1)..(495): unsure at all n locations
  Clone ID: PAT_TA_83887
ctctcacccacctcctcttcctctcccctcccgggatcacgaggcgacgccacccgcgagattgacgggagccgatagatctgcgcggctacgctacgcagtcacactgcgctcacctgacctgactccgctctgttcatgccgcggaggtagagtccgcgggccggcggtggccacggccagcctcctcggccgtcgggatgaaccgcggaggtcggctacggctacggctacggtaaggccgggtcaagcgccccgcggcgctgctgctgctgctgctgtctnctctggctcaacacctntcctcctgctctccaaggtcctcnanccgctgganccgcngcgggcgcggcggcggcggaanaaatttccgagngcaagcgagtccaaganggccctccgcccgggatccaagnccttctcttaacgncgaacgctcccgtcaatctcgggagctctcccgtaaagaggaagtctcanctcgtnanccggggg

SEQ ID NO: 83888 - DNA, 539 bp, Triticum aestivum
  unsure (1)..(539): unsure at all n locations
  Clone ID: PAT_TA_83888
tcgccgcctccgccgccgatgacgtccgtgcgcagctgtgccgcgtcgttaaccccgtcgatccgcgggatgtcggggctggtccggcaggaggcactgcggcgcgagctggacgggtgccagctgctggcgggcatctggtgccacgggttcacggtggcgcagctgcggagcatccgcgcgtcgctgcccgacgcggcgcggctggtggtggcgaagaactcggatggcnggcggcggtggcgggcaccggttaggaggcgctgaggccgtgcgcgcggggcatgaaccntggctgttcgtgcgctccgacgagattcccgccggcgctcaaccctaccgcgacttcaagaaggatgggagctgcagtcaacgacttcaccggcgccgtctacgaaggacggtctacggccnganactcgcgcaactcgagaaatccaacaaggcgcatctacaatactcctcggatgctgaaatcccgcgtcaagtctcgcgtctacggcgctcaagaggacgtcgcgaggcgaaaccgcccnccc

SEQ ID NO: 83889 - DNA, 285 bp, Triticum aestivum
  unsure (1)..(285): unsure at all n locations
  Clone ID: PAT_TA_83889
gagaaggcccgggagctgcgggcgcggatggcgcagacggagtccttccacgacgccatgtaccactccgccatcgcgtcgcgcctcgcacgctcctcctagggttggtgcgcgcgcggccagctcgccggtgggttgcgccgccgccgtagcccggtctctgtctggccgtctctgtgtacatatggtagatttgtcagtagctggctagctgctcccctggnaaaangggaagggggggaacgaaagagcaaggagatctggattttttttaaaaaaaaaaaa

SEQ ID NO: 83890 - DNA, 575 bp, Triticum aestivum
  unsure (1)..(575): unsure at all n locations
  Clone ID: PAT_TA_83890
caccatcggaggcaagcgactcaacgaccttggatccaacttctatgcacccactgtcatccgtgacatgacccctgagatggacatggcctcgcaagagacctttggacccgtcgctggtcttttcccctttgagacagaggaagaagttgtcaagatggccaacaacaccgaagtcggtcttgcaggctatttcttctcacgggatattgagcgtgtgcaccgtattgccgagtctcttgaggttgggcatggttgggtgtcaacactgggtattatttctgacgctgctgcgccgttcggtggtgttaangagagtgggttcggtcctngagggtccctgtatgggaattggagagtatcaagttacaaagatgatcacatatggagcatgggcaancccttcaatcataaactgaagangatggcaaacaatgcgcgatttatccgatatttatgaagaaagaacttcacatcaactagaacgatactctacacacacaagatactaccacaggtgggtaatcacaactagncaataaatgagacaactgtaaagtgccttcccttcgcaa

SEQ ID NO: 83891 - DNA, 678 bp, Triticum aestivum
  unsure (1)..(678): unsure at all n locations
  Clone ID: PAT_TA_83891
ctctttcacccccccctctctctccgccgcttcgctcccccgtctcggggcctgcctcggatgctcccggcctcgcatccgctgctctacgcctgcgtcttccgcgacacccacctcgtcgccgagctcgaccacgcccactcccactcccagagcaccgccacctccgccgaccccgtcgcttccgacgccccctcccccgcccctgacgacgacctcccggcgctcgccgctgcgctcgtcgccgccgctccgccgcaccaccgccacctcacacacacagccgccgggcgtgcgcacgcgctgctcctgtcccccgccgctcgcactcgccgccgtntcgcgggcgccccaactcccggnatcgcagtcctgtcttcctccgccgcctgcgatcctccccgaggccggatcgggaagaaatccgcgcctaacgctgcctgcaatccgcgggngacangcgccgagggaacaagtcccccgcggaggcagcggangaagaggcnccggaggacctgactacnggcgacanccaagaggacaactncacgggcggcggacactgactgagngaacttgtgnaactgngttcncccaanctttccgctgtcaanngcggatatgattgcgaaataaatcaagggggcattnaaaannggganttttcaanaanggaan

SEQ ID NO: 83892 - DNA, 649 bp, Triticum aestivum
  unsure (1)..(649): unsure at all n locations
  Clone ID: PAT_TA_83892
tgcctctgccatatctcaaagtggggtatttgactgctcctccagctaacaattccatcgcaccacacggggattgggaggtatcacagttcattttgaatcatgagggcctccagcaggctgatgcttctgaccagcctccatcgcaatcccctgggcatttggacaggggcagaaagcctgtcagaataaacgttgcagatattgtttcagtgtcagcatgtgccgatttaactttaccaagtggtgctggctctgtatagaaactattcatggtcctacttcttgggttgcccatagttgggaggtcttgacggctgggctagatccatacccttgtctacactattttgccaagaaggaagacgatttccttcccggtataatactggttaaatggcttctgcaaganggaagacgatgaactaccggtgttgttactgccactggagaagccgaattttggtgatcaactcagcctaacaattaatgcccctcaattgttagaancctccatcgtgatgtaatctccaaatataggtanacaacataatcggttgaacnctacttcattantgcganagtcctttttcttgaaatggcctntacgtttancattaacananttcgcatctaattgtaaattccn

SEQ ID NO: 83893 - DNA, 677 bp, Triticum aestivum
  unsure (1)..(677): unsure at all n locations
  Clone ID: PAT_TA_83893
cagaagatcacaaacctaacaggattgatgagcgaaagagaatagaaaatgctggtggtattgtcatttgggctggtacttggagggtangtggtgtattggcgatgtctcgtgcatttggcaatcgtttactgaagccatatgtggtggcggaacctgaaattcaggaagaacagttcagtgatgagctggaatgcctggttctcgctagtgacgggctttgggatgttgtggaaaatgaggaagccgtttcccttggcaaatcagangacacgccagagtctgcagctccggaaattgacagagatcgcttatctccgtgggcancgctgacaatatcacgtgtatcgtgggtcaatttcaccatgacaaaaccggatgaccatgtggcggcaattcagttgtacctgctcaagntatatatcctgcaancgggtggtgggctctccaaattangctcntgtacaactcaagaactctccatgatccttgttgcctgtaggaacattgtccacagtgtntagtattcatgggtaattcaataaacaagttcantanaaaanaaaaaacncagggggccgancaatccccaaataatcttanccccatgcgtcttnactcnanggaaccncttcactacnctgaaancccttcacgntanacaagcnacttcctnn

SEQ ID NO: 83894 - DNA, 442 bp, Triticum aestivum
  unsure (1)..(442): unsure at all n locations
  Clone ID: PAT_TA_83894
ctcatncncattcangannagcgccacncctctncgcttccannaagtcgaatcgagganntngctgttctgctgntaacaagttcctgntgtnactnggtctaccagtggcagccactgtgaactgtgctgacaacactggagccaanaanctttacatcatttctgtgaanggaatcaaggggcgccttaanaggcttccttcngcctgtgttggtgacatggttatggcaactgtgaagaanggaaagcctgaccttaggaanaaggtgatnccacctgtcattgtnaggcatcgcaancnatggcgcctaaangatggtgtctacatgtactttgnanncaatgctgtngtgantgtnaacccaatgggaganatgaaaggtctgcnatcannggaccatcggnaangagttnctgatctgtggcntangattgccag

SEQ ID NO: 83895 - DNA, 430 bp, Triticum aestivum
  unsure (1)..(430): unsure at all n locations
  Clone ID: PAT_TA_83895
agctanctagatctggcctgattcgccgatcgagcggtggtgagacngngtgcttcagctcaaagactgctantggtangctggtagctanctgtgtgcctgtgtgcagtgtgcactgccactgcatgcncggcgccttggacttaagacngnancacacgcacgcnatgaggcgtcngctgaagcgagcgctccggcngctccgcttcactcatcaggttcttgagccccggtaacgatgagcacgacccggccggaagacacncagcaactgatcaacaatgcccgccnctagccccaatcgcagcgcaccgtctgccgngcccanccatatgganaagggcaacggaacccccgcgtctcnttcacgcgtttcacaactctnattccacnatanggcatccaaggtgtgangganggnggngggtat

SEQ ID NO: 83896 - DNA, 666 bp, Triticum aestivum
  unsure (1)..(666): unsure at all n locations
  Clone ID: PAT_TA_83896
gtgctttgcttcattttgcttttcttccttttacttctttttcctccaaaaacaatcgaatcaagttcatcataagaaatggttcttatcaagagcttcgtgctgagcgcccttgctgccaccgtcgcagccaaatccgccgtcatcgaattacttccctccaatttcgacgatatcgttctcaagtccggcaaacctaccctcgtcgagttctttgctccgtggtgtggacactgcaagacgcttgctcctgtctgggaggatctagccaatactacgagtacgcaaaggacaagnccaaattgccaaagtcgacgcggacgctcaacgtgaactcggtaagcgatttggtatcaaggtttccctacccttaagtacttcgatggcaaganaacaacctcaaggattacaagtctggcgcgacntngaaacctgacaattcacgttgaaaagatgggtgaaaccaaagaagaacttaactgccaacgagtactactaacgatgcgaattccaaagcatgggggcanaacatgtcctcgcttacgctcgtgngtgnacgaaaacttcccactngaaaactncaaaatctacaaanagtcgttcaggtagcaanncaaaagatntagannggttatcacaataatgtccggaaaaggncaaangctg

SEQ ID NO: 83897 - DNA, 673 bp, Triticum aestivum
  unsure (1)..(673): unsure at all n locations
  Clone ID: PAT_TA_83897
gcgggttttggtcccgttactcggaggttcgaatccttccgtcccagattgtttctgatgaaacaaacggtgaaatcatatagtattccgtacgagacaaaagtttattaaagagaataatgatatcttattctttctcagaaaacataataaagtcttaagtccagtcaaattgactatctttattttcatgaaaaaatgggatctatcaagcacattcaggatatgcctctactataaaacacttagcatatttttttcttccttttggtattccgagttgaagaagtacgagaattctataactaccaaaaacttcaacctttcaatgggataagttttttaantaatatagtaatgttttgggactgaaaaaatatattactactangaattagatccaataataaattaattaactttttgggagtgatantaattatgaggagatcaacctctctccactcaagatgataaccgaggggggccggnacaatcgcctaaggatctatacccgccatgggcgtcnttaaagtctgacnggaaacctgngtaccacttatccctgagantccccttccacggngaaaacaaaggcccacattcctccaatnccactaaggaanganccccgncggataccggggtntgngaccacnacgtactcancanc

SEQ ID NO: 83898 - DNA, 438 bp, Triticum aestivum
  unsure (1)..(438): unsure at all n locations
  Clone ID: PAT_TA_83898
ctcgagtcggagaaggccgtcagcggcttccacgccgacaacatcgcccccgccatcctcggcggcttcgtcctcgtccgcagctacgacccctttcacctcgtcccgctttccttcccgccagcgctccgcctccacttcgtcctggtcacccccgacttcgaggcgcccacgagcaagatgcgcgccgcgctgcccaggcaggtcgacgtccagcagcacgtgcgcaactccagccaggcagcggcgctccgtggcggcggtgctgcanggggacgccgggctcatcggtccgcgatttctccgacgggcatcgtggacccaccaaggaaccctcatacctggcatggcggccgtaaaggcggcggcctgcaactggacgctgggtgcacattaacgggcgggcccacatggtggctcncagngaagagaggggag

SEQ ID NO: 83899 - DNA, 437 bp, Triticum aestivum
  Clone ID: PAT_TA_83899
tagggaggtggtcgacgcccgcatccagcgcctcaagcgtgccatggacctctccatgaagcaccagtacctcccggaggacctccaggcacagcaggttccattcagaggatatttgagtgacatgttggcgttggtgaaaaaggaaagcgccgagcgtcagtcactgggagcccttccactataccaagaggacacttccctagggtgctggatagacatggtcgcaagtattctacctctttaccgcaaatcaagaacgcatcaaataaaatgcagtgggatgaaactgttttttttgttccaaccaaatctaattttacttgttcaatgccatggtgcattaaccatgggtgtactgttgttttcaaccaatttgtcctcaaccattattaacctgtgaaacctcgatcgtgatgccgtttaaaaaaaaaaaa

SEQ ID NO: 83900 - DNA, 664 bp, Triticum aestivum
  unsure (1)..(664): unsure at all n locations
  Clone ID: PAT_TA_83900
tttcgctctctgttaattgaccaactttctctgtcatcctcgtcttccctcgccacaaaacaccatctgctctgctctgctctctccctctgtcttcccttcctccttcccaggaactccattgcactatttccaccccaagaacacagcacagagtcggatccgaatccacaggagaggcagaagcacaactcactccccactccctccacccatcagctagccatgggcaaggactgcggcaaacacggcgacgacgacctccggcgctcgtgcangcgcctgctagcatcctcgtggtcctcgcgctgaccgttggcgtcctcgcgctgattgtctacctggtgctccgcccaangcaccgngctctacctgcaagacgcntcctcnggnactggactctccaacgcaacaacaanacaanacannacctctctcaacgcgttcaagtgacctactcccaaccgaanacgctncgggtcnatacacgctcacttnccgtgtaaagtcaanactacgtggcgggtngtgcgccgntacaaggcacgggantngngtcggnccgtgctgcggtccaagttcctgngccactngcagnctcgcagatgcagnggtactctccagaagcaggcntcctgagncganggttcacaancccttgnng

SEQ ID NO: 83901 - DNA, 209 bp, Triticum aestivum
  Clone ID: PAT_TA_83901
cacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactccgagaccgaggtggtcaccgccaccggcgagggcgagtacgaa

SEQ ID NO: 83902 - DNA, 634 bp, Triticum aestivum
  unsure (1)..(634): unsure at all n locations
  Clone ID: PAT_TA_83902
caaggaccatgtggatagcaactacaagctcgcctatgatgggtttctctccaaggtgccgattcctcctggacaagtttatgctataaacgatgcgttgtcagctgaaggagcggcagacgactacgaagcgtgcctgaagcagcttgtcaagaacggtgtgatttctatgtcagcggcgactgggatttcccaggtttgatctccacttccggggaatggggacctgatggccacattgcgtctctcntccctgggcacctcctgttaacgagaaagaaagtggncacatacattaagatctccaaaancactccanagagaattacatcactttccaattaacaaccatccgcatacttncnatggtggtgactgggactgggaaaggcgcaacngtgcanaagngtctcagacaacaaactctcaaacctgctcctgttaaatgntgtgcacaagatggagaatcactggttactgataagggacggttctnctganaacaataaatcncatggaaccttgtcgtcaaccatttaccaaaataaagntatggcctctnaaactnatcncccagatttttacgaaaccatcttattatgngntaagtcaaacccatgntaaaaaaaaaaaa

SEQ ID NO: 83903 - DNA, 364 bp, Triticum aestivum
  unsure (1)..(364): unsure at all n locations
  Clone ID: PAT_TA_83903
ggccgttataacataattgcgcatagcgaatgacagggaaactacattcggtgcaacatcagtcccattcgagctcgtcaatgtcaatggacaggaacagcaaatcttccatcttatttcgcatgtggggtgtgctgttcacctctcctcaagctgccacacgagacaacactgtcggcatagataaaacacccatgctaggctgcctccttgtcttcctcacgctacacatttacagtcaggcgctcttgagaaactgagcatggtgcgcaatgtgatcgtccacgaacgtaccgatgaaatagtacnagtgggcatatccaagctgcatgcgcaaagtcaaagcaacccctgcgggcttgca

SEQ ID NO: 83904 - DNA, 290 bp, Triticum aestivum
  Clone ID: PAT_TA_83904
ggaggaggaggttgacgaaactggtgtcgaggccaaggatgtcgagctggtgatgactcaggcatctgtttcgaggcccagggcggtcaaggccctcaaagcttctaatggagacatcgtcaccgccattatggagctgactacttagtgttatttttgtcaaccacccctttcttttaagcatgtatcgtatgccatgcagcttgagcggatatctgtggacaacatgcttgcttagataattttatcatgcttgctttttctgtcaaggctatttgaaaaaaaaaaaa

SEQ ID NO: 83905 - DNA, 652 bp, Triticum aestivum
  unsure (1)..(652): unsure at all n locations
  Clone ID: PAT_TA_83905
tgacaccatagtacttcatggtatgttatattgcactgcctctcctcatgtcgaacatgattatgctgtccgtcccgagctcatctcaacgtaccctcgtcgagcggctctttggactcgtcggttatgaacaacggttctcctccgaccgcttccacccctcaccctacagacaacgccgaggtgttgtctcaaaaggcactgaaccaaggggaggtggcctgggggcgcctcacggcgacttccccggaccctgggtacaaagggagaaagntcctaacgggctccaagtttgggcccaancgggacaatgcaccggaactcccatggttgcggatcccggnaggcgtccccaattaaggggggcaacatccntcccgttcctccggtccaaccaaaagnaccggacantgctggaanattcnaacgcttcaacnatnaaaacacccactacataacgcggggtcaaaagntaatctgcaaaaatggctgaccnaactgcncaactccnanagcttgaggnaggataaatatagaatgnacccataaantaccccgagcncgttagatcaganaaactnatnaggttatataccagatcatcnantacanttagtagntncgtgcctccannngcagtctnnaaagcaaa

SEQ ID NO: 83906 - DNA, 408 bp, Triticum aestivum
  unsure (1)..(408): unsure at all n locations
  Clone ID: PAT_TA_83906
gtagactcctagcggcggaagggcttgagttggatacagatgaagatgaaaacaagacttttctggggtaacgcttttgatacttaccctaatttattctcttcctccattccagcaatcgttcaagatgcagtgacatcgagtgcacaaggcgaaacagttgggctcgtcggaaaccctgtaatctggagatgtgcgccaacaaatattggatcgaaataataactccccggggcgaaggttagcattttaccggagagcaagaaaggaaaggcaaatgaaggatgtntngagggtgttagtagggttgtaatatgattcaatccacaaatgaataaatttcgatgtaagtanggttgtaatatggtcaataaaaaatgatagttcccggtngcggcctcaattttt

SEQ ID NO: 83907 - DNA, 598 bp, Triticum aestivum
  unsure (1)..(598): unsure at all n locations
  Clone ID: PAT_TA_83907
tttttttctcaatccttgtcataaattattattatcaattgtaaccatgtgcactttcactctctttacatcatccagctctccaatcaacagtacacagatgaaaaccacacatgcaacaccacaacaaatttcacaataaacactgatctggtccggtctcaatggaatgaatgaatatatgtgcagccgccaggaccttgggcttgaggagatcacgcatgcacacccatctcgtctccctgggctctaatgtattattattattcaagaagtagcaggcttctgccccatcaagctggtcatgatcctccnggtcctatctgtgtccttcctgcaacaaccagatttggggattgtgaaacaacgaatggtcaatcagttgctcccgcggtctctcctcnataaattcctaaagatggggacactgccttccttcgggctcgtaccgtcanccgacnaggccgccctgctgggctnccgaggaggtgtcaaacanctgggaatcntgcaagtccgaacggagtgttnacaccgaagtacgcgctggcaatccccncctggtanatctcaganncatngtcagccagttagacta

SEQ ID NO: 83908 - DNA, 368 bp, Triticum aestivum
  unsure (1)..(368): unsure at all n locations
  Clone ID: PAT_TA_83908
aattcaaatagtgctacttctacaataaaccccaataaaaatcattttagaaataccaagctgatttcaaaatcatttctctccaattttctgatgtagggaatcattttaccctattttctatttattttatttttggagaaaaataatttgaataaaacccaaataactccaaattgaaaataatttcaaacagactttaaatttgatccttttaaacttccaactcgtatttcatatattttgaagaatcattttatcttctctcatgaaaacattgagtcgcttaaagttccaaatttgaaatatttcctaataaaatcaaacttttcaaaaaaaccttttcatttaattaaatgggaagaanc

SEQ ID NO: 83909 - DNA, 677 bp, Triticum aestivum
  unsure (1)..(677): unsure at all n locations
  Clone ID: PAT_TA_83909
ctgatcaattgttggctaccatttccatctgcaaaacaatgggagttggtgatcaatatcgcacacaggacagcagtagagagaaacccagatctgtacacagcgttgattgggatgggacaaaccctgttctcaaatagattgtttcccgaagccgcggtttgttttgaacatgctataccaaaggtctgttgtttacctcgggcgactttcatcatctggagacaataattaagaccaatgcctccgattgtgtagattcaagaagatgaccctcctccttgtgcttgcgtattttgggggcaagctttccgaacaagcgtcaggtagantaatgatacatccgggacttcgttttaaaaacacatttgggataacagtgaacaacataagcacgctttcngttccaatccaatgtaggggataatgagacggaataaaccctggagagattacagactcaaggaaccagaaaaccatcaacaaaagcgctactcaaaggatcctgcttggaagtatatattaagaaggcggantcgagggtgcaaatatcgcgatgntatgcntagtctcgtaagggtccaggaagcaggaggatggcattacaagcaagaantattcngcnaaaccatacangtaccacctttnttaaaacnccaatttctncangtggaaan

SEQ ID NO: 83910 - DNA, 668 bp, Triticum aestivum
  unsure (1)..(668): unsure at all n locations
  Clone ID: PAT_TA_83910
agccgcccctcacccgccgcctctccgcctcttcctcccctccccctcccatcgtgatcgcccccctcgacctctcccacctgccgccatacggcacttccacccgaccggcttgtagttggagagcgccgccacgagcggcaccgacgacgacgacatcgtgggcatctgcacggccgtgcacgggctgcacgcgtagcacaagccgcggcagctcggcgggctcgaccccagccgcaccttctcctcctcctccttcgccgccgccgctccgtcgtcgccctgctgccgcaccattgatccgttagcgtggcacaacattaactccggccaangcaaccacctggactgttgaaacaatcgctcacaggcancattatcagaactgttgntcaattanggnagaacttcttggatatgattattagaagatctgttaatcttgatgagcatataatccaagattagggtaaatggtggntcngagggtgggtatnaaccaatgtcagnagaattcncnagccaatttcgaacgantcaagaaaaagnaaaaacangggggccggancaatcccanagngtnttaggncaatggctcnttaagncgaggaaactggttcantancctgnaanccttcagngtaacaaagcnncttctccaatggagg

SEQ ID NO: 83911 - DNA, 151 bp, Triticum aestivum
  unsure (1)..(151): unsure at all n locations
  Clone ID: PAT_TA_83911
gtcttgaaaggggacagagagacatanantttagagncatctcnanaattcattgtttttatccncanangcccgctnttggctnatagtcnatgttaatcaaatgtcncnaaaagacttctaatccctctccagaggtatganccataag

SEQ ID NO: 83912 - DNA, 654 bp, Triticum aestivum
  unsure (1)..(654): unsure at all n locations
  Clone ID: PAT_TA_83912
attaaagatggctgaatcctttgttctcagtaccggctcgaggatcccatcggttgggcttggcgtatggcaaatacaacctgacgctgccaacgacgccatctacgctgctgtcaaggctgggtatcggcatattgactgtgcagcagcatacaacaatgaggaggaggtgggcctggctttgaagaaattatttgaagatggtgtggttaagcgtgatgatttgtttatcacctctaagctatgggctgctaatcatgcacctgaagatgtggaagagggaatcgacaccacacttcaagatttgcagcttgactacttgggacttgtacctcatccatggtccaatccgcatcaaaaaaaggaactaacacgatgaccctgaaaacttctccctacagatnccctgctacatgggcagcgatggagaattatacnatccggcaaaactcntgcaatccgcgtgatnactcncttgtaagaactcatgattgctnccgtncacaatgccccacatcaacaagtnantncaccggttggnacaagaaactcggaacttcaatcaaggngtcacttcgatccgcttagcactgatcctgataaggcattctaaaccatgggccgtcaaaatnnaaaacncatcccacggacang

SEQ ID NO: 83913 - DNA, 256 bp, Triticum aestivum
  unsure (1)..(256): unsure at all n locations
  Clone ID: PAT_TA_83913
ctggaagtggaccttctagccacgtcgtcgtcgccagcctccgaggggccgcattgcaaaatttttcgggtgaaagggaaaaaggttgctttgctttgctttgctttgcaacaccgggtgaagtttctccagtcagtccagtaggagggaaagcaagggaaacagaattcgaatcaaatgccggccgctgtaaatttttttccgtgtttaattgataatcgggnnnggggggaaanggnaaaggannaaggagaag

SEQ ID NO: 83914 - DNA, 641 bp, Triticum aestivum
  unsure (1)..(641): unsure at all n locations
  Clone ID: PAT_TA_83914
ctcctctccgcttcgctcatcagctgcgcctgcggcgtcgtcagccagcggcaagaaacaaaagcgccgcgataagtccgttcgttgaaggcaggcagccatgatccctaggacgtcctcggtctcggcggcggcggcgccctcgccgccggcgtggcaaagcgccagcagcagcgacggcatgttcccggccccgggtagctcggggcagcagcagctggccatcaagcaacggggtgctcctccgccgccgtcatcttcctcctcatggcctcgtcttcgtcttcctcctctacctctacgccaangctacctgggcgccaacccgctgctggcgccttcgtcgcctcctcgcgttcctcttcgttgccgcgtcccgctcccggaacgcggctgccgcctcgtcctgatcctcccngtaacgtctangtccccccggnggaaagacaggacccctggatncccgtntctnccaagtngcacgnaaaagtcggactcccaatgtccaaggtcaagtggatgatcnaattggtcatcaanaaatgccctcgcgcnccgtgggaatcaanctgcgcgagagctcggcccctgattncctttcacantcgtttggacaaaaggtncaacngctttcccccccc

SEQ ID NO: 83915 - DNA, 466 bp, Triticum aestivum
  unsure (1)..(466): unsure at all n locations
  Clone ID: PAT_TA_83915
ctctcccgacttttccttcccttcatcgcacgacgagtgacgacgaccatcccccaaccccacgccgcggagccgcaccaaatctcaccccgcatcctttagggttagggttctgcccgcacctgtgaattccgttgcgaaatctctcatctcctgagtcgagaatcgcagtttcccgctcggctcgtttggggaaatcggttattttcgtccggccgcgtgggctctctgaagcgtttgggctgtcggctatttgccccgagttttcaggtttgaaaaacgtcgtaatttgttcatcacgcggctgccgaactttaatgggtggtggaanttcngtgcctcggcgtggcccctgctccgatcctgatnacctgccgncccgcangctattacncaaggcgcccgggcggggtcttgctgtccgggnagcccgcgggnccctgttnaagcccnggtgtccgcaatt

SEQ ID NO: 83916 - DNA, 300 bp, Triticum aestivum
  unsure (1)..(300): unsure at all n locations
  Clone ID: PAT_TA_83916
gccaagtctagcacgtacaaggcggacggcgagacctgcaagatcacctacggctccggctcgatcgccgggttcttcagcgacgacgacgtgctggtcggggacctgaccgtcaaaaaccagaagttcatcgagacaacgcgcgaaagcagcataacgttcataatcggcaattcgacggcatcctcggtctccggataccccgagattccgtcggcaaggtcctccgatctggcagagcatgcaggcaaggagctgctggcggangactctctccttctggctaaccggacccgccgg

SEQ ID NO: 83917 - DNA, 492 bp, Triticum aestivum
  unsure (1)..(492): unsure at all n locations
  Clone ID: PAT_TA_83917
cggctatgccccagtgctggactgccatacctcccatattgctgtcaagtttgctgagctgattaccaagatcgacaggcgttctggcaaggagcttgagaaagagcccaagttcttgaagaacggcgatgctggtatggtgaagatgattcccaccaagcccatggtggtggagacattctcgcagtatcctccccttgggtaggtttgctgtccgcgacatgaggcagacagttgctgttggatcatcaagagtgtgggagaagaaggacccgaccggcgccaagttaccaagcactgccaaaaagaaatgatcaacctgtccgttaacctgtactgcttttgcaatacctgacttgtcacccatcccgaattttgtatccgttgttacnttattgtgtacgttaactccgctgcggctgcccgttgtttggnacctcaactccaacccactnncggtgtccttgtcnctacaatagcgnaaaatgaacc

SEQ ID NO: 83918 - DNA, 448 bp, Triticum aestivum
  unsure (1)..(448): unsure at all n locations
  Clone ID: PAT_TA_83918
gccacctccacttggccccgctcatcgcctcctccgacgaccaccgtccaccggcgacaaggacagcgacgatgcagtcggcggcgtggaggcgtcacctcctcgaccaccacctctccccttcaacctcggctgccatcgccgccttcagatccgcctcccagcccgggctcgctccccaagggttgtttggagcggatggcgcaagatgcatgtctgcgagggcgccggcggtcaaggggtccgggcatctcgtccgcaagggcaccggagggaagtcntctgtgagtggaattgtaccacgtgtttggactactgggttccttggggcgctaccttgtgcaacaacttgccaagatgggtcnaaatgcttgtccaattaaaaagttntnaagattcccccncaacttaaaattagggtaatttggcaaattgtgccaanaaaaca

SEQ ID NO: 83919 - DNA, 522 bp, Triticum aestivum
  unsure (1)..(522): unsure at all n locations
  Clone ID: PAT_TA_83919
gttggtctctctgctgccaggggggtacgggacgatggaggagctgctggagatgatcacctggtgccagctcgggatccatgacaaaccagttgggttgctgaacgtggacggctactacgaccccctgctcgccctgttcgagaaaggcgccgccgagggtttcatcagcaccgactgcagccagatattccgtctccggcgccaaccgcgagcgagctgctcacaaagatggagcaatacacgcgggtgcaccangaggtaccccagcgacgactgggagatttcggactccgctacggcannaggaggagacgccggngccgccacgccgccaagcaacaacaacaggagagcannaagaaggaaaagncgtcnttacaccanatcanctccctnagcttacttctcnactacgcttgctgattnataccctccgntacgttcccngcattttttcctcaatcactctccaaatccaaacccgtttacaagtccggnccggacttcggggaacacata

SEQ ID NO: 83920 - DNA, 660 bp, Triticum aestivum
  unsure (1)..(660): unsure at all n locations
  Clone ID: PAT_TA_83920
ctcgtgccgttttttttttttttttacgaatttggtctaaaactatttgtactctggagtctggaactaacaacgcaaaacatacattactcagctcatatgttcagacagtattggtccacagctctatgcttcaattgctgaactatttacatggcagattcgctcgcgtccgagtcccaacgaatcatcattcgccattaactagcgcagaagagcaggcagatacattcccctgaaccgcgcaccaagaacgtcaccggagaacaagtggacattcagccagcaccggagcacaacacgtcaacaccaaagtccaattcaacacgtnagancaagatatccaatgcatggtnnaccctgttctggcaacaggctggataacacgncgcaactcccaacgaacagggaccgtcatcaaggctgaggtgttcccggcactcaacgaagatccattcctgcttccctgtatccgcaccagccgtacaatgaacaatccgaagtccgaaacacaagacgtcatcanagatacgtatgacggatgcccgagttcccgcaataccagcgagncanaattcggtgtcanaacggaggttgncggtccgtccaagnccgtatcgggcagcgtnaatgtttcatgcacngggaagtccttcctcg

SEQ ID NO: 83921 - DNA, 264 bp, Triticum aestivum
  Clone ID: PAT_TA_83921
caggagttcatattttttatttagagagtcccttatttcgacatgttgacatgttgacatgttgtgatgttgtacactcttatttgtattttagtggagacctagaacactttgttgatagatatactgttaatatttgttgatagctatgtggcatggaaactacaacccatttgtgctatagaatagaggaacaaaaggttttgattgaattaatgaagtaaaagtttactttcaaaaataaaaaaacaaacaaaaaaaaac

SEQ ID NO: 83922 - DNA, 470 bp, Triticum aestivum
  unsure (1)..(470): unsure at all n locations
  Clone ID: PAT_TA_83922
tatcgccgcctccatttccaggacgcgtcgaattcctccatctaccgcgccggccgccgaggcccgagggggaggaggatgctgggcgccgcgaggaggcagcttggatccggtcccatgctgggacaggttttgcgaaggctccgcccggcggcggcggcggctgaggtggcgaggggctactccgctgcggcgaaggagatgactgtccgtgatgcattgaactctgcactgggatgaagagatgtctgctgatccttctgtttttctgatggggagaagagttggagagtatcaaaggtgcatacaagatttccnaagggcttgccttgacaattatggtcccgatagggtccttgacacacctatcaacagagctgggctttactggattggtgttggtcacttacaaggccttcggctgttaanaaatttaagacattnatttcccnatcangtaatgtnatata

SEQ ID NO: 83923 - DNA, 659 bp, Triticum aestivum
  unsure (1)..(659): unsure at all n locations
  Clone ID: PAT_TA_83923
tcgagttttttttttttttttttaaatataaattacaactatattttgtcacgcgacagacattgaaacttcgacaaacaacagcaaaatgcaagatgtacagagctttcctgtttctccttatttcttcnatactccaattgctttgaactggattgggtcataaacctatacatctatccatatcaaacagtcgatatgtnagcctggacaaatgtcataatgcattattcttaagcatggtctctcctcttttggaatcaatgacaacatcaatgctcntnggattgggctgatttttttccacgcgnganggtggcagagaccgactctcccgccttttcctccggtactccatagataggtattaagacatccaagacttccanatttnacaacctttacatgtnatgtagttgttttaacaccatncatgggccataagancaataaatggactccttgagttaccgggaaataagaanaaagtaatatgaagcatgggacttaagcagctacgnncgnaccatatcaactacaatgtggcagacaacacaaacatctnaaaatgcncaccatcatgtaccagagtggtaancaatntgtnaaacntanggaggngnattggtaaacanaantgggccatacacagaaanncg

SEQ ID NO: 83924 - DNA, 616 bp, Triticum aestivum
  unsure (1)..(616): unsure at all n locations
  Clone ID: PAT_TA_83924
cagagaaggataagcaaagtaggcacacgaatatttattaattaagagttttcgagactttattctccttttagttttgactctgggtccggtacaggttgacgcagaggatagggatgggaaaagaagccctagctttgggaaagaccggatcataacatgaatttcagggcatacttagtagatgcagatctagggactctttcttccccaagatgggggaatggggcaagccgttccgttgttggctcctgaaangcatttgctattccgaaagaactgaatccgggtgcaaatggggattccaaaatgatccttatgttccataacatgtgttcggactccacttgggaaataccttcccctaaaagagcaaggtcccacacatgaatcccctttttgaagntacctatttgattttatccatacttgggcaaaccacnngacatnccaccaccaggaagaaagagngaaccatattccttaagntaacccgagatactagtcaataacatggcnaatgcncatacccccctaatacnattggaatcccatcaaantaccacatgaggaataaatatagaccaggagccatncaggaggaaacaaacaggtt

SEQ ID NO: 83925 - DNA, 156 bp, Triticum aestivum
  unsure (1)..(156): unsure at all n locations
  Clone ID: PAT_TA_83925
ttgccggagaatngnaggggagnaaattaacccgggacncaatttgccgatnggaagcagcntcaattgccttgaaatgttgggggctcnttaacacatctcgcaaggggtnagcacttancccaaanggtgcnggactgcatgattctggggtaa

SEQ ID NO: 83926 - DNA, 647 bp, Triticum aestivum
  unsure (1)..(647): unsure at all n locations
  Clone ID: PAT_TA_83926
atcgcgcgcgagatctccgcgcaggtcgccaagaagcaccaggctctcccgccctccaagaaggtaccggagatcgagatcatcgaggtcgcggagaatgtctgcaacctaaagaagcaggaggcggattggatgcttcggatcgatatcgtcgagaaaggcgacaagctcgagcttgttgagcaagatgaggaagggcattgcaatgcagaatgcaagaccattgagcgtgcatgtcaggaggtgataggatatgctgataccgatgttgctgagtttgtatacaaaaataacccctccggtcgattaagcttatgaaattctcctgcaaagtctttcnaaaacattgccaaaggacccacgccatttccaaaaatngtgtccctgggggaacattngcaaggganccatcaaaagatgctgaatggaaaaatattgaatnaatggaggtatnccggagcccaaccatgaaaattncnccaaggacatntggtnaaaatacttggnactgaanacacacangaggatataanatagnnaaactccaagaattgggaagcctnaaaaanggcccaaanaaagntnaaaacaatctgacatnaggtcnacanattaanggantaaagntccgntgnaaaatgngaagg

SEQ ID NO: 83927 - DNA, 525 bp, Triticum aestivum
  unsure (1)..(525): unsure at all n locations
  Clone ID: PAT_TA_83927
ctcaaacatggaggggctgtgactactggtgatgtgaaggaaatctgcaaccatcttgccctagacaatcttcagaaacaacatacttgtctaaacacagatgagaagaacactgtgcaaggactcgtgactagttcttgtgagaccaatagtgcagctgatatccctgccaaggatatttcctccatttcaatcttgggtgtcccaggaactttggtggcttcaaggatgaacctatcctgtatctgtactaagatggaccgtttatatgtgataacaataggaggctactgtaccatcctgaaaatttcatcacttcatccccacaactttgtcaaggcccccctgatcngttatttcaacggcactncatgggaagttnccccgctggatcattnccccattccttgaaccctcaaggtttcnccaagntgagaaattnaatccacggactttaccaaaactggcatctccnagnacgnccaaaattcatataactgaccttgggcccattgcccaaaagtt

SEQ ID NO: 83928 - DNA, 638 bp, Triticum aestivum
  unsure (1)..(638): unsure at all n locations
  Clone ID: PAT_TA_83928
gctactcggcgcaccttggcttgctatttcgccaacaacctcctccctctttaccgcggcgtgccgcgtgcggcgggcgcggatggcaacggccacctccgcctccgcctccgcctccgcctcccccggcgcgttcggcgccaaaaccccagccccagcccgtgggctgagcacgcacccggtcctgaccccgagccccgcattcgcgaggccttcgccgcgcacccccgcctgcagcaggtcccgcgccagcctccacctcggcggcctgggctcgaccaagcagcagcagcgccgccgccgccgggaaacggaaccgggtccacgtgcccccacggtcgcgccgctcgccgtgcctaagatggcggccccatgaagaccataagactcctgtcttctaatgcgaagaatgcggactcgcgcanaagtgncccccgggacgatacatccaatncatcactcatggagaattcagangtaccnnctttaactcaatgccatanattctggaacattccttttggttcgttactcccaaggtcatattggcatatcgtnnaaaaccgcaaatgttaattcnnttaactaanccgtttcaacggantcgacnatgaaatagaattcacgttactncantt

SEQ ID NO: 83929 - DNA, 544 bp, Triticum aestivum
  unsure (1)..(544): unsure at all n locations
  Clone ID: PAT_TA_83929
agaaagcaaaggggaagggggagaataatctcggtttctagcacgcaaacacacggcacgagcagctgagcgcccatggcaggtccccggcgtctcctcctcctcctcctcctcccgctgctcgtgctcctcggcgcgcacccgccgcagtgcgggtccgcggagggaggggacgaaggtctccctggagctctactacgagtcgttgtgcccgtactgctcgcggttcatcgtcaaccgcctcgcggggatcttcgaggacgggctcatcgacgccgtccacctccggctcgtcccctacggcaacgcgcacgtcgcatccaacagcaagatntcctgccaacatggtccgtacgagtttctgctcaaaccgttgaacctncnccatcgaccctggcngatntggatgtncattcaactnatctatgcgttggaggactgtggnnaacggantacaaggacnggatcctctccagaacnggctnacncaaccgtntnaaatctacaaaacgacatggcacantcactcagtancaacaaacga

SEQ ID NO: 83930 - DNA, 537 bp, Triticum aestivum
  unsure (1)..(537): unsure at all n locations
  Clone ID: PAT_TA_83930
cacaggctcaccacaccaaccagcaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgtcccggagctgngcccggccggggccggcgttnaagcgcatctccggggctcatctacgaangagaccccgcggcgtgctccaaattttccctgggagaacgtcatcccgcgacgccgtcacctacactgagcacctcncccgtaagaccgtcaccgccatggcntctctacccgcttnaccccaggccttccctctacgnttccngggtagcctccgcccgccctcgcccttnctcggtctgtgttncctcattccaatttttgtgttggggaaatttccaaatacgttaacgcatnccgtatctcaatggttttntcccgaaaatttcatgcngtncncgggancaacatcccatttgtttaaaaacaan

SEQ ID NO: 83931 - DNA, 633 bp, Triticum aestivum
  unsure (1)..(633): unsure at all n locations
  Clone ID: PAT_TA_83931
ccagtccatccctaggatgacatccagtcctttattttccaacacaataagatttgcgtgaaacttcagtccttcgaactcaatgaccacattctgacagtaattctgagtaacttgctgaatcccaggggacttgatggtcatggatttctccaaaggaagcatcgaaaaattattttgcaaagcaaaacttttcgaaatgaaagagcgagaagctccagaatcaaacaaaaccattgcaggtattgtcntgacaggaaacgtaccgagtacgatatccggagcattttgtgcctcctctttgggttacatggttcaagatgacccttccctgtggttattgttggggattgaaanggttnnactnggggcgccaaattgttcccccgtttgttcggtttggggtnatcccttggctnggggactgtttggatatgcctncttctncanaagntaacaagtaaccccggggnatagggattccntgnccntgcangaatccngatgggcgtnaanatgggtagatngntgnccacctttgaaattgtcngctcggtgatgcacagatagcgggcctttngcnggggaactcagacgntnccattcaaanagggttgnccattttaanngaaa

SEQ ID NO: 83932 - DNA, 372 bp, Triticum aestivum
  unsure (1)..(372): unsure at all n locations
  Clone ID: PAT_TA_83932
gatttgatggccaagttctctgaaatcaaacaggtcaggctgctgacagctgagtttgtagttcaccctcaggccggctacaatacattggaggacttttgggatggtgaaatataaaagcatacaaatttgttcagaataaaagagccaggcgaggaaacaaccacaaaaaaggggagatcgaatgcataggccccaatacgatgaatttgggggtttacgtgattgctgaacacaagtattgtgtgactaatctgtgttttgatgtggtaaatgtaattgggttagtccacaataagagataagtgtcnttgccacaagactttgggtcattgggttgaagcatgatgtaaaccgttaaaggatatcatg

SEQ ID NO: 83933 - DNA, 612 bp, Triticum aestivum
  unsure (1)..(612): unsure at all n locations
  Clone ID: PAT_TA_83933
tgaccacccatggtgatcatcctgttattatacaggtgtgcgtgtcctcgcccaacacgggtgagtggagcgatccgtgccctggtcttgatcttggcgttgacgcattcatcatgccggtgccccctgtcgtcatccgagatagatgcagtttacttgatgcatgcatgcgcgtggtgagcatcatcacattacaggaattctcaagtacgacttgggctctaattgcttatcgctgattgacatgccgctgccgggggctgtcaatgttatagaagatatgttatgtgggaacaagatatggaaagagacaaaaatccttgctttggatccctacatgatttcccacanccacaagaaaggatgacccccggaaagtgaacaccggtaacatatggttgaatatctttaactcaaggaggcactatcanccaataggaaagatgactactgtgattnaccgttcattatcataacttttatgcatggtgctgtatccatatgcgttccttgggcataactgataatcccgtgtgttgagtgttaacaggaatgatgcttgtataactcaantctnacacacaagtcttctgtaacgctaaaaaaaaaaaa

SEQ ID NO: 83934 - DNA, 418 bp, Triticum aestivum
  unsure (1)..(418): unsure at all n locations
  Clone ID: PAT_TA_83934
cttcaatccactagctaagcgcgccatggcaaagttcgctcttggtcaccaccgcgaggcctccgacgccggctgcgtccgtgccgtcctcgccgagctcatcctcaccttcctcttcgtcttcgccggcgttggctccgccatggcaacagggaagctggccggcggcggcggggacacggtantgggcctgacggcggtggcgctggcgcacacgctggtgggtggccgtcatggtgtcaagcggggctgcacntctccnggcggcacatcaacccggccgtnacgctgggcctcgccgccacgggcgcatcangctttccgctccgggctctactttgccgccaactgtcgntcaaagctcgcctgcctctcctggctttctcgnattgccaaaacggcttccctncacccctgg

SEQ ID NO: 83935 - DNA, 292 bp, Triticum aestivum
  unsure (1)..(292): unsure at all n locations
  Clone ID: PAT_TA_83935
ggagtcctgtgggtaaaaaataaaaggtaaaaaaaagaacgacacacttgagagcccctggtgtggttaagccatagtctgggcttatcgtggtcgtgcccctctccccatgcccatggtatcttcagagtgtaatggtgtacgcgaaggacctgctttgattgcaangggggccttggggtttggggccgcactgctatgcatgctccggaacgtgccaggtggcttgttgtagttactcccgggcgcgcttactgtgtccaccttaancggcgccccaaaaggggggggg

SEQ ID NO: 83936 - DNA, 375 bp, Triticum aestivum
  unsure (1)..(375): unsure at all n locations
  Clone ID: PAT_TA_83936
gatacnccatcacnggaaanatctatgtcnacacncccttcngcaanatcannctgcccataancaaanagggtggaaccacccgcctcagatatgnaggatgacgaggactnngacgatcacaactgaggttgangnctgctgnggggcgccgctgttgcctttcacgaaacgcacacgaaacataatatgccagggatcgttcatctacctggatacccacactcttaacnntgggntaatctcttgcctttagcttagngttcccatgttgntttgcattntctgacacntccacncacntcctgactgttgtttcactttnnganttcctgtgtngnccatctgantctttaaantttcntgttgnatctg

SEQ ID NO: 83937 - DNA, 371 bp, Triticum aestivum
  unsure (1)..(371): unsure at all n locations
  Clone ID: PAT_TA_83937
ctcgtctgcaaatctgcaatggctagcatcagcagtcttgcagcacttagcctcttccttctcgtgagcgttggattaagcgacgccatccgggtggccagatactccagctctcaaggagcgccagggaaaggggggaatggtggggcgtatcagaacggctcaggttcaggggttgggctcggttcgggatccggtgagagcggtgcggacggcgtctacgtgagtgccggaggcggtggtgaagggcggtggctggtcacagtacggtggtactgcttttggtggcgggtctggtacggggtccagttccagccagtatagctcgggatnatctttcggtaatggcgggtctactcttgccgggggat

SEQ ID NO: 83938 - DNA, 336 bp, Triticum aestivum
  unsure (1)..(336): unsure at all n locations
  Clone ID: PAT_TA_83938
cgacgcctggctcaaggacatgcccgcggtcgcctaatcccacccccctcacccatggattggattccgggaaggaagaggagagaagctggttgaccgttctttattacagtttgtttttgcaggctacgctaccgattttctcttgtgtcaggcataaaaaaaggttggacgggctgctagtattccctgctgtttgggtgttttcgtatcggaggacgtctgtagatgtacaatcctnaggcccttgtgttcggctttaggaatttccgttgtaccctggacctgctataccggttgattcttcaattgtattccctaaaattactacacann

SEQ ID NO: 83939 - DNA, 642 bp, Triticum aestivum
  unsure (1)..(642): unsure at all n locations
  Clone ID: PAT_TA_83939
cttgaagtggatgagtacagtgaactgggaaacctttcctcagaagtatcagcaatatatcttgctatgcagcagtctaagttggagtgcattgatgaacagagtcaagattctacctcaacagaaggttatggtgaagctgaggagactgaagagtatgatgattttgacccctactcctttatcaaagatttacctgatttatctatggtggtccccaagtttcgtcctgttctccttccaaagcagacccggagttgtcctacgatgaccttgtacttgatcttggatgagacactggtacattcaactcttgaacactgtgaaggatgctgattcaatttcaantcnattttaacttcagagaccacacatatatgttccaagccgccccnactcaanggattctggganaggttgcaacgtgtttganacattatttcacngcnntcaaagcatttatcnggnaactccaatgtctgatccaaaanaatttccctcacggttacctgaactgtgtcaagtggaggaacacnaggtngaatctgnctactaccctaagatgtgaaatccccagcttggtcattggaangatcaaaaacggttggtcanaaggncgnaatgcctcaaactgcggtaant

SEQ ID NO: 83940 - DNA, 613 bp, Triticum aestivum
  unsure (1)..(613): unsure at all n locations
  Clone ID: PAT_TA_83940
cctcaatcatgcatactatgcaaagaatcaggagcatcgtgctgatcacttagggtttcacaaagccttatgtgttcttatgggttggaattattccgtagcccctgttcacaaaaccgcttaccaagcattatcaactgtcgacgctgaagccaatcaaggagaccttatcttatggccaccaacagttataattgagaacacatacaagtcaaagaatgatggagaaaaggatgtcatgagtgataaagaggtggagagcaagcttagagaaatgggctttgccggtgtcaatgtgcagccgctcctggggaaaggacgggcagaggtcggtgcaagctaattctccgccagcctcgatggtctgaacaacgcgtcacggctcgccgattgttcgagcgccaaggcacgggcgaacacctgggctcgcgtccgggagcgcctcccacaagcgtgggggcataacaacccatgctgtcaagtggtggnagggaancgacatgggtctctacggtacctgcacgnatgggactnattctgaccnatcaacaaaccatgtaagacagaggacggattaatnagccactatactgncgcaaatggattacgacat

SEQ ID NO: 83941 - DNA, 561 bp, Triticum aestivum
  unsure (1)..(561): unsure at all n locations
  Clone ID: PAT_TA_83941
gttttttttttttttttttcggaacaacaacacaacatacagggtaaatcagatggcgaaaccgaacgcgtgccaacagctaacgagaacaggattgcgcgcaggcatatgcatcagctagcaagacaagaggatgctaataatcttaatctcatgtgtgtgttgtgtgattgtgtcatctctctcccgcttgtcagcgtacgtacgtgccaccgctaagaaggcaggaactacttggccgtatgactcggagctgtttgttacatcgcaaaggaacctgcacctgccaatgccgccgccaagcagcgtgagcactgaaacagacacgtagtggtggcggcggcggncngctgcngcnaaggtaaaatggtccnggcccagntcngtctcccnangggcatttcggaggcggnaanacggttcccttgggtgnnttgnggatnanaaaccgcctanancaangggggccgtaccaatcncctataggatnctattcgcncgncacngcgncgttaaaannctacgggaaacctggnttaccactaaccctncanaaccctt

SEQ ID NO: 83942 - DNA, 452 bp, Triticum aestivum
  unsure (1)..(452): unsure at all n locations
  Clone ID: PAT_TA_83942
cgtacgatggcggacaccggtgacgtcgccgccgccgccgaggcctcggcgcgaccggcgggcagcagcagcacccagccgctggcggggcgcgtggcgatcgtgacgggcgcgtcgcggggcatcggccgcgccatcgccacgcacctgtcctccctcggcgcgagcctgggtgctgggctacgcggcgcgcgccgacgaaggcgggcgcgcctggcggcgtcgctcccgcgcgcggttggcgtnccgggcggacgtctccngacgaagccggcgtcggtcntcttccgacgccgcggacgaggcttccgcgggcgcgcaatcctggtggcaacgccggggtgctggacacactacccgccgtntgccgccaacggcaccgaggcnttnacagngtgtctcccttaaacttcgnggncttcctgttcctcccgggaggggcaacgctcccc

SEQ ID NO: 83943 - DNA, 592 bp, Triticum aestivum
  unsure (1)..(592): unsure at all n locations
  Clone ID: PAT_TA_83943
gcaggcatgagcagggtaaagcctacactcaaaaaatgtttttgtgctacttctactactttggacccaggccactgccctactagctcaactcccaggcccatctacaaatgcatagctcaaatgcgcagagataaataatgatggcgttcaatagatccatccacggatagctaattgcttgggtacctccactcctgggcatataagtaaggagaaactaaccttattccacgttgctacgtntgctttaatggacaatatatatatatatatatatatatatatatatatatatatatatatatatatatatataacatgttanagttaaaaaagcgatgcacaatgttcacctccttttnggaaccatgtcnatttccaacatgattgggttggttggtagcatccccngcnattggtgtcnanagggggggaacaaattntaagcttttggaatggncccnagtatgccccccgttaaggggttcctccattggacacccggggattttaaacggnagntgaccaggcanaaaacacttaccnatggatcaanacacncantgatgctaaaantacnaagtgcagt

SEQ ID NO: 83944 - DNA, 498 bp, Triticum aestivum
  unsure (1)..(498): unsure at all n locations
  Clone ID: PAT_TA_83944
gctgccactctttcccaaccacttacttagctagctagcagccatggccgccctctcctctgcagcggtgtccgtcccttccttcgccgccaaggctgccacccccatgcgcagcagcaggatggtggtgcgcgcctccctgggcaagaaaggcggcgagcgccgcggtcccccgtngcggccagcgcgatgctgctgggccggtccngcgaatggcgcaagacttctcccttgggcgccaaacggcggcttctgggttttncagccccaacgatttaagcgtcaattcccggngaaacatcaccttnaaagaanacccggttcccgcaaacttgtgttncacaaagacccttcccttccgggttgactttccaaatttcccaagangattctcaagccccaagnaaactttaataactnaagttcccngaactaaggttntaatggnacccaacccngggccgaatgtcgnaaagcncctnaaaaaactatttcaaa

SEQ ID NO: 83945 - DNA, 645 bp, Triticum aestivum
  unsure (1)..(645): unsure at all n locations
  Clone ID: PAT_TA_83945
gtacaattacctcatcaagtttctactttcctcccactcacttctttcgagagaaactccttctctagaaaatttccgaatttagcaacaaaagtttttgccttcggatctgtgatagaaggtatacccaacagctcctttgggtatcctatgaagacacatttctcccgatttgggattccganttatcaggttgaagttcctccacataancatccgcaanccccaaacttttaaagaaacgactactttgggttccctgcccaaaccacanttcaagaagcgtccncctccaacggtttttgatggggcccctatttaacgtnnaagcactgtccccaaatgcatacccccccaaacgattaangggnaatttnggnaagaacaccatagatttgccactataccaataaanacggttatgactttcggnacacattagcngggggtcccaaatnggatattttgggaacatccaatgtttaaacngaaggaacccanggggggccggtccaatcgcccaaaatgatctatacccgccacggcgtcnttaaactccgacgggaaaaccgngttncaantaaccctgagaaaacccttccacnggaaacaaggcccccnttccttcaattncacnatgaangn

SEQ ID NO: 83946 - DNA, 546 bp, Triticum aestivum
  unsure (1)..(546): unsure at all n locations
  Clone ID: PAT_TA_83946
cggacgtgctcgcctctcctctcctcacatttccggctcccctctccgcattccatggcaccgcattaccggtatttttagccgccggaggagacgggttgtgtagagagaggggaaaccagagctcctgactgttcctctctccctcctcacgggcgggctccgtctgttccgtccatccaccgccccggtcgtctcccggccagatccctctcctgcaaggtttctttgcgagtgggccggagaagatgatgggcggntcctctccaaggtcctcctgctggttttggctatcctacctgcctatgaagctacaagacgtttgaactgaacaaaccacagattgacactcatatttggtgtcaanaatggttttattgccccgtttaattttggganaatttggaattttacaatatcaaggtacgttttacccanaacaaagngttttccttggnaattggggnaccctaagacaaaggaanactntttaangacttcttaaccatatttccancatnnatgaatcacgaatctctggccaac

SEQ ID NO: 83947 - DNA, 498 bp, Triticum aestivum
  unsure (1)..(498): unsure at all n locations
  Clone ID: PAT_TA_83947
cgcctctctctctctctctctctctctctctctctctctctctctctctctctctctcggccgccggccctccgtcgcattcaacacgtacgccatggcgcgcctgctccgcgccgccgccgtcctggcgctcctggccgtctccaccgccgcgctgtcggcgccggcgtgggcgggcggcgtgtccgccggcgacctggcccatctgggcgccgccgtcgtgatccngcgcggcggcgggcgggcgtgccgcggcggtacgacggtgggcgagtgcatggagtactggacgttggacgccgagggcgaaggcgactcgccggcatggccacgggcggnaacaagcgccgggtgctgcaaggnggtccggctaatcggntacgangcgctgcgccggganangtccctgctncgaacgcggggtcctantaaaatgcancncngggcangcaacctatcnggggtgaangnaataccatnaagggggnttnagnatga

SEQ ID NO: 83948 - DNA, 651 bp, Triticum aestivum
  unsure (1)..(651): unsure at all n locations
  Clone ID: PAT_TA_83948
ctccatctccctgctcctccgccttcttcttgatccagccaagccagggatcgccatgtcggactcggaggagcaccacttcgaatcgaaggccgacgccggagcgtccaagacctacccgcagcaggctggcaccgtccgttaagaacggcttccatccgtccatcaaagaaccgccctgcaagtttgtggaggttctacctccaaagactgggtaagcatggtccatgccaaatccacttttgtttnccataaatatattccaaacgggaaaaantcccgaaatatgtcctttcgtcacacaactgtngatattcccgcatgttaaccntactggantatcaactggatttgatatatccaaaggatggttttgtaccttccttacttcaaaatggcaacactangatatttttaacccccaactggnaatccttgtggccanntttaaggaggtttttaaattgcaancnnttgttgtgacgtccatctnaanggggaaggacaatcttgcccccnaaagntttggccaaattaantcctgcctgggatacgttccaaaactaatcaaaaaaaatnttcagggtncncnaaaaancacnggntacnggtttcagtaaanattcaggattcnggtttncctttcaantn

SEQ ID NO: 83949 - DNA, 249 bp, Triticum aestivum
  unsure (1)..(249): unsure at all n locations
  Clone ID: PAT_TA_83949
tcgggngcatccgtcaaaatacacnangggnatccaggcnangcctantatagnggaaaacgagtgagaggggggaaatgctgcgccacgccgcccgccgtctcgtctcccncaccgccgcggcgcctaccgnccnccgggcgctcgtcacggcagacgtgcctgnggangccgccnaggactccacgtttgtnnaggcgtngaaaaangtcgcnccnancatcgancccccattgacgctnctcttcc

SEQ ID NO: 83950 - DNA, 331 bp, Triticum aestivum
  unsure (1)..(331): unsure at all n locations
  Clone ID: PAT_TA_83950
ccaccaccaccgctgcggctcacggctacgcagcccgctctcccgacccccccgtgccctcctctttttgctactagcacatagagtttcgcccgaatcgatcgccgactgactccgctagggttccggcccgatngccgcttccgtcctcccggctccccgcggggaccccgcccgagatgtctgactgggagtcgcccggctgcgccgacgttcttccctttttggcccgcaaggccgagggttgaacttcacnttcaaggtcnaatatngggatacacttnaaagttttaaggttntcccangggagcattttnncaaaatttaaccg

SEQ ID NO: 83951 - DNA, 469 bp, Triticum aestivum
  unsure (1)..(469): unsure at all n locations
  Clone ID: PAT_TA_83951
gcaaatggttctgccggaancggagggggtagtggagttgggtcngncagtngaggtgtcnccgggggctccggcagtggtggtggccaaggttgattgantttgtttactttaanactaagaaatgaatatagcacnggttaagtggaattggacactcccaatgcttgttggcttcataagcaaaacttgtangtgaaatactataattaacaagagagagagtgtggtgantttttacgtttagtggagatanancctaatttggttccctatgcantgtgatcanaancctgattccaatgtngcaagnccattcnatttgtccacntttaagaccgngcaatggnnataccatggaattgntaccnactaaaacccctaaaaagatgttgaagttgtaangtacnanaancccatatttgttatctatattgtgcaaaanaacaaaaaaancnagggggcccgg

SEQ ID NO: 83952 - DNA, 208 bp, Triticum aestivum
  unsure (1)..(208): unsure at all n locations
  Clone ID: PAT_TA_83952
tgacgacgatggccgggaaggcggcggccgcgacggcggcgaangttgggcggaggggtacccgtnggaaggagaagctggcaaagtacaagggtgactcngggaaanggggtgtttgggatantgggaagctcngcgcatgtnanccgctcngcatcagcgctcgcaatctcncccgcctccgcagtgnggtgctcctctnnggtta

SEQ ID NO: 83953 - DNA, 370 bp, Triticum aestivum
  unsure (1)..(370): unsure at all n locations
  Clone ID: PAT_TA_83953
ctggagctcactagaagaaaaaaatcatcgtcgtcagcttcgccacggttctagcctttctctatcatacaatccctgtgcgattcctcttcccaaccaaaagttgttgttgagcaagaggcaaacaatcctctccaactaccttacctagtcgctttttttcctccttcnaccggttcctttccatccgtgcggtccttgccataaagattatattacagacgtcatgctacgatagtttacttttgccggtccacaatccttccttacgcccgactattctactccngaattacaaccccctcctggggnaattggaacaaaaacnaccgcccaagatgaatgnaattaatactccctaacggtcttc

SEQ ID NO: 83954 - DNA, 504 bp, Triticum aestivum
  unsure (1)..(504): unsure at all n locations
  Clone ID: PAT_TA_83954
aagaggcgatcgcggagctgaccaaggccatcgccttcaaggcggacctgaacctgctccacctgcgcgcggccttccacgagcacgtgggcgacgtctcgagcgccctccaggactgccgcgcggccctctcggtggaccccaaccaccaaggagatgctggagcttcaccaccgggtgaacagccaaggaaccctgagcgcgtcccacggtgtacatacaggacaggaanccctccatcataccaaccggccataccggtgtatgttttgttccatacacagcaattcagatnnaatgtttaggcacaagttaaaanccacattaattcctccccctttgaaaccaacacccattccttgttcccctaatttattaatataatatgttgtttgttttgctatacctcccctttanagttgttgccncccattttgataacctccctattgtacccccattnccccaacgcccttcttcccaaatccanantttgacgtcatt

SEQ ID NO: 83955 - DNA, 464 bp, Triticum aestivum
  unsure (1)..(464): unsure at all n locations
  Clone ID: PAT_TA_83955
gctaagactagtttccaaacaacatcaggcaaagcaaaatacaatgcttcgattgattcactggtgtggaagatcaggaaattccctgggcagactgaggcaactatgagcgcagaggtggagtttgatttctactatgggtgaaaagaatccatggaacagccacctatcccagatggatcccantcccaatntcactgctcctggttacgttttccgctccctttaaggtttnggagaagagtgggttatacactgtttgantnggttccnctacatccacaaggctggttnaatatgaataagggtttacaacaatcccatacaaattnnaaatattattgacaataatccattngcccccatttaccactatccacaaattnacccggtgatcatgcatattntaanncatatattttgcacattacccgacttntctcaacaaaggtggggcaggcatt

SEQ ID NO: 83956 - DNA, 410 bp, Triticum aestivum
  unsure (1)..(410): unsure at all n locations
  Clone ID: PAT_TA_83956
gtcatcttcttttgggctgcatacaagacaaactttttcccaaaaatatttcatgtggaaagccttgagaagacagctcaagatgatttccaaaagcttgcatctgctgtttacctgcaagttagcaccatcagccaggcctcatcttccgtgacaaggtccccggagctggcatttgtccgagcgcccaggttctattggctttgcttccttggtgcgcactgatgccacactgattgctgttacgccgactggcttcacttccattnaagaattgggtttgggcctggctngaatgtgtngctgtacaancancttccanttccctccccanacacaattccncaacnaatatccccttaatggaagctggatnttggccattancaagattcgtttacaaggaatgg

SEQ ID NO: 83957 - DNA, 219 bp, Triticum aestivum
  unsure (1)..(219): unsure at all n locations
  Clone ID: PAT_TA_83957
acacctggatcctctccttacgactataaaagggaggaccagggccttcttagagaaggttggccgcgcgggaccgaggacgggacatgcgctctcttggggccgctcgcttccctcacccgcgtggacgcttgtaacccccctactgcaagcgcacctgacctggggcgcgggacgaacacgaaagccgcgggactncaactctctaaaaaaaaaaaa

SEQ ID NO: 83958 - DNA, 583 bp, Triticum aestivum
  unsure (1)..(583): unsure at all n locations
  Clone ID: PAT_TA_83958
gtcaagggtggtccagaaaaagagctaaaagcaatacagtacttggagagaagagagtgtgagtacgaccagaaaatatccattgatttctacaaggaaggagatcccttgaaaccagctgtgacgggcgtcttaagtgttccgtttccactcccagattccaattgggcaacaattactatcttggcctgctcctcctgccaggatatggcaaggcaaattctacagcaatggcctactggctataataaggattacctgtccnccaatgggagaaagatttacccagcattanccacnaagatatccatttataagctttgcaacgaggtnaggaaagtgctccaacaagacaaagggaccagttnactggtgccatgcttcccatnancaatccctccttgncaccttccgcccttccnaaaggacntttntggccccaatacaactccaccccaattncttcacncctgcagtttgtggtttngcaacaattcggtttccctttnaanattntcctnagggnttccncgggttnaaaaaaaaactaaaccggacaaaagnttaattaaaacnaaaaaaa

SEQ ID NO: 83959 - DNA, 587 bp, Triticum aestivum
  unsure (1)..(587): unsure at all n locations
  Clone ID: PAT_TA_83959
tccttcagttgtggaaccaacagataacgggtttacattacaacattgatcattcactctctttctcattatatccattctctagtatcacaatgaacgctttccgctgcatgagaccagtggcaggtcgggtggccttccaaaggcctactcttcctcgcgttgctccgagcttacagctccggggacttatgagtatatccaagtttctcaacccaacccggtgttggacaattaccttgaaccgtcccaaggccctcaaagccctgtgcacgccccttaacaaaagantcaaacaagntcttcctgaattaatgtgggccgacaatactcancancaattttaaccggtccccaaangctttgcaactggggccgaanncaaagaaaggccctcctaacttcngccgaacttanacaanccttcatcgatcccgggcaactcacatccanggtgnaaaccattacgcgcatctcaagnagccttgggggagcgcaccccanagtttncaccatgtcaaaaatggaattggcaacaaaattaaccngacgtccggacgggggataacnctanntcatcgaataag

SEQ ID NO: 83960 - DNA, 347 bp, Triticum aestivum
  unsure (1)..(347): unsure at all n locations
  Clone ID: PAT_TA_83960
agacaggcgtcttcgtactcgcctatctccgcgactcaaagctttccccaattcccccccttctcccatttctcaccaccgccgccgctccccccgttcaacaacaccatgagggagtgcatctcgatccacatcggccaggctgggtatccaggtccggaaacgccgtgctgggagctgttactgcctccgagcatggcattccaggctggatggcaagatgccccggtggacaaaccattngggggaggttgatgatgcttttcaacaccttccttcnatntagactggcgcctgggaanactccccccntctgttttttggtttgacctttacccacttccatc

SEQ ID NO: 83961 - DNA, 366 bp, Triticum aestivum
  unsure (1)..(366): unsure at all n locations
  Clone ID: PAT_TA_83961
gcggcggcaatttcacctgggagggcgccgacggctacaccgacgaggacctcgacctcgtcgccaacaaggggaccggggccggcgcctccgcctccgcctccggcaagagcaatcctagggggctaggtgatgcctcgcccggcctgcccgccgtcgccttcccttccgattcatagtctctcaaccgttccgtatcattttccaaataaaaaattttancccttgcgttgtttngcgttttaatacatctatttccattactaatggacttgcctaattagtacctgtttcccccctgtcctangttttccancaccttngggtcctcccgcctttattttccggcctntnaaaaaaaaaaaa

SEQ ID NO: 83962 - DNA, 438 bp, Triticum aestivum
  unsure (1)..(438): unsure at all n locations
  Clone ID: PAT_TA_83962
tgctggggggcgccatggtcggcgggcccgacaagaacgacggcttcaaggactcgcgcaacaccttcgggcagaacgagccgacgctggtaggcaacgccggcctcgtcgcggccctggtggctctcaccagcagcggcaggggagtccngcgtaaccgccgtccnacaagaacaccatgttctccgccgttccgccaatttccccgccgcgccgccaccaccgtcatcnatgggaanccatgacgaccgttnaacattccatggtccatacattttttgtattcatttacttacgccgcnaatttccttcctgttcaataccacaacgttaatttacattacgnttttaancaatatatattncttncccaagnggtttatcngccgaatactttaccttttaaggntttccaangananaatgggtttanccccn

SEQ ID NO: 83963 - DNA, 276 bp, Triticum aestivum
  unsure (1)..(276): unsure at all n locations
  Clone ID: PAT_TA_83963
aaggagccatgattgctctcggatggccatcttgggcatttgatgggattaactagcggcaccactgcagcatctttatgcttcaagcaaaagcataaaggaacgtcttacatacatgcaaggagatnaaggaaataatcctcttgtcaatctaaantttgtcctgggttttcngcccactgggtttattggccctgcagcttananggcctaattcccttttggagcccttannntccataaacatgccattaaataanaggntagttatccctt

SEQ ID NO: 83964 - DNA, 475 bp, Triticum aestivum
  unsure (1)..(475): unsure at all n locations
  Clone ID: PAT_TA_83964
cgcaggtcttgttgataaaccaccgaccgagccaaagccatgtctcgcttctcatctaacangtccagcgcctcttggcgtgcttgctcgttgtccgcttcaacataattcgcgacccggggcgagtcgtgacgaatatcacttgggangatagcctcagccccatagaccaggaaaaagggtgtatatcccgtanatcggtttggggtgggtatttatgctccataacacagatggtaattcttccacccaacaacccggcatccgcttncaaagggaccatnagccnaggcttgatacccttcacgattcctgattcgcctctcaagcttgaccattanattgggggtgacccanggatctacatcaaactaattgctcccnttngcagatnctccntctcacctttanaaagtcgnacatatctttatgatgctangttggaanccganagggnatatcctttttagaaatt

SEQ ID NO: 83965 - DNA, 509 bp, Triticum aestivum
  unsure (1)..(509): unsure at all n locations
  Clone ID: PAT_TA_83965
cacgagtaagggctcgtcgtggacaggcaactgatcctcatagcattgctgaacgacttcgcagagaaaaaatttcagataggatgaaaaatctacaagatcttgtcccgaattctaaataaggcagacaaggcatccatgctggatgaaacattggatcatgtgaaattccttcagcttcaagtcaaggtgttaaccatgagtaggctaagactcccaagacantcttccccttttcgcaaanctcaaactgagggttaccgccgtcaacttcctgttnactcccaaccaacgccacaagattactggacacggnaaaccggnaaaccttcccctttccaagaaaggttnttnaaccnaatngaaccacattcacaangcatgcataccttttaaaanaagancctgcccganncattnccttgttccnccannccacccaaaagggttccccgnttancccnccccaanatggaaaaaaaaatgngngccccanattnnaggaaaac

SEQ ID NO: 83966 - DNA, 593 bp, Triticum aestivum
  unsure (1)..(593): unsure at all n locations
  Clone ID: PAT_TA_83966
cgcagccaaaccctctccagcagccgtcgtcgccaccgctgcagcgcggaggcgacccccatcgccgccaagatgcagatcttcgtgaagaccctgacggggaaaaccatcacgttggaggtggagtcctcggacaccatcgacaacgtgaaggccaagatacaggacaaggagggcatcccgccggaccagcagcggctcatcttcgccggcaagcagctccaggacggccgcaccctcgccgactacaacatccagaaggatccaacctccacctgggtgctccgcctccgaagtggcgccaaagaagcgcaagaagaagactacaccaacccaagaagtnaagcacaagcacaagaagtgaactcccaatgctgcattctacaagtggacgacgcaaccgcaangtgacccgcctccgcaaggatgccccaacacgantgcggtgcgggtgtctcatggcaacactngaccgcantacngcgnaagncggctcactantctanatcagaaggnttatcccatcgcccttgcttaccgctacttaacatcactgtggtaaccaattgatacattantngttnggtggaaaa

SEQ ID NO: 83967 - DNA, 328 bp, Triticum aestivum
  Clone ID: PAT_TA_83967
caaagctgaagttgaaagtgctttgccacttcagaccagtgtctcgcagtagaatttcatgttggtagtttcttgctcgtgccaatagttttataagggtttttgttgctgtgttttctgaaacgcataagcgtgtcagtagcatgttttcataaccggattgtagtgcttcattatctatagttttctgtacgtgtaaaatagaccagcgtaacagcgtagtttgcttcattctccgaagtcttgtatggctgtacacccaggcatctgggcatcatgaacccaactgattgggctaaatgaaataaatctccccaaaaaaaaaaaa

SEQ ID NO: 83968 - DNA, 490 bp, Triticum aestivum
  unsure (1)..(490): unsure at all n locations
  Clone ID: PAT_TA_83968
cccgttcggcaacgtgcagtcggaggtgctcatgcgcaaggacgcaaggaccttcaccttcagcatgggctgggcgttcccgcgcaagatctacttcaacggcgacgagtgcaagatgccgccgccggactcctacccctacctgcccaacgccgcgcccgtcgtcgcctcgcagctggtcctgtccgccgccgcctcggcgttcctactgttgctgctcctggtggcatgaccgtgaccgaaccaagggcaaggcctccgttttgttttcccgtctcgtcccgtggggcagggagcagacttcagtangcanggcattttatttggtttttttgcaaaggattcaacacttgggttttccgtcagaggaaaactgtctgtatgtagtgtgagttcagtctccgattccaacgtacaagacatctttggttcaanatatgcaaaacgtgaatcaacacncaggatatcgcccccaaaagattggaagaaa

SEQ ID NO: 83969 - DNA, 595 bp, Triticum aestivum
  unsure (1)..(595): unsure at all n locations
  Clone ID: PAT_TA_83969
ccgccgccgcatcaccaccgtcgcgccatgacacctgcctcctccgtctccgtccccgcgccggttcccgcgccccctaagcctctctacctccggggcccggtcatcgcaggcgccgtcgcgctggccgcgtttctcctcctcgccgccgcctacgccaccaggcgagcagggtccccgccggccgccctcctctcccacccagctgtttccaccaggttcttctccttcgacctggtgcgcgagtaccctcacgacccggccgccttcacccaaggtatcttgtacgccggaaatgacaccctttcgagtcactgggctctaacggaagtctcaatttcnaaaggttttggttaacaacaaatggacggagattttttggagaaaggttnaatcctcctggggacagattgttcaaaggttacctggtnaaaaacnacggttatatatgaccggataactttcaaatgcacaattttaccaataaatcaaanggttgggtctggcaatgatggaaattcntttggaatgatggactcaatgcgttaancggataaatccctnaatntaaatgggacgcaatncacgnaatcat

SEQ ID NO: 83970 - DNA, 626 bp, Triticum aestivum
  unsure (1)..(626): unsure at all n locations
  Clone ID: PAT_TA_83970
agcgcgctcctcgagcccagcagagaaaggccggcctacccactctctctctctctctctccagtctccaccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgagaaaggaggccggcggcggaaggcgggcctggcgcccgaaggagtggtggcgcngatcccgcggcgccccggcgacccngccgccgcggcggcatggtggaccgcatgctccgcctgctcgcctcctacnacttctccngtgccagatggnagaccgggacggcggtacnacgccntatccggcgcgcccttcgcaattgtcaccccaaagaagacgctttcatgcgcctngcctcatgaacaggaaaggcctcatggaanctgtanantcaangacccgtgcnggncgcggatcccttaaaaggctncggatacgnttcatacanggangatccctaacnctnttacaggatnagacntcgttnntacaaaatgtgctttaaggctcaggntttt

SEQ ID NO: 83971 - DNA, 518 bp, Triticum aestivum
  unsure (1)..(518): unsure at all n locations
  Clone ID: PAT_TA_83971
ctctttcttatctccgctgtgcctgtgcctgacttttcctcctcttcgtcccctcccacccgcaaccgcacagagaaaggggaggaggctctctacccagcgcagcccgagcacccctcccccccggatcgggacccctgctctgcgcaatccacccatggcggaggaatcaggccgccccttgccaaagtttggcgattgggatgttaatgatccagcttctgcagacggattcactgtcatattcaacaaagccagagatgagaagaagggtgggaacggacaagacactgagtcaccttccaaggacaccaggactgaganggttggaatcttatgctgcaaagccaagcacgaagaaatggntttgttgtnttaaaagcaancctacgcaatcctgaggaagacaactgcatgcncnttggnaatacgtcccttaantttccatncatactancataagacaatttggggtaccaagctcncnggctcaagatgggtatccctaaaancttgct

SEQ ID NO: 83972 - DNA, 414 bp, Triticum aestivum
  unsure (1)..(414): unsure at all n locations
  Clone ID: PAT_TA_83972
ctaatctctgctttctccagagaagggagttgccacatggaacacaaccagaacgcctcgccttggagctcgctgcctccggtaacctctctgtcggcctcgtgctcctctgcctcgagcgccgcctcctacccgtcgtccatctcctggaggtgcctgtcaggcaggggttgatgcttatcctcgactctctctgtcagctctctccttctccaggccgaggaggatgaatggggctatcgcaggtcggccgctacgtccgcgttgactgcgggcgagcgcgcacgaccgacacatacgaccccgcctctgctcctactcattctctgtcacnaccggtttttaataaaatatttattgagagacaatcccttttacggacaantaaagaaaaatccntctaaaaaaaaaaaa

SEQ ID NO: 83973 - DNA, 501 bp, Triticum aestivum
  unsure (1)..(501): unsure at all n locations
  Clone ID: PAT_TA_83973
cggaaccctataggcggagcagaagtgagcctccacctccacccgccgccgccatggctctccgtcgtgtcaccccgcagaggagacccttcctccccctcccccgtgccttcttctcctcgttgccccccgttcactccgcccccgtccccggcgaacgaccccgacgacgaccattccccgtcctcctcccgggccccnnaaccccggcgcgccgcggaatccgtcatcctcgcttttccaggacatcaaggatcgcctccgcttgtctcccacgtcgtcncctccgcgccggaatccatcgaacttgctccgtccaanccgcgcgtggtcctccttcgaaaacgtnccttgaagagttcgccggatgctcgatgacttccgcccaaccgtcggngcgcctcccctccgnaccggagtcgcccctcctttttgacataatcaanaggagcanctcccnanggngcaatctggcaaggggtnacggnttcattccntcga

SEQ ID NO: 83974 - DNA, 321 bp, Triticum aestivum
  unsure (1)..(321): unsure at all n locations
  Clone ID: PAT_TA_83974
ccgcccccaaggcgtcccctcccgccccgtcgcccaaggccaaggccaccccgccggtggccgagctgccgcccgccgcctcgcctcccnggccccncccncgcctcanntcgtancattcccggcntangtcaanncgtcngctccgtccaagaaagaagantnanctctcttcgtcntccantatcaanantaagaagtccaatgcnccggntccanccccagtcgccnangcacccaccatcacnaancgctcaaaggcnatgcaccttcggccagcgaaccgacncacnctgcccggtcggctatngcgttggcncc

SEQ ID NO: 83975 - DNA, 594 bp, Triticum aestivum
  unsure (1)..(594): unsure at all n locations
  Clone ID: PAT_TA_83975
ggaaacctccgatcgaagcaaagccaaggctctctcgtcctcctcctcaagatgcagatctttgtgaagaccctcactggcaaaaccatcacccttgaggtcgagtcttctgacaccatcgacaatgttaaggccaagatccaggataaggagggtatccctccggaccagcagcgactcatcttcgccggcaagcagctcgaggatggccgcaccttggctgactacaacatccagaaggagtccaccctccacctggtgctcangctccgtggtggcatgcagattttcgtcaagacctcactggcaagacattaccctcgaagtcgagtcttctgacacgatcgacaacgtcaaggcgaagatacaggacaaggagggcattcccccggaccaagcaacgcctcatcttcgccggcaagcaactagaagatggccgcaccttgctgactacaacatcaagaaggatcaacctcacttggtgctcaggctctggtggaatgaaatttcatcaaaatctgacgggnanacatacctggagncatctcngaacattgaaattnaagnaaagtcangacaggaggaccccggcan

SEQ ID NO: 83976 - DNA, 382 bp, Triticum aestivum
  Clone ID: PAT_TA_83976
ttgatgttgacaaacgtcttaacatggtaacagaagagataggtgtaagaagcaccgagccaaaccacataccttctggacctatagattctgatacggtgaagccaaatgtagtagaagctaatattacctttcagaaaccatccagtacagatgccataaaattgccaaccataccggaaggaaattttagtactctggagaccaacaatgggtttaagcaggaagcagctccggctaaggaaatactagatgtgacatccttcaggcagcgagctgaggctctggaagggctcttagaactttctgcagaattactgggaacacagttaggctggaggagcttgcgattgttctaaagccatttgggaaggcaaggttc

SEQ ID NO: 83977 - DNA, 364 bp, Triticum aestivum
  unsure (1)..(364): unsure at all n locations
  Clone ID: PAT_TA_83977
cgccgttccagcaatataagaactcagcgacagtcataatgcccgaaacaaaagacaaaggagaaaagaagaatcaatcggcgcccccgcctcaacctaaagatgcgcatgaacatgaagagcatcaccacggcaaagactttgcaaaaagggcaggccacgcaattaccttcggcgcaggtgccacgattggttcagatgccgtaaatgggattattaagaacctataatagcaacgacttagctctgtcatttggatagcccgggcgttacgataacctgactgtgtccaacgccatgaacttgcctaacagcttaagatcaggccactgcaatacaagaaatttatcccaanaaaaaaaaa

SEQ ID NO: 83978 - DNA, 588 bp, Triticum aestivum
  unsure (1)..(588): unsure at all n locations
  Clone ID: PAT_TA_83978
atcgcaactcacgtgtcggattcgctcgtccacctacccggacgcgcgcacgcaaagcagaacgctcccctcccggccttcccttcctccccgccctccgaagtccgaaggccagaagcttccggaagccagcccaagccatgaacgccgccagcaccgccgccgcggcccccgcgcctgccgcgaccgtgcaggtgccgcgcgggcaggtggatctgatcgacttcatcgactggaccggcgtcgagtgcctcaaccaggactcgtcccacagcatcgtcaacgcgctcaagcagagtttgagagacgacgangggctgtacctcgccaagcgattcggacgagcaactgctgatctacatccccttcatgcaagtatcaaactgcantccgcgctattcaaagtcccgaagaagaaggcccaaaacagtaaaatcttctcaacaaagacatatgggttcaacaattcaatgactatccacaatgaacctcgagctataaccgtnattgataganataaactttgcaanaaatantcaattnaaaagttccatccgacaaattatgggnnacaaatggatgtttcca

SEQ ID NO: 83979 - DNA, 252 bp, Triticum aestivum
  unsure (1)..(252): unsure at all n locations
  Clone ID: PAT_TA_83979
ctgggcctcaccaacgccaccttcgtcgacatccgcttcaacagcttctacggcgagctccccgccggcgtcttctgcaagctcccgcgggtgcaggccatcttcgtcaacaacaaccgcttctccggcgccctccccgacaacatcgggcagtcgccggtgaactacctctctctggccaacaacaggttcacgggggagatacccaggtccatcgccccgcaacgccggcacgctcctcnaagggggggc

SEQ ID NO: 83980 - DNA, 464 bp, Triticum aestivum
  unsure (1)..(464): unsure at all n locations
  Clone ID: PAT_TA_83980
gccaatttcgcggcttacacggggctgctccagccgaacgacaggatcatggggctcgacctgccgtccgggggccacctcacccacgggtactacacggcgagtggcaagaagatttctgcaacctccatctacttccagagcctgccgtataaggtgagctccgacaccgggtacgtcgactacgataagctggaggaaaaggccatggatttccgccccaagcttatcatctgtggcggtagtgcgtgccctcgggagtgggattacccaggttcagggccatccgcacacaagtgcggggccatntttctccgcgacatggctcatatcactggtctcgtttctgcgcatgangnttggttcttttnattcccgaatgtggttaccactacgacccanaaaatcctcnnagggccaagnccggtatgatttcnncaggaagggccnaaccncnaaaaaaa

SEQ ID NO: 83981 - DNA, 634 bp, Triticum aestivum
  unsure (1)..(634): unsure at all n locations
  Clone ID: PAT_TA_83981
ggctccttatgggttaccaagaaatttggtcgcaagcgcagtccctttttaatcagctgggacgcatggattctccaacatcctctgccttttataatgctcttactgatatgctatggcattttggccagaggcaaggagctcagttaattgtgctcaaaggggtaaatctccgtgtgtgggagaacacatggagtgagttttgcttgngacctgcaccttattcatgtggtgcactcaagcaatggtcatgcatgggtccctgaatgtgcctctattgtcttccgaaggacgantatgcctgatttcctaagcattctgacagggtggggaaaccatacaagatgcnggcgcaanatcctcgccagtcatcnaanactcctcaactccaaccgganacctttcaggtttaccatcaacattggaagttgtaccccaacgtctggtgggtgcctggntgaaanaacccggacatcaacacgataccntcancgacacctcgcaantgcaaccnaccaatcnggtgccaggcngaggccncattgtgccctaacacgataccgtncacctgtcgtaaccccccgctcctantngctcgccttaaaaagttanttnaggcnccaaagactttttt

SEQ ID NO: 83982 - DNA, 268 bp, Triticum aestivum
  unsure (1)..(268): unsure at all n locations
  Clone ID: PAT_TA_83982
ccttgaagcaattaccggaagggatcctgttgactatggacgcccaccaaacgaggtgaatctagttgactggctaaaaatgatggttgccagcaggcggtcagaagaagtagtggatcccaccatagagacacgaccttcgacgagagctctaaagcgtgcacttttgacagctctgaggtgtgtggatccagattcaagagaagagaccgaagatggtcaantgtccggatgctggaatcggtgatccattcccccnaaggggggg

SEQ ID NO: 83983 - DNA, 460 bp, Triticum aestivum
  unsure (1)..(460): unsure at all n locations
  Clone ID: PAT_TA_83983
tgaccgcgtcatgctagagaccgacttccagaacctcccctacctacaggccgttgtcaaggaatcactccggctgcacccgccgacgccactcatgctcccgcacaaggccagctcgaacgtcaagatcggaggttacaacatccccaagggcgccaacgtgatggtgaacgtgtngggcggtggcgcgtgatcccaaggtctgggacaacccgctggagtacagaccggaccgcttcctggaggagaacatcgacatcaaagggcagcgacttcagggtctgccttccgtgctggccgctgttnttcccgggccgcaactcggcatcaacctccgtggctccatgattcggcacttcctgcacactccnattgccctgcccggagggcactaaccagagactccacatatgggtcccccgnctctcacttcatggnaaccgctcaacttttcacccct

SEQ ID NO: 83984 - DNA, 323 bp, Triticum aestivum
  unsure (1)..(323): unsure at all n locations
  Clone ID: PAT_TA_83984
gagaaatccagatacaactatattcaaggaatgtattaattgatggctcaaactggagcggttgacatgctgaggtgtggtatctggtggtattcagggagagcattgaaccagattttgaataggtctggtcatatatggttttgaggagaaaacaatatgttatgtcaatattttccctcattggaagantgaanttgtccggttggtntangtggaatngacaaaanngagaaaccttttgccccaatatggtaccacccngtgtttaaagccccggttaagctggtncaatngcacctttgtcctttaaaaaaaaaaaa

SEQ ID NO: 83985 - DNA, 379 bp, Triticum aestivum
  unsure (1)..(379): unsure at all n locations
  Clone ID: PAT_TA_83985
gcagcaaaaatgacggctggctacattgttggctcactggtcggatcctttgccattgcatacctgtgtgacacatttatctctgacaagaaggcatttggaggtagcacccccaagactgtttctgagaaggagtggtggcaagccacagacaccaattccaaggcctgggctccgcactgctggggccaccggttgtcatgaacccatcaaccgcccagaactcnacctccaatcccactgattagttttgggctgggagaactggtcctgccactttggtgccgccatgaaccagantcccttttccnaagnccttaaccattgttataaaacgaaatacatcccagtttttttgggattttttaaaaaaaaaaaa

SEQ ID NO: 83986 - DNA, 470 bp, Triticum aestivum
  unsure (1)..(470): unsure at all n locations
  Clone ID: PAT_TA_83986
gccagcgccgccacccgccagcagcaggatccagctccacgtccagccgcactgccacagccaggcagccagcagccagggctccacgtccaaccgcagcagccagcaccagcaggctccacgtccagccacagccagagctcgccggggatcctggacgccgagtcgcccaccacgccggtcggccacgccatccagggaccaggttgccactgcctcacgccctcaccaagtaacccaccctaatcgaatcgagcaggtccgcaatgccgccacctgggtgtgacccgggatnaagttctgattcccgaaggagcaaaagggatgtcaaatnggatcccggtacatgntttgcattaataccactagtgttaattgtatgccttatggggctgattatanattgtgatnnaatgtctttttggtgaacctgctcaaacaaacctaaaaaatcttcnanattcaantnn

SEQ ID NO: 83987 - DNA, 597 bp, Triticum aestivum
  unsure (1)..(597): unsure at all n locations
  Clone ID: PAT_TA_83987
caaacttgttgcatgttctaaataagagaaatatcctaattaataaaactgaaccctcaaacatcaccatgttcaatttaggtcgccgatgtttggtcatgtggagttactctgtatgtgatgcttgttggtgcctatccctttgaggaccccgacgaaccgaagaatttccgcaagacgcttactgtgagtagatccaaccttccccaaacaataacttatgtatgtactactttactgctcggctcatgtatttaattttctccgcagcgggattatcagcgtccaagttacgcggtccctgattttgtccgatttcaatgggagtgcaggcatctgctgtctcnggtctttgtggcgaaacctgagcaataatgcgccnaaacatttccgcaacgaaaacatacccngcngcatcctaacaccaattcctgcancggtaacanccaagganaagacaccaaggtcccgaagaactgccaacnagagacgacagtacagtgaactnactatcnnatgaagcccncgnaanctgagngtnattcaacaacggagccggaaccgnnaggctaacagcggaatccggctggacaggac

SEQ ID NO: 83988 - DNA, 549 bp, Triticum aestivum
  unsure (1)..(549): unsure at all n locations
  Clone ID: PAT_TA_83988
acttgatgcagattggtacagggaatatggtatcgagcttattctcggaacgaaggtgatttccgtcgatgtgcgccggaaaacactggatacttccgccggggaaaccatcagctatgaaaggcttattgttgcgacgggtgctcgggtatgtccacatcctatctatgcttgcccgtgctattttttttttcttccctacatactctgtgcgatttcttaccggccggccggatgctagagcatgctattttgtccttttaaaacgttaggccgtttaagctggaagaatncggagtntaacggcggtcaaatgcccgagaacttctgttatctgcgccacatcnccggacgccgatattatccgtgtnatgaatnatgtcctgctgggccnacccctngncntccggcggcgatacatangaatggatntcaacccccngttccaacaagatgaancacgtctctccccngggaanntttatggnaatcgttcnaccgaantnccgattttcngaatactacaaccaaggntccttntaaaggact

SEQ ID NO: 83989 - DNA, 459 bp, Triticum aestivum
  unsure (1)..(459): unsure at all n locations
  Clone ID: PAT_TA_83989
tcgagttttttttttttttttttagacaataagtctgccatttcattgattaaaaacccagtgcatcacgaccggtcaaagcatatagatacaagatttcatttgatccgggagtatgcaaattcaggccaaattgaagtgaagttcatcaggacagaggagcagcttggggacattctcacgaagcctctcggcaaactgaanttcanagaactctgtatgacnagcagattcggcatgccgagatcagcctnaaatccgtttaccaggcgctccatcctgccgccgtaagccgtggcgtnntccaactccatggtgtcgtctcccccctgggaacaagacacgggcgcccaaggtgcctccnnccggcggaaancggggcgcccctcggntanngcggctcctnaaaaagtccccctttggccanatcaaattctggtgccnccaacgngccaggat

SEQ ID NO: 83990 - DNA, 628 bp, Triticum aestivum
  unsure (1)..(628): unsure at all n locations
  Clone ID: PAT_TA_83990
gttttttttttttttttttttttttttttttttacttctanacaacggtatcattgtgaaacgttgtctacatatatccatctctgtctacagtacatccacttcaccatccctggccaaaaaagctccaatgatttcatccccttcttgtctttaatccatccgcatcgccagtgtcctttgccaaaaccatgcaaaccacccctgaaaatgaanacgtaacaaaagaaaaataaaattggggagcaaagatgacaactccgtcgctaatgtacccctgaacctaaaacaatcgngaagcaaagtgcaaaagggtgtaattgtnaaatgtggtgaaaaatccaactcgtgaaagccccttgctaacaaaccccttgaccgttgcttgcntagaagaaaccccgagtaaananaatgggcaagtatccaaagggagtaangttgnaantcnatgctagggagaagcccaaagacataaccacngaggngatgccaaacantggaaagnaacttgaatttcancatangcnacaancaggttcangctgtnctaaacnctnccggttgannctcgacccctctngatccantggaatcccgttcgctctcncanaacagcagccaacng

SEQ ID NO: 83991 - DNA, 463 bp, Triticum aestivum
  unsure (1)..(463): unsure at all n locations
  Clone ID: PAT_TA_83991
tggacgcggcgctgtgcctctgcaccaccatccgcgcgcgcctgctcaacatcaacatctacctccccatcgcgctcaacctgctcatcacctgcggcaagcacgcgccgtcgggcttccagtgcccgccgctctacgactgatgaacaccaccaccagccaacacttctatacgcgccgccatgcatgcatgatgtgatggcatcctgtgcaagctagcgctactagtagtagcatgtctaccatttgctccgtgattctctantcctgntctccgcgantatgcgtacntnatgcttgctctcgtcangactccgggantttccaactccgatgctaagcgtgtacttgcttaacatccattacatgttaacaangctaccttctcgtcntctcnattctcgtctcattctgatngcagagatatatgaaacttttacaaaggatataatctactgttgac

SEQ ID NO: 83992 - DNA, 283 bp, Triticum aestivum
  Clone ID: PAT_TA_83992
ctttaggctgcgttctggaaggcactccagaagtgtaggcacgttagttataagaaaacagccttcattgttcattgaccttacttttaattgaatttagtacacgagacaccttaggccacagttcctgacgtactccatggtgctgaaacatttcccatctcaaatatcatcaactgtaccactactggaactgtagtccaatccctctcagatgttaaaatcctgtgtgtaactttgaacacagaccaaataacaaagccagaaatttgccaaaaaaaaa

SEQ ID NO: 83993 - DNA, 655 bp, Triticum aestivum
  unsure (1)..(655): unsure at all n locations
  Clone ID: PAT_TA_83993
gccgcctcctctccccagcacccggagctcgcccgaccgccgctcaccatgatcatccccaagaagaaccgcaatgagatctgcaagtacctcttcaaggagggcgtgctgtatgccaagaaggactacaacctggcgaagcacccgcagatcgatgtgcccaacctccaggtgatcaactcatgcaagagctttaatcccaaggagtatgtttagggaaccttctcctgggcattactactactgggtatctcaccaacgatggcattggacacctacgcaactacctgaactccccgtcctagatnntgcctgccacgctcnaagaatcctgccaaccacctggccgcccatttggtcctggcctccctggtgaccgcccaagggcccagtcnttttntacgggacaggcaagttttgtgacaggatggtacntngtggccccctgggccccggtgctttggngcganaaatgaccccgcngttcaaccanattcaggagctggttnggctngtgcngaacggtnggcaagcaactctctcatggntgaattncctgttggnanggttcctcnttggcttatttaggnatntagtcanaaatacccgttgcatgtaatcaaaaattttgctaaatggncataatgctcaancc

SEQ ID NO: 83994 - DNA, 581 bp, Triticum aestivum
  unsure (1)..(581): unsure at all n locations
  Clone ID: PAT_TA_83994
ccgaccttgcctcctcctgcagcagcagcataaccagaggggagtgcagcaagccgtttcgagagacagctttataggctactgctagcagtatggcttccgctgcgcgcttcctggtggtcgtggtcgtggcgtgtgcactcctggcgagcaacaactgccacgccggcgcgccacttggccgacacggccgcggtcccgctgctgctgggtgccgtccctggctccccgccgtgccgaccttgccaacggtgcaccatnccacaggtgggcgctgcacctatccggcctncccgcngtcacctnccgcaaatacctgccgcccatgccaacggtccccaagtgccnnccgctgcgccatgccgccatccatccgnctgccaaactancctgcaaccatcccgctgtcntcanccgtctccccaaagnggcttgccgccatcctttgncccaacttaactgccaatccntngnggacgctcnttggaanaanccccncgggcnncctgaagttcctcccctnccaccattttaccaagngnggtaccgtctgttncggctacgtttcaaatagtatgttg

SEQ ID NO: 83995 - DNA, 597 bp, Triticum aestivum
  unsure (1)..(597): unsure at all n locations
  Clone ID: PAT_TA_83995
gattcgcctaccttgccacaattgtccggcgctcctaagagccgtatgctgccttttatactccagttgcactgctcaatttttttttatgacatggtttgccatttttcagcaaatatcccttgaaggggatctgttgctgaaaacaaggcttgtaatttgttttatgcttttgggtgttttgcaacgaacttttctagcgggatctacggagaatgcaaaactgggccacaaaacatgcaaantgtatcaaacactccaaaggcgtacaaggagcgggtaacaggtatcttgaaatgaacatttnaaggacgggcangagaacttccgaattataaaccacgaagaagacaagcataaggaatgtataactttataatttgttgggcgttaaggntcntcctaatgacacantatccaatatttgtaactagaaccggtggaacgtntccgaaagganagggttcgacctcccgacatagaacaccaaggaacgggagcttgttnacaagtccanggacaaaaattttatanaccaggacngaacaaagaaaccgggntnaatncataagtatnacaacnganatgatgnctgct

SEQ ID NO: 83996 - DNA, 532 bp, Triticum aestivum
  unsure (1)..(532): unsure at all n locations
  Clone ID: PAT_TA_83996
cttttccccgccgattcgttccaccaccgcaaacatctatcccagtagccctacacggagagagctgcaaaggcaatccagtgatcggcactatgaacgacctcatgaccaagtccttcatgagctacgtcgacctgaagaaggcggcgatgaaggacctggaggcggcgggcgacgggatcgagctcccggaggcgggcgccggcggcgtcacggacgagcgcctgcgcgggttcttccaggatgcngaggcggtgaangcggagatggcggccatccgcgaccgctcgaccgcctgcacgccgccnaacnagganggcaagtcgctgcgccaggtggacccctcngcncggaacgtnggcgcnttnaagcngatatcgtcgccgtctcgncgcgcccgngannccgcgctaggtcnatctnctggacgngcaaacgcngcgcaacggagcttctccgggtgccccaagnnanccgctggacgcancnacgccgtaacccggganccggaaaactaangactcagctcaat

SEQ ID NO: 83997 - DNA, 561 bp, Triticum aestivum
  unsure (1)..(561): unsure at all n locations
  Clone ID: PAT_TA_83997
ggcgagttcaaatcccacaatcttcttgtagcacaccactgtcttcgtccaactcggcggcgatgtctgggcgcggcaagggcggcaaggggctgggcaagggcggcgcgaaacgccaccgtaaggttctccgcgacaacatccagggtatcacgaagccggcaaccggagcctgcgaaaggaaggggcggcgttgaagcgtatctccgggcttatctacgaggaaaccccgcggcgttctccaaattttccctccgagaatgtcatcccgccgacgcggtcacctacaccggancacctccgccgncaaacctccaccgccatggatgttgtgttccccctccaanccccaaggccgcactcctgttacggntcccgtggttnacccatctccttcctccgtctncaacggtgcccntgctttcctcatttcctcctgcctnccttgggttgattttaaantntcnaattaaatacnccgattgctccttatgggnggacatttcccaacattctgggaatcaannaagagttcttcttgcaataataatttaaatcagt

SEQ ID NO: 83998 - DNA, 467 bp, Triticum aestivum
  unsure (1)..(467): unsure at all n locations
  Clone ID: PAT_TA_83998
agccgggctagctcgctcgctcgctcgcaatggcttccatcatcgtgcaggcggtggtcatcctcctggacgtcatcgccttcggcctgggcgtcgccgccgagcagcgccgcagccgggccaccgtcaccccggacgccgccaaggagtacgactactgcgtctacgactccgacatcgccacgggctacggcgtccggcgcgctgctcctcctccgccgccgcgcaagtcctgctcatgctcgccaaccgctgctttctgctgcggccgccnggtcnaanccgggaggtcccccgcctgcgccctcatcctcctcctccttcaacagggtgacttcctcnancnccgagcttcctgctggcgggattnattaccnacgcctacacacccngtacagggcgtattctacgnganccctctcaatgcaaacggtgcggaagnttcttccctgctggccngattactc

SEQ ID NO: 83999 - DNA, 622 bp, Triticum aestivum
  unsure (1)..(622): unsure at all n locations
  Clone ID: PAT_TA_83999
cgaggaccacgtgtacccgccaccgcgccgcgcggctccaccgttcggcggcgctcgggcacggcacgccgtaaaaccctagctcttgcgccccctcctctccaccgcgccggcgagccgtggagacgcggagctaaggatgccgcggaccactgtgctggagancccggctgcccgccgtccgcgccctcaccaccgacatcctcggctttgtcaaatcctccaagccacgccaagcccggcgggtgccgccaagncctttgaaacnttgggngcaacccaancttcctgggcaatcttcgctgcttcctcnccatttntgcaacgaccccntttttggttnttgcaaggataacgnnttgtttaatttctnatccccttnaacggaaantttgctgccgtnnaaggaattngacaacaccaatatggggctaagnatccctcaatggattgacttttaaaaaaaagttggancttnttagaattcttctncacnacaggaaactttaaggcatncaagaaatcantaggtaatttggcacgcnaatgaatttcgtggcattcatttccattttaggaaaaantanttgggaagttaatntttgaanaactttnaaagcnn

SEQ ID NO: 84000 - DNA, 495 bp, Triticum aestivum
  unsure (1)..(495): unsure at all n locations
  Clone ID: PAT_TA_84000
tctgcgcgcctcatgttatcagtgcccgcgacctgctggatctgctgaagagcatgtaccctgactacccttgcattgccaacgagagcatacttgacagagaccacccagcgccgatgacctctgacaagctgaagaagatcgggtggagctgccgaccgctggaggagacgatcgtggacaccgtcgagtgctgcctgcgggctggatttctggaccatgtngggtggggaagacttcctgtcgcttccctcctcttttaaaccagatctagcctcnggcgaaagcatgaattgtgattgcctatgctccntgcttatgttacccgtggacgacgagcgtcactttttaaataaacttgttgcatgctgttgtatcccttaatatactgtggacaacatcnatnaaagntttaaataaatgtcatccaagtgttgtatccggtggtggtgcccacttaagtgtncccaactaatccnagataatnagacttta

SEQ ID NO: 84001 - DNA, 639 bp, Triticum aestivum
  unsure (1)..(639): unsure at all n locations
  Clone ID: PAT_TA_84001
ttttttttgataatcatgtcccatttttaatgcaatagctaaacctgaacgccgccaaagccctcatccagccgttggttctccggctagatgttctggtataatacatccagacttgtacttgttctaacacaccacaccatccgctccagggtaccctttctctttcttgatctttgggggatcccggctctctcttcatcttcggacctttcctacaatgacggcactgtcgcgtcgtcgatggaccttgtccccctagtacttggtccacccttggacccaagaaagctggttgccatatccttcctgcacttacttngacnaggacgcgtactctcggccgaacgctcaacgtcacctcgccgtccttgttaacgnctgtccttgattctgccctcgggcttctccatgatnaagacacagngtagggccttggcttggcgnancccgactcggggccnacttacgaanatnaaggnaatntgnctccanacacgggagngananagactcaagggaaattcccgggatataacccgggaaaagtttccgggcgaagggaactcgaatctanactcttaaccctagggtgtctgggctcgtgctaaactntagctncaccaggagnaggaaaag

SEQ ID NO: 84002 - DNA, 315 bp, Triticum aestivum
  unsure (1)..(315): unsure at all n locations
  Clone ID: PAT_TA_84002
tcgccgccgaggcccccgcgccgagcccggcctccggcgccgcggccgtctcctcgtcgctcttggccgccgccctctgcccggccgtcgcgctcctcctcggcaacctgcgccactgatgacgcctgcctgcctgtccgacgagagccgccgtgtgctgtcgcgtgatgttattgtcctctgtatgtgtgtgtgtgtgttcctgacctgtgcgtgcttgtaccgcaacccgcgcgtggattggaactctatcgattgttcngagatcaacgcgttgtttcngtacaanattggttaagacttaaaaaaaaaaaa

SEQ ID NO: 84003 - DNA, 606 bp, Triticum aestivum
  unsure (1)..(606): unsure at all n locations
  Clone ID: PAT_TA_84003
ccgccgcagcccgcagtcgcttgcgcgcagcagcacttcgcaccgccgccccatcccattgccgccagtgtctgctcgatccgatggctcccacgaagaagtcgaagaagagcacagagagcatcaacaacaagctgcagctggtgatgaagagcggcaagtacaccctgggctacaagaccgtcctcaagacgctgcgcaactccaagggaaagctgatcatcatcgcaaacaactgccctccacttaggaagtctgagattgagtactacgccatgctggccaaagttagtgtgcaccatttccacggaaacaatttgatcttggcactgcctgcggcaagtactacaaggtgtgctgcctcagtatcatcgaccaagtgactcggacatcatcatacaaccctgggcaccaantgagccagcccgggaaccaatgcagcncttcgccttccaanatagataaatgtacgctccggcctaagtcttcctttttacctttacnagtatttgcacangttcaccacatacgaatntctataggtgcatcaggaacaggttttatanagtgtcttcctgtgantatgtagcaaaaaaggggccgtcn

SEQ ID NO: 84004 - DNA, 619 bp, Triticum aestivum
  unsure (1)..(619): unsure at all n locations
  Clone ID: PAT_TA_84004
gagagaactagtctcgagtttttttttttttttttgttgacagatcaaccaaatggatcatgccgatggaactaatctgggaaacggtgcagtgttttttttaaggagaaaccgtaagacaatcctatatttggggaaagggggtgtatgcttggacccctttacattctttataaatacagatttaaatccnaggccagcaaaattgggaacaggcatttatgaaagaaagaaaaaaacaaaatccaagaacgatgatagaccccatcaaaacctcaatataacgctacacagttaaacataagaanggttccttttgtttccaacctacnggtacaagctattatgaaaaaagaaccatttccccaaggnccaacaaacactgtcatttgttaccncaataccgaactanggttcccgcctttccngtaggaacccnacccttccaagctttcttgttntccaacctggaaaatttttcaagttncggaancnccaaaataaccgggaaaaaaccntttnaacttgtccccaaaaatttccccaccttttaaaaanaaaactnngnccccattgtncaccganaacccnatnngattgntcaanggactcngttgnt

SEQ ID NO: 84005 - DNA, 293 bp, Triticum aestivum
  unsure (1)..(293): unsure at all n locations
  Clone ID: PAT_TA_84005
aattcattcatgtagactcaaacttttcagaatatggtctttcagatcaatattcttttcaacatactgcagttcaatatgcaacttgcttgcagcagctcatggctgcagtaacagtaaggggttagctctagagagattctcaaaaccactctataacgtccgtaggttgattgtggcagcattcacaatgcctgggatatatgttgtgtaattggacatacaatttacaaatgggtcccttcctcatgntccttttaagatgccccactacaggtaatttggcaaaaaaa

SEQ ID NO: 84006 - DNA, 633 bp, Triticum aestivum
  unsure (1)..(633): unsure at all n locations
  Clone ID: PAT_TA_84006
atgaaattcagctacctcaactagacacatctggcttagatcttcccttctcggaagttgaagtttggaacgccatcaagcagtcaccgccaaacggagcccccggcccggatggcttctccgatgtcttttacaggcaatgcttgcacatcataaaagctgatcttacgcgagctctgcaacaattccacgacctcaatggcggcgatagtttcaaaaatcttaatgcagcaatgggtgggtgctcatcccaaacactccctgatccaactaacattgggacactttatggaccaattagcctaatgcactcctttgcaaatctcatcggccaaattctatcnactgcacctcgccccaaagcttggtatcctgttctcccccagcgcaaatgccttccctggaanactaatgcatccacgaatttttgtnccgtaaaaatgagcgcgcgcctgcatcctaaaaagacttgcacggctttcaagaggtatactaaggtttcgatcaatccctgngatactgcncgaaggggggccgtaccaatcncctaaatgatctataccncgccacggcgtngttaaanntgtgacggaaacctgngtacantaacnctnaaaacccttccagnggtag

SEQ ID NO: 84007 - DNA, 531 bp, Triticum aestivum
  unsure (1)..(531): unsure at all n locations
  Clone ID: PAT_TA_84007
gcatcccncgtccccgcatcacctcnccgccganactccgctcgcnttcnctcccganacccgggccngccgagccgccnccatggacaatgantacnacgtgatcgttctgggcacggggctcaaggantgcancntcancggtcncctctctgtcnacggcctcaangttctacacatggataganatgattactacggtggagattccacntccctaaanctgnaccagctctggaagatgtttaggggggaaganaagccaacggcanatctaggtgcacncanggattanaatgttgacatgggtccaaagtttatnatggcaancggaacttgggtcgcacctcaatcacactgatgtgacaaaanatttgtcattcanactttnatggaactattctnagcaaacngaacatcacaangttctgcaccgtatggaggtcnaaatcncnttgatggtcaattnaaaantncacaggaattttgttctcaaaatcatganctgtcatnccacagggttggccacag

SEQ ID NO: 84008 - DNA, 413 bp, Triticum aestivum
  unsure (1)..(413): unsure at all n locations
  Clone ID: PAT_TA_84008
caaagctgcatacgctggtgctcacgaataatcgtctgacaaatcttgcagagattgatcccctggcatctcttccaaagctacaattccttagcttactggataatactgtaactaagcagccagattacaggctgtatgtgatncataaattgaagcatttgcgtttgctggatttcaangaaagtgaaacaacaggagagagttgcggcagcgaaaaagttcaactccaaaggaagcagaggaagaggcaaagaaggtgcctggccaaaacgtttactcctggtctgcctgatgctcanggacatnacaatgggagccacaaggtcctaaaagtaattgctcccaagnccctgancaaatcacagctancaaggctgctattgcaaaaggccanactctccaaggggggg

SEQ ID NO: 84009 - DNA, 590 bp, Triticum aestivum
  unsure (1)..(590): unsure at all n locations
  Clone ID: PAT_TA_84009
ccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctgggtgctgttccaatttccactgcccagggcgaagagctgaggaagctaattgggtgctgccgcctacatcgaatgcagttcaaaaacccagcaagaacataaaagcagtgtttgacgcagcaattaaggtggttctccaancaaccaaagcaaaagnaagaggaagaagaaggtgcagaagggatgcacaattttgtaactacaaacggtagagggaacatctggctgcngcgctgctgcaatgataacaacgcctcccttgctgtataatatacgcctgtnatccacaacatcacaagganatgnggtttagatcctgnctacgtttgtgtaacacggtgtatnacgtaccggtgtttgtatgtantcaaacaaacacacgcaatggatggnagggaacaatcatatacacggccattcagatgangaataatggccag

SEQ ID NO: 84010 - DNA, 250 bp, Triticum aestivum
  unsure (1)..(250): unsure at all n locations
  Clone ID: PAT_TA_84010
cggttctttgcgacatagaaccgttgttgtatgattgtatactggcttgtaagacttaaaaacactgggcttgatttggacgttaatgtgtgcattgtaactggtgtgccctatctgctgacagtgttgcacatcacatgtttggtgttaataaggacagactatgtatcatctgccagattgttgtacatatacattgtggtgatataaacatgaagctgtcttctgctaaaaaaanaaaaaaaaaaaa

SEQ ID NO: 84011 - DNA, 627 bp, Triticum aestivum
  unsure (1)..(627): unsure at all n locations
  Clone ID: PAT_TA_84011
cgccaccgtactgctgctcctggtggccgccgcggccctggccgcccccgccgctgggcactttgagtcctcctgccccttctacgaccacggcggccacggcgaaccacacgaacgccacgaccatggccacagctgcggcggcggcgcggaccatgagcaccaccatcaccatcaccacggccatggacacggcgagatncagcggctgctcccggagagattgccggnaggaagcggttttccantccgatccttccgtttacgaaagaccatgaccacngcaccaccaccaccaccaccatcaccacaccaacggngacattgaacatcccccatggcgttttggtnnaccccatgggntctccctgctggcaattatgctcccttgtctgctctctccttgcggcatcttcntttaagggaaccttttaagcaaatgntccctncatgtttggggaagactatcttgnatcnttctcaacaactgcaatctttgggggagggatcnaanccatgtnataggtanatatccatccatacatcaatcanccatgaaattacgtggntgcgtcantgatttcgntttntnaaaatttagnanttaanattcaanggnancaggcn

SEQ ID NO: 84012 - DNA, 619 bp, Triticum aestivum
  unsure (1)..(619): unsure at all n locations
  Clone ID: PAT_TA_84012
tccatttgttccatcaacagaatactgtatggacaactgttactgtacaagcaaaaatgagcataactagacgatttacagggccaaatcagctaccaatatggcaagaatgggccagcgtgctcatcatctcctaggccggcctgtcaagttccttgctacagtggacgtcgacgatgaggaagatgaaagagttgtcgttttgttaaactcctccttgtcctcgctgaacgccttcangagcgcatcttgcaggtcatgaaacctcctcctcctctctgaggatgcatctcttccgagcgaagccagctcangttcatcatccatgatcttgtccaatttatttgaacagcgcgggaaaaaactttgccgacttcnacgtttgggaganggtctcatccgagctaatgtcctcctcatttgaaagaagtacatttagatnaacgtgttacnccagagtggattgtcnngacaanggtaaatcaaagtacatcacttgacatgtcatgcacctgccattgaaatactgcaaacancgttcaggaanactcacaagaatacacatgaaaaacgngtccantggtctctnactgcatccagcatnntggnagtctcnttc

SEQ ID NO: 84013 - DNA, 215 bp, Triticum aestivum
  unsure (1)..(215): unsure at all n locations
  Clone ID: PAT_TA_84013
gtcacacacacacacacacacagacaagtggtttccaaagccaagtgtgtgtactagcaaccagctagctcgggcggcagcaggcagccatcatgtcggaggagaagcaccaccacttcttcaaccaccacaagaaggacgaggagcagcccgccggcgagtacgggtactcccgagaccgaggtggtcacccgccaccggcganggcgatagaa

SEQ ID NO: 84014 - DNA, 625 bp, Triticum aestivum
  unsure (1)..(625): unsure at all n locations
  Clone ID: PAT_TA_84014
atcaagaagacgggcatggccctgattctcggtatctacgatgagcccatgactcctggccagtgcaatttggtcgtggagaggcttggcgactacctggtcgagcagggtttctaagcccgccctgatatgctgttattttgggtcgtctggggactaatttgctcctactgtgggctttgcatccatctgcttgggcgtacccgcatgatatatgcaagtgaataatttaacttggggttgnccgttggatgattttccaaagggaaaaatggtttacaanttttcccttttaagtttggnacccctcctatcaaatcaaccgctctttcccctaataaagtnatttgcccggtcctgggaacttttgggttcggccgcgctttaattnaaaataatgcaattttncctgaaaaaanggggggcccgtacccaatcccccnaaaggnatccantaacccccnnaangccttcttttaaactcctannggnaaacctgggtttccaantaanccttganaaaccccttcccaatgggtatacaaangcccacttgcctcaaaatnccnnctaaggnaatgaaccccntcggatacccgggtttggtacccantaccnaattcac

SEQ ID NO: 84015 - DNA, 593 bp, Triticum aestivum
  unsure (1)..(593): unsure at all n locations
  Clone ID: PAT_TA_84015
gtctcctcctcccttccacactcctctccactcacgattctcttcccttgattccgctagctgatcagcgtctcgccggagtaatacacagcagcagtaagaggccatggagatggtgcggcggaacctgaagcggcaggcgtcgcgctcgctttccgccttcggctggcgccgcatccccggcacgccgtcgaccaaggagaactccaccccaactcgcctccacgccgcccggcgtcgcccgccaaagggactcctcnccgcccccnaagacccaagcggtgccggtgcngtgcggtcaaccggcggcaccgccgagaggttatccacanccctacaccggccaacgganacacgtnctcaagngtggtaaggttcggccacgtnaccngcggtnaacgnagtttntgtctccgcaaacgcccaatcancctttggacggcttccaatggnggtctcaanaagnttaagccancttgttngnggatccatattaaatctaggcggntaaactcctgttnnaggcaatgacgganataacatttggcctctggcangttaatggttanantaccggntntccggttcaactt

SEQ ID NO: 84016 - DNA, 484 bp, Triticum aestivum
  unsure (1)..(484): unsure at all n locations
  Clone ID: PAT_TA_84016
tatggagttgctggtgaccaatgtgtcgacttctcgatgcagtacagaaataacattcatccttactcgggtcctgaatttggttttctgccttcacagccagttcacaagacctcagtgaacttccatgcggtaccagtgacaccactgaccccgttgtgtagccgcggaatgccagtggcgacaaatcaaagagaggcagcagatcctgcctcctccctaaattaaaacaggcagtgctggccctgaaccgtctgtgcaggagacaacaccttcaaaacagaaaggcgatgacgtttgacanacacctctccttgttccaatttcaacctgccgattgcccctcccnaccctggnaacatcccaaaagacnaaatnngggaactggcaccactcaaatactcnatccaaccgtgctccaaggaaggagacaacttcaaggatanaatttccccggggtgttacggggattttccacccaact

SEQ ID NO: 84017 - DNA, 425 bp, Triticum aestivum
  unsure (1)..(425): unsure at all n locations
  Clone ID: PAT_TA_84017
gttaacggaaacagtccagcatgcccctgcggggccccacactactctctctttgtgtacgaaagggagaaaaacaaaatagacatggcctgcccggcgacgactcatggcagggctcgtacttcccttcggagctcagtcagacccctcctcacgcttcaccgaggcgcgacgatgggctggccaactacccctctcaaggcgagcgcgacggcacggtggctggtcacggccgccgctggaggaccgtcgtccgaaggggagcaaccgaagcttggcgantacgaactccgccggcangcgcctccttctcctcatctcgggcataacgaagccgacacccgtcgcctnatnatatcttcggggaacacccaagcgggacgnttttccaaanacctccacttnanggtggatcacctcaaact

SEQ ID NO: 84018 - DNA, 209 bp, Triticum aestivum
  unsure (1)..(209): unsure at all n locations
  Clone ID: PAT_TA_84018
aaacaatctctgtttattttgtcattcagcttggaagtaccctaattctttacatgcatgtcntctccatctgcttcttgaatgaggtttttgacaaccttctgttggaatgccgtgcangggancagaacccaancanntagccttctctgctgcccatganancacnattgggatctttccgangtattatagagcacctaaaggat

SEQ ID NO: 84019 - DNA, 329 bp, Triticum aestivum
  unsure (1)..(329): unsure at all n locations
  Clone ID: PAT_TA_84019
ccctcgcaaaaccctagctccaaccaccatgaagggcaaggccaacgcctccaagaaggatgaggccaggctccgggccggcggcggcggcgccggaaagcgcaagaaggccgccgcgagcggcaagcccaagcgccctccctccgccttcttcgtcttcatgtctgaattcaaggcaggagtaccaggcgcagcacccctggcaacaagagcgttgcggccgtttagcaangcagcaangggaaaattgngctctatttncagagcaagagaacaaccctatgtntgaccaagcttggcaagaagaccagacttatgagaaacttaag

SEQ ID NO: 84020 - DNA, 601 bp, Triticum aestivum
  unsure (1)..(601): unsure at all n locations
  Clone ID: PAT_TA_84020
cgaaaacgaatcccagaacagtaccgcagcggcagccatggtgctctcgcacgcgagctccggccgggacgacgacgacgcggtggcctccaccttcgcgtcgcgctacgtgcgcgagcgcctgccgcggtaccggatgccggagcggtcgatcccgcgggaggcggcgcagcagttcatcagcgacgactcatgctggacggcaaccgcgcctgaacctggctccttcgtcaccacgtgggatggacccgatgcgacaantcatcatggatccatcaaacaanactacttcnacatngacgatacccttcacaactgactccaaaaccgctgcgttaacatgatactcacctgttcaaccgcccatttaaggaggacgaacantattggggccggacatggattctcgggangatnatctngcagtctggcttcaagaggaatggaagacaagagaagacaaggaacntntgacaaccaaatntacgggtgcaactnaagtctctggaaaattcaagnattgagnggactaagnagtaacttagaggnacantatgacccgnaggcgttaatgngcanaaaaaacgttncgattttgnca

SEQ ID NO: 84021 - DNA, 552 bp, Triticum aestivum
  unsure (1)..(552): unsure at all n locations
  Clone ID: PAT_TA_84021
gtcgtcttcgagcggagccaggccgacgtcgtggcctacgcgctctgcctcgccaacatcatcgtcatggtcgtctggctctcgccggacaccgggtcaacggtctcggccgccaagtcgctcctgcgtctcagcgacgacgaggatgaaggcagcgggggcagctccggcgcagaggacaagtgctgcgtctgcctcgccggcatgcgggaggaccaggcgcttcgggcgctgccgcggtgcggcacagcttccacgacaatgcatcggcaagtggtcaaggcgcacccaactgccctgtgtgccgggcaacgccgtnccgccgcngtccaanagcgggggcggggatccgctaatgncatattaccccgtntaactacttccctcaatgattcancatcntatcttancnacgatttgtggaatttnttgggaatttgggaaaactgtatatatcaaaanttgtcaactnatcaaattcatagngatntaaaangccttntcaccnaaaanaaacattccttgctnatanaaaaaaanaaaaaaaaaaaa

SEQ ID NO: 84022 - DNA, 585 bp, Triticum aestivum
  unsure (1)..(585): unsure at all n locations
  Clone ID: PAT_TA_84022
gtagattctgaaagctttcatactaaatatcggaggcacgaaatgcgtgtcagattgagtggtggtgaaccagaaaaaccattggtaatacatgtgggccgttttggacgtgaaaaaaatttggattttctgaaaagggttatggagaggctcccaggagcaaggattgccttcgttggagacgggccatacaggtgcaccattcctcagtcgttagctatatgttatttttttaagtaggatgcagacctgatgagatttgtatatgtatgttaatccacaaacaattatttacatgctgtcaaaatggctttactgtgtccaaatgcctgctaaagcccttcnnataaacatttaagttaaaactacaagtggagaaacataattcaaccctgggttggcctgaatccttttttccaatacnagtcataatgtcaatgcaaacattgttacaatncatattancgactgataagcctccgataacatcccnaatccgatttgncctgtngacaatttagcaatttttaaanaaanaacgcggtcaaacaaaanaggccaagccaaattagccncaacattgtc

SEQ ID NO: 84023 - DNA, 574 bp, Triticum aestivum
  unsure (1)..(574): unsure at all n locations
  Clone ID: PAT_TA_84023
caactcccaacattacgagacgcctcgccggccgcgccgcgcccaactcctctgatcctcttccttgtccccaccctcttctccgatggcgacgctgcagctcaaccacatcgcgcgggagacctccgacgtggcccgactcgccgccttctacgaggccgtgctggggttcgagcgcatcccttcgcccacctactcgggcttccaggtcgcatggctccgcctcccgagctcccccgacgtcgcgctccacctcatcgagcgggacccgcccgcggaccgtcgcggtggggcctggcgcccnaaggcccccgccgttcgcactgcccccgggccacaactngccttctccgtngctgatacgacggtttntgaccgggctgaagngcncggacgatgttttcnaaaatcccaaccggatnggcgacgcncaancttcttcttnnacctgacggaatggctaaagttctacnctgtgaaggaatanatgaacagaacatgattcatcactcatttacgtgatactannaactgcnaatatcattaaacggaaattctggtaaactcttctaaa

SEQ ID NO: 84024 - DNA, 669 bp, Triticum aestivum
  unsure (1)..(669): unsure at all n locations
  Clone ID: PAT_TA_84024
aatgtggcggcaggccgagcgtcttctccgggctggggcacggagggtagtggttgacgttgaggaccacgtcgccggcgctgatgtcgccctcgaagtagtcgggccggatccccatggcctcggacagcagccgcagcagctccacccccagccctctggtcagagcggtgaaacgctccacgacacccctcagccgctggggcgtgtgcggccatcgtcccttgtgccgctgccgaccggggaaaggacgangggcaagcgaagcggaggcatcccgccagtacttgtcgccgcccgtgtcntagttgtgccggagaaattcggttggnctctgactgtcctccgagtaatgtacccttgctccccgccggcactggaaaatcctcgcanactccacatttncgcataactcctcngggatccgnctccacacttttgtttcaatgcacatactatatacgtttaaaaaatatattatcatganaangggggcccgtacaaatccccnaatgatctatancncccaangctntttaaantctganggaaanctggtacnaantatgctganaatcccttnaatgntatacaaagccacgttcttcaattgcactatgaaggancccgnnggataaccgggttggtccccnncgaattcancacccn

SEQ ID NO: 84025 - DNA, 686 bp, Triticum aestivum
  unsure (1)..(686): unsure at all n locations
  Clone ID: PAT_TA_84025
cgaggcccgagtcctgctctgatggcgaccgacgtggctgagactcccgcgccgttggtggatgcggcccctgaggcgcccgcggacaccccggcggcgcctgctgttgacgcgaagccggccaaggccaagaaggccacagcgccgaagaagcgcgccagcccgacccatccgccgtacgcccgagatggtctcggaggcgattcgcgtcctcaaagggagaggacggggtccagcactttgctattgccaatttctttggaggacaagcacaaggacaanttcccgccaactttccgcaactttctgaacttcaactcnaagaactctncccccggcggaactgacaaggtgaagatccttacaacttnctcccgcaacnaaccaaagcgcccccnaagaaaccaaaccgggtntaaaacccaaggcgctgccaaacgnaagcattcccccgnnaacccaacccgcaaaaacccaaggggcgcaaccccttcaaaccgaaanacacaaaccaaggacaacaaaccaangcaactgcncaaggaaaccaggtgcgggcaacnaaccactcaaaaggcggcccccagggcaaaatngcaggcnccagaaaaggncgtgcaaancccgcccnaaaggccnnccaaggccccgaaggtcctncaanccttcaagaattanggggttga

SEQ ID NO: 84026 - DNA, 630 bp, Triticum aestivum
  unsure (1)..(630): unsure at all n locations
  Clone ID: PAT_TA_84026
ttaattcccaccccacaaccccccaccacaagaacttgttcgatcgaattcttcttcaactacccgccgcgggaacccaaggaaggaggcaaagcaaaggcttctcgcagggtttcccgtcagcggcttctgcggcgggcgccatgaacagcagcaagcaggcgctgatttacagcttcgtggccaagggctccgtcgtgctggcggagcacacggccttctccggcaacttcagcaccgttgccgtccagtgcctccaagaagcttccccccaacagcaccagtncacctactcctgtgacggcacaccttcaacttccctccgtcaaccgcggctcgtgttcccaatgggtcnccgataagcggccgggaagaggtcccttcgtctccctagagaggttagggaaactccatcaacngtatgtccatatcnataagagggcacaccgctcccnatatctganaagagacttcgttccaanacgttacattcctaaactnactnatncggcccaggttaggcaaatcntatggttacnncnagggattaaannccaagggaacccctaccgttnaaggatttangccnatgaaaantggttcggaaaattncnttgggnaaaaaaccaa

SEQ ID NO: 84027 - DNA, 458 bp, Triticum aestivum
  unsure (1)..(458): unsure at all n locations
  Clone ID: PAT_TA_84027
caaggaagccaaagaaggagagaatccaatcgaagtcgaaccaccgagcacggttaggggcggcgggggctcgccgtggccaacaagctcaagaatcaaatccccccactcctcaaccgggcgccccgcggttttataaaataagattccctccgtcaactgtcncggtccccggttngatncggttcnaactcnacctaccccaccccctccgattcccttccccaactccnggctacttccctacgccacnaccgcccngtcccggccttcggtccctccnaagcaagctggccnatggctggccgccgcgccttaagggagcactcaagctctcctctcctccaagtttcgcctccggtctgggtggacgaacatttcccagaacttgcaatctgcaaggaaaaacgggggnaccccggctttnttccccaggncctcacctcctttttgggaca

SEQ ID NO: 84028 - DNA, 642 bp, Triticum aestivum
  unsure (1)..(642): unsure at all n locations
  Clone ID: PAT_TA_84028
gtcaggccttttcttgctttcttgccagaggtgcagagcgcggataggaagataccgttcagagaaaaagttatctacactgttatttccctcttcattttcctggtctgcagccagctcccactctatggcattcattcaacaactgggagctgatcctttcctactgggatgcgtgttacctcgcatccaaaccgtgggcactgtgatggagtttgggnttactcccaatggtgacatcctgggatggtaatgcactccctgntggttcgaaattcattggaagttgacaacagtgtnagaangattctctccggccgaatggtgcacaaaantgcttngtaccctgattgctattggggaactgtggcatagtccctgcccgggaatgtttggaatgttancaactttggacaggaatgctaccccatanactcactttccttggcgggacattgcaccgtccggagatcccaaaaagtatggtgggatnngnatccccgntaatgcacaatacncanaancacnggaggattaccaaacanaaaaggctgggcnaantnaaggngtntgacgttcacgtntacaaacaaaatcngcctcgagntnaccaactcagtcattctcaactgcnccaatann

SEQ ID NO: 84029 - DNA, 624 bp, Triticum aestivum
  unsure (1)..(624): unsure at all n locations
  Clone ID: PAT_TA_84029
cgcgatgcccacgccgtgagcccgtgaggcgcgccgctggagccgccgcagccgttactatgacctcgccggcccccacctcctggttctccggcctctcgcgctcctcctccaccatggccggcggcgtcgcctcggcccccacccccgcctccgcctccgcctccggccccgcctccgtgttcctcccccgacgcgcccaatccgtatccgcgcccggtccggaaggaagcaagcggacactctgcngggcgctttcaaantacggcccaaatctgccaagtacattcaagactggggattttnacacaagtgatcttcatgggggctcaaaaagggtttttactacgatacttggacatgtcacttncattggagtttnaaaatgcctttggacacattgtttctnaanaaacacnggtatgatttcaactttaacaaatcgtttnacttganancacattncctaataatagganntgaaggatatagctggncananacggtgcaagaatgtcataatcnaaaantgccgtcaaaaggtttggnnactgaggccatattgaggattaanaacctcgaaantaatttanctgaacaantntncagggccgangntttcca

SEQ ID NO: 84030 - DNA, 355 bp, Triticum aestivum
  unsure (1)..(355): unsure at all n locations
  Clone ID: PAT_TA_84030
ctgacttggaagctgtggatcccaagccagcgtcgtagaacgagtccttcagaaatgataaaaggggctcgatggcgatgtagaatggcaaattgttgacagcgagccagaggagatagcggcggggccatggatgagatcgacggtggttgacanaaagggggttggggttgggccactttagactgtngacatacccgcctcnagaccgtcnctgtccgatgacctccattcatagcccggcggccgaacatgccccgcatactcctacccgctgctttgatgcctgccgccaattaatggcctcaactttcctccgggacgttcnggcgaaanaaccctataaactcctttt

SEQ ID NO: 84031 - DNA, 379 bp, Triticum aestivum
  unsure (1)..(379): unsure at all n locations
  Clone ID: PAT_TA_84031
anatgcgcacattataatcaccaagtcttggaacnaccatacaacaaccaagctgtttcaaactttcgatggcgtgaggatccggngcctcatttaattgttacaacanactgctttgcagctacaangccagnggtaanaatggtacaattgtacagatgccagattccagaagcaagctgcaggtcaagacgaaagccttttgggcacatcatccgtgttnggggatacatcatacanagacctggngaacagtttcgattacttccaaggtgancnacaggcgaccaattctggtatgagcntccactgnacggcgcacccncccaggggggggcccngtacncattcncctaaantgantccttttacgcgtccn

SEQ ID NO: 84032 - DNA, 283 bp, Triticum aestivum
  unsure (1)..(283): unsure at all n locations
  Clone ID: PAT_TA_84032
gagaatttaagttaaaaaaacatgcacagctcggtacaggaatacacagagttcttgtttcggttaacagaacggcgcagcagtgagcaccagccctgaagagacgacgaataggaatcgacagagaaactaggcgtgggcagacaagaagacatcacaggaagacgcccgttcttccggactgggcatgtctccggcacggccacggcagctttaagacctgctccttggaacgggatggtcctgatgatcacctggggacgaccnnaaagggggggggggc

SEQ ID NO: 84033 - DNA, 416 bp, Triticum aestivum
  unsure (1)..(416): unsure at all n locations
  Clone ID: PAT_TA_84033
cggatttctcgtgacggtgagtccgtgacacgccggcgccatggcgagcaggtgcctagcggctgcatcggaggccgccgtcgtcttcctcatccggcccatcctcgccatcgttttccgtcttcaccctcatcctcctcggctgggtacgtggcgtgggacgacggtgctgggtgcacgtgccgctgggtgcaggagattcgcccggcctgcgccccgaagaancctcctaaacccaaagccagccaaccggcggccgctcgccaanttctaccnggaaccaagcccgaggccgcacaaaagaactgcaaatccaagaagggcaccttttaagagaatcctgctgcacactaattatcaattccccnggtattccnaattnngatgcatactacnaatgatacgttttcccaagg

SEQ ID NO: 84034 - DNA, 609 bp, Triticum aestivum
  unsure (1)..(609): unsure at all n locations
  Clone ID: PAT_TA_84034
gaaaaccgcagtacgctgtacgcagctgtccctcgcagttgggcgcaccggtctactcctcgatcggcaaggccgcaactacctagatctcgaaccctcgccgccgcttctttcccgatcgccgcggccatggcgaaggagttcccccgtgccgccggtgggtcttcacgccgtccacaccgacgcaccgcggtaccctccccaaggcgttgggggccctcccctccgcccgcgttcgcgccgccccgccctccaactcantccgcggcaaccgtccccttcangtcgttccatgtatcanctgccgcgcttcttcttctncgngcaacctcttngcgggcancgttncccgttccggtcgtcctttnaggaaaacgcntctcaagggggggcccgtaccattgcccnaaatgagcctatannccctnatggctcctttaaantctgacgggaacctggggtaccaactaacnctggagaatccctttcaacggggaaacnaaaagcnacgttgcctcnaaatngnaactaangnaatgaccccttacgggataaccggggtttggtaccactnccgaaattcangccaanccccctttttttctnttt

SEQ ID NO: 84035 - DNA, 649 bp, Triticum aestivum
  unsure (1)..(649): unsure at all n locations
  Clone ID: PAT_TA_84035
cttcccctcccttccgtactcgcgctcggcacgcgggcaacggcagcggcgctcaggctctcagcgacggcgtcagcggcttcccctcccgactctcgccagtcgcctcgcgccctagcctccgatcctccgcacaccggccggtgacccagcgttcagttagtgggtccattgaagtgtactgtattgcgatncttcaaactgctgggggccatgggcctacgagattaagtggagatncaaaaagattgggatagtcctggtggggttttgggatcctatcctcatcccttgggtgttatccttttccttcnnatangggctttgttaactcccggggtatatttccttttttaactggatggnccngttaccccgttgggatcctaatgtggcacttttnccacaaagaagnaaacttaaggattangccttcctccatgggttgttcctcccgtttgtcctttgcccgttccgggatanccaggacaaggtctttgtcctcatggttatggccctacnactcccgtacaatacacatggtggtctgaatacatcaacgctggnattagntaaccacnaattcgaangcaanaanctgactangtaatacttttgtagtaaatatccnttncctaactntggttaa

SEQ ID NO: 84036 - DNA, 345 bp, Triticum aestivum
  unsure (1)..(345): unsure at all n locations
  Clone ID: PAT_TA_84036
ccgaagtcggaggcagggcaaaaggcccgatcccccctccccgccggttgccgcgctcgtgccacggtgcggtagccccgtcgacgccggcggacagcgtgcactatgggttgctcctcctccgtgccanctaagaaatactggngggctgancactntcagcancgatagctctccanacgccaagttcaaaggncttgcgtgctaagttggtattgctgnggagactcangtgttgggaaangttgcattgttcttcgntttgttcgtggncagtttgntnctncttccatggtaactgttgnngcatcttttttagcacatncattggnattggaggattca

SEQ ID NO: 84037 - DNA, 619 bp, Triticum aestivum
  unsure (1)..(619): unsure at all n locations
  Clone ID: PAT_TA_84037
ctaggttttgctcccctctttagctgagtcgacttggctcttgaattgtttctttcattttgctcagaataaaacaaactgaatcgttaatttaatttcttctattgcacactcactcactcacttattatcaatgattctcgacctggacttaggcgcccttgcgtctcgcgctgaggggatgggtctcacgcgagtactccccagagaagccaaggaaacatgtcacaatgatcaatactcggatacctgcgaaaagccaatattagcacaggcgagatcatgctaatctcttcgtcgccagcgctgtggtacccttggcgttatcgcaatgctagctcctccatcgccggcgcaagcgcctccgacaaacccgaaaccccaaggatttccaagaacccnacgactacggattgcgcgttnaagcaaaaacaacaaatatgccccganacacgccgactttgacgatcccangacaagaaggnatgatacggtccctgcantacaatgaattngacgggggaaggaccacgatcttanactccttcaaagnaaggggtacccccannaacngcaatacaggagnatcacgtgacgtggggtactcgcagtgtggcgg

SEQ ID NO: 84038 - DNA, 231 bp, Triticum aestivum
  unsure (1)..(231): unsure at all n locations
  Clone ID: PAT_TA_84038
tggacgaccaccgccgcggcgaagaacgacacgcagaggttccggcccggcgacgagctccggcggtaccggagggtgcaggcgctgctcaagaggctcaacaagccggcgctgcggagcatccagccggccttcgaccacccgaaggctgcgaaggccagaggccactggntggcgggcccgccgccggcgaggccaaaggggaatcgcctccgcgaccccgataagaat

SEQ ID NO: 84039 - DNA, 468 bp, Triticum aestivum
  unsure (1)..(468): unsure at all n locations
  Clone ID: PAT_TA_84039
gccgcctcggagctgccgcgtgtagcttgctcgctaagcagcagctatagtagctgagcgagtgcgtccatcgatcggagtcgtccacctccgtctccctttgcgattcggcgtcgtgaactcgtgttcttgagcgtgggggcaaggggcagagcaacaaggagacacttcttcttcttctttaacaacaaataagaaagcaacggaatggagggagctggtctgcagtgacagtgacacgancatggttncccgaccattcntgcgtctcatttgggcactccgtctgaactccccccggcgggaaccnanaaagggcggccggcngtctgcannngaattcggttggcnggttccccgggnaaccgtcccgggcnctgccancccccgggttnaacttcancatnaacaagcgggttccncagngggggcccngtaccattcccctaaatnntnctataccccgcc

SEQ ID NO: 84040 - DNA, 206 bp, Triticum aestivum
  Clone ID: PAT_TA_84040
gttggtgaaatcgccctgatacttccgtgctcttatatacatttcgataatagttttggttttctgacatctactgtaaggtgacctgttgctgggttgttggttatctgaatattaattgtaagaggccacttagtctgttatagctgggtggatcgcctttatcaaacaatattttttttttttttgcaaaaaaaaaggggggg

SEQ ID NO: 84041 - DNA, 326 bp, Triticum aestivum
  unsure (1)..(326): unsure at all n locations
  Clone ID: PAT_TA_84041
gcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccaacggcgggagcaaggaggccaagtcgcccaagaaggccgccaatcccccaaagaaggcatagggtttggaggcggttccgatgttgtcatgtgtagttgtaagcgggcaatgtgattggctgtgttacctnttccctccaattgctttaagtccatccccaaatggataaggaaaaa

SEQ ID NO: 84042 - DNA, 632 bp, Triticum aestivum
  unsure (1)..(632): unsure at all n locations
  Clone ID: PAT_TA_84042
ctgacatggaaatattttccatgtacggagtaggcattcctactgaaagggcatatgtctataagttggccccacaggcagaatgttatatacctttccgaattgacacctcggctgaaggcggggaggaaaatagctgcttgaaagggggtgtttacttagccgatggtgatgaaactgttccagttcttaagtgcgggctacatgtgtgcaaaaggatggcgtggcaaaactcgtttcaaccctgccggcagcaagactacgtnnagagaatacaccactccaccacctctactctccctgggaaggcaagggcaccccagagcggtgcacatgtttgatataatgggggaacttgctcctaatttgagactcanccagaatactnctgggggcaaccngtnaagaattnngtggcgattcagtttatccaaatatatccaatgggcaanagaaacaaatngaattgttacctaagggaattaagattcccacctttatgcgtccaaatgtccgccngatgcatccggtttgctaaatatgtatttcanctcatcgtccttgcaaattcattgcagacncatcatacactacccattnnatgtntaacgtaggtantnnttcactaatnt

SEQ ID NO: 84043 - DNA, 176 bp, Triticum aestivum
  unsure (1)..(176): unsure at all n locations
  Clone ID: PAT_TA_84043
gtcggtttanattttagnttctgttattgtttcttcctcgccnacncatnacattgatcccccaagaatgttcacaannttgtcngtggacactttcntcggtttaccttccttttnatttgnantgtcnggaaattttanantatgtattatnnattaacaggtaaataatttat

SEQ ID NO: 84044 - DNA, 547 bp, Triticum aestivum
  unsure (1)..(547): unsure at all n locations
  Clone ID: PAT_TA_84044
acatcatcattttatcaactgtgaggtcaaactcggttgggaaggtaggttttctttcaaacgcacagcgggcaaatgtgtgtttgacacgggcaagacattgcctttggatcctaggaaatgcaacaactctagcaagcagtggatctatttggtctgatctagttcgtgatgcaaaggataggcggtgtttcttcaatgccagtagcgactatgttatctctcacgtgattgctaagcaaaggagagatctcgacagagttaatgttgaaaagagcatccatatctcaagttccaaaaactgcagggtttgggttgaaacgcgatccccaaatgaccttaatgaacagggcacttcttcgacgagtgtttcacattacgctggaatcccgtcaagtgacattgttgttgttctgaattcaacgtccaagcaataaaaatgaggatgttgaggatataacgtcatccaaataaagagaatgataaggatacaagctagccgttatcagataaaggaattcttgatggaacatatctcncattcttg

SEQ ID NO: 84045 - DNA, 474 bp, Triticum aestivum
  Clone ID: PAT_TA_84045
ctcccgttccttttgatccatggtgaacctcgacctaatatctgggatacactggagggaaaatggaggctgcggcaatccttgtgcagatgggccgtggaatacagcatatgcaagtgtttgattgtgcagcattctttattacttgggcgcaaaactgatcgtctgagccgagcagcaaggtattttgatcctgcactgctcccgtgtacaaacttggttctcaataaggcaggcaggaatgtgcatctgccagtggaacagaggaacctgcacagtatttatgtacaaacttcattacatgttccgtctatactaggaaaaacagaatatttgtaccaatctatacttgattaaagtatgtaaaggagcccttttttttcctgggtactgtaatcgtcggagtagttttgtgagatttcgtagaaaggttgaatgtgatataatatattttaagggcccaaaaaaaaaaaa

SEQ ID NO: 84046 - DNA, 353 bp, Triticum aestivum
  Clone ID: PAT_TA_84046
catcattcgagttactatcaagttcatcattcgagttactatcaagttcatcattcgagtcgagttgaggctaagggagttaccgagtcgacctgttgtcggttggtcgtaatcaaagaggtcaaaactgctttgttgatgttcgttctcgatgcaacactagtttagtttcccttccatcaattgaaacggattgatcagataagttgagctcgttcgctgctgctgctgctgctgccaggcgctgcgatccgctgcctgcgtttttgcacgctgcagcttgttcttcctatacctgcctgtgttagcgtttttaatgaataaatatacttcttgctgttaaaaaaaaaaaa

SEQ ID NO: 84047 - DNA, 277 bp, Triticum aestivum
  Clone ID: PAT_TA_84047
ggagttctagagatgttaccctttgcgccccatgtttcgactgctttatatcttttgaacgcaaaaagggggaaatacacaaaaggcgtatgcggtgccgtggatctcttgcccatccgtgaatcatgtgaagaaagtataaatgatttcaacttggcctatgtcagtgttgcgcttcctgtctcaactactcgccatctggttatacactctcgtttctggcctgtttcaggatgcggaagtatgctttagatttcactctcttaaaaaaaaaaaa

SEQ ID NO: 84048 - DNA, 333 bp, Triticum aestivum
  unsure (1)..(333): unsure at all n locations
  Clone ID: PAT_TA_84048
gctgagcccgcgcgtgccgcggntgctgccntccaccttcanctccgcngccggtgcccggtgctttggccccgccgcgaggtgccangcgacggcggnggncggcgtggcggncgcggngcccccgtcntcggagctgnancgncatccggtggggcancgccaagctgcanggcnctcgcgacnanatggangatgaagtcntgctccgcccgggntccctcctcgaatggcttcnccttcgcngccgtcttggatggncacgccngcttctctgacgtccagttcctcagggatganctgtnacaaagagtgcncagctgnagttggaca

SEQ ID NO: 84049 - DNA, 538 bp, Triticum aestivum
  unsure (1)..(538): unsure at all n locations
  Clone ID: PAT_TA_84049
gaaaaaaagaaatcaagatatatccaacccccagcaaaccgacctggcactttggttggtgacacaagggtgcagtttcacaatgaccaaacacatcttttggtcgtccatgagagccagttgggaatctatgatgggaatcttgactgtttgcgcttgtggtctccaagagatgcactcccagctccgatatcgagtgcgatatactcgtgcgacggtctcttggtttacgctgggttctgcgatggtgctatcggagtcttcgaagcagaatctcttangctgcgctgccggattgctccttccgcttacattccaccttcaatactagcctgtgctggacgggtctacccgttggtagtcgctgcgcacccatgggagcctaaccagatcgcgatcggcatgaacgacggcaagtccatgtggtggagccattagacggggaccgaatggggatcggaactccacaggacaatggaggcaccgcaccgcatcaacgatataacggaacgtcaacgcacaacaagcatctatagca

SEQ ID NO: 84050 - DNA, 543 bp, Triticum aestivum
  unsure (1)..(543): unsure at all n locations
  Clone ID: PAT_TA_84050
agaaagccttggaagagccgaggcggaagcagaactgggaaggggagaagattccgatggggactaagaaacagggaggaggcggaggagaccagaaggtcctcctctggaggctgccggaggtcacctctaaggagctcggcaagataggccccgccctcggaatcggcatcggctgcggcgccggcgcaggcatcggattcttcggtggtgcagggttaggctatggatttcctggactcacattaggctttggagttggagctggatgtggtgtgggaattggctttggttatgggttgggcaaaggaattgcatatgatgaaaagaaaaatactccaatgttggcaagatgttccangaactccacattttcctatggacactgtcggtgctttatttgacganctggttataacaccaagaagcttgtgacatcaacatccaaaaggatcnaaaaatggcgttgaacggaacactgcattgttgcncaaaaacccctgaatntacaacgggattcaacacaatttcntancagnaggn

SEQ ID NO: 84051 - DNA, 525 bp, Triticum aestivum
  unsure (1)..(525): unsure at all n locations
  Clone ID: PAT_TA_84051
gataaaccagtcactctactactcgatggaaccagcaacatgggctgtgttcctcggcattgccctctgcgcagcggcagcgctcttcctttcgcgcggccggcgcccggtctacaaccccccgccgggccccaagccatggccgatcatcggcaaccttaacctcatgggcgagctgccccaccgctccatgaacgagctgtccaagcggtacggtccgctcatgcagctccggttcgggtcgttgcctgttctcgtcggcgcgtcggttgagatggcaaagctcttcctcaagaccaacgacgcggcgttctccgaccggccgangttcgcaatcggcaagtacancgcgtacgactctccgaccttctaagggctccttcgggccgtactgcgccaagcaagcangatttgcgcaacgaactctnaacgccaagcgntcgatccttcaacactcgcgacaagaagtcnctnatctcnaaactcgcaagcgttggccacgtcggtangacactgaaatnttgg

SEQ ID NO: 84052 - DNA, 549 bp, Triticum aestivum
  unsure (1)..(549): unsure at all n locations
  Clone ID: PAT_TA_84052
cgccgatgggcttccatctgccgcccttggtggacggcatgggaatgggcatgccagcagccatggactgcggcgctctaggccatgaccaccgcgttgccggcggcaacaacaatggtcaggcggcggcggcggcggccggcatggcgaacggctgctgctacgggcagctgcagaagcagcaggaggaggagcagcagccgtcgctggggcaggaggaccagtgggacgacgagtcggcgcggcacctgctgatgtgggacgatgaccaagaactaacaccgtccaacctggaagccatggaaagtacagctcactccctcctttttatgggaccaaatgaccatacatgacgaaaaactagcttattattggtgtgcatgcgcatctatccccctctcttcttgatctgatctgctactctanctctctcaccgatctgctgatcgtgtcatacatgcaataanaagttgttgtcaaggagcataattattttgcngatttcaatttccatatgattaccttattttttggtttaaaaaaaaaaaa

SEQ ID NO: 84053 - DNA, 557 bp, Triticum aestivum
  unsure (1)..(557): unsure at all n locations
  Clone ID: PAT_TA_84053
taaccctccgccgcccctcggacccccaaccagcagctgccgcggccatccgccggcgagatggcgctgtacctgctgttcgagtcggcgtccggctacggtctattccacgcgtacggcatcgatgagatcgggcagagcgtggaggccgttcgctcctccgtgctggacctcgatcgcttcggcaaggccgtcaagctcaccgccttcaaccctttctcctctgccgtcgatgcactcaatcagtgcaacgctatatccgaagggatcatgaccgatgaactgaggagtttcctggagctgaacctgccgaagcaaanggaggggaaagaaaggccaaatacagcctcggggtcgtcgagcccaaggtcggttctcacatctccgangtcaccggcattccctgccagagcaacgaattcgtcaagaactgctccgcggtgtccgcctccacttcgaccgttcatcaacancttaagatctgacttgagaaggcaacttggctggggatactacagaaggcaagtgaantaatgtaatctgttacaaatgggata

SEQ ID NO: 84054 - DNA, 327 bp, Triticum aestivum
  unsure (1)..(327): unsure at all n locations
  Clone ID: PAT_TA_84054
gagggaccgagggagccagtgagcgagccagactacccacctactaggtccagcggcaatgaggggcagcgagatgttgaccgcctcggggggcaccggcacggccccgtccacagcctcctcgtcgtcggcagcggcggcggacctggttgccggagccgggggcttgggcgccatcggcgtgggcggaggaggcggcaacttccccctcgccgttgctctcctcgccttcgcctgcgccaacttcatcaacctcctctccatctggttaaaagagaagaggtgggatgcagggaantttcttacttcagctggagtcatgtatct

SEQ ID NO: 84055 - DNA, 322 bp, Triticum aestivum
  unsure (1)..(322): unsure at all n locations
  Clone ID: PAT_TA_84055
gtttancncaanatccatcaacantgggcgtggtgctgagtttgnaggggnantcattgnattgattccatctatngactactcgcacanataaagtcagtgctctacgcgaggctttctaccgatcagaatcttccaaatgtgaccaatttacttgctactgtattggncttcctcatanttatctatttccaaggtttccgtgttgtacntcnantgaggtcaannaatgcccgtgntcatgaanggctcataccaaaancatttggttccnatatttaaaaantgccntatnatcnggnattctgnanaaattncaaac

SEQ ID NO: 84056 - DNA, 561 bp, Triticum aestivum
  unsure (1)..(561): unsure at all n locations
  Clone ID: PAT_TA_84056
tttttttttttttttttttttttataacagcagcaagctttgctgttccaatcatatttataactgatccacgtactatgaagatgacatatccgttatttataccggtaaacatctgccctcagacgattttttttacaaagagacgaaaacagaagatgaaatccgacttctcctaggccacacgcaccaccattttatcgagccaatacatcaaatcaccgtttggtttttttccccttgcagccgtttatgcagtggttgagaaaaaaatgacggcatcatgttactgcacttctgctctgccgccaggctcacaaacatgtcctaatttgaaccggatgtcgcaacacaaggggcggaggcgttgctaacgcngggtacccgtactggtagtaccaccaccagcagcagcagcagcagagttgctctctgtnacctttcattgcntgatcgtagcagagggaactcagaagtggatgcgggcgggctacacttgntccgntantcccaagttcananctcatcancgtgtacggagcaatcacattactcctntat

SEQ ID NO: 84057 - DNA, 197 bp, Triticum aestivum
  unsure (1)..(197): unsure at all n locations
  Clone ID: PAT_TA_84057
agaatantcaggttttccatctaaatancanccantgatgtacnacatacagtnatacaaagaatgtgacgcccgccgcagggaggcagccaangcggnacgcgcgcgcgccccaccgcgtcaagagctcaagacgttgtcaggcatggtctttcntgctggacgctgttacacctgcagcgcggngttcnggacga

SEQ ID NO: 84058 - DNA, 299 bp, Triticum aestivum
  unsure (1)..(299): unsure at all n locations
  Clone ID: PAT_TA_84058
gcaaggcccggggccgcgccgccgacaaggctaagggcaagtttactgccgacgacgtcgctgccgccgccgctggtggcgccgccaccggcgcctctctccaggagatcgactaggctcttcacggtcatctgatggttgtcgtaccgccttttcctcatctctttagtttttgctaccaatgattatgtgatagaggttttatgttatttgaaaactgctctgtgcctggatgagagttctggaacataatgtgaacctgtgtgtctgtgacctgaaaaaaaaanaaaaaaaaaaaa

SEQ ID NO: 84059 - DNA, 543 bp, Triticum aestivum
  unsure (1)..(543): unsure at all n locations
  Clone ID: PAT_TA_84059
gtttgttcgcgtcttctccctgtagggaactccgttacccggccccggctgtgcgtggcgtcagcacgccccgcgggcaggagggtgaggctgctgagcgtgaggtgcgagcagggagccaagggcggtggcgggctggacgtgtggctgagccgcggggcgatgctgggcttcgtcggagcggtggccgtggagctgaccaccgggaaaggcgtgcttcagaatgtgggattgaccgcgccggtgccgacgctggcgctggcgctcaccggcgcggtcggcgtcctcacggccttcctcatcttccagtccgggacgcgggactgatgggtgaattgtcaaagctcccaaaaggacatgcataaagtctgtcagagtcttgtgctgtgtatgtctatgctgttgtaattgccttgccttcacangaactgaggagtaacacagncgaaaaggataattataattttacaaaatgtgttacagtaccctcctgaaggacaaactgcattangttaaattgnataatccaatctacacacaann

SEQ ID NO: 84060 - DNA, 171 bp, Triticum aestivum
  unsure (1)..(171): unsure at all n locations
  Clone ID: PAT_TA_84060
cggcgacgcggcctcctgtaaccgtctcangcntancctcggatnagtgttcangcgtcnganntactagtaggagtancctgagtaaattanggtccaggtanatactacgctgcngttgaagtcnaaattgctganccactcgcctgttcncgtcgcacnaaattatta

SEQ ID NO: 84061 - DNA, 425 bp, Triticum aestivum
  unsure (1)..(425): unsure at all n locations
  Clone ID: PAT_TA_84061
gcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggtaaaaaanan

SEQ ID NO: 84062 - DNA, 576 bp, Triticum aestivum
  unsure (1)..(576): unsure at all n locations
  Clone ID: PAT_TA_84062
cattggagagcataagtgagggtgttccaatgatatgtagaccacatttcggcgaccagatgataaatgccaggtatgtccaggaggtgtggaagatagggtttgtgttagagggcaagatggacagggacaatatccagaggagtgttaaaaagttgttttgccacaaagaaggtgganagatgaggcgaagggcaaacaatctcaaagacaaagcaacccagtgcattaagaaaggaggctcttcacaaactggaattgatttgttggtgaattgcataatggcattaccttcttccatttagatatnactnagttttgancatatangttcccgtgtggcaaattgttgngagctganacgagcatttgaanacaactgnattantgtatgaccgcangccacattgcaatattgtccggcattttcgcttgtgcatgctatatatcaacagcatataagttttaattgggaaaggantgnaagaatacctaatgtccgcctatnccaatanttaaaatatcactgtacanancanaaaagccnagggggccggtaccaatcgccatatggtc

SEQ ID NO: 84063 - DNA, 645 bp, Triticum aestivum
  unsure (1)..(645): unsure at all n locations
  Clone ID: PAT_TA_84063
gctgatcatcaacccatgaacagcgcgttcagtggatcctcggaggcgctgctggaccaccagaggacgaaggacggcagcgacaagggcgagccggagctcggccggaacggccacgacggggttctgagctcggaggcggctgctgcgggggactgctcgtccaagaggacgtccgactccaagaagaggagaaggcctaacgaggtgatgggaggcgatcaggtccagtcgtcgaacctgcccgccgactcagcgaacgagagcgtgcacagcaaggacaagggcgaggagagcagcctggcaacgaccaccaccggacccggcaatcgaaaaggaaagggggcgaaagagacctccgagtcgcagaaggaagactacattcatgtccgagctcggcgcggacaggcaaccaacagccacagctagcaaatgtaggnnggggaaaaanattncgagaggatgaactgctgcaagactcnttcctggctgcagaaantcactggaaagngtaatcttgcnagatnataacttgtcatcctgcaagacaatccagttctataangaactcgaacgnaaccaaggntgacnaaananagggttcaccaaagtnttncgctnctggtcctcgctccttgtccccgg

SEQ ID NO: 84064 - DNA, 529 bp, Triticum aestivum
  unsure (1)..(529): unsure at all n locations
  Clone ID: PAT_TA_84064
atttcgctccccacagcggcggcggccacagccacacgttctcgcgcgggatctaattccaaacagcactgcccttgcttctaccgttccccaagtgcgctccctctctcgccatccatctcgtgcacgactgggcaaccgttgccgctgtcgaggtgcccaggtcttcatcggtccctcgtcagttcttctccggcccttcgccgccgacaagctcccccagtacttatgttaccanaagcaaggctagtaaatcataccggaaagaatggtgatggcgtcttggncctgggtctgctaagatgcatgctactgccttaatcgcaaagctagcttactggtcatacgaatttgtagtcggttctgatcaaattgcaagtgcatcnaataacttgganttttcncaaaaaaaatatcgggtgttcaagcctggncctgngcntgaggtactaangagaaaggncaagagttacaagnggatgagnccccnaacggttatacnttcncctnccaaaggnaccaagaaggt

SEQ ID NO: 84065 - DNA, 621 bp, Triticum aestivum
  unsure (1)..(621): unsure at all n locations
  Clone ID: PAT_TA_84065
cttggcctcaccttctccaacgaggcaggcacactcccaccgtgtggcacggggggacagtgctgcatctggcagttcaatttccggggcttcaacccgcacacagacccttacagccccgactccatcgacctgctccgccgcagcggcatcgacttcgacctctttgcggtggagggggtcgattccacccgcttcgccgagctgatgatgtcgtctgggatcgtgctgaacgacgatgtccagtgggtgaccttccacggtagccacgacttcggctacctcctcaggttgctcaccggacgggaaatgccaacaccttggatgagttcttgaagctcacaaagatcttctttccggtgatgtacgacgtcaagcatctcatgaagttctgtggcctggcctatatggtgggctgagnagacttggaaactgctcaaggtcaagcgtgttgggaccggcatcaagctggttctgattgncgctgacctgaagtgctcanaangtcaagcatttacttaaggatcgtaagttgtanaaggttgttgttggctatccgggaatggnataaatgcncccgcaatgatatatggataatacagatcgatgnaaatggaaant

SEQ ID NO: 84066 - DNA, 463 bp, Triticum aestivum
  unsure (1)..(463): unsure at all n locations
  Clone ID: PAT_TA_84066
gagcaacttggtccacagcttctctacacaatattttcgtcagtctgtgtggtagcctcaatatttgtgaggcgccatgtgttggagacgaagggaaagactttacaagagatagaggtttcactcctgcaaccacaataaaggtacatatttgacgtggctggaaccttgggcaggctgtttctgttcagcaacagcctgccctgcagaagttgattcctgaagtcatcggcaacgccctacaaatggtctcagggaagttccagatatgcgcctgcgacagctagggcggtgtttccatagagcatcatgtactgaagttatgcctgtatcgcccgccctagatangatatttcatacntgtgttgtcatctgttctactatagtcgtaatatcagaaaaaaaaggtactactgttttaccgttgatgagcacagttgaaaaaggaactacanctcattta

SEQ ID NO: 84067 - DNA, 314 bp, Triticum aestivum
  unsure (1)..(314): unsure at all n locations
  Clone ID: PAT_TA_84067
cgggtacgtgcaggcgcacaccatcgactccggcgccacctccgggaccaccgtcgtccagtacaccgtcaacgtcaaggcctagctacctgttacgtacccttgcttgcgactccgggccgtggcttctcgtacgtccatccatatctccggntgctttgtacacaccttgtctgtcgtctttgagcgggattcggatttgcanagccnantttactactaaagtttcaaaatttcacagagttgtagggtcgagaattaanatgtgtcganaacacgttagncgaccattcttatagaggtttttgttgggc

SEQ ID NO: 84068 - DNA, 255 bp, Triticum aestivum
  unsure (1)..(255): unsure at all n locations
  Clone ID: PAT_TA_84068
gctaccctgcctgaccaggcccacaggctgtctcctgcatacggtggnaacacaccaacactgctggcctgccctaagacacatcttcgcgttgcgtccactggatacctgctttcttagtcagcagcatgccgaaaccctccatttgtgaaacctcagcggtgataggcggtggttgtcgaacgctggcatgaaggtgtgagctcccaactgctgaatcgtgttcctcttttacatgcacgtgtccaacaagaa

SEQ ID NO: 84069 - DNA, 565 bp, Triticum aestivum
  unsure (1)..(565): unsure at all n locations
  Clone ID: PAT_TA_84069
tttttttccagatgtgcaaggtttttttccatcgatggtcgctacacacgtctatctatggtacgaaaccaaccaaagaaaaagacagtagcatgcatgaaacatcggctgatacgccacgcatggttaacacaacgggtttgctgtcaaactccatctgaaacggtcgaccatcatgcaagtaaccagccaaaactaggttttctaggtaaacgcagcctactctgcttgaggaaacgcggtcagcgagctaccctgttcatgtctagaagatcaacggccagcaaactgcccatctaagtctaangcgctgctgaaccaagttgaccccttgagtttcctcggacggctgcgangctcaataagcgcttcgtatagaagccttttgcttccatcttcaacaagangggcctggtcctctcctgnacgcttccntttcttnagtcattacaagattgnaagaaaccgaccctgctgcnctgnatgaancgtatgttggnctaaaatggncaaatgttgntgatctcaggacttanaaacataccaaggctctttganggtaaac

SEQ ID NO: 84070 - DNA, 606 bp, Triticum aestivum
  unsure (1)..(606): unsure at all n locations
  Clone ID: PAT_TA_84070
gtaggcagcaagagcaagctaacaggcaagatcagttaagctcccagtttgcttcgaaagctcaggttggccctacccctgctcttattaaggctgaagtgccctggtcagcccgaagaggcaatctctcggagaaagaaagagtcttgaaaacggtgaaaggtatactgaacaaacttacaccagagaaattcgatcttttaaagggtcaactaatggaagctggaattactactgctgatatattgaaggatgttatatctctcatatttgagaaggcagtttttgagcccactttctgtccaatgtatgctcaactttgttctgatctcaatgaaaagcttccgacattccttctgaagagccaggtggcaaagagatnacattcaagcgcgtgatattgaacaaatgtcangaagccttngangggctagcaacttaagagctgagattccaaattaactggcctgacaaaggatggaagaanagcaaagacggttggcaacttananattggaaatccgntaatggggncaccaanaaaaaaggtccnagaagnattaacaatgtatnggcattgggctggntgnaaaacngcctgaagga

SEQ ID NO: 84071 - DNA, 371 bp, Triticum aestivum
  unsure (1)..(371): unsure at all n locations
  Clone ID: PAT_TA_84071
cttgactgggcctctagaggaaagaactgttgggcagacaaacctgctgcgatcgtgagtgcaggcggcggctttggaggagggaggtcgcagtaccatctccgtcaggtcggggttttcctggatctccatttcatcaacaagccagaactgtgcgtccaagccttccagcagccacccaagtttgacagcgatngaaatctggtcgatgctgaaatcanngagcggctcannaaagtgctcctancccttcaggccttcacgctcangcttcagaaggaggactgaatcaactccggtaccatngtannacgtgcttccctgagaagcgtttattgctcttggaagttgtaacgcgttgctgggtggct

SEQ ID NO: 84072 - DNA, 252 bp, Triticum aestivum
  Clone ID: PAT_TA_84072
actatatctcgatcgggcggcatgcctggtaattcctctggaaatacatccgggtaatccttcacaacaggcacttcttcctgaacaactcctgagagtgaatttacttgggtcctctttggcgcatgccgagacacatacttaatccgtttaccctctggggtggtcagcagaattgacttactggtgcaatcaatgtttcctccatacatcgatagaaaatccatgcctagtatcacatccaatccttgt

SEQ ID NO: 84073 - DNA, 551 bp, Triticum aestivum
  unsure (1)..(551): unsure at all n locations
  Clone ID: PAT_TA_84073
gccggcggaggacaggaacaggacgatggccaagggaaagaggtggcggttcgcgatggtctgctcctcgaacatgaaccggagcatggaggcgcactcgcagctgggccgcgctgggctcgacgtcgagtcctacggcacgggcacccacgtcaagctccccggnccctccctccacgagcccaacgtctacgacttcggnaccccctacggngccatctacgacgacctccgccgcaaggaccccnaactgtacaagaggaatgggttgctgcctatgctgaagaggaacacctcnggtgaactggcgcctcaagnggtgggcaagacaatgccngngacggggtgttttgatatgataatgacnttngcggagaggcctttgactnggttgtnnaaaatattantaaccgcnaccgaggttatgaatgtgtgctgataataaatatgattcaaaggtacangangaactggtgttggggnaacttgcgtaaatttgccaaaactttaacaattgatggnactggaagaatattganactgatacgatt

SEQ ID NO: 84074 - DNA, 633 bp, Triticum aestivum
  unsure (1)..(633): unsure at all n locations
  Clone ID: PAT_TA_84074
cacagtgagggcacgtcgcagcagtgccgcggcatgggcatcctcacagtcctcctccggacggccataagtgatttgggtgcttgcgtgcttgctgcttgggggaattttatcacagcttggagaagacccctcgccattttgcatttccaatcgtcgactgtaatcttgctgacggagagtacatccttgtgccggagcaaggagctgctcaggaggtagccccagatcccgcacccgagtctgcaccaagaggacctgcctgccactgctttggaaggtccttggaggacatgggttgctgggagtgacttggccgtccacttgccaccgggttggactgtccgagtgggacctacctcggctggaggaggagcatgcaggatgatggacaggttccccaccctctgtttacttaccgttagtttatcccgctgcacttcgaacaaggatgacacttttgcaaatcccatgatgatgtataacttaatnccttcagcatggtttaagcttaaacaaanaaanaaaaatcnanggggggccgtaccaatcgccaaagganctatacngntactgcgtcgttaaagtctacnggaaacctgngttncaactaacgctgagaaanccttcagg

SEQ ID NO: 84075 - DNA, 636 bp, Triticum aestivum
  unsure (1)..(636): unsure at all n locations
  Clone ID: PAT_TA_84075
gtctcagcatcgccccttgagcccagggccaagactgccgttcttcccttgaagcacgtcgtcaaggccagctccatcaaggccatcgtccaaaagggccaggcccgtatccgcaaggtcaatggagaggattctttccacgtcgatgccgtcagctctggctctgtcactaacgaggatgtctcctacgtcgcgcccgtcgtgattgggaggcaagacctggaatctcattgttgatactggatcttcaaacacttggtgtgggtgctcaagaccaagtgtgagccaacatcaaccggcaagtctaccggcggttctgtcagtgtctcttacggtctgggtcgttctccggcaccgagtacaaggacaaggttagtttggcggctcaatgttgccgcacatcgattggtgcggcaagcantgccaacggttctcaagtgtagatgggacatcggtttggcccgttgatcttacngagagatgtctcaacgcgacacggtccanatttagganatctctanagcaaggtcanctcgtctaagngntggggtcccttaaccagatcggancatgtaggaccaatggaattacctcgtggngnnaagtcattaacggcccantacttcaatctanagg

SEQ ID NO: 84076 - DNA, 385 bp, Triticum aestivum
  unsure (1)..(385): unsure at all n locations
  Clone ID: PAT_TA_84076
cgcgcacaggaaagtgttcgtcctcatggcgccgccgcagccgaagtcgggcctcttcgtgggcatcaacaagggccatgtcgtcaccaagcgcgagctgcctctgcgcccgtcccaccgcaagggggtaagccaactttcagcttttttttagggtcatcatgttgatgtcgcgtctgttagtacctgttggattaggtgttacatattgtggggttcaggatgctgagatcttactangttaataggatgggtcaggattcgtttcaccatctcaagccatgcgttttaaatcatgtccttgttcatgtttacaactcaaaccannacacaatttcatggatctgtagtacttgtgagaagatgatggactactcatccctca

SEQ ID NO: 84077 - DNA, 571 bp, Triticum aestivum
  unsure (1)..(571): unsure at all n locations
  Clone ID: PAT_TA_84077
ccagcaccaaacttccatccgccccgagctctgcctccgccgccgccgcgccatgaggcctctcgacgagaaggagacgactcaggtattcgagaagctgttcaagttcacggggcccaacctgaagcacctcctggagcgccccgcagtggagggccccgacgcggagcccggccgctactgcctccggcttcaccgcaatcgcgtctactacgcctccgaggcgctcgtgcgccgcgccaccgccgtgtcccgaccgcgcctcgccgngcgtggggacgcccatcggnaattcacccaccacggcgcgttccaccttacggccacgcgctcgactcctcgctgnacagcgcgccgccgcgtctggtcaaaccggacaccgagcgtcctttcnctttgggattccgtgccaaatcttcttcgctcgnatcaccnagaacacaaagcggggacgggtggctnattccatggtgantcctctcggttcggatncggaangtccgncaagntgaggaggcganaaangcgtctnggcncaaatcggcccggganantcgnaggggggntattt

SEQ ID NO: 84078 - DNA, 407 bp, Triticum aestivum
  unsure (1)..(407): unsure at all n locations
  Clone ID: PAT_TA_84078
ctgacttctttgtgggagcgaagggctcgggaactaggatggagacccgagaatgccaaggcacgtctaaagtagtaaaaccagtggatggtgttggatactatgtgtagcaatagatctcattgtaaaaccagtggatggtgttggatactacgagctcgagatgatgaggaaacaaatgagttcctggttggactccgactctctttacacgccatggggccttattgttcatagtaaatttatgttcatttgtaagtgtactttcattgttctttgtgaacactgttgtgtgttgtacttgggatggtcataggattacattggtcattatttccctgggatgttccaaaaaaggagaaaataatggtctgggggtgggtggcataaggaagagntgcctgcaa

SEQ ID NO: 84079 - DNA, 318 bp, Triticum aestivum
  unsure (1)..(318): unsure at all n locations
  Clone ID: PAT_TA_84079
gcttttcctcttctttccccatccaccctcgcaccctcaccgaaaggagaaggcttcagccttcaagcgcacacagccacgcaaatcccctcttcatcaacctcgactcgagtccgcgcgcgtccccgaatcgagaggagatgagtcgtccgnatgacggtnaaaggtccttctttccnatggggaatcccttnaggatgattctcccaagaggagcccgcctgtcaccgaagctcantgagctgctcacttcgtatgangatgggcnggcctccaacttnagggaagncaagccangagncaccncaagggngttta

SEQ ID NO: 84080 - DNA, 576 bp, Triticum aestivum
  unsure (1)..(576): unsure at all n locations
  Clone ID: PAT_TA_84080
cccagttcccccagctccccccaccttccgttgccttctcgaactcaacccccgcccccgtcgcggatcgtcatggccgccggcctcgccttccccgtcgcctcctttccactcgcctgcgtctcctcacctccccaccccgggcaccgcatctgctgcgcgatcccgtcgtcgtcctcgcgccgcaccgtcaaatcctcgccgctccgcgcgactaccgtcctctccagggaacgacggggcacgggccgtggcgcgtccgtagtgtgcgctgtccaaggccaggacacgaccatccaagtcccagatgtgacanagtcaacatggtaatcactcgtgatcgnagagcgaagttcctgtcctgnttgattctccggcggnatggtgcngggcatgcaagatgntagaaccagttgnnggangtctcnaanggatacgaggggaagtgaaatgtncaacnancanagatangagcccggcatgnaagaagnacgggccgggngatcccacaanangatttnaaggatgggagaaaaggtccgnttcggggcgtcaaaaacaatggnaatgatgaga

SEQ ID NO: 84081 - DNA, 613 bp, Triticum aestivum
  unsure (1)..(613): unsure at all n locations
  Clone ID: PAT_TA_84081
ggacagcttggtcaacatcaacctagccagggcgggaacaatgcaggcagtgccacaggtacacggggaaaccctagccttgacaccttgatgagcatgctcagcgggcttggttcgggaggtggtctaggtgttccaaatacctccagcgtgccaccggaggagctctatgccacacagcttactcaactccaagaaatggggtttattgacaccgcggagaacattcaagcactgggtcgctactgctgggaatgtacatgctgcggtggaacgccttcttgggaaccttggacagtagctaaccccgagcgagcaagacactattccgtaanccttaaaaattgtcgcgcatatgcaggagtgttccggttaatgtccctcaaaccccaganttnaaagcggcggcgtccatagccccnaaaacaaaatatgaaagatcangnacctttattttgtcataatggnggcctgncttttttttacagnatgtatttgcaagtnattgggtaatactacggcggtgttactcctgtagcgtcttcaaataccatctgattcatatctcaatcaattttacnatcaaccaanggggttcttcaaaaaaaaaaaa

SEQ ID NO: 84082 - DNA, 165 bp, Triticum aestivum
  Clone ID: PAT_TA_84082
ctcttacaatatgcatgcgccggccgacgacgacgcgcgctgcctctcgtgagcttctgttcaagtgatgcatgtttcaaggcatccatggatgctttacgtatatgcgtattaattagccgtgtcagggaaccggacagaagggggtgttgttttatatttact

SEQ ID NO: 84083 - DNA, 593 bp, Triticum aestivum
  unsure (1)..(593): unsure at all n locations
  Clone ID: PAT_TA_84083
ctttcttctctccgggctcacctaccggatcatcctccatggccaccctcgccttgccgccgaccaccaaggctgccggccaggacgccacccaggaaagcctagcagagtatgttttgttctgtttagcggtttcttcgcaagaaccaatctacaaagtttccgtgtcgaaagtcgaataatggttccttgttttttttctcttcctcctaatgcaacgggatcaggaatcctgccaaggacgccgcagatccgggcagcatggatccgagtgggtcttctcgggaaaacggcatcgtcccggccgatgtggccgccgccgccgccgcggggcacaacaactcaattctcgccgctgccgatgatcctactggggtgcaatggtctccggggcgtggtttacacggctgtgccntctacaagagggtgtgaagtcnaaggtgaacttggcatgtaaaatgcatggaggcctgganagtccccaggtacggnaatnggtgcaaatcggcagtcctgcaaaaaaggtcctganaggtgcntgaggtggatgcttctaacgtgtaagagaatagttagaacacntagtnagggac

SEQ ID NO: 84084 - DNA, 339 bp, Triticum aestivum
  unsure (1)..(339): unsure at all n locations
  Clone ID: PAT_TA_84084
cgagttttttttttttttttttaaatagcagtagttgataactaattgcagacaagtcattgttttacacagcatcattcaaatccttaactggaatcaaacaaagtgctcaatgaacagggcaccaaaaacttgcacaggaagaacccttactcctccgggcgctcaaagacacaagaacacgggtaacgatatacctctcaacatgaaaaggttggcctgggaagcttngaaagtggcccggggcttcccnggtaggcggcctgaccttgccggtacaacaagcgggacttnatcnccngggtttgngactgctttggggttnncccccttggcaaa

SEQ ID NO: 84085 - DNA, 587 bp, Triticum aestivum
  unsure (1)..(587): unsure at all n locations
  Clone ID: PAT_TA_84085
ctcgcacatccactcgaatcaatcccttttttacccaacctcgcaacttttctttcacacaagccataatgggtgttcagaagaccatcatctccgagggcagcggcccctctccccaggtcggccaaaaggtcaccatccaatacaccggctgggatcaaggacgagtccaagcctgacaacaagggcgaccattccgacagtccgtccggcgtgggtgcttccgtccgtgaatattgggtgtttggcaaggcatcaaagggtgggaatgagggtgttaccccagatgaaggccggcgagaagccttcctcggacatcatccctggactacggtatggggccgttggttccccggngcaaccctcccaagcatctcctcttcnagggttgantccaagagttaatanctcccaattactacgtaccttccatngattttggaaanganttcnacggcttanatgacngatgtcaagaacagacgatgactgagccatatncctnnagcattggacgggtgatatggcaaggacaacatgggctcanatatcttaggacggcaatgagatatnggaaaaaaaaaaaa

SEQ ID NO: 84086 - DNA, 519 bp, Triticum aestivum
  unsure (1)..(519): unsure at all n locations
  Clone ID: PAT_TA_84086
gatgtgagattgtctaattaatggcttatttaaggtggnnncttatcgacacatctgggtggattgtggcacctggcntactccaggacttgcctgtctacgcacctgggtttccaggacttgcctgtttttcttcagnccgccacccangctcanngggatcatnnngttattcatgctagaaacttccgtgtgcagccacatgctattatgaggtctagcatagttgnttnagtcttgcgaatcttacagggttnaactagcanatgtaggggatgtacgttnnttacggtctaccctcctatgtaaggtncaaancgcttcctgnaagactattctccggcacccnttnctaaaacaccatgtaatgccaagaaccaancngaggaattcagcaatgtggggaaaagtgcgcaactccncagagtgtataaactaacaatgattaccgttccccggttatggcaccttggnnacctanactgtgtacatgtgacncaacangtacccnattaaatg

SEQ ID NO: 84087 - DNA, 661 bp, Triticum aestivum
  unsure (1)..(661): unsure at all n locations
  Clone ID: PAT_TA_84087
caagggtctgggcaagggcggcgcgaagcgccaccggaaggtgctccgcgacaacatccagggcatcaccaagccggcgatccggaggctggctaggaggggtggcgtgaagcgcatctcggggctcatctacgaaggagacccgcggcgtgctcaaagatctttctccgagaacgtcatccgcgacgccgtcacctacaccgagcacgcgcgccgcaaagacccgtgaccgccatggacgtcctctacgcgctcaaagcgccaagggcccgcaccctcctacggttccnggaggctangctagggcctccttcgtatccggggactgggttaagggaatgtctcctgtgtgatctttccggaggtaatattgctgcataactgtgtaaccaacccttccgcaatgaacgttttgnacatctacgtatgttgtgncngtggtgattgatttccgggnataacatatcctccctgattttggtaatacantcatccnaanaaacaaannaaaaaaacccaagggggggcccgtaccaatncncctanagganccatacggcgtaacggcgtcgttaaantcngactggaaacctggngtaccaattancgctganaanccccttccagtgntaaancaaagccnacgttncttcaanttcan

SEQ ID NO: 84088 - DNA, 545 bp, Triticum aestivum
  unsure (1)..(545): unsure at all n locations
  Clone ID: PAT_TA_84088
tcgccgcgtgccctcgccgcagacctctgccatggcggaccagctcaccgacgagcagatcgcggagttcaaggaggccttcagcctcttcgataaggatggcgacggctgcatcactaccanggagcttggaacggtgatgcgctcccttggccagaaccctaccgaggcagagctgcaggacatgatcaacnaggtcgatgcggatggcaatgggaccatcgacttcccggngttcctgaacctgatggcgangaagatgaaggacacggnctcagaggaggagctcaaggaggcttccgcgtcttcnacaaggaccaagaacggnttcatctcnggtgccgagctccncnatgtcatgacaaacttggggagaagtgancgncgatgaggtcgacgagatgatccgttaggccgacgtcnacngcacggnaagttaatacnangagtcgtcaagttanctggcaatgangagcggccctcgacatannaccacggttcagcgattatnggcaaanctgtnntgtatgcctttganaccacct

SEQ ID NO: 84089 - DNA, 448 bp, Triticum aestivum
  unsure (1)..(448): unsure at all n locations
  Clone ID: PAT_TA_84089
cccgtcccctcgtcggcgcccgatctaagtcaagatgagtcgtggcgggagtgctggaggtggncaaagttctctgggttacctgtttgganatggtgagcctgcaaagcctgctgcagnacnagntgcgaancnagaacctgctgagaaacaagaantggaagntgccgntgtaaccaagnagattcnagntggaattcnaggtagccgggcaaacaactantacngtgaatatggccagaacacggaaanttccnttacgggaccgtccttcaaccaagggtcatgctgctccccgncggtggctcctcnntggggtacttgnttgggcggaagttatcncngttaatgatgctgcnatgattggcctgnacccctggtaaccatgnggngaaactgaantgttggttcaacatttacaactgngnnaatgacccngccggnaggg

SEQ ID NO: 84090 - DNA, 615 bp, Triticum aestivum
  unsure (1)..(615): unsure at all n locations
  Clone ID: PAT_TA_84090
ttttttttgcatggatctgaggtatcacataaacactgtaactctgtcttgcaaagcttctaaacatggtaactctgtcttgcaaagcttctaaacatggtctggtggacagaaacatatgaaactagattcagaaaaaccacaatacgagttcatcagttcttccccgtcaaactacagggcagacacagcagtagacaatagacaatctaggcatccgctgcgcanctccttgggcgagcaattttcccggncttgggcttggcctgcgactgggtcccanngatgccacctccccattcttccctgacctcatcngacttgtccgttggaagtttgccttaaatacctccaaagatcttggctgaactcnanttaccctccgtcctttgacaggggcaaacacaagacggagcatctccttggngaacaccgttccaaggggantttccttttaacatgcagtaaggactccacttcctgaaaaggtgggaaccaacaaaantcnattggtcangtcctgangatnaaaaagtganctgtcgccaanaggaatcanaggtaaggcatctaaaaatggttctcgncaaatttctaancaatgggccctaangn

SEQ ID NO: 84091 - DNA, 488 bp, Triticum aestivum
  unsure (1)..(488): unsure at all n locations
  Clone ID: PAT_TA_84091
gttttttttgaatctagtctgcaaaggcatccaagatttacaacagaaagcttggagaagaacaagcagatttacctgaaaatagaagatttggcgaagaagtaccagtgcagcccagctcagctagctctagcctggggttctgcgtcaaggggatgatgtggtccctataccagggacaacanaaacgaagaacctagatgccaacgttganccttggaaggtgaagtcnacagctggaggaccttgaaggaaattgggcagccagatactgcagaaagatgtggtgggtggnaagacatacattccctatgcaatactccctggggaagtacgcaagtacaccaaaaagtgagttctnggccctggaacttgggngcatccanagngtatgcaatgttgacnttcccctgcatttngncccgatcctacgatgatnacctggggacatcggactataatccagacnagataagngttcccacnaa

SEQ ID NO: 84092 - DNA, 632 bp, Triticum aestivum
  unsure (1)..(632): unsure at all n locations
  Clone ID: PAT_TA_84092
gccactataacgttcacagcattgacaatgaacttgaagacagaacacagatcaagccgattgtgcgaacatcgctgttcctgtgctccagtgtttacattgccacaagtttctttgcttatctcctcttcggtgaaggcacactggacgacgtgctcgccaactttgacgcaaatcttggcattccattcagttcagtcttcgatgacatagtgcgagtgagctatgcagcacatgtcatgcttgtctttcccattgtcttctttgccctccggctcaacttgggatgggttgctcttccccacgtcaaggcacatctctcgtgacaacaagagattccgccatcatcaccgtctctctcctcgcaagtaattacttgctgcattctcaataccaancatctgggacgcgtccaanttactggtgcaaaactnngctgtcctgattggttaaattcctgcatggcatacttaggatccttacggacncgagaagcgcgacagtctggtgtacatgacntgctgcttccgtnaatcngcgcctataaatgaccgataaactcnttagaggagtgctgaccagttcaagtacatgcggtaanatgcccatgagncctgcaaggaacatcctgg

SEQ ID NO: 84093 - DNA, 624 bp, Triticum aestivum
  unsure (1)..(624): unsure at all n locations
  Clone ID: PAT_TA_84093
cctgatctccgtcgggacgtcgcgcggcggaggggatgagtggagcagcgacttcgagctgacgctccggcagctgaggctggacgacctgatcgaggacgggcagggcgacgccgacgtcctggtgcaccttctgggtccagcagcacacccagttccggaatgtcgatcaaagggcgagtgggtcacatcnctcaccaaaatatgcgattcnctgctccgccccatactgcacaaagatttgatgagcattccgacatcacngtgctgtcttcctccnaggaaggtnaagagcgggtgcctgaatccgngagacagcgattccgtccanccactacgttgaagccaagnaacaagaatttgatatcnactcgtcatcccaaggagacaatacgactaacaggtcagccaagattcatgttccngaggcctgtnaganctcctgtcgtgtggaaactgctgggaacaaganaacggtacacaaacgtggcaaattcttgnccaaaganatctggtaagncccactataattcatggcatcaantnaanccacnantgatntcgatacaaatgcananggnatacgacaaaantattgccgnggtaacantaatgnntcaagaa

SEQ ID NO: 84094 - DNA, 610 bp, Triticum aestivum
  unsure (1)..(610): unsure at all n locations
  Clone ID: PAT_TA_84094
cctacagcaagcgctggccatggcagagcattttgtgctgtgccccgtgatggcagtactattactatccatggacgtcctcggcgccgcccgccggcgtcttcaagccgccgccggcgatgtacgtgttcggcgactccgacgctggacgtcggaaacaacaactacctgccgggagcgggcgtccccaagggccaacaggcctactacgggtccgactcccccggcgggcttcccaccggaaaggttaagcaacggctacaacaccgcccgattcaattgcaaagtgcataggttcgntnagcagcctcccgccgtacctgtcgctgctggggagcaacaagctgcggcggcggcttctggtccgnanggtctcactatcngggtcaagtatcttccggaaggagctggacctcgatccaanaacgccngnacacatccgctatcgaacaagtgcatactnaacncacaagcggnatnattcncnggggtctccaccggnggngcctgtnaacgtctngnctnactcctcgggggaacacttccnatncgangcgacggcgcggaaantcgggcnactganacaaaccgnngcnttttttnnggggcc

SEQ ID NO: 84095 - DNA, 233 bp, Triticum aestivum
  unsure (1)..(233): unsure at all n locations
  Clone ID: PAT_TA_84095
aagaaaccctctttcgacatcgtgactgtttgcccgcctctggtcctgggacctgtatcaaagcatcttgctacacttgagagcatcaacacttccaacgagaggattgtaaagcttctgaggggtggctggaaggacgagatccctccttgtacacctgttccgttatggatcgacgttcgagatgctgctccgtgctcacgtcagagcttcgaaggngaggggcccggtac

SEQ ID NO: 84096 - DNA, 277 bp, Triticum aestivum
  unsure (1)..(277): unsure at all n locations
  Clone ID: PAT_TA_84096
acacagcgcagacgatgccgaccatcatcgtctcggtggacctggaatgcagccgctgccgcgccaagatccatagggtgntcaacaggatccatcnagaagggcnagttctgcatcgatgacatcgacttcgacganaagaataacaaggtganagtcacggggcccttcgacccggttcaagctcgccgacaagctgtgntgcaangcgtgnaanatcatcnngcagntcgagatcgctnnctctnagcctngccgcngatgaaagcccaaggtt

SEQ ID NO: 84097 - DNA, 276 bp, Triticum aestivum
  unsure (1)..(276): unsure at all n locations
  Clone ID: PAT_TA_84097
ctcgtgccgaantcngcacgaggttggattaancantgtctgggggcaaattttaccananccatttctcanacggctgattcncaggttnattttctgncgggcagngcttttctatttccactcagatgancacgaatatctaccnccctgcttacctactcttccagagtcagtctccccgcatgcagnngccattcnanctcctatccttncgcttgnanaanacttgtcggcagcgaccggtttgacttcctnngactccacacgcaacat

SEQ ID NO: 84098 - DNA, 608 bp, Triticum aestivum
  unsure (1)..(608): unsure at all n locations
  Clone ID: PAT_TA_84098
ctttggcttcttttgacagggaaggtcccaaccaaagagcaagttgatgcactatcaaaggaattgcttgcgcgctcaactgtcccagctcatgtctataaggcaatagatgctctcccagtaactgcacatcctatgacacagtttaccacgggagtaatggctcttcaggttgagagcgaattcaaaaagcttatgacaatgggattgccaaaatcaaagtttggggagctacttatgaagactgcttaaacatgattgctccggttcccaccaagtggttcttatgtttaccggagaatttcaaagggtgggaaatcaataagaaactggacattctcnnggattatgcggaatttctcacacagcttggtttggatgaccctaaaatgctggagctgatgcggtcctagtaacatcacacngtcatgaagggggaagtcaangctcaaacggcaccggtgggaagggtctgcaaatcttacttcttcnnagggtctaaagggtanctggcacaaatggcttgnaanaggatgctcaagggtaatcngaataaggacnggangtntaaacggtaaccaaggtancgganacaaaggggaagtnnc

SEQ ID NO: 84099 - DNA, 580 bp, Triticum aestivum
  unsure (1)..(580): unsure at all n locations
  Clone ID: PAT_TA_84099
gtctctcacacgcacgctcctcccctacgcagcaaaaccctaaccctagctgcggacgccgtcgccgcctccgcgcccaaccgatgtctgattctgaggcgtccccaccgcccactccggccgccgcaacgcccgcagcgccggtggagacctccccgtcctcggcgaggaaggaagaactgctgcctgtggaggaaaagatctcggaattaagtgaatcacaatcaagagttctagggaggtcccgtgggttaaggaggttttgctgantggaggagtaatttagatcccaaagtgacgaaatacaaagtgggatctctgacatcaaagatgcactcanatantgaaataagcanttcgctcagattccaaagagtgaagacacccttaaagaacacaggaagagtgtcactttacttggaaatttggggttcaaagatgctaccgaaatgatgggaacaaagaanggagacggacaatgagncttgtcaactaatntgggaattgaacggngtctctgaaatatatgaanaanatcaagnggcaatggnaaacgantgtgggtggactcaaagtcaag

SEQ ID NO: 84100 - DNA, 541 bp, Triticum aestivum
  unsure (1)..(541): unsure at all n locations
  Clone ID: PAT_TA_84100
gggacctgggccggcgcgccggcgtgccgtgcgacagctggcgcctggccgtggagacgtacaacaagcgcgattggacgacggtgccggccagctgcgagcgctacgtcggccactacatgctcggcggccactaccgccgggactcccgcgtcgtcatcgacgaggccatcgcctacgccgagggcctcaagctgggcggcaacggcaaggaggtctgggtcttcgatatcgacgagacgtccctctccatctcccctactatgccacccacggcttccggcactaagctatacaacgcgacgagttcaaacgagtacgtgctgggagggggagcgcgcnntgctccccggagacgcaacggtgttcnaagaactctctcgctgggcatcaaccggtgttcctgacggccgcacnnggacaanaggcatcaccgtcacaactccggcgccangggatccggtggatgacctgtgtcaaccctcggctcaaggcacgcatccctaaatcngggacgcataancaggacccggtactnacg

SEQ ID NO: 84101 - DNA, 614 bp, Triticum aestivum
  unsure (1)..(614): unsure at all n locations
  Clone ID: PAT_TA_84101
gcagaatgaaagccgatctgatgctgagaagataacaaatactttcatcttcaacacatttgtattttgccagatcttcaatgagttcaatgcacgaaaacccgaggaaaagaatgtcttcaaaggggtcacgaagaatcacctgttcatgggaataatcggtataacgacagtatttcagatactgataattcagttcctggggaagtcttcaaaatagtgaggcttgggttggagactatggttgggttcaagttgctatccggcttgtgagttgggccctgggcttatgtgggtaaatttatccctggtgcccgttaagacctcttccnggactatttcaaaaccccgctgttgttgggaaaccgcccgccgagacnaggaggaaggtgggnaaagctnaagcgcaacgatgggcagtgtaaataggcacgtgataanaaatggagataattgcacnggtgatccaanggtacanacctggggattaccaananatggaggaacngcnctcgttcttcaggaaacatncggagaaanancntcaaaacaaantgtcaccctaccacggnggccgcanngaaggaantgngcatagtntncnatgaanggca

SEQ ID NO: 84102 - DNA, 385 bp, Triticum aestivum
  unsure (1)..(385): unsure at all n locations
  Clone ID: PAT_TA_84102
tttctcaccacccgcaccatctgccgctgctccccacgctcgagctcgcgctcaccctcgtcgaggaccacttcgcaacccanggcgaaggcctcgccgtcgtcgggtactatcacgccaacccgcgctgcgacgacaccgagctcccgccagtcgccangcgcgtcggnnaccacatcttccgatacttcccccgctccgcggngttgtgggnccgataacaagaagcttggaggaggccgtcaaggggaantttctggatgccggtgatcaagttacacaccaanggattcaacaaaaaattggcgtcaaggtgggatncnagatggnagnatcaagctgatcctaaaaagacttccnacaatgttgtcctanccnattattt

SEQ ID NO: 84103 - DNA, 165 bp, Triticum aestivum
  unsure (1)..(165): unsure at all n locations
  Clone ID: PAT_TA_84103
tcaaggtgaagccgagcagcccggcggagctggagggcctgctggactcngccangtacaccaagcactgcgaggaggaggacgcccactagtgctccttgctcgattatcgttccttttttgttgcanccatgtcgactactcttgnctacaataattaaacca

SEQ ID NO: 84104 - DNA, 427 bp, Triticum aestivum
  unsure (1)..(427): unsure at all n locations
  Clone ID: PAT_TA_84104
tatctatctagcgagagagagagaggaaagctagctatctagcatggagtgcggcagcaagaaggcagcangcggtgtgttggcgctgctgcttctccagctggggtnagctccgacgacggngacggcccgcctcctgcaggcngatacctccaccgtggttggcctggacatcatcgnnagggagtttggccatccangtgngaggcatcctctgtggtgaaacctgtgtcttcctagcatgctanancggagccatgggntgccaatgcattgggcaaatctgcatgaangtgatatctggactaacgcaatntggaatttntgntgncgagnaacacanggacggtacngnggtgttcancttantgcatgngtatgtngntctaataagtacagnattatcaaangnnatgttggtgtttac

SEQ ID NO: 84105 - DNA, 324 bp, Triticum aestivum
  unsure (1)..(324): unsure at all n locations
  Clone ID: PAT_TA_84105
gtcatcacggacctaagtgagaaggtcaaggtgctggagcggaggctggcacgcaagaagagaccaaaggtgagggtgcacaagccatccaggcatgcttcctgtgtccactgaaaggataagtctgtaaggttttgaggttttatgttgtatggatccccatgttgcttcctgtgtccagctattgtgcactgtgtaggtatagccatgctgtggactgtgcttccgtcttgggacaacacaagtgtggcatgtctgtatttatgtctgtataatgcatccaactacatctaaaaaananaaaaaaaannccaaggggggggg

SEQ ID NO: 84106 - DNA, 446 bp, Triticum aestivum
  unsure (1)..(446): unsure at all n locations
  Clone ID: PAT_TA_84106
aggtcaacaagacgagacaagagaatgcctgtgagcaggatcgccgtgggtgctccgggcgagctgtcccaccccgacaccgccaaggccgccgtcgccgagttcatctccatgctcatcttccgtcttccgccggctcaaggatcgggcatggcttcaagtaagtcacggacggcggcgcaccatcccgcccggctcatccgcgcgtctctggggcgcacgcctcgcctcttccgtggcnctccgttgggtgcaacatctcccggcggccaacgttaccctgcccgtgactttccgggcttttggtgggcggaacatcagctcctncaaggccttngctactgggntngccantccctggtccgttctcgctgctcctcctcnaaattngcaacggcgggcggcatttggcttctcgctgtccngcggcgtccgngccatagccc

SEQ ID NO: 84107 - DNA, 598 bp, Triticum aestivum
  unsure (1)..(598): unsure at all n locations
  Clone ID: PAT_TA_84107
ctgtcttgcccttagctacatccctcggatttgagctcgctacaccgttccctcagtggcaccgccgtggccttccagttttccaaggatctgaacatttgcttcggacggatcctgaagatggcctggagggcttcttcattgcattgtttgtcaggaaagcaggccctacttcagaagagcctagcgaagatgccacggtagaagtaagaaccaaacaagtgcgcgggaggcgaaatgggggtcaggcgttcagctccttgaggctgtccaaggatgatcctctggtgaccaaaggcgttctgggatttaatttgatgtatcattgctatttttgggagtcaatgtggtaacangtangttgaatctgttcctgaatttnggaccatttttcctccaccccaganaatatgttgccatacccaagnccattcaagattatangacattttagcttatatangtaanattntgtntaaaancnagtaataaaaaggggggcngggaccaatncgcctaanggagcgttaccgcgtnaaggcgnncttaaacgccgacnggaaacctgggnacaannaatnctgaaaaaccccttgca

SEQ ID NO: 84108 - DNA, 447 bp, Triticum aestivum
  unsure (1)..(447): unsure at all n locations
  Clone ID: PAT_TA_84108
gccaagcggaagagagatgatgatgatctgtcaggcagtggtgatgacagtgaggatgacggtgttgaggacttgaggcccttcaagcacaagtgatggagcagccaatgtacatggatccctccctcccccttcctcaagctagaagtaagcagcaagtnaagcagcaagcaggaggaggcagcaaggaacaagaatatggtgggttcccctgtctcctttttaattgttttttcctggtaaaacttttgattngagagaaanttccgcctcccttgggaatagcanattttaggaggtatgggagagaaacctttgtgtacccaagtagcccagtagnaccantccggtccttnancccctcaacttngccggaaccccttttgggtncatttccctccaactttncaaaggtagtgcaccgttgggttcccccccaaaaaaaaa

SEQ ID NO: 84109 - DNA, 277 bp, Triticum aestivum
  unsure (1)..(277): unsure at all n locations
  Clone ID: PAT_TA_84109
gagagagagagaagagagagagaaaanaganagacantcgaggagtggnagantcgcgataggctgccgtgtangnaccgtatactcancgantgcnanggaaggataaggggatggacgggatcggaccgatcaggcaggactggggatcnggtcgttgtgctgaagaaggtacccaccgncgccnccanngaaggatnagaaaggncgtcaacgccttncgccgcancggtgcngtgatctatactatgaaggaatacaacgctggtantaaaca

SEQ ID NO: 84110 - DNA, 437 bp, Triticum aestivum
  unsure (1)..(437): unsure at all n locations
  Clone ID: PAT_TA_84110
accgcatcgggatttcatccgtcaccaagcaaaatggtgtccctcacccttggacccctacttcacagtaagaagcttgcaaggccttcgcgcaggacgtgctccgcaagagcgacgccctcaccgccgaggccgcggactccgcgcggtccctcgccgcgctccaggccgaggccaccaccgcctcctccatgctctcctccggcttcgangaggatctccgccaaggcctccccttcgnnggggccgccgccccgctccccacctcccagaaantatcctccnggctcccggcctcgccgtacggcgtcctcaaagcgcgncaaacgacatcggttggacgactcctaacccagatnaacgctggctaaccgcgaccgngatngcgcgcgccgagcagttggaacacgcactacaagtngcatcgaggctcctga

SEQ ID NO: 84111 - DNA, 462 bp, Triticum aestivum
  unsure (1)..(462): unsure at all n locations
  Clone ID: PAT_TA_84111
gacaacaagaagacccgcatcgtcccgcgccacatccagctcgccgtccgcaacgacgaggagctctcccgcttgctgggcacggtgaccatcgccagcggtggtgtcatgcccaacatccataacctgctgttgcccaagaagtctggcggcggcagtgccaaggctgcggctgggtgatgaggactagaccgaccacgcctagctttcatccggtggtggacctcttgtggatgctgccgtatcaattggtgcctgtgttagtacgctcctaagaaatgccttaaggtgttgcgttgtantccgggatgtnctccctgtaccactgccaaaggataagtcctgtatattttgctataagggangcacctttgggacgacctgtttatcaaccctgggacccaatttgcattcnntgtccaatccttgggtagccatttngaattctggaaaaaaaaaaaa

SEQ ID NO: 84112 - DNA, 643 bp, Triticum aestivum
  unsure (1)..(643): unsure at all n locations
  Clone ID: PAT_TA_84112
cacagccccatcccgccgccgcaggcgagaaccagcgccaccttaggttagggcggccgccgccggagaagtgcgcggttgccaagatgcagatcttcgtgaagaccctgacggggaagaccatcacgctggaggtggagtcctcggacaccatcgacaacgtgaaggccaagatccaggacaaggagggcatcccgccggaccagcagcgcctcatcttccgccggcaaacagtccaaggatggccgcacctcgccgactacaacatcccagaaggagtccgacgctgcacctggtgtccgccttcangggaggcgccaaagaagcgcaagaagaagacgtcaccaagcccaagaagtttaagcacaagcacaagaaggtgaactggcctgctccaattctacaggtttacgacgcaacgggnaagcaaccgcttccgcaaggangccccaacgcnaatgcgnncgggggcttaatggcaacattnaccgcatacgcggnaatggggctcactantcnaaacaanaggtaggtncctccttcgtcggaggaatngaatctgcagngaaacctttgntgnttgttgtcanganatttctgaaaaaacngnncttgacctatttggtataacaggttggccgnn

SEQ ID NO: 84113 - DNA, 585 bp, Triticum aestivum
  unsure (1)..(585): unsure at all n locations
  Clone ID: PAT_TA_84113
gctcaataacatcagaaagatgcggcctcatacattcatacatgcaattgtgaatggctccttcagtgcgcccttcttcgtgacgaggttccgagaggctctgttcttttactcggccctgtttgacgctctggacacgaccactccaagagacagcaaccaagaggatgctgattggaggagaacttttccgggcgggctgccctgaatgtcatcgcgtgcgagggacagttcgggtgggagcgccctggagactacaagcaatggnaggtgcggatcaaacgagaaggttnaagcacaaccgctgacctgaagtcctgaaggaangcggacaaggcaaggtttatccaaaaggtttggatcnaatganacaacngnctncaggaggaagcgaacctcnagcaactcnaatggtggnaatagcccnctatttacgtttttgggacaatgcaaaattaaggcaatttgnacggnctcgggcaggtgcnacnngggccaacgcgcaaactggggggaaatnggccctgnggtancacacaaaacccagntagatcccaaatcagaangttntgataacaggtttgc

SEQ ID NO: 84114 - DNA, 559 bp, Triticum aestivum
  unsure (1)..(559): unsure at all n locations
  Clone ID: PAT_TA_84114
ctagtctcgagttttttttttttttttttgattataatagcacgatacatgcatgacaccagtgaaacactacatcagcatcagctggtatgaatcctccatccagcaagcatacatgtgttgcacctgtgctgcgacaccagatctcagtcgctgtcgctgctgctgctactgtggccgccgtcgtggtcgtggcctcgccgtgcttcttctttttcttgtccttcttttccttgtggtcgccggacttgtcgccgtgctcgccggtgatcttgtccttgatcttcncaacgatgccttccttgtgctccccgccgtccttcttggtgggctccccctcctccttccttggggggtcctcgggcttcttggggtgtcctcctccttatcttgtggncgcccncatgtgganttcncctccatcttggggatgatgcagacagggcgatgtcttctcgctctcttcttgccaccaaaaggaaacggnataatggacgtgcaatcccaggggggccggtaccattcncctannggagcnatacgcnnctanggcgtctta

SEQ ID NO: 84115 - DNA, 518 bp, Triticum aestivum
  unsure (1)..(518): unsure at all n locations
  Clone ID: PAT_TA_84115
cttggggctgccaagtaaaagtagtaagctagagaagcacagcaaagctccgatccaatccaatccaccgcgaggattatgtctctggtaaggctcctggacacgctggccctggactcgtgggtgcggaacccgttcaccatcttcggcacggcggtggccgccgacgcgtggctggccagcgacacgtcggcgttcgccaacacgcacatcgagagccgggacacggcggccgcctacgtgttcagcgccgcgctcccgccgggcgtcaagaaggaggaggtcacggtggagctggacganggcaacgtgctggtcatcgccggcgagcgcagcgtgtgccgccaggagcgcagcgacgggtgccaccacatcgagcgcanccgcgccacttcctcgccaaggttccacctgnccgaggacgccgccgtcgacggcgtcaggccgccttggacgccngaaggtcaaccgtcacggnnccanggtcggggccgcngcggccgccatcttgccgagaa

SEQ ID NO: 84116 - DNA, 646 bp, Triticum aestivum
  unsure (1)..(646): unsure at all n locations
  Clone ID: PAT_TA_84116
gccgcgcccgctcccacctaccgttgcggccgccacctcgccctcgcgccccctctccctcggctgcgggcatcggccgccgtcatgtcaacggcggcggaacagacgatcgccgaccagaagcgcacgctgcgcgccgaggtgcgcagggcgctgaaggccctctctgccgaccagcgcgccagcgaagatctggctattcaaactacaatactggttcctcttgggtcaaaagcaagcaaacggtgtgcgcttatataagctgtcagcattgcgagaagtttgatacatcaaaaaatactagcagagtgtctaccgtccgatcctgggacaagagaatgggaaaggtctttatttcctccnagtgggaggataagaccgtaacatgaggatctcaaancacaccatgggtgatttattaagatccaatggaattcctgggacatcccctgtggatgctactggggaanacctgaagagtttgtcacatggccccgtggtcttttttatgccngganaactttgataaatggccaagacggggcgtgtggaggtatatacaaatctgtagtacaagaantgaaagaaaagnggacaaccncctatggccttcancgngaatntgcaggganaaccannattattg

SEQ ID NO: 84117 - DNA, 632 bp, Triticum aestivum
  unsure (1)..(632): unsure at all n locations
  Clone ID: PAT_TA_84117
gcttggctacacactgtacgtacacttctcttctccccctttcccggccggagcctttgcttcactcgcgtcgccgagctggctagcgacaagcgcgacaccgtcggcggcggcggcgacgccggcccgcgcctcgatgacggcgaggactcgtccgccgtgagcagcaaggcggtggtcgaggagctgtaccgcgcgctggagcgcggcgacgtggacgccgtgcgccgcctgctgaacccggacgtggatggtggtccaacggccgcgcgcgcaccagcacctgggtgctcatgcgcctggtcaccggcaccgggcgccggcgccggctcccgttcaagatccggccctgggacgcttnggccgacggtgctggccgagggcgccgaccgacgggcgcntctacgggtgcaccgtgacgttggcccgggggcgctcacggggtcgcganatgcaacacgggtcgtntcacagtcgcggggcggncacgggganaggcaaggcactgtcgttncatgcgtcaancagtgtgaaaaccgnngcgacggntcgagaactctggctcngntncattacggtngtgcaanatcananaagtgttcaacaaggnggngttattatagttgaagnna

SEQ ID NO: 84118 - DNA, 464 bp, Triticum aestivum
  unsure (1)..(464): unsure at all n locations
  Clone ID: PAT_TA_84118
atttttggtggcattatgaaatgtgatgtgatagcaagtggaattgttaatgctgccaaacaggttgacctgaaagttcctgttgttgttcggttggaaggcaccaatgtagaccaaggaaagaggattcttaaggaaagtggaatgactttggatcactgcagaagatcttggatgatgcggcaagagaaagctgttaaaacatccgnccaaataactaaggtaccaacctgaagttccttttttttccaactggggtacaagatgagcnangtcctttttaacggtttcccattttggagcaagaancccntgaactgcaacgttttngaagtaaggtattttggcttggtttgcccggttaaatgttgccaatgcccaattgtgcccccnttttaataaacaacnacccgcccattgggccaannnaaaaaaaaaccnnaggggggggcccggaccaattc

SEQ ID NO: 84119 - DNA, 677 bp, Triticum aestivum
  unsure (1)..(677): unsure at all n locations
  Clone ID: PAT_TA_84119
cttccgatggctgcctgccgtctctgacctccgacctctgcctccagcctccagccttctcccgccctacctgaaagcaactcctgatcggattcaggctaggtcctcacagcacagccctcctctgagactcagcaaggagacctgaacacgaattgatctctgcgccgctgcaaccccggcccgtccgaagccatggggtccggggactgggtcnaagacgattnatcaagcaaagaaaaatcggaagcggggaaagtcnaaagcacgcaaagtctcctggcaaagtnacaaatgggaggcaaccaagacaatccagaanttagacggccttccttcaaantagtggagacaacgnaagacaatgcaanacttagaggaatggggtgctatcccattcaagatgcgttcccggaatacaaggcaaggaaacctgcgtttctcnaagggancaaaaattgcccttgtggtcaaggcgacccgntaagaanaaacgctgcacgctgattacatacaanctgggacaagtgcaatcggagataagaacgactgcttcatggcacgaaggaccaacaggagagaacagagaacaatgaacttagnaaactgataattnaatnatggatgaggnncgtacaaggtaattcctnnggtnacacggaaanacataactacac

SEQ ID NO: 84120 - DNA, 642 bp, Triticum aestivum
  unsure (1)..(642): unsure at all n locations
  Clone ID: PAT_TA_84120
caacatcctccttgacgatgacctcaatccaaaagtctctgactttggttcctccaagctcctggcaatccatagctactacgttagggcagtggctgcagatataggctacatggacccattatatatgaagaccgagcacttcacattgggagtgcgatgtctacagcttcggcgtggtgcttctgggagtcatcacgaggagaaagggcagctgggtatgaacaagatcaccaaagggaacaagatcctccccaccgagtccgtcaaangcttcaaaaggaccacggtagcggatgtgcgatgtatgatagcagacttgattctcnaactgggcgaggatgctcaactcngaagcaacaagcgttgcctccnacatgattgggatgttgggcctcccgagcctcaaaggagcaaagaggaanaggcaaccatggcagagtgtccaagganttaagcaatgaaaggacacgcnggnacacatatttaaataaggctgcaanatcaaacgagtcgaancaccanatgatggaacgaacaagataanatggcggtnanaattgaancctganatgngnggtctgtaaanataaaagggtcccaccataatncatgtttttccctcatanagaagtnaccgaa

SEQ ID NO: 84121 - DNA, 468 bp, Triticum aestivum
  unsure (1)..(468): unsure at all n locations
  Clone ID: PAT_TA_84121
gaaggattggaatcctggccttggattaagacatgttcttctggttgtgagatgccttctgattgaaccatttcctgaatctgcacttaatgaacaagctgggaagatgttacttgaaaattatgaggaatatgcacgacatgcaaggttatacactgggcatccatgcccttaaacctaagaatacgtccaagaccggagctatactggagtcaaaccacagtcctgaatgtcgacaancaaantactgcctcctagcaagaacacaccatccgatgccaccggcggtatctacctccnaatgcatccaaganattttggacgagtttgcaggtttaagacccactgtttccgatctgctgtangactgccggggacgaaagaagatggccaaggttcnaattcccngngganaaaaaggtggancccggaanaaactttaanaatatagggganctggaaaannaa

SEQ ID NO: 84122 - DNA, 416 bp, Triticum aestivum
  unsure (1)..(416): unsure at all n locations
  Clone ID: PAT_TA_84122
cgaccacagacagcgcgcgcttcaaggcctttttttttgagataacaaggaggagatggcggtcacgatcacgtgggtgaaggcgaggcagatcttcgacagccgcggcaaccccaccgtcgaggtggacgtgggcctcagcgacggcagctacgcgaggggggccgtacccagcggcgcatccactgggaatatatgaggcttgggagtttgagggatggaggatctgattacttggcaagggtgttcttaaaggctgtcaagcaatgttaaataccattattgggccaagcattggttgggaaaggcccactgagcagtttgaattgacacttcaatggccaacacttgatgggacctccaatggagngggctggtgcaaacagaacttgggagcaaatgcatccttgcgttca

SEQ ID NO: 84123 - DNA, 644 bp, Triticum aestivum
  unsure (1)..(644): unsure at all n locations
  Clone ID: PAT_TA_84123
gcgagactccaccgcttcctctccgccgcgtcctcctcccctccctccgttcctcacggctctccggactcgccccgcggctggccgtgctgagtttcgttctctggccggcaaagaagcgatttttttgtgctttctggacggatcccggccggagaagggaccgaattccacgacctccgaccgccggctgctcctctgctggggtctcccgtgcgcaaagaagagctaccaaggtgaacccggaattttgagtcccgggccgcctcatgggatccatggcgcaagaaagggacgcgtttggttcacctgncttgtccgattggacaaaaggttgcggtccggagctgtccancaccctggntggatggatgcaacgcaccccaaggagggggcggacngtacctgtcnaagttccgggancttacacgntaacgaacaacgagagagtggacagaggaaanatggaatcctgngaggatgaantatggccgnctggggcagtacaagaacatggnaaaagagctgtcanatcggacatntanaagtttccaagtctctgaactgggcataatcaattaatcacccaagcaaggaacaatgancatacctcaanggcancactnatgncatgnaccaaagnc

SEQ ID NO: 84124 - DNA, 488 bp, Triticum aestivum
  unsure (1)..(488): unsure at all n locations
  Clone ID: PAT_TA_84124
cgaccacgcccccgctcctctcgtctctttcttcgcctcttccatcgcaggattcggcggccatgggcggcggcaacggccagaagtccaagatggcgcgcgagaggaacgccgagaagaacaagggcggcaaaggcagccagctggaggccaacaagaaggccatgaacatccagtgcaagatctgcatgcaagaccttcatctgcaccacctccgaggccaaagtgcaaagaacatgcggaggcgaggcatcccaaagaacgacctctacnatgcttcccccacctccaaagatttataagcagcagaanatatgatctgctcaantaaaaagacaanactacatatatatatatacctgtgtgtcaataatgggttggtagntgctgttgatgcgtgcttccttctttgcccctccggataagtacngtacctttggtgtnaactacgngcnaaacacngttctggtgnggtcaaaaaaaaaaaa

SEQ ID NO: 84125 - DNA, 367 bp, Triticum aestivum
  unsure (1)..(367): unsure at all n locations
  Clone ID: PAT_TA_84125
tgcagtgaccctgatttatttggctggccagtagcccattatggaggccccatgcagagtcctggagggagtctcttgtggaatggtattagcacgggagcaaggcccagaaatagcagcccggattggtggtatgatgatgtctcatgtttaagcctcccgttatacaaaaagctcatctcagccatggagtatcggggcatcagtcagggggttattgttggatcccttaaccattatgcaaaaaggcgtttgcctggtttgaatcggcgtaaaagcatcggtgatgctagcaactgtctttctatgactagtttaacatccatcccttctgaagatgaccagaagtatctctcnaagggggggg

SEQ ID NO: 84126 - DNA, 372 bp, Triticum aestivum
  Clone ID: PAT_TA_84126
cgcaactgaggagcggagaaggcttatatgggagcaccttgagaggaatgccgcattccatccagtaaccagagacatcagctttgctgcttttcctaaacccgctcctctggtagctccaactatgacataatatatgtgtgttcaaatgtacttcattccactccatttatagcactatgggtgctgtgcagggcattttgtcaacttgtctccccccccccccccccccctcgtttcaaagtctgtaattaatagtttcttatttgaggacgaaccttgattctttcatggtgtattctcaagtgatggacatttctttctttgacaagataatgcccaattctagtcaattgttctgtgaaaaaaaaa

SEQ ID NO: 84127 - DNA, 362 bp, Triticum aestivum
  unsure (1)..(362): unsure at all n locations
  Clone ID: PAT_TA_84127
nacccgcgccttctccccttgncggcgtcnctcccgcccccacctcccgagganctgctccacagtcaggccacngntctcgtcgctgccncacaggccancttcatgcgcntcatcntggacgccacggncccggggntggaccaccaccgcggctccnacntgctctgcgtcgtccgcgcgctgctcaagaagatccgccgccgcatgctcgtcggtgaccgcgtcctcgacggggcggtcaactggancgatngccgcggnatgatcgangangtcttcgancgganatncgaggntgtcgacncgcctgtcgccaacgtcgacgccttgtcangatcttctcgctnaaatccgatgcc

SEQ ID NO: 84128 - DNA, 490 bp, Triticum aestivum
  unsure (1)..(490): unsure at all n locations
  Clone ID: PAT_TA_84128
gcgcgccgagatggtcgagatcctccgcacgctggagggcgcgctcggcgacgggcccttcttcggtggcgacgccctcggcttcgtcgacgtcgcgctcgtgcccttcacgtcctggttcctcgcctacgaccgcttcggcggcgtcagcgtggagaaggagtgcccgaggctggccgcctgggccaagcgctgcgccgagcgccccagcgtcgccaagaacctctacccgcccgagaaggtctacgacttcgtctgcgggatgaagaagaggctgggcatcgagtagagcatccatcggtcggccggtggctggccgggagtaataatgacgaaccaataatctagttttgggttttagtgtgctcaacanagcagttcgtgttcatgagttcgtcgtcgttgtatttctaatgtcagcggtggaagcgccgtangtgttgcctcgtacacacaaccgaataaatggtatgaanttaaaaaaaaaaaa

SEQ ID NO: 84129 - DNA, 394 bp, Triticum aestivum
  Clone ID: PAT_TA_84129
ctttcatcttgagcatgccaaagcggaagccgatggacgagacgcaagaaaccctccggacctctgcctttcccagttcacatgtcaaggagaaatgggcgaagaatctctacatagcttccatctgctacggacgaaccgtgtgctgatagtcgaagagaggccgcgctgactcagtacggtggcttgcgtcaagagattagagatgtgagatgaacattaaatcaaaaccagttctaatgatgataggatcagtagatctgaagatacggtatggtatcctaccgtagctgtaaagaaatattgtaccacccagtgccggccgcgagaccgttactgccatgaagtgaagctaatgcatttgggagtctcttcccgggaaaatggaacacaa

SEQ ID NO: 84130 - DNA, 600 bp, Triticum aestivum
  unsure (1)..(600): unsure at all n locations
  Clone ID: PAT_TA_84130
nggntgnccagcanaagaagcttaacctcnccatccttcccaccactacaatcggttcgttcccacaaaccgttgagctcaggagggnccgccgtgagtacaaggcanatnagatctctgaggaggaatacgtcactgcnatcaaggaggaaatcaacaaggtcgttaagcttcaagaagagcttgacattgatgtgcttgtgcatggngagcctganagaaacgatatggttgagtacttcggtgancanctctccggttttgngttcactgccanatggctgggtgcagtcttatgggtcaaggtgcgtcaagcctccgatcatctacggtgacgtgagccgccccaacncatgaccgtnttctggtcnaaganggcacanagcatgacgtctcgcccaatgaangggatgctgactggccagcacaatcccaactgnccntctccggaatacaaccgaggttgagactgctacagtngntcttgcgatcatgaagaatcnaggtctgagntggggatcaggtancaaatcgacaggtgacnaaagaaggtgcgtcgaaggtgaaangctcacttgatggtgcacnctaaatacacgg

SEQ ID NO: 84131 - DNA, 585 bp, Triticum aestivum
  unsure (1)..(585): unsure at all n locations
  Clone ID: PAT_TA_84131
tacagatttggtggcttggcctggctcttcctcggcgttgccaattcagacagccttctgtatgacgaagaattcaccagctatcttaagcagtatccagacaatttcaggtacgacaaagccctcagcagggagcagaagaacaggagcggcggcaagatgtacgtccaggacaagatcgaggagtacagcgacgagatcttcaagctcctggacggcggcgcgcacatctacttctgcggtttgaaggggatgatgcctgggaatccaggacacccttaagaaggtggcggagcggagaggcgagagctggggaccaagaagctgggccagctcaagaagaacaagcaatggcacgtcgaggtctactaaggctcggattgctgtggtngcgaccttgatgctgccggggcagcgtcaggagacaaacacatgattgaaattgaatcatggatggtctcggggcggtgtaaatcacaaaagtcctttgtgagaaaacgcctttgtaatcataaaactcgcgcacgggtatcgtggacgacgttacttancngttaattnatcagtgcttgnaaaaaaaaaaaa

SEQ ID NO: 84132 - DNA, 612 bp, Triticum aestivum
  unsure (1)..(612): unsure at all n locations
  Clone ID: PAT_TA_84132
ccgagacggcgctggtcctggccggccgcgtctacgcgggattcgtcgactcgggcggccgcgtcttcgccaaggtgctcgagaaaggggaggtcatggtgttcccgcgcgccatggtgcacttccagatgaacgtcggcgacgagccggccacggtgtacggcaccttcaacagcgagaaccccggcatcgtgcgcatcccggcgaccgtgttcgggtccgggatcaaggacgccgtcctcgagagggcgttcggcctcgagccggaggagctccgccggctccagaagaggttcgggcctcctcccaagaccaagacggcggagatggacgattgatcggaagatcaggcactcgcgatcaagggggacatgattaattgattagttatattaagagcagcagactttgtgatctctgggaatatatctccttcatttgttaatgtctgtatgaattattggcggtggacgtgggtatatggaccgataatgccggtactaaaatggatgggattggggtagtgcaaatcagttcacagatttatgggttaaaanatgtaanaacaagcgacttattgncggagtaattgtacnatggaatgtcacancg

SEQ ID NO: 84133 - DNA, 568 bp, Triticum aestivum
  unsure (1)..(568): unsure at all n locations
  Clone ID: PAT_TA_84133
gaaaggcttatcgagttcggcattggtggaatatgtaactcctgtgttgatcctgcaaatgctttaatcattactcagtgtggtggaatcccattggttatacaatgcttatcgagcccagtgcggaatactgtgacttatgcgcttggggctttgtattacctttgtaacccttcgacaaagaaggagatcctgaaaccagatgtagttagtactataagagagtatgcttcagctggaactgtgaataacaactttagcaatctggctaatgctttcttgggagaaacatgttgatccatgatatgacaattttacagggtagactaaagcttacacatttcggtgtacctgtggtgttttcaaaatcctggatatgaactaaagaaactagagcttaagatccaatgcttcaatggtttggggcacgatgcttgcctggaatnaacaaggcccttttaaatgagagtatcacagtttcagtgggaagcaattgcatagtcagttttccaantacggtggacaatttanatgtaggccggttgnanaagtttngaaaaaaaaaaaa

SEQ ID NO: 84134 - DNA, 205 bp, Triticum aestivum
  Clone ID: PAT_TA_84134
tttttttttgacgaactaatcagccaccttgcatctctctacccttagttagaagtacaaaaaatacccatgttgtgcttcatctacaaagctcaagctactacctatgattagtgtatgaacaatttgtctaagcaaccaccgtcgaattttccttgcgtgcttcagcaaaacgcaaaatgtcgcagccagcaacaaggggggg

SEQ ID NO: 84135 - DNA, 477 bp, Triticum aestivum
  unsure (1)..(477): unsure at all n locations
  Clone ID: PAT_TA_84135
tggcaactgcagcggggcggcggcgtgcgtccctgctgtgagcttcatcgccccgtatcaagctagtttaggctgtcagcgggccacaacttcagccacacaacccggaactccgacaaccctcgcggctcgtgccgccctctcccgctcggtcgttcccatggatccaccgcaagagttggccgccgccggccgcaagcggcgccggcgaggaggcgtccggaaccgcaaaaggctttcctcgcagaaggggctccctccagcgactgcgcccccaacgccggngtccccaactgtcaagcggcggcgcaaggacatcgctggacangccgctgctatgccgaagagangcaacacctcagtctactgggcaagatgcgtgnaaggtttctggnggcaattttagaangttaaccganangtataaattgcantgganaggatgaattgncnacttaaaaacgacctaaccttttg

SEQ ID NO: 84136 - DNA, 215 bp, Triticum aestivum
  unsure (1)..(215): unsure at all n locations
  Clone ID: PAT_TA_84136
aacagatcgcacgcctcggttccctccactcgacgcttctcccgctcctaacccctagtaccttcgctcgctctgccgcccccgccgacgacgcgccagatccgcgcagcagtggtgtcctccgcggcggatcgagctcccgatccgcgcagtgggagtggcggcgaagcgcaggagcgctcggccgggggttccgcgaggctgggacggnaggg

SEQ ID NO: 84137 - DNA, 323 bp, Triticum aestivum
  unsure (1)..(323): unsure at all n locations
  Clone ID: PAT_TA_84137
ttttttttttatctctaggagcttacccatcctcatacatattcaaactccactctaatgcagaacagtgtttttggataatctatgcgtagactagtgcagatggcctaacacaggcaggacagattttcatcacatgcggagtacagaaaacaataggacatctttggggttcgatacccacatacganaacaacaggacatcaattatcttgggtgcataccttggtttctcatcatanttcaaaataacatttaaaatatgtagctagtacaagaaaactcttttcgcgacacttggaacagtaaaactaagacgttca

SEQ ID NO: 84138 - DNA, 549 bp, Triticum aestivum
  unsure (1)..(549): unsure at all n locations
  Clone ID: PAT_TA_84138
ggactctgagctcctctccgtgccaagtttctctgcacccatcgcttcagctcaccggttctcccccctgcactgcgctggctgtatggctcctcccttcgcgtgcgccatgcacggccgcgccctgctagcagcagcagcagcagcgctgctcgcgtcggccgtcacgctcacgcttctcccctccgccgccgcgcagccgtgggtgggcccgtggccgacgtgcgacgacaccaccggcaactactcggccggcaagcgcctacgccaaaaacatcaagcagctcatcctcagcctcaaggcaaacgcgtccaacacgcccgccctcttcgcgacgggtccgccggcgcgggcgccgacgccgtgtacgggctcatatctgccgcggggactcaagcccacgaatgcttnnctgcggaacaangccgggcaagacctgtacggtctgaaaggaaccgggacgccggctgtctanaacaatngtagtcgctcgcccaaggnttctcgcacacaaaaaacggatggaactataangaanagtcccggga

SEQ ID NO: 84139 - DNA, 446 bp, Triticum aestivum
  unsure (1)..(446): unsure at all n locations
  Clone ID: PAT_TA_84139
ccgatgtcgagtccaaaattgcaaaaatctctgccgtgcctctcgtctctcttctcaggcgccacgcaaaacgttctccgttttccctctccggatccggcccgcgggggccaggagctaccgatgatccggaccgcaacggtgcgagcgcgtctcctcctatcgcgctcctacgtagcacaggcacaaggcagcttctcgctgggctctcgtccgctgggaaggcttcgaancttggntcggtacgctctttcaanaagatggcaatnacanggaatacanaattaaagttngattgcaanaggtgcaaaattcctngagagtcaggattagnatnaaaattggttcaatgnattcnaaggnttagggncaatgtnaaaaaatncggcnaaaaattctnaaaangtaangttggaattgtcactnaggggggttcnaatttaata

SEQ ID NO: 84140 - DNA, 645 bp, Triticum aestivum
  unsure (1)..(645): unsure at all n locations
  Clone ID: PAT_TA_84140
tctattcagatacatcgcaccggaacaagttcctgtccaatttggaggcctcttcaaggaggatgatcctgagttcaccacctctgacactgtctccgagctcactatcaaaccatcctcaaaagaaaccgttgagatccctgtcaccgagaactccacaattgtatgggaactccgggtgctgagttgggaagtgagctatggcgccgagttcacccccgacgcggagggtgggtacaccgtcattgtacagaagacaaggaaggtgcctgctaacgaggaaccgatcatgaagggaagcttcaaggcaggtgagcctggcaaacttgtgctaactgtgaacaaccctgcatccaagaagaagacgctcctttacagatcgaaggtgaagagcacaagcgagtgagtgtgaggtcacgccgctagctgctgggcctacaagttaaaacgattacagcatgtagaagagagaagaactttgggttgggtcgtaaattacgggtttttttgggttccatccanatttgttggtgaacaaagggagcttgttttgnanntaatgggaaanataaggaatgggtnatggnggtgtnataggaagaggncaaantgggatnaagtggnangccggccccgtaagntcnt

SEQ ID NO: 84141 - DNA, 545 bp, Triticum aestivum
  unsure (1)..(545): unsure at all n locations
  Clone ID: PAT_TA_84141
tgcaaaggaaaagaagcttgagaaggacattgagaatgagaatggaggtgctggggtctattctgcaagtctcaagaaacattatattttggccaatgatgaatggaaggaggatattcttccagagatactggatggtcacaatgttgccgattttctggatccaagatatccttgtaaggtgtgaaagttggaaaaggagaaaanggggcttcgtcctggaagaacaagctgcagaaagatgctttccaagattgatggtcatgaactaactcaaggaacagaaggagattttggctcaagattaggaagaaagaagcattactnatcaangacatagatgaagaaananaactgcaagaaagcctcctaatggncccnanaaagtttgccaangntaggaattcaaactgataggttgggacncaacttnaaccatgggtaagggtccaaaggctgcaatgaataaatccaaancatccaagggcccaagcntaaaggcaatnancaaactgcacggntgngacggnatggnaaaaatgcca

SEQ ID NO: 84142 - DNA, 261 bp, Triticum aestivum
  unsure (1)..(261): unsure at all n locations
  Clone ID: PAT_TA_84142
cgcagtcgcagcagntccaccaccgacgcgcgngccgcgcgccncgacgcggagcgctggtntcncgcgcagnaggaggcggccancccgtcgncgtcgcantctcccccggtccccgnaagcggcggccgcggcgtcngntacngcacgcnctcgtcncnggacttcctgctcctccccgacgacnccaagatncgccgctactcagngctgcccancggnggacggcaggacnacactgntcgagngcgcgtaccgcta

SEQ ID NO: 84143 - DNA, 608 bp, Triticum aestivum
  unsure (1)..(608): unsure at all n locations
  Clone ID: PAT_TA_84143
gccgtccgtcctaggctcctagctagctagctagcaagctccgccgacgacggtacgtcaatcgagctagccctgcccatccactacactaccgcagcggcaagcaatggcgtgcggctctgctaccgccgctcgaccagcagcccgcctctggctgctggcggcggtggtggtggcgacctccttcctcgccgtcgcggcgccgccgggcgcgctggtgacgagcgtcccggggttccggcaacaagcagcagtgccgtcgaaagcactacgccgggtacgtgacggtggacgagcggcacggcaggcggctgttctactacctggtggagtccggagcgcgacccggccggggacccgttcgtgtctggtcaacggcgggccggtgctcaacttcgacggttcgtctacgacacgggcattcactttgaccatcaggaggtcaactgggactgccaaacttatctcaaccttatactggctaagngtccagtgtgatatactggaccccctgccggcgtcgggtttctatcaanaagttcgntacaaacggnactnaagacgcgccgatcgaaatttcngtnagggtcagtcaccnagttctgaaa

SEQ ID NO: 84144 - DNA, 444 bp, Triticum aestivum
  unsure (1)..(444): unsure at all n locations
  Clone ID: PAT_TA_84144
gttagccgagagctcctctgctcctctcgtgtctggccgaacaggcagagcgaccagtctccagagcgctccccatggcgtcaggagctgcggnggcccctgtcgttcagactgtggtgctgaaggttgccatccactgccatggntgcaagaagaaggtccggaaggtgctcaggggcatcgaaggcgtgcaggacgtgacggtggacgcctcgcagcacaaggtgactgtgacgggcaccgtggacgccgacacgctcatcaagaggctgtacaagtccggcaagaagggagtgccctggcagtgtcacccgcccgccaagaacagcgagcccgcgccggaggccccgccggctccgcagcctgncggcgacggnggcaagatcgcggntgctgttntgtnccgctanggcatnaatcacngagcngnaaggtnccanggcg

SEQ ID NO: 84145 - DNA, 616 bp, Triticum aestivum
  unsure (1)..(616): unsure at all n locations
  Clone ID: PAT_TA_84145
ctcaaagctgcctccagcgcgaacgtccagcgagtggtggtggtgtcgtccatggttgccgtcgagatcagccccaaagattggcctgaaggtaaggtccgagatgagaggtgctggtcagaccgagagttctgcaggagcattgagagctggtacccggtggctaagatcatctcagaggaggcggcgctggcgtacgggcagcaaaccgggctcgatgtggtgactatcaatccagggttggtgttcggccccatgctgcagccgacggtcaacacgaccatccagttcctcatctacttcctcaaaggaggccccgacccggtgaagaacaagctctgggcatatcgtcgacgtccgtgatgtggccgacgccatgctgctgctctacgaagtgcctgaagcgaccggcagacacatctgcgcgcctcatgttatcagtgcccgcgactgctggatctgctgaagacatgtacctgactaccttgaatgccaacgaganatactnacanagacaccancgccatnactctanaactgaagananggtggactcnaccctgagaacattgaaactcaanctccgcggtggattcgncaagtggngggaantctc

SEQ ID NO: 84146 - DNA, 613 bp, Triticum aestivum
  unsure (1)..(613): unsure at all n locations
  Clone ID: PAT_TA_84146
gggagcagaaccagattccgaaccagactctgaatcctaggggcttcgatgtctttgacagcatcaaggcgcaggtggaggcggtgtgcccggggatcgtctcctgcgccgacatcctcgccgtagccgccagggacggagtggtcgcgctcggcgggccttcgtggacagttgactggggaagaaagggactccactgcttcgttcccggcacagacgagcgacctcccgcctcctacgtccagcctccaagcagcttctgcgcgcgtatagcanaaagaatctcaaccaaaccgacatggttgctctctcaggtgctcacacgatcggacaggcgcagtgcttgagcttcaacgaccacatctacaacgacaccaacatcaacccgccttcgccatgtcgctgaggacaactgccccgcgtccggaacacaanctggcgctctggacgcatgacgccacgctttcacaacgcctactanacaactgnntccaaaagggctccngantcggncagagtctnaanaacggannccnaagaanggnaanaattcnggcaaagccgaacttanaaggtttcccacggntggnaatggaactnaccaacacggtaa

SEQ ID NO: 84147 - DNA, 590 bp, Triticum aestivum
  unsure (1)..(590): unsure at all n locations
  Clone ID: PAT_TA_84147
gtttgctaacggtatcgactcgagccaggtgagggttcaacgtggaggttcatcgaggtctgctactcgtagctcccatcgctccactcaagatccagcagaagtggagcaactgcgagaagaacttaggcgacatcaggattacttgaagcaacaagctgcacaacataaatattatactacacagattcaacaacaacaaacactcatacaacaactagcacaggtccaagggatacatgtcccagtgcccccaccaccaccaccacctctcgttcattatccttgggtcttcacctccacctacacctatatctccatctaccgaacatcaagaccctccaagtaaccttgccgcngnatgaacgagaagncggttagctttgtcgaaacctattcgctagtggagtatcgacatcatccgtcactggtaccgatggtgatcggcgaccgtgagcttcaaggtatggatccgatacttgagactttantatgacaagtagagatatggcccttattagnacggaagattggtcctatatactanatganacttggatggaatgagngataggnttaaaaaaaaaaaa

SEQ ID NO: 84148 - DNA, 616 bp, Triticum aestivum
  unsure (1)..(616): unsure at all n locations
  Clone ID: PAT_TA_84148
gcaaatcgaagggctaacgactgagcgagtgccactatccctttgcttgccctggagaggagagggtgcgctatgggcgatacagggagcagctccattctggtgcacattctggtggtcgccctatgcctgaccgcctttggcttcgccgtcgccgccgagcgccgccgcagcacgggttcaatagtcacagacagctccaatgccacattttgtgtttatgactccgatattgctactgggctacggtgttggtgctttcctgtttcttctctcaggccactcactgctcatgggtgttacaagatgcatgtgcttcggtgcaccacttgcaccaaggtggaagcagagcatggtccatcatatacttcgcatcgtcatggatcacatttgcagttgctgaggctgcctaattgcggagcaacaaagaaccatacacaccaagtatanggatatgtatatgctggtaactggacctgccaaactctcgcaaangatgttantgccggagaatctcgggngtcacatgatttgactcactcaatgtcatcaaggcatagcaactaaaaggttatagaaanccannttgatacngtatctggcactanaatcccgn

SEQ ID NO: 84149 - DNA, 571 bp, Triticum aestivum
  unsure (1)..(571): unsure at all n locations
  Clone ID: PAT_TA_84149
tcctgctagcactacgccactaccagtcagggcaagactcgcagcccggacaaggtaaggcgacgtacggcggcgatggcgccggtggtcatgatgagcatgtgcgtcgtcgtgtcgctggtggcggtgcagctgcaggcgacgagcagcgacggcgccacggccgccacaccgtccgtggtgctgccgccggtgacggtgccccgtgtgcgcggccggttggaggccggtcgtaagctgcaggccgtcgacgccgtcgggatgggcatggactccgtggtgcgtcggacggtggtgctcaccacgatgcagacgagcaactcgccctccctgggctacggctcgctccgcccgaacaacgctgtgtgcgggtccagctgcgccgggaagacctcctggtgagccgtatctgcatcagatccgcccgtgtggggagtattataagtgtccgtctacacgtcttantagtctangcgggcggcgtactttaacaaatcaatancataatatgttaagtgagaatcntgaatattataatgtgcatttatcacatggntataaaaaaaaaaaa

SEQ ID NO: 84150 - DNA, 576 bp, Triticum aestivum
  unsure (1)..(576): unsure at all n locations
  Clone ID: PAT_TA_84150
gctgcgcttcatcaacgccgcgctcaacacggagctcttcgtctccctggccggccacaccatgacggtggtgggcgccgacgcctcctacaccaagccgtacgccacgcccgtcatcttggtcgcgcctggccagaccaccgacgtgctcgtcaccttcgaccagccccccagccgctactacctcgccgcgcgcgcctacgccagcgcccagggcgtccccttcgacaacaccaccaccacggccatcttcgactacggcaccggcgccagcaacagcagcagccccgcgatgcccacactcccggcctacaacgacaccgcgacggccacggcgttcacacgagcctgcgcggctccgcgcggcggaccttcccgcgcgcgtcgacgagagctcttcttcaacgtcggcgtcggctcttaactgctcaacggcaaacctgcgggggccaanaaaagcgctcgcnggcaagataanaagtctcttcggtccgtcaaaactccatcntgaagggnntaggtanccncggnggggaccaacaagnnntaacgcggatccgggaaaccccgggggtt

SEQ ID NO: 84151 - DNA, 619 bp, Triticum aestivum
  unsure (1)..(619): unsure at all n locations
  Clone ID: PAT_TA_84151
ctctcttacccttcctctccccacccacgaagcctcactagggtttagcggcggcggcgagatggtgcagcgcctcacgtaccggaagcgtcacagctacgctacgaagtccaaccagacccgagtcgtcaagaccccaggcgggaagcttgtgtaccagtacaccaagaagagggcgagcgggcccaagtgccccgtcaccgggaagaaaatccaggggatccctcacttgaggcctgctgagtacaaaaggtccaggttgcctaggagccgcaggactgtgaaccgtccttatggtggagtactctctgggaattgctgttagggagaagaatcatccgtgcttccttggnccgaaggacagaagatggtcaaagaaagtcctgaaaatacaanaaaccaaggncaaagacagctgcaaagtaatctcaaggaatggggaagctancccggtttgncacngnaaaattantttggggatggaaatctaggggcttgttgacatttacagtagntanaatttgggnatgaaccttcacttgaatggtggaaacggaaccgtcccaagtgctttatagantagntcaaccatcaagtaactcggttgaaaaaaaaaaaa

SEQ ID NO: 84152 - DNA, 424 bp, Triticum aestivum
  unsure (1)..(424): unsure at all n locations
  Clone ID: PAT_TA_84152
cttcagtgagggcggcctcgactacctcggcaaccccagcctggtgcacgcgcagagcatcctcgccatctgggcctgccaggtggtgctcatgggcgccgtggagggctaccgcgtcgccggcggcccgctcggcgagatcgtggacccgctctaccccggtggcagcttcgaccccctgggcctcgccgaggaccccgaggcgttcgcggagctcaangtgaaggagatcaagaacggncgcctcgccatgttctccatgttcggnttcttcgtgcaagccatcgtcaccggcaanggcccgctcgagaacctcgccgacnactcgccngacccgtcancaacaacgcctggncttcgccacaacttcgtccccggcaaatgagcgcggtcanctcnaacctctnaggcnacaanttnatgg

SEQ ID NO: 84153 - DNA, 343 bp, Triticum aestivum
  unsure (1)..(343): unsure at all n locations
  Clone ID: PAT_TA_84153
gggatgttgcgnggtcacgacaaggntcagacctctctgnnaggcattacttccagaacacgcanggtcntactctttgttgtggncancantgatagggaccgtgttgttganngccaganangaggctccacaggatgctgaatgaggatgnngttgcgcgatgctgtgttgcttgtctttgccaccaagcangatcttccagntgctatgaatgctgctgaaattactgataagcttggattacattcccntcgtcaacgtcactggtacatccatgngcacatgtnctacatccggtgagggtctgtncgagggacngngctggcnatccactaaattg

SEQ ID NO: 84154 - DNA, 629 bp, Triticum aestivum
  unsure (1)..(629): unsure at all n locations
  Clone ID: PAT_TA_84154
gtcatctccccaaatccccccaaaccctaccgccgatccgggcccagatcgccatggccgcgcccaacagcaatgacgccgccagcgccagcggcaccggcccggctggcgaggaggacatctccatcgaggcgttggcgcggcgcgtgcaagagcacatgaccctcaactcgaaccccgccgctcgccgccacaagttctgggagacacagcccgtcggccagttccgtgacgccgccgacgcatcgctaccgaacggccccatcgagccgcccacgccactctccgaggtgcgcgccgacccctacccgctgcccgccgccttcgagtggtcacctgcgacctcgatgacgaccgctcctcgccgacctctatcgttgctcgcccacaactacgtcgaaggatgacgagaaatttcgcttcaactatccccggcttcctccgctgggcgtcaaaccgcgtcctccttccgggcctggacatcggcgtcgcgcaaggatcaaagaactctcgnctcaactcgggcncccgccgcatcggngccgnacaanctccgatgcgnntaantcttngtcanaaaagtcgtcaacgctgaacgtctancggagnaccgccgtcaaangaaaatg

SEQ ID NO: 84155 - DNA, 606 bp, Triticum aestivum
  unsure (1)..(606): unsure at all n locations
  Clone ID: PAT_TA_84155
aaaatcttttgacgccaacagcaatagccacatgagttcataacaccagaacagaagaactagccaattatcaaaaagattcagataagtttgccagctcgtttgaactgctgaaggtacaaaaattctctctagtaaccgcccttgagatcgttgaccacatcataaggaataggagtgactgtctcgagtgtagcaccctcaaccatgaagccaggtttgggtcccacaggctgcctcttggtgctgatcacctcaccgcgggccttggcatccgccttgagctggtcattcttggctttcntcaagcggaactcctccgtgcaacgggagggctgcacatgctccacgcggacatggatcngcttcctgatgatgcggcattaacctgcntgttgatctcgacgccgatggcgcgcttggtgacgttccanacctcccggtgcggncgtggtataactgtgcgggatcccttgtgcacgggccgttaccttgacgtcnacgtgtcccatcttgaggtnccagtantgtgatggatnanctcctgcggaaggcgcgcgaaaggcncggccggncgagccgtgccgncgganctcngtctctcta

SEQ ID NO: 84156 - DNA, 621 bp, Triticum aestivum
  unsure (1)..(621): unsure at all n locations
  Clone ID: PAT_TA_84156
agcaagcagacagaaggacaggcaggcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatggtgatcgacttctcggcgtcctggtgcgggccctgccgcttcatcgagccggcttcaaggagctggctcccgcttcaccgatgccatcttccgtcaaggttgacgtcgacgactcgcggaggtcgcaaggacatggaaggtagaggcgatgccaacgtccgtgctggncaaggatgggaaggagtaagccgtgtgatggggntaagaagacnacttganaggaagtcaagatgttctcactcactcctcctcctaattagaatgcatacatcccacttcttacggttcccgatccagtggtaacttggacgggtgctgaatggtcctcncnaatacgaaaatcaaaaagagttntaaaatgtggaanngtcggtcatagantcnaactggttgaaggcanccgggtcgttcagaagtantattgaaaaaa

SEQ ID NO: 84157 - DNA, 634 bp, Triticum aestivum
  unsure (1)..(634): unsure at all n locations
  Clone ID: PAT_TA_84157
tctacgtgatctctaccccgaagagctcgataaccctcaagctgctctagaagctctccctcctcgtcatgaagcataccttgcagaagctcagcgtcttcagcgcgagtatgcctcacagattcatatcctcattggcttcgaggctgagtttatccgtccaaactgcgcagctcacgttcgcaaactcgctgagcatcccatcattgattacttcatcggctcagtgcattacgttcacagcactcccattgactacaacaaggagatgtttgccacagctcgtgaagcaagcagtcgcaagactgaagagtcgctctatgaggattactacgatcttcagtacgacatgctcaaggagctgcgaccgcgcgtcgtaggacactttgatctcgtgcggttgatgagcgaggatcagcccgagatgttcggcagtggaaggcgtttggggaacgcatcctgcgaaatctggtcttgcganggaacaagatggatggttgaggttacagcgcgggatgagaaaggactgctgaacttatcctggangataatgccgaggaaggattaatgggagnaagtactttgcntgcatcatgnatgaaagtgcacactagccgacanactactcagagcg

SEQ ID NO: 84158 - DNA, 338 bp, Triticum aestivum
  unsure (1)..(338): unsure at all n locations
  Clone ID: PAT_TA_84158
ccgccgccgccgacgccgagctcgacgtcgccgcgctcctccccgacgactccgtcgacctcctcgacaccgacgacctcttctacgcgcctgacgtccaccacccccacaacgccaagccggngctgctgcccgggtacgacctcgacatgctcagggcgctgagcctcagntccccccgggncgncgccgcgccgtcgccgtcgncgttgctgcgcgccnagcagcanaggnacgcngacaggccggngcaccacnccaggggcnccgtgcttcgcgtcatcatccacnancttcgctagaancancctgntcatggncgaggccgacgccatggc

SEQ ID NO: 84159 - DNA, 625 bp, Triticum aestivum
  unsure (1)..(625): unsure at all n locations
  Clone ID: PAT_TA_84159
atcgtctttgcttggtgtgtcgagccccttgtgttcggcgttaaggtggccggactgtttgaagacccaacaatctcggtgggtatggtttgcaggcttcccgggggtactgtggatttgacatatcctatccagaattttgtttaggttggatagctcgtcactgttgtccttaagaggcagtgttttgctgttcgtccgagagcttttgaacccggcgttgaccgccgtgctctttaggccattttccttattccagcgctgatcttttctacgtcgtgatttcccatttccatccctgacctcggatgtactctgggtcgctgngagctgcatcttgccagccaagctatcttcccccacgcaaaacgggtcatgangcttgntancgcggcattggtcttgntttcctgggcaaagtgtttggcgagcatccgtctcgngacgtaagtttaangcnctagggcttcagntctggacatcnacnattggtctttttggggagaactgtccaaaattgtgtctgatcncgggcgttcatangtaattaatctcgnaancggaggcggnatatccttgaattgctaaanaacccagggggccggaccancccaaanatcaatac

SEQ ID NO: 84160 - DNA, 283 bp, Triticum aestivum
  unsure (1)..(283): unsure at all n locations
  Clone ID: PAT_TA_84160
accaacatggtctcggccaccaagctcatccgcacccagcttgccagcgcgaaatgaggtcgtttgatagctccatggtctgatagcgcggaatgagccagttgttttgaataatttgggtgttaccccctgttccatggtgttagtgttaggttagcctctcattggtgagatacgccgtttcaagatgtgttctaagtttggagtgtgtgttttcctttgggctatgtttctgggggtatgtgtgtgctttggttataaacagganatganntaaacnaaa

SEQ ID NO: 84161 - DNA, 467 bp, Triticum aestivum
  unsure (1)..(467): unsure at all n locations
  Clone ID: PAT_TA_84161
ctcggctccacgatgcaggcaattgattcaaccgccgtgctaatctgcgtgtctctcctgatcaggggatgtgcctgctgtggctgacggcgatccttccggtgtacaagaacaccccggagtgcgcgccggggcggccggtagggtgcgcggtgctgccgtggcagctgccgctcctcttcacgtcgttcgcgttcatgtccctcgggtcgggcggcatccggccctgcacgctggcgttcggggccgaccagctggacaagcgggacaacagcgccaatancgtgaggacgctgcataccttcttcaactggtaactacacggtgctgggcctctccatcgtgttcgcgtccaccgtcatcgagtaatccagcaggccaagggctgngtcgtncggcttcgncctgccgtcangctcatgggcaccgtgctaagctgtcctcctgggctcgccttctaaacaagg

SEQ ID NO: 84162 - DNA, 485 bp, Triticum aestivum
  unsure (1)..(485): unsure at all n locations
  Clone ID: PAT_TA_84162
ccgccgccggccgcctgcagggctacggcagccgcctcgccaccaacacctgcgggcagcgcgagtgggaggactacctcttccaccttgtgcaccccgacgggctcgccgaccacgcgctctggcctgcgtacccgcccgactacatcgccgccacccgcgacttcggccgccgaacgcgggacctggcctccacgctgctcgccatcctctccatgggcctccttggnacanaccgtggtgacgcgctagagaaggcgctcaccancaccancaccangacagcagctgacgacgacctcntcctgcagctcaagatcaactantacccgaggtgcccgcanccgggagctggccgtcggtgtngagggccnacacggacgtnagcgccntctcnttaatcntccaacaacggcntgccgggctgcangtgtccaacggtnccgntgggtgacggcgcgcaccagccgggcacatcatcgtca

SEQ ID NO: 84163 - DNA, 251 bp, Triticum aestivum
  unsure (1)..(251): unsure at all n locations
  Clone ID: PAT_TA_84163
gtactccctcagttctttttatttttcatgttttagtataaaaatgaactaacaaacgacaaatattcgataacgaggtagtatctgtttgccctgtgacgtgtttaaaaccggtgaatttggggatatggtggtgtcacaagggaaaatgcttctccaattatatcactcgataaatactaaacgagaaatgggaactggattgtaaagaagatcgcttcttttccagaaaaaacaaaanaancaaaaaa

SEQ ID NO: 84164 - DNA, 594 bp, Triticum aestivum
  unsure (1)..(594): unsure at all n locations
  Clone ID: PAT_TA_84164
gatttacctcatgcatatgtttgcgcagaaagctacatatttgatgtcactgagtggttcaactgtcagggaatgagatgcccggcgaacactcacaaggcaaccttccatgtcaatgccaacatggcaaagcagagcagtggcaaggcgagtacctcaacgcagagggctggtaaggccccaagtggtgtaaacatggatggaggaggactcaacgaggaagagttcttcgagtggtccagaatgcagtcaactctgggaatgtttgaaactacattccggggcacaaggcgacccgacttctcctggtaacggaagcatgcccaagagtancggtancagcagcagcaacaacaatagtaggaaaaagaaganaggaaagaaacagtggtatcaaaacaaacagctgggnccnggtgtcacttcncgggggaanggaaaaaangaacancagataagcntttgggtattaaatacactcggaaatcgncctggctaaatggtcctanganangcactgtaancttgtcacaagggtctacngntgtaaatgcattnaaccngtcaanagtggcgtttaaaacgcctgccncg

SEQ ID NO: 84165 - DNA, 633 bp, Triticum aestivum
  unsure (1)..(633): unsure at all n locations
  Clone ID: PAT_TA_84165
gatccttcgatgtcggctcttcctatcattgtgaagcagaattcaccaagtgttggattgttcacccaccaatagggaacgtgagctggggttagaccgtcgtgagacaggttagttttaccctactgatgaccgcgccgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcaaccggcgcctctgctcgccgcccgccccgacccacgttagggcgtccgcgcccaaagggcccgtgcaattggtnaacccgcccgggccnacgcgccngcggcgggcgcctcaaaactcccttcccaaacgggcgggcgtctgatcctttgaaganacttaaaacccanggggcatgtaantgaaaanggcttccngcaagatcatgantcancccncgtcacaggttcctaaaaaaaaagaaaaaaaacccgggggggcccgtccaatccccnaaggagcgnttaccggccaaggcgtctttaacgtcngnnggaaacctgggtacnntacccttgaaaaacccttccaggggt

SEQ ID NO: 84166 - DNA, 494 bp, Triticum aestivum
  unsure (1)..(494): unsure at all n locations
  Clone ID: PAT_TA_84166
agggcttccaggagggcctctacatgggcgccggcggcggcgccaacgccgtcaaccccgggtacaccaagggcgacgggctcggggcggagatcgtcggcaccttcgtgctcgtctacaccgtcttctccgccaccgacgccaagcgcagcgcccgcgactcccacgtgcccatcctcgcgccgctccccataggcttcgccgtcttcctcgtgcacctggcgaccatccccatcaccgggcaccggcatcaaccccgcgcgcaagcctcggcgccgccatcgtctacaacaggtcccacgcatggaacgaccactgggtcttcctgggttggcccttcatcggtgctgtcttgcngccatctacaacgtggcatcatcagggcctccccttcaaagaccgtgactgattatactacattgtttattaccaacagnaccatgcagatacgatcatccttattaactatatagtanatacaanattcttgtaat

SEQ ID NO: 84167 - DNA, 457 bp, Triticum aestivum
  unsure (1)..(457): unsure at all n locations
  Clone ID: PAT_TA_84167
gttcggctcctctccgccgatccccacgccggtgctctccaaggcgctccgggtggacgccagtgtcgtggatctcatcaagtccaagttcgccggtgggtactgagactgagacgggacccagcatgcatcttgctagcgcactgtgcatgcgccgacaatggctttgcgttggcggattgatatttctcgttacggaatgggcgacgtcgtggagatccgtaacagtttgatacgccagggaaataaaataatgttcatgcgacagaccacgtataataagctatattatggttaaagattcagttgtaataaaaagtaaagatatcttgcttctgtcttcactgcctagctatctccngggtaaaatgtatttgctcattttacatgtaatataagaatgggcctatatatatatatatagtcncctttcaagtgtgtttccaaaaaaaaaaaa

SEQ ID NO: 84168 - DNA, 159 bp, Triticum aestivum
  unsure (1)..(159): unsure at all n locations
  Clone ID: PAT_TA_84168
cgccggcgccgaggcgtcgcgcgnacgccgtncctcngtncagcttcgggctgtcgtcgttgctcgccgaagactgcggcggcggngtgcccgtgcccgtgccggaganggngatggcgctcgcnccgngcgncgcgccgaggcactcngcgccggtgc

SEQ ID NO: 84169 - DNA, 414 bp, Triticum aestivum
  unsure (1)..(414): unsure at all n locations
  Clone ID: PAT_TA_84169
gagaactggcagtggatgtacaagcagatgcacgccaggggcctgctgctcccggagctcaagaactgaatgaaactattgctgctgtagctttagctagctaaatgcctgcatgctgcaccagctgttgtatctcccagctctcgaagactcgtagcatcacccagggccggtcgagtggccagtatccagccttccgttgttaattgctggcgttacctttcccctgctagtctgttaatgttactagaatattgggtgtccatgaccatgcttgattgctgggcatgggtgaangacgggcaagatacattaagttgattttgtagagccactccctnaagactgaatcaatcaagatggagttatattgattactgcaanaananatcaananaaaacncnanggggggg

SEQ ID NO: 84170 - DNA, 442 bp, Triticum aestivum
  unsure (1)..(442): unsure at all n locations
  Clone ID: PAT_TA_84170
caaccctctcccaacccgactagtcggactcgcagctccgccccaagtccaggtccaagcatggaagtcgcggcggcgtcggcgaggcccgtcctgcgcgtggctgccatctgcggctccctccgcaaggcctccttcaaccgcggcctcctccgcgccgccgcggaggtgtgcgaggactccatcccggggctccgcatcgacgagctcgacatctccgacctgcccatcatcaacaccgaccttgagaccggcagcggcagcggcaccgtcttcccgcccgccgtcgaggcttcccgcgccaaggtctgccaggccgactgcttcctcttccggcgcgcccgagtacaactatccanccgcacccccttgaagaaccgctgactgggctccaanagaaagactgtttgggcagaaaacctgctggatcgtgatngaagcg

SEQ ID NO: 84171 - DNA, 226 bp, Triticum aestivum
  unsure (1)..(226): unsure at all n locations
  Clone ID: PAT_TA_84171
caggagcttccggcccagtgaaccgtccttcgcttattagcctgtcaggagtctcagtccaattacttcataaccatgtggnttctcttggcaattttcttcttcacatgaaccatgtttcttgctgtttcagtttactcccttgtcattggnagatcgtttcctangcanaattttggctgaagagggttgtgcgatttatctgganctgtagntgaataaataa

SEQ ID NO: 84172 - DNA, 201 bp, Triticum aestivum
  unsure (1)..(201): unsure at all n locations
  Clone ID: PAT_TA_84172
gcaccgcacacggctaagacatccaagggatcaattgttgtgtctatgggttgccccctgcccccctatataaaggagcaagggagaggccggcgctagagggggcacgccaagtgtgggagtcctactaggactcccaagtcctagtaggattcccctttcctttccggagtaggagagaaggnnaggaggnagcaacca

SEQ ID NO: 84173 - DNA, 618 bp, Triticum aestivum
  unsure (1)..(618): unsure at all n locations
  Clone ID: PAT_TA_84173
tttcgaggtgtcattgtcctggaggaatgtaacctggaagagatagaggaggaagagatatcgaagagttctaaggattcgaagaaggcaaatggacaagagaaaggcccaagtcttgtttttaagattactaacagggtttcctacaaaactgtcttaaaagctcacagtgccgttatattgaaggctgagagtatggctgacaaaattgaatggatcaagaagataaaaggtgttattcaaagcagagggggctctgttaagggtcccactgaagatggtcctatgagacaaagccgttcagatggatcccttgatacaatggctcggaggcctgctgatcctgaagaagaacttcgatggatgtctcaagaatccgtgggntatgttgaagctgttttgaacaagtttggntgcaaatgttccaaaaggcantggtantttgccaagtggagaaatcaaaagaagatatgctaacaaacntacaactcaataagtgcacanagcaatgcaagantcaagannctcaagaggacanatgctaacttagcggaaatncaaancatcatcccctgnaaaccacncancanatcntgcaatgncaactcntnngacaaa

SEQ ID NO: 84174 - DNA, 343 bp, Triticum aestivum
  Clone ID: PAT_TA_84174
ctaccgaggaggcaaccccaacgtaccgccatattcgggtggtggcaatcctggctaccctggtggcagccctggctaccagggtcaaggaggcaactccaacttccagtgaacatgaccacgagtactaagttggcacccctgtttcagagtagccttctgcaagagatggtgcgccgtagcctagcataaatcgaacccttgttgctatcggattttcatggattgtcgctgtttgcacttaatgttctatatatagtactcaaaactatgcttggtgtctgaagtgatgtacgtggaattctgaaactatggatcagctcttgtgtgcacttgctgaaaa

SEQ ID NO: 84175 - DNA, 646 bp, Triticum aestivum
  unsure (1)..(646): unsure at all n locations
  Clone ID: PAT_TA_84175
cgcacacctatggcaggtagtggctcagacagagtgcctgcttggggatcacgaacacccgcagctgcaagcggacgcacacccgcttggaaggctccagatatgtccggagcccgaactcccgcgtgggccgatggttcacgaaccgtcaatccttacgacggcaaccgtactgcttatggctctggtggacgtacacctgcctggcaggccggtggaaggactcctgctcctggcgatgctttcggtgctggctcacgtacgcctgcatatggcggtggtggagacagctgggggctaangatncaagactcctgctttngngagtatctgcgccaactcctggagctagtggnaacgactcatggggaggttcaggcgcttatgatcccctacacccggtgttggtctcggtgccccaactcctgntgcgttgagtgctcctacacctggtgcctaatcagcaccgatcccgctgccatcagcgcacctacacaaggagctcanggaaggtgggtggggaacaactcgntccantctgngttggtgctccacnctggtatatgggccctaagcggnagantctcccggnatccgcgcanngtccnaacangatncatntggnaggtnttgcagtncaggnttt

SEQ ID NO: 84176 - DNA, 582 bp, Triticum aestivum
  unsure (1)..(582): unsure at all n locations
  Clone ID: PAT_TA_84176
ctggggtgctctttcttccatggtgctccctaagtatcctctgcctacatatgacgttgtagtacgtggaggagcacctaatgccttttcgcaatgtatggttgcatatgatgagacacaaaggccatccctgaagaaagctttgcttcttggtgatgcattttcagatttaccaaaggtcgaaaaccatcaacctaacgatgtaatggagtatggtggttcccccaagacagagttccaagcgctacattcgacttgggtcgtaaagacatgttgggattggtcgtttgggtgaggaggctggtccaagatgaaaggaaactcttgggntaacaagcccttacggcttaacaatgatgataatgagcggggttaacaaattcctgtcaaanaanggagcaacttccgtgacctaaaaggtgtcaaaggttggagcaaaataaangttgttaatgggattcaaaaatccaacgtgtgntacctttcgncnggaaacantggtcctgacnagccatnnatcancaaggnaaatcatcaagcattcggcccngtgnnggacaaangtccnaanttgacaagcaa

SEQ ID NO: 84177 - DNA, 492 bp, Triticum aestivum
  unsure (1)..(492): unsure at all n locations
  Clone ID: PAT_TA_84177
gggagctgcagttgtccagatgaaggagtatcttgacaagtttgcacaaagtgaggagcattcagaagtcattgaggagactggcagtttccagcttaggagaaagaagtcagacaaagctcatggatttgtggatatatccatccggatctgcaaacaagaagatgatcatggtcggttttcaggattacctgaaggattgaagaactccgatcaggtcggcatcacattggctatagaagacggaccagtttataattatccaccgccaccctacanccattataggggcgacagagaagatgctgatcaccacagtnaattcaggccggtgatncctggaactcgccangtcatcaccatnggaagtagctacagctacaanccccaatgttccatcaaccctggcacaacaacaacttaaacctccggctccttccaacannagaancccgntagggaaatntgcanagantccataaatngccacca

SEQ ID NO: 84178 - DNA, 480 bp, Triticum aestivum
  unsure (1)..(480): unsure at all n locations
  Clone ID: PAT_TA_84178
ctgcccttcccctgcccgccgatcgcttgccccactcccttgcttccgtggcgcacacgccgcgcacgcgtgctcgcctctcctggaaccgtttccgccgccctcccgcgtcggcgtcgcggcgcaagagggtaccctgaatttcgtcagtgccaagtgacgaccgcttttgcctatttgtgatagctgaatctctgtggttcaaaggcgattgatttgggtttgctgacgcacgcctaatgagtcccaagctccacatcacacggcttcatcccccggggaagttggggaatttgagtcgccccatgcctggccgctgtcagcgcctaaggccagcccgaagcggacgcnggtgatgacaaggagncagctgttgccggtngccgggacaaaatgcgatgttccnggtgggacaanatgggttaggtcttaatgcaactttcaaggaatttaaggnggatttaagacggngntcgggat

SEQ ID NO: 84179 - DNA, 632 bp, Triticum aestivum
  unsure (1)..(632): unsure at all n locations
  Clone ID: PAT_TA_84179
gtttattggcttctggctttaattaattactgtatttgcatgttcaggtatgttgttcatccatctcgtatgatgaagtgttttatgctcttttccaattattgttgcaagtagcaaaattagaacatgtccttatgtttagactatgaaagaaaacacttatttcaatttgtaggtgtatttttctgtttcagttggcatatcatcatgaggatgtgaattccacaggaaggcccatgtgatcttattgctcccttagatcttccacattttttacagtcttatccttgccgaggggagcctgctccagtagtgggctcagaaggggcaaataccatggatgttggcaggctgtgcttgtgcagaatgcaccaaggacaagacgggatgcaaggacatgggggacgatggggattggttggggtactgtatgcagctgcagtanctgaacctgaatgacccgtggttgcntggaggcgatctggattggctcggtgcaatggaggtgaggtgacaagggctcaacagtgatctgtttacaatgggacatcatcctgcagntaaaacaagtaccaaggcgntccacaanctatgcagtaccagaaggaaagtagatcaagcagntctaggga

SEQ ID NO: 84180 - DNA, 307 bp, Triticum aestivum
  unsure (1)..(307): unsure at all n locations
  Clone ID: PAT_TA_84180
ccggcaggcagccactcgcgaaggcgaagacgcaggcgccgagccgccgaccccacgggcccccaccccactcccgccgcgcctctccctccgcgtttccagntcccctcgctcgcccgtgtcggcattggcaccggtaccccgccgagcgcctgcantgcgagncttctagcttcccgtancacggacgggtatcgngagaggcatgcatcccangccngagagcggcgacnccntcggggncgcnncggaggnggnntccccgcggtccggtanattccggagtgtgagnatgcacgccgctccc

SEQ ID NO: 84181 - DNA, 615 bp, Triticum aestivum
  unsure (1)..(615): unsure at all n locations
  Clone ID: PAT_TA_84181
ctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttgggaggcattgacaagcgtgtgattgagaggttccgagaaggaagccgctgaaatgaacaaacggtccttcaagtacgcttgggtgcttgacaagctcaaggctgagcgtgagagaggtatcaccattggatatcgctctgtggaagtttgagaccaccaaagtactactgcactgtcaatggatgccctggacatcgcgactcaacaaagnacatggtcacgggtactccaagctgactgggctgcctgatcaattgatccacactggnggtttnangccgtactccaaggatggcanaccnttagnagctcccttgcttcancttggggcaacaaatgattgctgcngaacaaatggtggacaanccagtatcaaggccgtacatnnantggaaggannttaactaccaagaagtggtnacctgaaantgcttgccaanccggttt

SEQ ID NO: 84182 - DNA, 299 bp, Triticum aestivum
  unsure (1)..(299): unsure at all n locations
  Clone ID: PAT_TA_84182
ggaaagttggaggagtggacaaagcggtatgggggcttcttcaagccctgctcttacctcgctgaaagagctgcaaaagggattcctctgagtgcaccaacaaagaaagttcaggctcggctataagatgatttccttgtggatggaggagacaataatggattccggtgaagcatttggaatgcgtagagctgtaggctaccactatcacatgcatgtaacgcaatatactantgggnaaatnaagtgcactgcacggcggtttttttatntataaatacaaggatttttttcttgtc

SEQ ID NO: 84183 - DNA, 470 bp, Triticum aestivum
  unsure (1)..(470): unsure at all n locations
  Clone ID: PAT_TA_84183
attcccaccttcgtcgctggacccggcaccggtttcggcggtggtgacggtgccgtcactaaccctactcccggtgctggcctcggtggcggtaacaacaacacccctgacgtccccgagactccttttcagactccgggagccggtagcggtagcggnagcggnaaccagtccgggggtgctgtcccaaccttcgtcgctggtcccggccaaggcttcggtggtggngatggccagaacggaggcttccagaagcgagctcgatcctctcagtaaatggnttcttgnngaatatacaatgattttgngtggatctcnatgtttaatgaaacgaagaggatantcgtgtttataattcttggggtgnnaagcagagcttagcacttcactatgtatctacctcatggcancacttgaagtgtcgatagagcaatttggcnaacatatcntccttcaagtgnnaaangttg

SEQ ID NO: 84184 - DNA, 252 bp, Triticum aestivum
  unsure (1)..(252): unsure at all n locations
  Clone ID: PAT_TA_84184
tctacgtgaagcgcaagaatcctcgtcgcatcaccgagaagcttgagtttagaaagtatgatccccgtgtgaacaagcatgttctgtttaccgaagcgaagatgaagtgagatcttgtttctccacaatgcagaactgtaataagttgtcaaccttttgcgaccagaaacctttatgccgttattagacagatgattaacgatcctatgtgtttttcctgctccaatgagctgcaagcaaaanngntccttt

SEQ ID NO: 84185 - DNA, 618 bp, Triticum aestivum
  unsure (1)..(618): unsure at all n locations
  Clone ID: PAT_TA_84185
gtgaattggcccatagggtggatgatgctcttgggttcatgactgcatcggggcttacagtcgaccacccgataatgacgactactgacttctggacctcgcacgagtgccttctcttaccctacgagcaggctcttacccgtgaggattccaccagtggccttttctatgattgttcggcccacatgttgtgggttggtgagcgcactcgacaactcgatggagctcatgttgaattcctccgtggtgttgccaaccctctggggcataaaggtgagcgacaaaatgaaccccantgagttggtgaactgattgatattctgaacccttcaaacaaacctgnaangatcaccataattacaaggatgggggcagagacatgaggtgaaattgctcaactcatccctgctgttcgcaatgctggctgattgcacatggattactgatcctatgnatggaacacaacaaagcccttgtggcctgaagcnntcattttatccatccggctgaatgcgnnctcttnaagtgnagncaagaagnancncctggggggtcaactttaatgctggaaaanttcccatgaacgtggttaggcgttncttcanattgagacgtacn

SEQ ID NO: 84186 - DNA, 200 bp, Triticum aestivum
  unsure (1)..(200): unsure at all n locations
  Clone ID: PAT_TA_84186
gtcggatctgagacgagacgagacgatcccccctcccctcaaccggaacttgttttaccccatctcatcccactgacccanngactcaggcnacangcatctatctgcacgcgngtaatgtcgcaacttcctctcngctcctcgnacaggccangttgcggttgctcaatttggaancctgantcattgtcancagttgc

SEQ ID NO: 84187 - DNA, 490 bp, Triticum aestivum
  unsure (1)..(490): unsure at all n locations
  Clone ID: PAT_TA_84187
cggtgttcaacttcggggactccaactccgacaccggcgggcgcgtggccgccggcttcgagtccatcttcccgccctacggctccagcttcttcggcgggcccgccggccgcttctgcgacggccgcctcgtcatcgacttcctcatggaggcaatggatatgccactcctcaacgcgtacctggattctctaggcacgccaagctttcggaccggtgttaattttgctcaagctggatgttcgatcacaccagcaaagccgacatcagtcagcccattctcatttggtctccagatcaagcagttcttcgccttcaagaacaaagtcactaagctcctgtctgaaggagatatgcacagccgatacattcctcagcaaggattacttctcagaggggactctacacgttcgatattgggcagaatgaccttgctggtgagttcantcangaacagnggacangtcatcgcatcaatccaantatttgc

SEQ ID NO: 84188 - DNA, 608 bp, Triticum aestivum
  unsure (1)..(608): unsure at all n locations
  Clone ID: PAT_TA_84188
gcaactccccacgcaaagccgccgccgttccctctcgtcttccccagttcccctacgccggtaatcccacgtcctatcagccgccgatccagccttgcttccatccatccatccatccatctcgtcgcttctctctgttccgcgtgcgatcgagtagatcaaaaggaggaggaggatggcgaggagttcgttcaagttggagcaccccttcgaaaggaggcaagctgaggctaaccgcatcagggagaaataccctgacagaatccctgtcattgttgagaaggccgagaggagtgacatcccaagacattgacaagaaaaagtcagccattcacgagtactttgttcctgccgacctcacatccgacaagtttgcngtaagtggtacgggaagcggtnaagtcaangctgagaagggatcttanccttngnaanaaaacctnccacaaaaaaangcccgnagncccccatctacnnggggacaaggnnagggaggttcncaaatgactgangggggngaaactcgggcgttgnggggnaccnntgggttcaatggggaagccncggtaatctaaatgatcaaagatcntgtcaaaganaaccggccg

SEQ ID NO: 84189 - DNA, 625 bp, Triticum aestivum
  unsure (1)..(625): unsure at all n locations
  Clone ID: PAT_TA_84189
cacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcgagggaggagcacaagaccgggcggcatcctgcatcgctccgggcagtccagctccagctccgtcggaggacgacgnggcggncaagggagggaagangggaatcaaggagangtcaaagagaagctgccgggnggccacaaggacgacaagcacgccacggcgacaccggnggcgccatgggannaggacacacggnaggcctngggcaacaggacacacggggggctangcaacggnacgaggnaccggngaganaaggatttggcaagntcaggagaacncccggcagactgacgggntaacttgcgnctgncttgctgccgcaaacctcnctcaggtcatggtanagtaaccangatanngcct

SEQ ID NO: 84190 - DNA, 225 bp, Triticum aestivum
  unsure (1)..(225): unsure at all n locations
  Clone ID: PAT_TA_84190
attacttgctgcgtctactacaaattttcccaattttctcctccaaatttctgttcccctttgtccttccaaattttcggttgcatctctgttcacgggctccggngttgttttctcaaactttttantcggtttttttaggatggtacccttagttttgctggtttcctcgcatttacctttagtcgntttttctcangttttaccatatccttcagtcanaga

SEQ ID NO: 84191 - DNA, 438 bp, Triticum aestivum
  unsure (1)..(438): unsure at all n locations
  Clone ID: PAT_TA_84191
cttgcctgccactcgatcagcagtaggcccacagctcactcgcaaccactcaccaagctagcggaagcaaagcagagcagcggtcgccggccgggcacgataccagcgtcgcgagagagagagaggatggcgttcatgcggtaccgcgcgctgccgcggggggagctaacagcggaggagttccgggcgtggctggcgcagttcgacgcggacagcgacgggcggatcagcagggaggagctgcggcacgcgctgcggagcctcaacgtgcggttcgcgtggtggaaggcgatgggcggcgtgcgcgccgccgacgccgaccgcgacggaggcgtgcagctgggggaggacgaggtggcccgcctcttcgccttcgcncagagcnacctcggcgtcaanttncccagctccgggtacnacnattacngttanccttct

SEQ ID NO: 84192 - DNA, 365 bp, Triticum aestivum
  unsure (1)..(365): unsure at all n locations
  Clone ID: PAT_TA_84192
cttcaaccggaagctgaacgccaccgtgggggcgctggtgaggcggcacgcggggctcaaggtggccgtcttcgacgtctacacgccgctccggggcctctccgagaggccggccgcgcacggcttcgcggaggccaggaggacgtgctgccggacggggaaggccgggacgagggtgtacctctgtgacccggcgacggcggcccggatgtgccggaacgccagcagctacgtgtacttcgacggcgtgcacccgtcggaggcggccaacctgggtcgtcgccgagtccctgggtgtcggccggcatcgacttctcacctaagtaagcttnaggcgacangggcgtacgtactacttgcagttt

SEQ ID NO: 84193 - DNA, 212 bp, Triticum aestivum
  unsure (1)..(212): unsure at all n locations
  Clone ID: PAT_TA_84193
gtttttttttttttttttttagtaccagcactgacagtctatgcgttgataagagaaacagttttccatcggtgtacaaagatgcctctgangcacatgananaaaaagcaacaacagatctggatgctcaccagttcagacctctgaaacacttggtagtgagtgactgactccaggaccaaacggtggccaaaagagaggaacagacctc

SEQ ID NO: 84194 - DNA, 513 bp, Triticum aestivum
  unsure (1)..(513): unsure at all n locations
  Clone ID: PAT_TA_84194
gggcggcagggggagggcgatggaattctgcccggtgtgtgggattctgctgcagatcgatccgggcaccggaagccaccgcctgcgcctcttctgccccgtctgcccctacgtctgccccatcctgaacaagatcgtgaagaaggcgaggttggtcaaaaaggaggtggagcccatctccagcacggcggatgagatgaaatcggcccctaagaccgcagttacatgccaaagatgcaaccatggagaagcatacttcaagcaagatgcagatccgattcagctgatgaaccgatgacaacaatatacaggtgttgcaaagaagaatgccaacatgaatggagagangactgaccatacatcccacttgcttaactcnctccctgtgctcctcatttttgagtgttgggattcctgttcacatgtatgcttctaacagctatacttaaatacaanttttggnaatgtantccaaacnatggacgcttttggctgaaaagnatncatgcaaan

SEQ ID NO: 84195 - DNA, 362 bp, Triticum aestivum
  unsure (1)..(362): unsure at all n locations
  Clone ID: PAT_TA_84195
ccaagctgaagaggatgaaagatttgtcaaagagtggaagaagtatcttgaggaggaggcgaggattatgaaagatgttccagggtggaaggttggcgagagtgtgtacaattccgggaaatggatgcccccggccaccggtgagctccgccctgaggtgtggtaagggctgttgtaggcatttgagaatgcaaccatgtcatgagggcatgaataaaggctatcnagacatgggcatcctcctttggttcnactaaggatcagtgttccaaatacctggtatcctatttacccctaatgaatcctgggctgggtnaataatatgaagccgacgcttttgcctccaaaaaaaaagggggggg

SEQ ID NO: 84196 - DNA, 392 bp, Triticum aestivum
  unsure (1)..(392): unsure at all n locations
  Clone ID: PAT_TA_84196
ctctctctctctctctctctctctctctctctctctctctctctctctctctctcggncgccggncctccgtcgcattcaacacgtacgccatggcgcgcctgctccgcgccgccgccgtcctggcgctcctggncgtctccaccgccgcgctgtcggcgccggcgtgggcgggcggcgtgtccgccggngacctggcncatctgggcgccgccgtcgtgattcggcgcggnggcgggngggcgtgncgcggcggtacgacggtgngcgagtgcatggagtacctggacgtggacgccgagggcgaggncgacgtcgccggcatggncangggcggnatcaagcgccgggtgctgcagggnggntccggatacatcggntacgacgcgctgc

SEQ ID NO: 84197 - DNA, 466 bp, Triticum aestivum
  unsure (1)..(466): unsure at all n locations
  Clone ID: PAT_TA_84197
tctagccggcccattcccgccccacccttgtggcctgcctcacccgacccgacccggtctcccccaaaccctcgggcagcttctcccgtgcccctcgcgtgcgctctacgactgggcggccgccggcaccctacaccagttgcccaggtctctgtcttcggggaccttccccggcgaacgagcatccaccaaggtcattgctggagaaaggccgagaaagagcgacaccctgggaaatcaacaagcaaagctggatgacgaaggacaaacgatgcaagtggtggtgggaagttcccccgggaaggtttctatcgcgcccaagggacacaagaacccgctcaaggatccncatttcccaancccnatacgcctggaaagtcntttctcaaagaatanccggggattcctgctganaaggnaacgacgtgaggagtgcacgcanacattcnttcccccatgtgggggc

SEQ ID NO: 84198 - DNA, 709 bp, Triticum aestivum
  unsure (1)..(709): unsure at all n locations
  Clone ID: PAT_TA_84198
gcaagctgaagttgatgccctagagaaacaaaccttgtctctggccaaggattgcctgccaccaagcatgccaaaggaaggaaggagaagccatcatcgcctcagctgtcgaagattgatgtgaggccaagcgaagatgaaaacaccacaaagatggtgaaggacatggaactgcagaaactccacgggaccatcaaaagcacttccagaaggtgggtgtcaagataccggggtgggcctgggagcaaagagaggtccgactttcaaacaagcaaccttccaaggacgcaaaggaagcagtttcgagatgcttgaagctgaaggagttcctgggacagcgacgccaagcgacgtgaactacgagcggatgatgnaagacatccagctggcctccgtccagacccctaacccggcgantgccgcctcaacangggggccacaggaagaaactcccgttgntgccgcggcgcatcctgacgacaaatctcccgctgtngacnttggcanggtagcaacggaccggtggatgcgtggactgcggcacacaaacgagnggcgagaacacanggaagaacgtctctcgaaccgtggtacgtaagactaactgcaacagagtctcttcgncatntggtnccgtggngcacgctcaaanggcaacgaggaaaaaggtnacgttccncggnaggttcgatcgnaancagntctcggg

SEQ ID NO: 84199 - DNA, 589 bp, Triticum aestivum
  unsure (1)..(589): unsure at all n locations
  Clone ID: PAT_TA_84199
ccgcgaccgacgactcatcagacatggcgaagccggcggcggcgaggaagccctctgcggcgtcgaccgtcgcactgacactggttctggccctggcttcggctgtcctcctcttcctcctgctccntctcctcccnnttcccggttcccccaacccgcacccggcaccgccgcctccgcctccgcccccgccgccgcatgcgcaccaccaccagatcccattccgaccctgtcgtcgnngggacataagagcgccgcctccgaaaaccgccgagtgggagcgctccgccgctgcaanggttgcacgtcccgggatggaggcgggccanccccagaggtttcaaccgacggtgagtccacccgnacgaagactacatcaatgacgctgcgcgtttaactcaccttcccnttggagggtntcccaaaaattnaagtcnacctgccnaatgggccttaagggcgcttactggcccgtggactcccaaagcccggggaagtgtanacgnacgccgggacncaactgnanacgcatannaggcggtccctanggaatacaacggcaantggctggtttcacatananaaccat

SEQ ID NO: 84200 - DNA, 617 bp, Triticum aestivum
  unsure (1)..(617): unsure at all n locations
  Clone ID: PAT_TA_84200
acacaaccccactcacccggcagggaggccctcttcgtcggcggaggccatggtttccctcaagccgcagaagaggctcgccgcgggagtcctaaaatgtggcaaggggaaggtgtggcttgaccccaacgaggtctacgagatctcgatggctaactcgcgtcagaacattccgtaagctgggtgaaggatggattcataattaagaagccacaagaaaatccactcnaaggtccccgggcaaggagggccatgaggccaagcaagaaggggaggcactcctgggttaccggtaagcgcaagggtaccaaggaagctaggtcccccaccaagtcctttggtgcccaagatgcgttcctccaaggctctgctgcgcaaanatcctggaagcaaaagaancngacaacacatgtaccacgatattttatgaaagtaaaaggaacatttttaaaataagaggnatcaaggaganaccacaatcaaagccgagaagcaaanagaanatcnctcggttaattttaggcaaccancaaganaaggttccttaaaaaaatttttaagggngaantgtaaggccaaggaactgggaacacantcaatangcccttgaatgncaa

SEQ ID NO: 84201 - DNA, 534 bp, Triticum aestivum
  unsure (1)..(534): unsure at all n locations
  Clone ID: PAT_TA_84201
tgctgatgacagcagcaagcacttttgctgcagcgttcatgactcctcttttgacatccaaactggccgggcaatacgtcgcagtagaccctatgggactgttcgtgtcgacatctcaggttgtcctagcgcctgttcttttgggtgctctacttaatcagtacatgggccgtttgggttgagtcaagtttctcccgtgatgccgttcattgctgtggcaacagtaccgttctatgcggcaacgcgattgcacagaatgcttcaaccatcctaacatcctggctacaaggggactggctgtcactccttgcatggttccggttctcctttggntatgtctttcaaaggagctccggnaccnatacccttcacnacgaaatctccgatnnnagttgggatgcaanancccgtgctggtgnggttcccgcgggcaanattcgggaacctctcaaggggntccctncgcggttccaacactgcaaccggtgtatggnacactggccgggtctggaggcatgccccaatnaaacagga

SEQ ID NO: 84202 - DNA, 688 bp, Triticum aestivum
  unsure (1)..(688): unsure at all n locations
  Clone ID: PAT_TA_84202
gtcttcactagccctaaggatctgcatttgtgtggcttatgttgctaccagttctcagttattctcctgctaaatctaatgaagccagccaagctggatctttcaaaaaagaaaaagttctcagttatttgtatctgctacgcctagtcataactagtttcattttttaacagcagtcctacttttgttgctcaccggctgacaccttcttttcttttcttttttctcttttttttccctggatgtatgcaacccacgggggcatcacaaaattatcattctagatcacgggggaaggctgggctgggaatacacttggggaacatccaagcattaccactgttggtgtacaatactttttaaagacgaccgatcaaatttaaggaggggtgggaaaatttccngangggnaagnaatgttggactaacacttcaancgcagcgattcngggagttaaaaaaatgtaattacccattacatcnctacaaggcgacctcggctagcacgtcaaattacngcccaaggatggggtntgccccggctacgaagtaacactccaggtactccacaaggaaactgnctcctctccgtcccnccgatacganatcctcgctcacgcagacgtncagnggaagatgtncccnaagggcaacaagngntccagggncgncattcccaaggncatan

SEQ ID NO: 84203 - DNA, 669 bp, Triticum aestivum
  unsure (1)..(669): unsure at all n locations
  Clone ID: PAT_TA_84203
ttttttttttttttttttttttttttaacgtcttatttgtagtattcatctggcatcatcacacatgaggggacgcacacgccgcgtcacatggaagatacaagaaaggaaggactagattcataacatggcatggattcactcatgcatggaagctccattacactccacacgtactgtacgtcactttttgggccgccgccgcctgtttgctgctcttcaccttccttttgggttcccgggggcttctgctcagccttcttaacgccgccgtcttccgcggctgacggttccgtcgccgtctccgctgactttgggcgccggtcctttgccctgcgccgcactccgctgggttcgcggctttcaagggaancatggntggtgtcctgctacccactactcatccgtcncgacctgcctgganttaaatctgctgggggggccgggaccaattcgcccaaaatgancntattacgcgcgncantggccncgtttaaantcctgacggggaaaccggngtaccaantaacnctgnagaanccccttcgcancngngaaacgaaaggccgacgatgccttcaaagtnccactaannaatggacccctgacggaataaccggggnntgggtaccaangaccgtaattcagcctagccgccttcttttctnt

SEQ ID NO: 84204 - DNA, 538 bp, Triticum aestivum
  unsure (1)..(538): unsure at all n locations
  Clone ID: PAT_TA_84204
ctcggttgctcctccggcaggccgccgccaccgcagctccgtgctcctgcagcccgccgccaccgccgctccgtgctccggcagcctgtcgccatagaagaccagatctggcctcccctacgcagcaacgtccacatctggctgctccggccgccgtgatgccaccgagatgggtgcgttagacgggtacccccccggccgtccgtgctcccggtagtttgtccgccgtccggatnccgtaccctccttcccccaatcttcctgggtgagcttaagaagcattttcctccgtccttttctccctgttcctccatgattttttatatttttgcatgatattgggtccttaacctaagataaatggcgattacctcccngaatatttggggacaatttgaaagatcgctccctacaatgtttccttttttccngaattttcncaaacttgggagtagtcaatggtaaattttnaaaggngaatctggttggggaactatgaananattatgggtanaangaatggatttttccttcgaaa

SEQ ID NO: 84205 - DNA, 625 bp, Triticum aestivum
  unsure (1)..(625): unsure at all n locations
  Clone ID: PAT_TA_84205
cgagactgaaccttccggcccactcgctgtgctcaagggcttcaagaacttgcccacggggatgccgtccgtgctcctcgtaactggactcacctggctctcttggttcccgttcatcctctacgacaccgactggatgggccgtgagatctaccacggcgaccccaagggtagcaacgctcagatctcggcgttccgacgaaaggcgtcaagagttggctccgttccgggctgctgctcaactcgattcgttctaggattcagtccgttcctggatcgagccatgtgccggaagtcnggccgaaggtggtgtggntgaccaacaacttcatggnctgcgtcgccatggcggcaacgcgctgatcanttctggccctcaaaggactacaacggatacgtgcangacccatcaccgccagacganatcaaagcgtctgctcgtctcttcgcgtcctgggtgtcctctcgcatcctgtaancgtccgtcgcggtgacgngnactggcggcacaaaggcggcggcaaggctgtcacgggtgtaaaactcatcgcatcctagngtatccctggcnggnccgtggaaccnntcgaaggaaatccgggttggnggncngttcccnaagggg

SEQ ID NO: 84206 - DNA, 373 bp, Triticum aestivum
  unsure (1)..(373): unsure at all n locations
  Clone ID: PAT_TA_84206
cggcctcggcctccgcaccctggaggacgtggactacctgnaggcgccgctgatggtgcccaaggacgagctcctcccgcccaccccggccggcgacggcgaggacgagcgcgcgctggtcctgctcgtccaggtcaccgccttcgcgtgcggcggcttcgtcgtgngcttccgcttcagccacgccgtggacgacggcccgggngccgcgcagttcatgaccgnggtcggggagctggcgcgaggccgccggccatnngantcgcgctcgaggngccgtcggtggagccgcagtggggccgnnacgccgtcccgngaccccgcggtcgcnctggtggggcngnatcncgggntcncgggtncgngtanccac

SEQ ID NO: 84207 - DNA, 523 bp, Triticum aestivum
  unsure (1)..(523): unsure at all n locations
  Clone ID: PAT_TA_84207
cctccctcctccctcccgcgcagatctccacaagcttccagagagcagcagcagcagcagctcgcctccacgcgacacgaggacggacatggcgaccttcaccaagctcgaggattcccccatgttccgcaaacaggtcaattctttgggaacatcttactgatgaactgaaagaacggtgctcaaacctgcataaaggatgtaaaagattcaatgggatcacttggatgaggcatatgcaggggatctatcatttgcagttctcctgcaagcatttgggtgctggtcctggatgatcctattaagtgttgccattgggagggccgtgatgtccaagtttactactgctttcaaaggacttggggacatacaaggactccttcggtctcaacttgagcacatgcttagtgatcgcctgtcacattcattaacgtgggtttaaatggtgtgaagnttgtccggaactttggtanggtgcatggntatgataagnacgtaaaatttgngcagtgcaaaaggacta

SEQ ID NO: 84208 - DNA, 639 bp, Triticum aestivum
  unsure (1)..(639): unsure at all n locations
  Clone ID: PAT_TA_84208
cgcaagcgaaccacagcgtgctcgccatctcactgactgtgacgacggcaacaagccagtgagcagctcgccatggcagcagtgtccaccgcgccggcgctcgaaggccgcatcgcgctcgtcaccggtggctcccggggcatcggccgcgaggtgtcgtcccacctcgccgcgctcggcgcgcgtgtcgtggtcaactacgccaccaacccggccaaggccgaggagctcgtcgcggagctcgcctcgcgcggcctccgcgccgtggccgtgcgcgcggacgtctccgacccggccgccgtgcgcgcgctcttcgaccgcgccgaggaggattcgggtcccgccccacgtagtggtcgcctgcgcgggatcatggacgccaagtacccgcgctggccgacactgccgtcgaggacttcacgcacgttccggtgaacaccgcggnagttcctggtgtgcgggaggcgcccggnnatcccccaanagggtggcgatatgagtttctcannacggttccntctgcgccggctaccgggtngtggtcaagcgtgtgagcatacaggtctggcaagaagtggcgcaagganaggaantgtgccggcntnaaggcntcttcggagntaggtcaaagnaaaacat

SEQ ID NO: 84209 - DNA, 367 bp, Triticum aestivum
  unsure (1)..(367): unsure at all n locations
  Clone ID: PAT_TA_84209
ttcctcctctctctgtagctattagctaggcgtttcgttcgccgcgccggtgaagctaggtgctgtgctgtgctgtgctctgcagctaatagtacntcagatcgatgaacaggttcaagaacgtggngctgcgcaagtgnaagagcctctcatcacgggtagggcggcagccgagcgcgtcgccgtcgtacaggtacagcagncctccggtccatgtccatgtccacccggaaggacgcggacgccgncgccgccgncgccacggaggctgccgtggtncggcggcccannggnggcggcggngctcntgggcatctcgcgggnggcggtacgtnatcagcgcgganganctcanacaccntctgat

SEQ ID NO: 84210 - DNA, 662 bp, Triticum aestivum
  unsure (1)..(662): unsure at all n locations
  Clone ID: PAT_TA_84210
cgcatgtatgagagcttccttgaggaagttccacttcttgcaagcttgaacccatacgagcgctccaaaattgccgatgcccttgaaacaaagaaatttgcggcaggcgaggtcatcatcaacgaaggagaccccggccacgcattctaccttttggagagtgggtgaggcagatgcttacattgggacagcctggataacaaggttccgccatttacaaagaagggcgattacttccggcgagttgccctgcttaaatgacgccccgccgaagcagcttagtatccgttgctacgtctcccagtccaaggttggnancctgggcaaagacctttccnagcgactttttgggccctggtgggaggcaccttaccaaaggacaaanttcaanggtgttgcaaccgggtccaaagaatggtcctctccnanaccggctaatcacaagggaagtatangaaanatgaactgagtgtttggcacccggtaactnaatcacgggctaaaaatgctgtgggtccctgtgctggctgggtgtaaatgttgtggcatcncctcggttgattagaatgncacgnggattncnttgaatgcgtttgtaggttcacacttcntccnanattgcaggnanaccttgtgacaaacatagnanccccaaaaaaaaa

SEQ ID NO: 84211 - DNA, 669 bp, Triticum aestivum
  unsure (1)..(669): unsure at all n locations
  Clone ID: PAT_TA_84211
tcaaggtggagcaagatatggggaaagctcttcaccacaagataacagttctgaggccatgaaaacggactctacatgcaagatgaagtcaaattcagatgctgctccaataaagcagggctccaatggcagtagcaataacgatgtgggatccagtacaaagaatgttgctgcaaggccttcgggtgacagggagagagtagcgtcaccattagccatcaaatctacccagcatgcctcaagcatttcaatactatacagaatcaaacgtcaccagctaatctgattgggggaaagacaaagctggatgaaggaatttccaaatacagtgaaaatgagccacccaacagaggtccacaaggctgcgtccagcatcatcatcatgtgcattattacctccatgttatgacacagaacagcatcaacagaccgtggatatcagatgtcacggtggtcgcaaatgtgttgatctcctgttgaaggcatgctgcaactacatgtgaatggggtgtccaattggcataaggtgaatgggaaatggaatacgtgtcccatattgaagccaacatnggngtttanggacatggncaaatntccgnggggattgagngagngagggaagcattcaaaccgtccgacaaanncttanaattacgagggaattgnttt

SEQ ID NO: 84212 - DNA, 494 bp, Triticum aestivum
  unsure (1)..(494): unsure at all n locations
  Clone ID: PAT_TA_84212
cgcaagtcaccttcgccaacccggcggcatccgggtacgtgagcatagacagcgcgtgctgcgggagcgggaggatgggggcggagagcgactgcctgcctaactcgacgacgtgtgccgaccacgaccgcttcgtcttctgggaccgcgggcatccctcgcagcgcgccggagagctcagcgccgccgcctacttcgacggagcggcagggttcaccgcgcccatcagcttcgaccagctggcccggaagatttttgctggcccggaagatttagctagctatagctagctaggtcggcactccaacaagcgcgcatgctcctctactccgtgcacgtcgcgttcatctacttatttttacaagatgtatacagtataaaagctactggtagaataataattanccgtgcaacagagtaatcaagagtgtctgaatgcgaatgtatgtgcaagcatagtngtgatgttccangaaatagatcaattagctcaa

SEQ ID NO: 84213 - DNA, 608 bp, Triticum aestivum
  unsure (1)..(608): unsure at all n locations
  Clone ID: PAT_TA_84213
ctctccgccgcgtcgcacgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacggctccaagttcaccgtgcggaccgacctgggcgccaccgtcggggcgtttaaaggcgattcgtcgcccacagctggcgacgtgccggcgcccgcagcagcggtgatctacaagggcggttttggaaggacgagcaaacctaccagtacggtgtgggagacagacatacatccacatggtacgtgggtgctgtgctatcaccaacatctactgcacctgcaancaaccaaagactacaatgctgtcctgcattcccccggcaacaagntgggtggttgttgcaaanctgggnatacangcctgctgctaacantgaggntgntgggtttgnccccctggattanacaaatcaacaacagtactgaaatccaactnatgagggaatgtgatatgcaccatnagaatttnnaaaatctaatcatacattanatggaaaacc

SEQ ID NO: 84214 - DNA, 643 bp, Triticum aestivum
  unsure (1)..(643): unsure at all n locations
  Clone ID: PAT_TA_84214
cgacatcgaccaggatctctccaggagtgagaagctattgggcgatcttgggggtctattttccaaaaagtggaagccaaagaagaatggcgccatcaggggtcctatgctaactagagatgattccttcataaggaaggggagtcatttgggagcaaaaggcaagaaactaagggctgggcagttcatccacctccnncaaatgcgcgccattcccntcctgaacctcaacaacacttngagaaagttngagataagagaaagnaaagcaagatgatgatctgccngatctaaagcacatactggaccggagctnnaaaggatggccgttnacatggccctganttcnagaggaaacaaaagcatgggggatgcaaagaaggttnttgncanctgacttcaaggncaaggganaaaacccantcgccncnccccgggngataaaaatgaaatccctggcccttgggtggccaatacacattactttgggggacaaantgangattgtcacanatttgataacatgtacgtggcattcgcgtgtangnattggaatanttaangttgtcctttcaattttaatgncacttagtttcangttttatgaaccttcggtnactctnttcgaaaagggcaaaaaaaa

SEQ ID NO: 84215 - DNA, 597 bp, Triticum aestivum
  unsure (1)..(597): unsure at all n locations
  Clone ID: PAT_TA_84215
tttccctctcggtcgacagcagaccatgacagacatctcagatgatcaggtcgatgagctgctgcgcaaggctgagcagcgcctgaaagatggccctgcttctgcttctgctatcgtctcttccacaacctcaaatgctgtagtcgctggcgacgccgcgacaacaaaacaactggtcaagcagcaaaactcttcctccaacagcagcagcaagaaagatggcctgactgttccgagcaccacctcaaaccgcaattggggacccaaggccaaggaaaatctaccgcaggcctgagtggtccgttctccccaagacgaacatgaccccggagtcaagcgagagtggcaancctccgaatgccgagganccttggacccaagcaccagaagaagactccgcgcgagcgtcccgaatatcccagncggcgagatatcgccggaccgactgattcttcaacgcgagacngaccgcaaggagaggaagaatctctcnaaggggggcccgtaccaatcgcctatatgagcgtataccgcctantggcgtcgttacactctgacgggaaacctgcgtaccaantancgctgagaaancccttt

SEQ ID NO: 84216 - DNA, 673 bp, Triticum aestivum
  unsure (1)..(673): unsure at all n locations
  Clone ID: PAT_TA_84216
cgaacacactatactagtgagcaaataaagccaccgatgtcatcactcctgttgcgagtgctgctcatccagcttgcagcagtggagtgcctctccgccgcgattccaggctgcctaacgcaatgtggaggcgtagagataccctatccattcggcgtcggcaccaactgctcccgcaaagggttccggatcaagtgcatcaacggcagcgcgggcgaggagatccagtgctgctacctactacgcgctaccagaacatccgggtgctgaactgtccgtgtcgccgttgccggaggtccgagtgctcttcccggtgggcatgggcagtgcttcaaacgccaccggggggcgtcactggggatctactccgggagatgtgggattcaacccaagagggcgtataccgcactccaacacacaagaacgagtctcgtcctcgggtgcgaactatgcgttcacaaaagcgtgagggtgcacacgttaacgcacgctcccttacagatactcacgggtgtacacgtcatgtnnacanaagggcccgccaacgncctgncggctcggtgtccgtcaatccgcagatacgnacagatncttccgcactgacggtcaacancttngnctgnatagccttacngaaggaattacctcagancgcntggtcaaaacgaacttg

SEQ ID NO: 84217 - DNA, 692 bp, Triticum aestivum
  unsure (1)..(692): unsure at all n locations
  Clone ID: PAT_TA_84217
gtggtgcagaaaaaaaggtacctttgtaagtagacagtaacaacgtggtgcagaaaccaagaaacgactgggcttataggaagtagggtttaagggtgagacagcacctagtataccaggtgccttttgaactatttcctgaacatgcagacaaacaccatatagtggcgcattgtctgataccttgagggagaagataaaagacagtcatctccgagacagatgttcctgcccaaatatcacttccattccaggtcactccatgggatgggagcctctctattaaggccgancttttacaccttcnaggaaaacagaatggagggcaatcaacctcccctaactcctgcctcctttcccaangtgggatacttngaaaaaactggggtcccatagatggtacaggccacatactggtttttccaannttacnactcggatcgtgcncattaatccccaacttcctttttgcaaaanactcaatatcccgacnctngcataagatgggagacaacacgaaaaaaccgaggggggccggtaccaatcgcctatntgagcgtataccgcgccacgggcgtcnttaaacgtctgactggaaacctgngtaccaantancnctgagaanncccttccagtggtaaacaaggcccacgttccttcaaatncacctagnatggacccccntggataan

SEQ ID NO: 84218 - DNA, 439 bp, Triticum aestivum
  unsure (1)..(439): unsure at all n locations
  Clone ID: PAT_TA_84218
ctgcttcgtccctggtggcggctgagggctgctgcttcgtccctgatggcgcctgattgcctgggcgcgatccgcccgtgcttcccatagcgtactccgtccctggcgcccccagtgaggtccgtccgtggcgctccgcctcccgtcgtcttccgtcaccacgctctgggtcgtatccccgccgtagcgtcgtccagtgctgccctgcagaccgcacatctgtccacctgctgtgtggttgggtccctccatggatctaccaatccggaaccataaagatgacgattcccatagaatccgaccgcgaacggggacaantttgggtcccaatatgtacaaccaagtngaagaaaccggttatattangnaatngagaccttaannttaaagtacnatggaacccttatgggtcttgcataattccnagcatatgaaacaa

SEQ ID NO: 84219 - DNA, 500 bp, Triticum aestivum
  unsure (1)..(500): unsure at all n locations
  Clone ID: PAT_TA_84219
tgactgccggcgccccaggcctgaggctccatcttcgggcccttcactggctacgagcaccacctgaggattatggattggctggggcagaagcgcgcggagatgctgatgcaggtgctgctggtggcgtctgctgtggcggcgttcctgggtgggctacgtgcgcgcggattccagtcatgctgctcctctacgccggcggcgtccgtgctcnacagcgtccgtcaccgtccccaactgggccttccttcnaaccgtaacccgctttaagtggtccgacgctgcccgaggcccgangccacccgcgccccaagtcnancgcccggtgcgagnnnaaggggaaaagnaagaanccccgggaaagacaanatccattttccgggagcatagtgtctttggccattttgatcaaacctatttaaagtttattcnccagactaaccaatggataaaaagantagagngtccgacatttggttgggattaanaaaaaaaaaaaa

SEQ ID NO: 84220 - DNA, 463 bp, Triticum aestivum
  unsure (1)..(463): unsure at all n locations
  Clone ID: PAT_TA_84220
cttctccggcgcgtccatgaaccccgccgtctccttcggccccgccctcgtcagctgggagtgggggtaccagtgggtgtactgggtcggccccctcatcggcggcggcctcgccggcgtcatctacgagctgctcttcatctcccgcacccacgagcagctccccaccaccgactactgagcagcgagtcagcgcagccagctgcttgctttgcgtgcaagccgcgctgcctgccgtccnccgtgtgatctatgatcgcgtcgctccttcctttgccacaccatgagccgttaanttgttccctggtccattanttgtggtgagtncntggagctgttaacccgtgggacgaactgtcatttgcttccngtaaactgtgattccccntcccgcccganattccaagttgatttgagtcaaaannanaaaaaaaaatcccaggggggccgggaccaatccccc

SEQ ID NO: 84221 - DNA, 477 bp, Triticum aestivum
  unsure (1)..(477): unsure at all n locations
  Clone ID: PAT_TA_84221
catgagcgtccgcgacgggaaggtggtgctggcgccggcgaaccccaaggacgagtaccagcactggatcaaggacatgcggtggagcacgagcatcaaggacgaggaaggttacccggcgttcgcgctgggtgaacaaggcgaccggggaaggcatcaaagcactccgctgggggcaatcccacccgggtgcgcctgggtgcctacaacccggattttttggacganccgngcttgttggccggagagccgcgacgtccggaacgcttcccgtggcnccgcatggncaacacatctactcactncgacgcctccaacgggacaagtgnacggcggcncccgtnacggaccgactcctgtctggnagttgngccaagggacaccacgtggaantccaccctactactgacaacggtgatatacatcgcgccatcgatttgtcaatgcatgcatactnctaacaagntaacagggctt

SEQ ID NO: 84222 - DNA, 326 bp, Triticum aestivum
  unsure (1)..(326): unsure at all n locations
  Clone ID: PAT_TA_84222
ccccgtggcgcactcggagcgcagcccggtgctgctgctgatgggcggcgggatgggcgccggcaagagcacggtgctcaaggagctgaagcaggaggcgttctggaccaacgcggaggccaacgccgtggtggtggaggcggacgcgttcaaggaggcggacgtcatctaccgcgccatcaagtccatgggccaccacaacgacatgctccaagacggcagagttgnccaccatcctcgacgacgccgngtccgtccgctgctggtgacgggcttaaccnaagggcgggactcatcctgggacggacgcttccttgggagccttt

SEQ ID NO: 84223 - DNA, 453 bp, Triticum aestivum
  unsure (1)..(453): unsure at all n locations
  Clone ID: PAT_TA_84223
caggcacgaaacctcgcgccgccaccaaatctccagcgagcgaagaggcggctccggcgagtgcgcggcaacgacgaaggcgtcggggccagtggcgaagaggaaagagcatgctgaagttcctgtccaaggtggtggtggaagtactgccctcctggacccgccggaaaggcggcggcagttggagtcctcccgcaatggcaacggccgcaaagccaaaggatcccaaccccggttgctccgtnccantcccgccgctcccctcccccantcccttcnacggcctcnaatccgcagccntcttcccnctcccnaggcctcccgtacctactttaaccggagctnnaagagcatctctttngctnaggganttacgggcaagnatcccggacaaattntcccaaggggcccgtcnatcnatacgnnaaaatttccnccnacgcgggaaaattg

SEQ ID NO: 84224 - DNA, 635 bp, Triticum aestivum
  unsure (1)..(635): unsure at all n locations
  Clone ID: PAT_TA_84224
cttaaactatctggtaatgatttcagcaaaggatgaaccagatgcacctctctctccagctatggatggcttacttagagttcataaaagaataactgatagttcagatggtgaatctagtcaacctcaacgaagtgctgggtaatataggaccaacacgacttctaagtgccatcttccgcaagctgggcancttattgggcaagcaagggagcaactatttaatccaatacaagatcctcaaaatctatggcccntattgttggagaatgngcctccctgttgcactaaatggatgatagagttggtgggagatacaaggcgancccttgggtgtcccaaggagcagtgggatttataccganccacctggagaattccttggttgaccgcatgtctacattgtttggaangcatatgaaatgcatggtagccnaggganaccaatgcaanncccaanatgggggccctcaactgngtncgccncaaacatccccaagtggctgggttggaggaatcanantatgatcaaggcgaagaagtacaacctcccgagtcccattgaaagaccgactangttttcgataggcggggnccacaangggnttgnangaanaccccccaagggttcaggg

SEQ ID NO: 84225 - DNA, 675 bp, Triticum aestivum
  unsure (1)..(675): unsure at all n locations
  Clone ID: PAT_TA_84225
agaaactagaaagaccagtccccaaactccccagcgggggcgagtagaggaggaagagtcgccgccgccgccgccgccgccgccgccgccgccatgtctgggggaatcgcccgcggccgcctcgccgaggagcgcaaggcctggcgcaagaaccacccgcacggtttcgtcgcgaagccggagtcgctgcccgacgggacggtgaacctgatgatctggcagtgcaccatccccggcaagcaagggactgactgggaaggtggatatttccctctcacccttcattttaagtgaggattaccctagcaagcctcccaagtgcaantccctcagggtttcttccacccaaatgtgtatccttctggaacanctgctttcgattcttaatgaggacagtggntggagacaagtattactgttaagcagatctcgtcgggatcaggacttgctagtcagcaatcctgctgacctgctcaaacaaacggtacacttttttcaaggttccacagaatacagagggcgttagacncaggnaagaatacctgcatggcnanactcgcctacangggatatgtgaatcgatantgtgtagnctgatgaagcaattacaggggttgnnatatancatgngctggggcttaagctatacgttgggngtttcgatngcaacctttg

SEQ ID NO: 84226 - DNA, 266 bp, Triticum aestivum
  unsure (1)..(266): unsure at all n locations
  Clone ID: PAT_TA_84226
ggaagatccagccctactactgaaccaacggatgatatgaccatcgcgcccatcgatcgtgcacatgcatgcatacgtactagcagaataacaggggtcttatctcccgaggcgtcttttgcatgcatgccagcagttgcatagataaagcaggagcgagacaaagggtgttcatgtatattgcagctgtatcactgtatgtatgtgccattgtgccttggtaataatacattataataataaagtttntccggagtggtattaan

SEQ ID NO: 84227 - DNA, 153 bp, Triticum aestivum
  unsure (1)..(153): unsure at all n locations
  Clone ID: PAT_TA_84227
cgcgatctggcgggaggcggtcgcagctacggtggtanctggggcggcggtcggagatccggcggcngnggcggtcncggcgcgtgctacaagtgcggcnagcccggccacatggcaagggactgccctagcgccgacggctgaagcggatac

SEQ ID NO: 84228 - DNA, 578 bp, Triticum aestivum
  unsure (1)..(578): unsure at all n locations
  Clone ID: PAT_TA_84228
ggacgcgcactacaaggcctgcctctacgccggcatcgacatcagtggcatcaacggggaggtcatgccggggcagtgggagttccaggtcggtcctgccgtcggcgtctcggccggcgaccagctctgggtggctccgctacatcttgagaggatcaccgagatcgccgggttggttgtctcctttcgacccaaancaattcccgggggactgggaatgggctgggtgcacacaccaaattacaagaccaatccgatgaaggagcgacngcgggacgagtgatccaagaagcgattnngnaacttggcctcccnggaccggggagaatcncccgcttacggaannggaacgangccgcctnaaccggcggcaaanagaccgccgacatcaaatttnctccngggcgtccncaacngcgggntccnntccgggtgnggccgcacacncagaaggaagnaaaaggtatcnanggaccgangcgggncaacatggacctactgggggactcctatgcgggnaaacatcttgaancaacaatcacgggacgaaaggccccgtccttattgatcncggaata

SEQ ID NO: 84229 - DNA, 249 bp, Triticum aestivum
  unsure (1)..(249): unsure at all n locations
  Clone ID: PAT_TA_84229
ttctcaacccgaggcacgcttgttggaaaatcatttcggcgctctctccaacgtgggtatctttgtaacctcgtccgacgcctccatgttttcgaaacctgggttcaacaacgactggaaactcaacgtgcctaactctcggatatatgttgtataggtcaagcacggagctgatggcctcattgggtggttgtgggatgtgtaataagaatgtacaanaccctccctaaacgactggggaaatgggtt

SEQ ID NO: 84230 - DNA, 690 bp, Triticum aestivum
  unsure (1)..(690): unsure at all n locations
  Clone ID: PAT_TA_84230
cgagtttttttttttttttttttatattcatccaatagcatgatcttccttgagatactgatttgaaaatattttgcaaattcgtttattacataaacgatcaagtggacgaagcacaaaactggatggctcgcctcataagtcaaaaggatacatgttgaaatgcaagatgagatggtctaatggcacaagaaagtgccacccaagctcaaaaacacatggaagggtaatagtgtccgatgacggataatgtgtccaagtacaaaggtcgcttgcggtacttccctttgcgctatatcatctaggagcgtgatcttcccttggatatgatcatttaaagtggtttacaaccatcctttacataaagatcaattgggaggaaacacaaaccagacgtcccctccataanccatacccaataagntacatggtgaatggtataacatggtacacaagaaangcgacctactcaagacacttggaagggaaatcccaaggaggtaggtgtcaagtataaaggtcactgcagtacttacnaatcgtggcaagcatgaatggttcccatcccgcaattagatctgcggcactgncaagnatcaagaatccagttcaaancatnagtttaatagngggncattgnaccccgcgtgtctcaacanacccngatattttcaccngaaaaaagggggc

SEQ ID NO: 84231 - DNA, 610 bp, Triticum aestivum
  unsure (1)..(610): unsure at all n locations
  Clone ID: PAT_TA_84231
tttttttcgtgtgcagttagaattacccctgcagttggagacaaataccctccccaaaaagccacccataagtgaaaaaatgcttctgtttttcttgttcgtccaccgtatgtcataagtcatctcgctggattgagccttgacccaccctgcctccactcaagcatgattccgactcgcactcgcacggttacccacacacatgaaacaacctgcgtaggaaccctcccggtcgcaactaaatgagccggccaagtccgttcttgcacaagttggttttccnaattaattggtcaattatttgttttattttgtcaaattttnggaaatatcaaagtacgtatatttcgggagcataatttatttaaaataaattttcaaattttaaaaaaattnncacaatacgggaagcattggttancanaattncaaaaaatgtggnaacataaaaagaagttgggggattcnaaaaaatgtcanatgttncaaatcngtgcagacattaaaacaatnnttacaatgnnataatcaataagtnnaacaattgtcaanaaaaatggggtaatttaaaaanccggcttnaaaaagntccgaattttanatnttacca

SEQ ID NO: 84232 - DNA, 524 bp, Triticum aestivum
  unsure (1)..(524): unsure at all n locations
  Clone ID: PAT_TA_84232
gtttgctcgcctcggctgtggtgtcagcagtgggcaataagctgggttctgccattggggatgaggtcacaatgttggggcggatgagcagcctaagcagcgccgtccgtggtggggcggatggggagcgacgcgcacctctatgacgatcccgacgacgcctccaccctgggctccttgactcaaaccgcctgcttgattgccacaggtgggtcaaagatttggcggcatgggtccctgggaggtgaagaagatcttctgtcctgtttccatttcatcctgcctggtgatgggtgctgtctcataaaatgttgctacaatactgcttccttcnattnaatcattttgtgatcattgcatattaagatncaaatgcaatttaccgagcttggactaaaccatgatttgctgacacgcatatttgatantaaacagacttttattgtacttgtgtcagaatcaagatcatgatacgcataanaaaaanaaaaaacccagggggggccggtaccaatcncctaaag

SEQ ID NO: 84233 - DNA, 607 bp, Triticum aestivum
  unsure (1)..(607): unsure at all n locations
  Clone ID: PAT_TA_84233
gcactgtgttggctcgtgccagccagctgcttcgtgtccgccaggcaggcagggaggtgacgccggcgcgcgagagctcgccaccgcgccacctgcttgccgctcgcgcccgtggacacttgggcgagctccacgtcgctgccccgaccccgcagacacctcgctcactcctctgtctctctccctcgccctctcccaacatggccgacgcacctgccgctgcaccgtcgacgtagccgcgccctccgtcgtcctcgccgctgcgccaccgtgtccatgagtccgccatcatccgactacatccgagcaggccaagccccgangctcgcccgtctgggtcaccccgacccgtcttccccaatccggcgcagaatcccttcgccttcaacgcanacagtctccccgactccccgatgtccgactgatgcgtgantcacactctcatcncnngttgctctccaggggggccgnaccaatcncctaaagtgancttaccgcgtaanggcgtcgtttanaagtntgatggaaactgggttacaactaacgctgagaaatcccttcgantgggtatacaaaggcgacgntgccttcaattgnactanggang

SEQ ID NO: 84234 - DNA, 633 bp, Triticum aestivum
  unsure (1)..(633): unsure at all n locations
  Clone ID: PAT_TA_84234
tctacatcgactacccagggctcaatcgagtcgcttctcaggagtgcttctggccttcgcgcgtgtggcattgcacgggcccaccgcatagcttcgttcgcatgcccttctgcttgccaaacgcgtctgcaacccaccagcgcttgatgagaagcattcttgaagctcaggtggccaagcatcacgcgttcctgggaggagatggagatgggacctcaagcgggccactccggacctccctggagctcccggaggctccggancccgaagggtccgtgaggatcgacttcttcaccccacaccgccagtgctcccgacatcattggtgcaacagtacaagggactcctttcanttttggttcaagtgggancgccctccaaggtgcacatcccaagnccgtgtgggccntccctaacggatgtaccatttgcttaancttcngcttactattgggggaccctcccanggggggccngnacccaattcgcccaatgtgancntattagccgtaanggcgtcgtttanaactctgacnggaaactggggtaccaactaacgcctgcagaatcccnttccantggntatacaaaggccgacgntgcctcaagttccacnatgnaangacccccgtg

SEQ ID NO: 84235 - DNA, 263 bp, Triticum aestivum
  unsure (1)..(263): unsure at all n locations
  Clone ID: PAT_TA_84235
cgcgtcaccccgcgtcggccgatgatgtccttccgggtgccgcggagactggtggccagcagagcggcgggtggagcgtcgccgtcgccgccggtgccggcggggctaaagaaaaagaagaagaaggtggcggtggcantttggggnnaaaaaaaggaaggctcttccggcgcngatccggcggctccggatgcggtggctggccgtgctgtacaggcgcacgctgcggcggctgcgcgcctactacgccacggcgatcaaac

SEQ ID NO: 84236 - DNA, 157 bp, Triticum aestivum
  unsure (1)..(157): unsure at all n locations
  Clone ID: PAT_TA_84236
anaccaannacaccggccacacgcacgcgcacgcacggcaggcgaggccgaggacgaacagacgataaaggaagcaatggctccgtcgctcgcgtcganggcggggctcccgagntgcggngcgcngcgcggnngccggtgcgtggnccgccgcgcg

SEQ ID NO: 84237 - DNA, 265 bp, Triticum aestivum
  Clone ID: PAT_TA_84237
tatcctcggagcaacaacagaaatcagtgactattcaagctgaagacaaagaggagctgtggagatgctgggggttatgtctgagttgctcctacttaatttctggttgaacccattcttccttgacatatgatccatgccgcctttagttcagtctattagctctttatgtttccccaaatcctcaatgtccgtgaaacagtttggatgatcacctcaccaggtctgagcttatactttttgggctacccttaaaaaaaaaaaa

SEQ ID NO: 84238 - DNA, 387 bp, Triticum aestivum
  unsure (1)..(387): unsure at all n locations
  Clone ID: PAT_TA_84238
ctcttctccaagtgtcgttcttcctcgtcggaccttcttcgtgtgggtgcaagtttcaattggagaattggtgggaggaagtaaggatgaaaaaggtggaactcaaggtggtggacttccggatcgtacttagggatttgcccgaacttccggtaaaggtacttggatacatgttggggaatgaggggagtagcagcactccacttcactcctcacaataacgctgcccaaggcgcacccatgatttaattagaactttttggtccaaaggaanttgttcctttttaactaagccctgcgcactatttatncattcaaanccgtatgttaactccccctttgcnanccgattnataatacttagatgttttttggncaaggataaaa

SEQ ID NO: 84239 - DNA, 231 bp, Triticum aestivum
  Clone ID: PAT_TA_84239
tctcgctgtgaccgtgcacgcgcgcttagggacgggtgtaatcacgtctaagtatactgctagcacttaatgcggtgcatccatccaacacgtagaaattttgttatcaagtggtgcaatgaggtcagtctactcaagctgcagcaaatctgaatgttctgcaccggtcaactgtacgccgttgtgtgtcattctgtgaagaaggcagacaacacggtcaaaaaaaaaaaa

SEQ ID NO: 84240 - DNA, 402 bp, Triticum aestivum
  unsure (1)..(402): unsure at all n locations
  Clone ID: PAT_TA_84240
cgcgcagctagctcggcctcggctatggatgtggagatgtctgatgcagggaacaacaggtctaagaccttcttgaggccacttggcagcattagcaagaagaaggtgcagcttcatttgaagatcaagaaagacaagagaaaagctaggaagaagggaaagtttcttttaagaagtaagaggagtgtatgataaaccatgcantttgntcccaantttggtaaaacaaacgcactgcanccatgtcatgtgggtgcacctaccttaanccatccctgggngaccttactattaaatatgtttgaaatggggtacgaaaaaagatangctgacctatcactgttcccgttcctggcgggtataaaggccaagtacccaattggctnaatttgggtttcccaa

SEQ ID NO: 84241 - DNA, 369 bp, Triticum aestivum
  unsure (1)..(369): unsure at all n locations
  Clone ID: PAT_TA_84241
ggagaacaaggggttcgcctttgtcaccttcatggacaaggaggctgcgcagcgcgccatcgaggatgtgcaagacagggagttcaaggggaggactttgcggtgctctctgtcgcaggcaaagcacaggctgtttgttgggaatgtgcccaaggggctgagcgaggaggagttaccaacactatcnaaggggaagggccaggtgttatcaacattgagatttttaaggatnaagcatgacccaaaccgtaaccgtggtccccttggttgagtattacaacatcctgncgcaaactatccaagcaaatttcactcccaacttnaaggtttatgggacaattaacgttaatttggctaacctaaggttaa

SEQ ID NO: 84242 - DNA, 297 bp, Triticum aestivum
  unsure (1)..(297): unsure at all n locations
  Clone ID: PAT_TA_84242
gtcaaactgcacggcggggcgggcagagaaccgcggtagaaaagaaggacccgattgcttttctgtcttacttgttagggtcctttgtattaatttccaggactactctgtaactttagggtttttttgggggtcatatttgcattttggtatttcaactaacgttgagtgggaaggcactacacacggatggggctttcccctggttaaaaaaagaagaaagataagcantgcacccccatggagtttgacccgcatccctccngggagcaacgctgggtgtgtttttttnaanaa

SEQ ID NO: 84243 - DNA, 404 bp, Triticum aestivum
  unsure (1)..(404): unsure at all n locations
  Clone ID: PAT_TA_84243
ctgagaagggctaagatccgaactgcaagataaatgcttcggttagtttcctcagaagtaaggtaggatatcttcactattaagtactttttgattacttacagcttgttagagggctgatccccgtgcaggcattgtgcggctaaagcaccctccgaggcaggaccatctgggtggagatttcttctcccctttgggaaacttgggtttccggatcttcaagaggtaccctcttcccttccgccggggcgagagaatgtccagatcttcccctgggtacctccctcnacggaggcgtcatcccctcnggtgggaataagtagccggtgggaggccgtttcgcctctttatccccccttcactccctttntagggnactaagcaagngtgtcccaagggggggg

SEQ ID NO: 84244 - DNA, 625 bp, Triticum aestivum
  unsure (1)..(625): unsure at all n locations
  Clone ID: PAT_TA_84244
tctcaacaagcactctctatccctgggatccatcatctacatacatccatgagcctccttacttcaaggatatgacaatgactcctcctggcccgcgaccagtgaaggatgcatattgccttctgaactttgggtgacagtatcacaactgaccacatctccgcctgccggaaacattcacccagacagcgcagctgcaacatatctgaaggagcgttggtgttgaaaggaaggattcaactcnatatgggtagcgnaagaggaaatgatgagatnatggttaggggaaccttttgccacattccgctncgtgaataantctntgaagggtgaggttnggcccaaagaatcccatgttccaccnggggatantttcantttntggagcggctatgaaatacaagatggaaggcatgatacnttaccctggcgggngccnagacgggaggggacccccgggattgggtgnaanggccatgttcaaggagtgaagntgngtagaagattttanaggtcacggaaatcttgcggaaggacacctctagctnaagngggagntgancaccgggctaacggnagggctnngncacttcacagggngggaaancgcagttnctgcacgaag

SEQ ID NO: 84245 - DNA, 444 bp, Triticum aestivum
  unsure (1)..(444): unsure at all n locations
  Clone ID: PAT_TA_84245
gtggtgatcaccgttgtttcgtgcttgattaccatcctaaaatccccagagggtttgaacaagtcacttgttgaaaatagtgcgatcactcttgggaggcttagctgggtctgtccagacatcgtggcccctcatatgggagcatttcatgcaagcatgggtgcagtgcctttgtgcacgatcaagagatgatttttgagaaagaggacgcgttcnatggactggtgtgcaatgggtgggcagcaaacctacaaggagcgctgggtcattagcttacatctgccaagctgtgcaagttggactggagataaaagcgaagcctccacatgaaggtgtgccaaattcccgnatggntacaacactgcttttggaacacgtggttgggaacatcatggcgccctggaacaaacgttngcaanaattactnnatacngggtatgatna

SEQ ID NO: 84246 - DNA, 680 bp, Triticum aestivum
  unsure (1)..(680): unsure at all n locations
  Clone ID: PAT_TA_84246
aatttagcanttcggtangacgtggacacgataaataatggagtactccaatccgataagtactttagaacttanccataaatttattacttatgtactaaaactaaatatgtagtatataatatactttgtgaatcaagaatggtataatatatcaatcgtatgtccccgctaaatcccatgtaataagttctatatataaaccagtgtcaccaatcgtcaagttatattgcttatgatacatccatgcacaatgcacctaataattagttgacatccagtaaacatgtangtcatcangcaccaangataaaaggatgggtactaagtgggaaaccattaacaataaatcataggtaaatagaggatgccacaaaatcccantanacaatagttgactataagtagattgtgaccataagtaatagtgtccnatatatacccctacaaacacttggtgagagcnatgagatgctctaatanataggngaaatttgagaaaaantttggggaaancaaaacatatagcatcgttgcatttaacgggggaaccatnttcanccattaattnnttgtttagganncccgccctaaggacagnnacccctcnngcangtaataacangttgnaangcatcagagncnattangccaccgncggatttcgtttttctgaccca

SEQ ID NO: 84247 - DNA, 590 bp, Triticum aestivum
  unsure (1)..(590): unsure at all n locations
  Clone ID: PAT_TA_84247
tcgcattttccttgcaaccgattgcctatccccctcccaacccaagaccgatggcgcccaaggccgagaagaagcccgcggcgaagaagccggcggaggaggagcccgcggcggagaagacgaccgccgggaagaagcccaaggcggagaagcgggtccccgcgggcaatccgccggcaaggagggcggcgagggcaagcgtggcaagaagaagggcaagaagagcgttggagacgtacaagatctacatcttcaaaggtgcttgaagcaagtgcaccccggacatccggatctcctccaaagncattccatcatgatcctttcatcaaacgaatcttccnnagaactgggccggcgagccgccaantcngcgcgcttacaacaaganccacatcacncccgcgaattcaaactccctgcgctcctgtcccccggggantcnccaanacgcnctctnnaggaccaagcncacaattactctcctagttgcantccctttggtagacctgggtgnatccctggtgnataagttcngtnncgtcgggtgcntacgctattaccncaggatgttttgaatcacaactngtgtt

SEQ ID NO: 84248 - DNA, 232 bp, Triticum aestivum
  unsure (1)..(232): unsure at all n locations
  Clone ID: PAT_TA_84248
cggcatctccctttctancngtgcacggtacangcctgcanactgtnccgtaaggaaatggnatccaaggccttccgngccgtcnncgccgccgcgctcgccgngtccgccctcncggnggtccngatggccgccgacgngcccgncgcccagccccacgtctggggccgncgtcntctcntcntcngtcgncggagccgatcntctgccccgccgtggcgctcntcttcgg

SEQ ID NO: 84249 - DNA, 620 bp, Triticum aestivum
  unsure (1)..(620): unsure at all n locations
  Clone ID: PAT_TA_84249
ctcgtgccgccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagcccccaaaccagcagtggcaccagctgcaagtgctccacctgttggagaaacatctgctgcaaagactggatgcggcaagcaggttgctggctgggggttaccagccaaaccaaataactaccacaagggcttgatggccaaaacactgggacttcccttaacggccntccttnnaaccaaagcccacgctgtccctgggcggggtcttccctgggtactgttcnngtgggaactgatcccctgctggggcntcaacaaantacctcccctgcctggtgcgtgctagtctgatccntgacacgttgcatttaagtgttacccctggaagtttngnccatggtgatccccngnggaaatccctccgcaggggttgtaacttcccaattaaggaatctggccnaactcactaantgtgcgancctcctgttcgtgacctanganggntgtcgacatntt

SEQ ID NO: 84250 - DNA, 232 bp, Triticum aestivum
  Clone ID: PAT_TA_84250
ggtcttgttactattgtgctaatgtatttgtttcgaagtttcagttaatatgctgtggaaaagaatctggtgcacgttgatgttctttatgatctgttgttcaagtacattgctctgcttccgttgctacgttaagaatatatatatactaacatcaagaaaaatgtatgtattttatgggcttaaatagatccagaactggggaaagatggaatggggcaaaaaaaaaaaa

SEQ ID NO: 84251 - DNA, 312 bp, Triticum aestivum
  unsure (1)..(312): unsure at all n locations
  Clone ID: PAT_TA_84251
ctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctgggatctacgagaagtaaacatggaaagttcnacatcaaaacttggagagcaagaggaagcatgtcaccattttgtgcttttagcaatntttccgaaaagattatgatctggtnccttggggacctttattccaatgggacaattccttcctttggcc

SEQ ID NO: 84252 - DNA, 601 bp, Triticum aestivum
  unsure (1)..(601): unsure at all n locations
  Clone ID: PAT_TA_84252
atgggacctagtgactctccatactccggcggtgtcttcttcctggccattcacttccctaccgactaccctttcaagcctcccaaggtcaacttcactactcgcatctaccaccccaacatcaactccaatggtagcatctgcctggatattctgcgtgaccagtggagtcctgcgttgaccatctctaaagccttctgtccatctgctccgatgttgacagaccccaacctgacgatcctcttgtgccccgagatgcccatgtctacaagactggaccgacccggatacgaggccacagtccgggagtggatccgaaagtatgcatctagagcgaataccagggccgggtgcggttaatccgggtggttcactcccctacatggaangacgtgaaacgaacgatgaanttcctagcnttgccaaagtccgttagccgggatactacagggngcttgcctgaacaaggtttgatgcnntattaggatgangacgatacnagcacttangggggaaaanccagcaacanatatcnagangattatgcggtggtgtgggttgattacatgntttggatcagaananantaaaattgcnccnt

SEQ ID NO: 84253 - DNA, 511 bp, Triticum aestivum
  unsure (1)..(511): unsure at all n locations
  Clone ID: PAT_TA_84253
cgcacgcagacgcaggcgcagctagcttcgcaacaagtaaacgatacctcgcgtcgccaagagcttaccgacaccgagaagcagccacgcgctcgcggagctagagctagagcctagagctagagcgcgagagcgaccgtcggccactcgccatgtcggcgctagtggacgcgctgtgcgcgccgcccagcgacaccgcgctcggtctacgacaccttcaacgcggncaacttcctcttcgacgccgccgcgttctgtgacggcgccggcattgtcgccgccccggcgtccgcgcaccaggcgcccgtgggaggcgcaggcagcgacgacgtctgcggcgccgacgacnacggttagggcnaggangcggcggtntgcggcngtaggagctgcaagtccaaggaaggagaccgagacccagcggatgacgnaatcgcngtcaangaaaccgtngccgccagtngacgtactggcgggtcgntcaaantgcgggggctantcaangggggaa

SEQ ID NO: 84254 - DNA, 654 bp, Triticum aestivum
  unsure (1)..(654): unsure at all n locations
  Clone ID: PAT_TA_84254
agacagctcctaaacatattgggagctgtttacagatacaaaaaattaaagggaatgagtgcagaagagaagcagaaggtcacaccgcgcactgtcatgataggagggaaagcgtttgcaacatacactaatgccaaaagaatagtgaaattgggtgaatgatgttgggtgctgttgtgaacaatgatcccgaagtttaacaaatatctgaaggttgtcttttatccccaaattacaatgtaccaagtgggctggaagtgctttatccctggggtagcgaatttccacagcatatttagactggctgggtatggaagcaaagtgggacaagcacatgaatcctcctccctgaatggttgtgtatcattggacccttttnatggggctaatgttgaataaagagagttggagnaaaattcctcccttttcccgggccnaacccagaattnccgggctnaggaagtanagaaatggcctgtcnaaccaaccacttttntaagaccagcattataagggtgggctttgggnactatgacnagaacntctgggtccctgaaggatctggttggcgtgggatantcctgtggtagactccaantnacatcnagntcgtgtcaccaaggtaaaatgcaagttcanctanagtgangaatt

SEQ ID NO: 84255 - DNA, 432 bp, Triticum aestivum
  unsure (1)..(432): unsure at all n locations
  Clone ID: PAT_TA_84255
gtcatcccggcctcgcgtggcggcaaatgggaatgggagaacctggtaactgcatgctctagatgcaactccaggaagggtaacaagacgctactgcaagcaaacatgaagctacgcaagatccccaaggggcctaaggaattcgacatcatcgcggtgcccttgacgaaatccgcgttcaggacgatcaggaggaggcacggcctgcctgaagagtggctgcagtaccttggccggggcatctccatgaccaaagggaagatcccttcaaaccataaccaagtaccatcatccatctccatggtatatatatatattactaccanntcatcttctcccaagccaaantccatgtatgtccatcaccantcctgtacatgcctactacttcctgatttcnngaaataacctgtacattcactggatttacca

SEQ ID NO: 84256 - DNA, 441 bp, Triticum aestivum
  unsure (1)..(441): unsure at all n locations
  Clone ID: PAT_TA_84256
cctacgtgcgaaggccatcggccttatgccgatgattgatcagggagaggcagatgacaagatcattgcagtgtgcgctgatgatcccgagtacaggcattacaatgatatcaaggagctcccacctcaaccgcttgggctggaaatcnaggcgcttcttccnaaggactacaaagaagaatggagaacaaggaggttgctggtgaatgacttcctaccaagccgagcgcccgctttatgaanccatacanactccctatggcctggtatgctacatacatccgnttttaaggccttgaggaggttaggttccctggatggntaggaaagtgggnaaggatggttttgaccgaaaactggggaaccatttttacccgcatgggacganaccgttattatttatttggtgccntgtatactgctagtagtgaccctccatcc

SEQ ID NO: 84257 - DNA, 235 bp, Triticum aestivum
  unsure (1)..(235): unsure at all n locations
  Clone ID: PAT_TA_84257
ctctcctgctcactcactcccttggncttctcnagtcctctgtcctcgatcgatcggnttgtttacttccttagcttggagatccatttccatggaccctcacctcagctcncangttcacgcggcagntgcngcggcctcngttttcncngatggtaanaagttgganagtgacntgctgcctccagggggtnatgaccctccangtcgnggtgggtgcgccgnctaacgcttt

SEQ ID NO: 84258 - DNA, 646 bp, Triticum aestivum
  unsure (1)..(646): unsure at all n locations
  Clone ID: PAT_TA_84258
cccttgcctgcctttcgccttaccctctctctctctctctttcacacaaccactcacactgccggttggtttcccttccgttgtggttggtgcgtacttagtggcggccggccaggcccggaaggaagggggcttctcggcggtggtgccgccggcgtggctgccggcggtgctcctgttcctggcaggcgcggcgtcgggcgagccgctgcagcagtactacaatgccatcttcagcttcnggcgactccttctccgacacgggcaacttcgtcatcatcaactccggggcaagctgcccaacatgcccaattcccgccgccgtacgcgaggtgctccaaacggccgcctcgtgattcgatttcctgggccgaggcgttcgnctcccgctgtccctcccgtcnggcgaacaagggcacaatttaaccaaaggcgccaattcncggtgatgggcgcgaaggngctggactcaagtattcaaggacaacaacgtgtggngacccgccctnnaanagtcaanggctgantgnntgtcaagaggtgaaggcagattgcccgagaccgcgntgcgncctgtcggangcctgtcnngtcggnaatnggggaagaaaagttccntgaagggangggcctgnnagnaaaaatg

SEQ ID NO: 84259 - DNA, 183 bp, Triticum aestivum
  unsure (1)..(183): unsure at all n locations
  Clone ID: PAT_TA_84259
caagaagagacgcagcagcatatacgcatccatccacccactcgaaacagaccaacccctaccctaccctgcaggctgcagcgcgcgcagagggggaaatggagctccagcagaangtttgtccagctcctcctcctcctactacaccggctaggaggaatctgatcaccgnncaccatggcg

SEQ ID NO: 84260 - DNA, 611 bp, Triticum aestivum
  unsure (1)..(611): unsure at all n locations
  Clone ID: PAT_TA_84260
cgaaagccctcgtcctgacccctcgcaaaaccctagctccaaccaccatgaagggcaaggccaacgcctccaagaaggatgaggccaggctccgggccggcggcggcggcgccggaaagcgcaagaaggccgccgcgagcggcaagccaagcgcctccctccgccttcttccgtcttcatgtctgaattcaaggcaggataccaggcgcagaccctgggcaacaagagcgttgcggcccgttgagcaaagcagcaagggaaaagttgggtctatgtcaagagcaaagagaanaccctatgttggccaagctggggcagaaagaagcaagactatgagaaagacttaagnnaatatttagaagggaganacaantccaaagnaggttagctgatgacgacgatggtcnaatccgagtccnatgatnaggatgcgtatgacnaagatacgacgacgacgantaatattnccgctgttgtgaaggaacaaccnttttaancccaattaancacgggttgctacttaagtnantgttgganaagtgntatgaaggattataatttctaggtgtantttgatnnaagaaaaccatgtgcactatagtncttttntt

SEQ ID NO: 84261 - DNA, 605 bp, Triticum aestivum
  unsure (1)..(605): unsure at all n locations
  Clone ID: PAT_TA_84261
cgacgaggacgacaagagcatccagccagggaacttcgagcggcactggggcatcttcacctacgacggcctgcccaagtaccagctgaacctggggacgtcgaacgcgggcggcggtctccgtgagagccaagggcgtgaagtacctccgagaggaagtgggtgcgtgctggaancttctggtgaactcaaacgaccccgaagtccgcccgacaacgtggggatacgccgtgctcccatgggcggatggcaccancttgggttacaagacgtccntgccgggatgctgggcatcccgcggaactctcccttacgcgttcnaacaactactttcccaagaagaacgaccaagacgacgtggctgccggnttccaagcctccgccgacgaccaacggccagaccccaanaccggactgcagtccnggcatgtcnagtccatccntttctccttgagtgcagttttggaanactctcctgtctcctggttggggttcaactaccctngcttcncttnaccaaannctgcaaggatgtggtggaattagnnataacatcngnaacactgaggtataaatggtgtttaagcaatcattanacccttccc

SEQ ID NO: 84262 - DNA, 456 bp, Triticum aestivum
  unsure (1)..(456): unsure at all n locations
  Clone ID: PAT_TA_84262
cggcgatggcactcccggcgtcaagctccggcctcttccgcttcgtctccccccgcagccgtccccagtccactgacatcgtggccgctgcctcctggggagtcttcgccggcaccgccggcctttacctcgtccagccatttgactggattaagaagactttcttccagaaacctggaaccagaggcatgatctccaaggcagaaaaatgctgcaaatctggcaatttggggtacaccacttttgtccgggatgatccctggatgataactcaagcaaataatatgaacccctcgtcttcccttggtttgattttatccaaatggtaggatccctcttgcatgtatatccaacgagggganggggatcatttgacttgttttncaancacacaagagaacggcttggttcaacccgtgttanaaggccttggaggatttcctnaaaaaaaaaaaa

SEQ ID NO: 84263 - DNA, 285 bp, Triticum aestivum
  unsure (1)..(285): unsure at all n locations
  Clone ID: PAT_TA_84263
ggaacgcccaccgcggcgccgccgacgccacacccggccgagccgaaaccgagactgcatcctccttcgcggcgcgccgagatgagcggcatgagcctctcccatcgtctccctcccgccgcggcggcggtgggacccctactacgtgtatgcggcgcacccggaccacagcggcagggcgtgtcagcnntccggggggngtncccganngangttgaagcccgcgangattcaaaactcttctcccaaccgcccgcttccgatnatgtctcgaagggggggggg

SEQ ID NO: 84264 - DNA, 437 bp, Triticum aestivum
  unsure (1)..(437): unsure at all n locations
  Clone ID: PAT_TA_84264
gccgttcgtcgctgggttggtagcctatatcctggacaacaccctccaggtaaaggagagcgcggtgcggaaggacaggggcaaccactggtgggagaagttcaggagcttcaagaaagacgcgaggagccaagagttctactcgctgccgttcaatctgaacaagttcttcccgtcggtctgatctcaaatggcgccgccgctgaatcaatctgggaagcaaccttgttcatatgggcgttaatgaggaacataatcctgctgggctggccagtgggaacttcctgtgtctccattggttggtcaattttggtgtggtttcccggacgagatggggagtaattgaactggtagaaatattacgattgaanatacgcgtctttttggnacctacatgnacaacgcagattaatatttgtagcgtaatatttgatcaa

SEQ ID NO: 84265 - DNA, 682 bp, Triticum aestivum
  unsure (1)..(682): unsure at all n locations
  Clone ID: PAT_TA_84265
cacacaccacaccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagctccgtgtcacgctacctcaagtggggaagcggagcagttcgagtggagcaagtccaagaccctacggatgaggtggtgggtgcctacgataccgtcgcgtcgcctccccgaagnctccaaggagacgaaagaactgctgggataantccgttgtgctcaaanttaaacggagggtccgggacgacatggggctgcactggggccaanctgtcattggaanccgcatgggntcanatccttgacttatgggatcaaattgancctgaacaaganatggtgaatgtcctttantcngatgatcttaacacatgtgacaacagaagatgtgagaanatcaactcaacatgantcanattcaacaggcagtacctccattgtacgaggnttctganttcanaaggaaactggaggtgtgganccctgcaaggannttnccccttaaaggaaantnaatcntgncagaaggttcctttaacanantggganca

SEQ ID NO: 84266 - DNA, 548 bp, Triticum aestivum
  unsure (1)..(548): unsure at all n locations
  Clone ID: PAT_TA_84266
ggcttctccacctgtagtctccatggcgtccatctcggtccccagccgggccccttctgcagccgaagacgccgagaacattaggaaagcagtgcaaggatggggcacggacgagaaggcgctgatcgagatactgggccaccggacggcggcgcagcgcgcagagatcgccgtggcctacgagggctctacaacgaaccacatccgacagctccatcccgantctcccggcgactcccgggagcgcgatgatgctgtggacggttggcccggnnnggcgcgtgacgccaaagtccgcccaacaagccatgaaagaagcaaggcgagcggacgtgtggtgctgattcgagtcccctgcgcgtccgcgcccggcacttcgtcgccgttaaggaaggctaccgcgaggctatccgctccctggaggaggactcgccgcggcccntctanaangccntcctcaagcatcttggggcgncctgantctacgtatccggcnaccntcantacaactgcaagcggaggccggantgnacaccgtgtggccggaa

SEQ ID NO: 84267 - DNA, 502 bp, Triticum aestivum
  unsure (1)..(502): unsure at all n locations
  Clone ID: PAT_TA_84267
ggttgacattgttgacaccttccgtcttcaggagcaacctgcttttgacaagaagcagtttatctctcacatgaagcgctacatcaagaacctctctgccaagcttgaaggggatgacctagatgttttcaaagaagaatgttgagtctgccacaaagtacttcttaagcaagtcnaaggacttcnattctttggttgggcgaagagcatgcatggatggatggcggcgttggtgtcccctactacaaaggagggagctgctggatccaatttccctggtacttttgcacatggggctgaaagaggccnaagtgctaaccgcactggttatgctaaacctatgcgtccgccanattttgctcctgctcccatggttgccanccaccctcccatgttggtgcccggnactatcaaatgttgagtgccttgaactttccggatatgggngntttctttggnaatgggatccctgnngtgggtngntattttgggccaaaaaaaa

SEQ ID NO: 84268 - DNA, 658 bp, Triticum aestivum
  unsure (1)..(658): unsure at all n locations
  Clone ID: PAT_TA_84268
caaagttgctggccacggttgcttcggtgctcgcttaatgtatgatccagagtttgtaggggatgctatgtcagctattgctgccaattgtgatgtccctgtcagtgttaaatgcagaattggagttgacgatcgtgaccctacgaaagaactttggtacatttggtagataaagttgtttctaatcaaccaaccaaggcattttaattatccatgctccggaaggcgttgctcnagtggctcnanccctgccggagaaccggaaggtcctcccttttaaaaatatgantactattatcttttgttgccggacttccccaagangtacacttttacactaaatgggagntttaatgactattggacaanttatgcaccatnagacaagcnccaccaantatggttngccntgctgcttacaaancccaagggatatgctgggcactngatatgaattatggatgccaaaactngnctcgcgtcncaatcttgaganacaattatgggatccaaatgggcataggacacaagcaactgaggaactgtaaccatgtanattgtcaccaaccngaaattttgaactaggngttnacttcncatganaattgantnntggaacctgccatccgncccgctgcacatttngcccagaaanttc

SEQ ID NO: 84269 - DNA, 668 bp, Triticum aestivum
  unsure (1)..(668): unsure at all n locations
  Clone ID: PAT_TA_84269
aacaagcaggcccttatctgctactcacttcatgggcatgcatcaaagcctcggtattcagttggcacagcttgggaaggatgcatctgcagcaggagctgcacgtagagttagtgcccaacgaaaggcagtcgaggttgagtctgttgcagctgctgggtaaacaagagattccgagaagtagtgaagaagttattccgtgctgagtttgtcgagaagcgatatgaaggttagatgaggatatcgattgagagtttggagaatggtttatactgtcacccctctgaatgttcatgggacaagtgggagttggaaacnggagcacagttcctgattgggtctcnagcactgtacactaagacaaagaaaagtactgcttcaactacagtggaccaacaagagttgcagctgaggaaaagganccctcaacaacctaacaaacacgcagacantccanacccgttagtgcttantcctgtggtgantcgtctttataccnctggcagttggttgccaggnttgcctcaaattgttgtgcatgcaatttttgtaacttccgcgtacggntcctgccaaatgattgngagaacctgntttgtgacattggtagaacncatnanaggcacccanttttcaggntgaagaggtgtcaaggaagtatnttcnnc

SEQ ID NO: 84270 - DNA, 649 bp, Triticum aestivum
  unsure (1)..(649): unsure at all n locations
  Clone ID: PAT_TA_84270
ccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctgggtatggtagtcacctttgggtccaactgggcctgactactggaggtgaatctgttgagatgcaccacgaggcgcttcaaggaggtcttcccgggcgacaatgttggttcaacgtgaagaacgttgctgtcaaggtctcnaagcgtgggttccgtggctcccaatccaaaggatgaccctgccaaggaggtgccanttcactcccaagtcatcatcatgaacacccggggnagatgggaacggtatccccaatgctggatgccaactcccanacnccgtcaatttgctgactcattacaagttnacagcgtttggaaggccaaggggggccggntaccaatcncctaaangagcgattacgcgcctaatggcgtcgtttaaangcgtgantgggaaacctgggtaccaattaacccttaaaaaacccttccagtgggaanacaaaggccaacnttccttcaaattccacnaggaagggccccttcggatacngggnnttggtcac

SEQ ID NO: 84271 - DNA, 677 bp, Triticum aestivum
  unsure (1)..(677): unsure at all n locations
  Clone ID: PAT_TA_84271
gccccctcaagctactgcacacactatcgatccggaggcttcggggaatattaatcttgaagctattcgcatcttgcgtttgtttcaacaatggccgttgcgaatctcgtcaagcgcattgaactaccgcgtggctcgcgcttcatcaatgaagatgtcagacctgttggggaccgagcgacgaacatggacgtttctaacgttccacaattcctgggtgttggatcaactggcaacattggcgacgtatctgacgggcagcgcgctggatccccttgggttgacgtgggtggcaggcacatcgncacacctccgggaaacctccgcgactgcggattgatcctgcttcgcttgccggganttatacacgtggntccctgnccttaaacccacggtatggggaaccggggangcattccncatctgggacgcacttctctcctccgtctgggatggtccaatcctgggtccggnggcatgcagttccaanctcnacatgggatccaactcgggaaanacccaacacatcccgcgtcgacggatactcgcgaattgncccantaactcgatcnnagcnccgtcccngtagcgacgataaaantctcacttcagncgnacccgtttccgcctnntgggtgganaggatnggggtttgaancttngaaacccctcgaagg

SEQ ID NO: 84272 - DNA, 234 bp, Triticum aestivum
  unsure (1)..(234): unsure at all n locations
  Clone ID: PAT_TA_84272
cccacacgagcaccaagccgaggggaggggcgatggcgagaggtgtggtgtcagcgaagggcggcacggccncggncaagnataaggggtcggtcgccttcacgatcnactgcaccaagcccgtggaggncangatcatggngatcgcctcgctcganaagttcctgcaggagcgcatcaaggtcgccggnngcatggcnggnatcctcggtnantccgtcatcatctctcgcg

SEQ ID NO: 84273 - DNA, 212 bp, Triticum aestivum
  Clone ID: PAT_TA_84273
gacgagaccgccggagatggagccgagatctgcaatctacagatccggcgccttccttctcctcgccgccatccttgcggaggtcgtcatccctgcatccgccatcggagacaagtgcgccgcctgcaaggccgttgctgcggagctagagattgggaatttccgagtgagaagcccgagaaacacttgggacttgcgcaaccgcttaatgg

SEQ ID NO: 84274 - DNA, 647 bp, Triticum aestivum
  unsure (1)..(647): unsure at all n locations
  Clone ID: PAT_TA_84274
agaatattgttaaatttattggagcatgcaggaagccagtggtttggtgcattgttacggagtatgccaagggcggatcagttaggcagtttctggcaaagaggcagaataggtcagttccactaaaactgggcggttaagcaagcactgggatgttgcaagggggatggcgtatgttcatggcttgggttccattcatagggatcttaaanccagataacctccttggatactgggtgataaacctaccaagatagctgactttgggagtactcccggattgaaagtaaaaactggagggaattgacacctggaaacggaacctaccttgggatggaccaaagatgattccaacacaggcatatgaccaaaagtttgatgcctacantttggnattggtgctgtgggantcaataactggagtccttttgcctaatatgacagnangcagtgctccgcngtggtgaacaaggtgccncccaactatcccaagacgcctgccaacctgctgagtatgacagtgctgggatcaaatctgatgncgtccgcaatcactgagtgtagatctganatccnanatgaatctacacntcgaggccgttttcggttcagncaccntctacgcnancacaggattatgccccaga

SEQ ID NO: 84275 - DNA, 613 bp, Triticum aestivum
  unsure (1)..(613): unsure at all n locations
  Clone ID: PAT_TA_84275
cctgttcctgttgacagacccagcattacaatatcatttggggagggtactgaggtttgtatgttgctttttttttactagaatactgcaattgtcttcaaatggccaaactgagttctgatatatttctagtaaactagatttttagcatgagcgctcattatttcttctcgttttaacagttccttttagtctttaatgagcagtgagccagtgaatatggcatttcttgggaaagcaggtacaagatactatggtcaagatctggggcatacttggcatataacatgctgatcctacatgtgggctctgccttcttggtgtagccctggattatccaaacgggtttggagntctggaaaggatatatagtttaaccccgttgggcattggcaactccaaatattcnagcaaagggctaagggtctccgatgatcngtcaatttgctcctttggggatacgggttgctaaanactgaatggctgcctgcacggaacagcagnttttgtcatggtgnttccgcatgaagttcagtacgtgctttggaatgcaagttnctaatagaaaaacacgaaggcaatngaactgaanctatcgatcganggctntacc

SEQ ID NO: 84276 - DNA, 582 bp, Triticum aestivum
  unsure (1)..(582): unsure at all n locations
  Clone ID: PAT_TA_84276
cgacgccaccgccacatccgtgccagcgctccgcccctggatcgttgacctcctcccgctcctcgtcgtcctcctcatcgccgcccacgtcctcgccctcggttactggatctacaggctcgccacggacgggtccaggcagcccgcgcggagcaagaagcactaaggggacggcgcccgcggccggatgtaaggcttgaaaccagtttgttatttcagtcctgcatccttggcttgttgatctccaaccttccaacgtcagatgatggcgtgggaaagtcctgaaagaactaggacagggaaccgatcttatccaatggnttgttcagatgttggtgtcaaaagtgacgatagctgaatagctgatatgtggaaggaggccttttgagcataaatagtttcggttgctgggataggttgacatctctcgactctccgtgtaaagaacagtactagacagatgtgccgttcaaatgttgtgggctggngggctttgtaatcaagacaacatttatacnggcaattagtaacagnatacataagtntgagaagagtatnatacgtcaagngaaaaaaaaaaaa

SEQ ID NO: 84277 - DNA, 609 bp, Triticum aestivum
  unsure (1)..(609): unsure at all n locations
  Clone ID: PAT_TA_84277
gttcgcagccgccgtcgcagctgctgtccttgccggctcccgggagtacttcgagctcgtccgcagcactgccagcggaggcgggaccccgccgccgcgatacgtgtcccgcgcgtgctccgccatctgcgctctcatgcccatccttacgctgtactatggacgcatggatgttactgtggcattttctgcattccgttattgccatagcattgcttttacaaagaggaaacctccgttttgctcaagctaactagtcanttttgggttggttttactgtgggctatctaccttctttccggggttaantccggcaaggattactgcccctgccttaaatacaagtatacataccgttggcattcttctccggtggacaantcactgggacattggcttgtagaaccttgnaggntattagtacacattgctgctgaacaccgcttcctttgtggaaggcattggncgtaccctttgactaanaaanctaagaaactggaggggcttaactggcnactgctgtgtctgacactggcgcgtnaatgcttacgctggcaaaatactgtgntgcanagttaggaaccganntcggtnatgttnggattgca

SEQ ID NO: 84278 - DNA, 453 bp, Triticum aestivum
  unsure (1)..(453): unsure at all n locations
  Clone ID: PAT_TA_84278
gaagaattcgcgcggctgtttgcgaagttcacccaggacgtggcgctggttggagctctcctcgtcttcctgggcatgaagaactccatcccgaagcggcagggcaagaagaaggctcacaaggcgaagacgaactagtaggaggctgctcgctctttctttagatggttgcgcgccggcctcaggcgggtgtcaggagacgaataggcccactagtgcgaagcatccgtccgatgcgcatccgagtgccggctgcgcttttacatgtaccggatattcnagatcccatttttgccggggcgcggcccaacgaaggtgtgactaagtgagcggccgaacgaagtgtgactaagtgagcggcggcaatgtatgtgattgccatggtgggtnggttccttgaactgggctgggantggtnacctttccnatttggntaaananaaaaaaaacggg

SEQ ID NO: 84279 - DNA, 471 bp, Triticum aestivum
  unsure (1)..(471): unsure at all n locations
  Clone ID: PAT_TA_84279
catcacctgtgtctaggttgggagcaaagcaaagagagagagaggaaagctagctagctagcatggagagtgccagcaagaaggtcgcagccggtgtgttggcgctgctgcttctccagctgatggtagctccgacgacagcccgcctcctgcagcaggcggatacctcccccgtgttaggcctgggacatcatggcgagggagttggcatccagatggagcatcccctgtgggtgaacctgtgtcttcataccatgcgctactcanctttggttgccgatgccaaaacaangctgctngaacaactgaagnaccttctcantccggacgagacaagcannctctgatctctgtctcgtcatttgcctgctaagacaantcacaatttgtgttgggagaacaagaaaacggnggggtcaacttatgggtacggggtttaatataannttaataacggaacttggtgnttgt

SEQ ID NO: 84280 - DNA, 571 bp, Triticum aestivum
  unsure (1)..(571): unsure at all n locations
  Clone ID: PAT_TA_84280
gccagatggcctcgcttatggaggtgtttgcaggaggatccttggaaatgaaggtaatggagaaagtttgatgccagaagtactcggctacacagtgggaatcagataaacccaatgagtatcaacgacaaatccattacaagttcagcaagaagctgtctcccgttgggcggagaggtgacaggaacccagcagaaatctcttatgcctaataagaaaggataggtatcgaagaggtgatggagtccaaggagccttcttgggcactctttacgctccacatcaaagtaccaggtccgaggcctcgctccccaagcaaaagagcaagaatgtgcaggctccctggggaatccgagtggtcngaagagnaccaaggaccaagagcggtncgagagacncctttcccantcgtcccgcgcgcctaaagngatgttcaaccttgcgtccnaggagtctcgcacgccaaataggagcggnctaagctttcgangntnaccaacntcctgngatanacacaagccgttatngagnganttacaccactacgtntgaagtggtgagctgancagaa

SEQ ID NO: 84281 - DNA, 634 bp, Triticum aestivum
  unsure (1)..(634): unsure at all n locations
  Clone ID: PAT_TA_84281
gttcaagccgcatagtctgattgcttggttcgttgcgctaaacaactccttcgaggaccatataattggatcaagattgtttagattccatcccgaacacctccgtatttcctacgtgggggcagaagccgatgacaggccaaccctcagatttcatacaacacggccacacagcaggtaaaatttaaaacataagaagcattatattacaaacccactttgttctaccatacaaagtagaaggaacttgaatacattcattcaaagataatatccctgcgaacactgcgttgctacaatgcgagaccctcctaggacatcatagcgctccgggtgtgcggtgctcccttgccctcctggcggcccttggcaagtcgacggcgtccaccttcgcccacacatctggcancggggtggaaggcatgcgcgcaccttcaatacagntgatcgctttacgggtcaaccaaggacagggctaacaaccgctnnaaagacngaatactgccgggnatacttnagnagcaatancggttacaancctnaaggcattcggcaccnatcagtcacaactgtttactgangtgaaggaaagatctanggnnagggatgcacagaaattccggggcccctcngg

SEQ ID NO: 84282 - DNA, 607 bp, Triticum aestivum
  unsure (1)..(607): unsure at all n locations
  Clone ID: PAT_TA_84282
ggctcgccatcgccgtgctccgcaggatcccgcaggccgaccgatacgtccgcgcggggctctggaagtccaggggagactacaccctaaccacgcggttcagcggcaagcgggtgggcatcatcgggctgggcaggatagggcaggcggtggcgaagcgagtggaggcgttccgactgcccggtgagctaccaccagcggacggagcagcgggcgacgtaccccgagctacacctactacccgtccggtgggtggagctgggcggccgaacagcgacgtgctgggtggntggcgtgccccgctggaacgcgcaagacgcgccacatccgtganccgcgaggtgatggnaacgctaggcccaacggtngctgattaacgtccggcctgggcacacgttgacgacgcgagatggtggcggccttgcgacggcggttccgcgngcccgctggactgttccaaggacaactaactgccccaagcttcttggatggcacnccctcngtgcccanctcgggaacggacaannaacccaangcatggcgactctgctnggaactgagggacgtctagaancctgcnaancgtgctacttcctgttcataaata

SEQ ID NO: 84283 - DNA, 385 bp, Triticum aestivum
  unsure (1)..(385): unsure at all n locations
  Clone ID: PAT_TA_84283
caccgcgccagcacaacgcatacgcatacctcaccttcctttcctcctcccgtcctccatcaaaagaaggcagggaaagatctgatctggggggtgagagagcaggaggagaaagccaagccattgccctcccctcttgaaggcttggagcttggttctacatcctcttctcttcccctccgtctctctctctctctctctatttgggtttgcttgcttgcctctactagactctagtcgtcgggtccggccatgggccaccatcctgggagaacatccaagaaggcgaggtcctgccgaccaggccgctcaaaggacgagtgcccacctttccaagggcggcggcnaagagcaaggaggagagcacctttttaaaaaaaaaaaa

SEQ ID NO: 84284 - DNA, 380 bp, Triticum aestivum
  unsure (1)..(380): unsure at all n locations
  Clone ID: PAT_TA_84284
ccgccgccgctcccagtctccacgcggaagcagcgcctcgcaacgctcctacccaatggcgccgacgtcgaagctgtcgatgggcatcaagcgcgcgtcgcggtcgcacgcgtaccaccgccgtgggctctgggccatcaaggccaagaacggcggcgtcttccccaaggccgagaagccgcgccgccgcgggaacccaantctaccccgccgacgacgtcaanctcggcgtcccaagcacccgcaagctatcccaccaagtcaggtcgagcacacgcctggggacggtgctgatcctcctcgncgggggcgttcatgggaaaagaagttggtgttcctcaagcantcaatcccggctggtcctcgtctctgggccattc

SEQ ID NO: 84285 - DNA, 636 bp, Triticum aestivum
  unsure (1)..(636): unsure at all n locations
  Clone ID: PAT_TA_84285
acaccaatcacctctgcggccggcggcgtctgcaacgccagtctctgatccgaccccgatcggcacacacgttctccatggcggagcagctcgcatcccaagatgctcccaatccccctgctccggcacagagggtactgatgacgaacacgcatggggagaaactcgtcggcctgctgcaccacatggggtctgacaaggttgtagttctctgccatggctttacgggctccaaggactatagcctcatcactgaccttgcggccgcactaacaaagcaagggattaagtgtgtttccctttgatttaagtgggaaatgggagaaagtgaaggtgaatcccagtacggcaactacaagaaggaggtgctgacttgcatctgttgtcttgtacttcnccaaggagaanacgacgtacacattgttggncacaacaaagtggagatgttggccttctatatcctctactacaaggttcccatgggggtaactctctggcggttnattngganaagnattaggacnctaggaaananttatggtgatacaggaggtcatgatcaangnatcagnatnttgtcaggtacaaggaantgtggangtgaccatnttnccanggcttcacaaagntgagntt

SEQ ID NO: 84286 - DNA, 496 bp, Triticum aestivum
  unsure (1)..(496): unsure at all n locations
  Clone ID: PAT_TA_84286
ctcgtgccgtcnaatttcaaatccttcgatcgcgcagcgccgcccgccctctcgcagctctctccgatggcccgcacgaagcagacggcgaggaagtcaactggcggcaaggcgccgcggaagcagctggccaccaaggcggcgcgcaagtcggctccggccaccggcggcgtgaagaaccgcacaggttccgccccggcaccgtcgtctccgcgagatccgcaagtaccaagaaganacggagtgtcatccggaagtgccttccnagcggtggngcgtgagatnccgcaagactttcnaagaccgacttccggtccnancctcccgtgtcgcccgcgcttgcaaggagccgcccgagcgtactggtggnctctttntaggaacaacttctngcgccaccacgccaaagagncacatcatcccaaagacatcaantcgcgcgcgcatcaagggnaanaggctgttgctntccgnctcccgttccgtaagtccggac

SEQ ID NO: 84287 - DNA, 480 bp, Triticum aestivum
  unsure (1)..(480): unsure at all n locations
  Clone ID: PAT_TA_84287
cctttgttcactttgccatccttcttatccancaagtatctggggcagttccacttccagtgaccatttcctttgcantagaagcactcagtttcatgcttgggtctagctttgggcttcttcatgggagtggcaacttgcatgccattattctttaagttccctttctttcccttgccttttacctgaaactagtggtcttgtcaaccatcaacacttgatgcttttcttgatttctaccttcgccgattttagtatcgcgaagagcacagggaatcnttttcgtcatcccttgcatattatagttcatcacgaagttccagtaancttgggngatagtgnctaagagaactctgtcaatcactatcttatctanaatattaactcccacttgattcaagcgattgtagaccanacaatcctgagcaatgctcactgggtgagatatcccctcatcatgtangcaagactgtcagcggc

SEQ ID NO: 84288 - DNA, 503 bp, Triticum aestivum
  unsure (1)..(503): unsure at all n locations
  Clone ID: PAT_TA_84288
ttttttttctgtagcaacttgggactatatgattctgagttatactgcagtatcatttaacttgagaagataaatggtatggatcctaacgaaaatatctaacttttgactaacacacactgaacaaactaaactgcatgtacccccattttgtccacacaataaagaaaagaaaagaatagaatagaataggagtatatattgccaccacaccatttggtggatcactatgctccatttctaccaacantgtctcccaaggtcctggttataatgtgggtgtttggaacattttttaaggtaagagcacatgccctctttggtgttccccggcatgctgnccaatgctgatgatttaccccnggggganggaacgaagcattgcactgctgctcctttgggagccangcttccctgttggacaatgccataactcccgtcatgatancctggangttgncccactttatacctccaatactancnangggggggccgggtac

SEQ ID NO: 84289 - DNA, 634 bp, Triticum aestivum
  unsure (1)..(634): unsure at all n locations
  Clone ID: PAT_TA_84289
cccgctccgatcgacctgctccctccccaccaccgagcccatggcggaccagctcaccgacgaccagatcgccgagttcaaggaggccttcagcctcttcgacaaggacggggatggttgcatcacgaccaaggagctgggcactgtcatgcgctcgctgggggcaaaacctacagaggctgactccaggacatgatcaacgaggtccgatgctgatggcaacggcaccatccgattcccaagagttcctccaacttatggtccccaagatggaaggacaccgactcctgaggaaagantccaaggaggcttccgtgtgttttgacaaggaccaaaacggttcatctcggcgccnantcccgcatgtcatgacaacttgggtgagaantaatgatgaggagtggacnaatgntcgttaggtgagtccatgggaggcagtnaatacnaagngttgtccaaggcatgatgcaantgagcaaagacatnnctgaaggangaaatttnatgcatatnaccagatgaactttatccacgactcaaggaanatcgcnatgnatnctaaaaggaatgantccggntgtctccccagggtttaaangtgtagtaattaagatgcccccgcgggctatgataa

SEQ ID NO: 84290 - DNA, 624 bp, Triticum aestivum
  unsure (1)..(624): unsure at all n locations
  Clone ID: PAT_TA_84290
tttgccggcaacccgtcgacagcgacgaggcgcagcataaggcatacgggcacggcggccatggcgaccagctccaaacccgccgcgcccgtggaccccatggtcgtgctcgcccacgagttccccgaggtgtcattcgactacgacgagagggatgtagcgttgtacgcgctcggggttggtgcctgcggcgatgacgccgtcgacgagaaggagttcacttccgtgtaccacagggatgggcagccacacattaagaccttcctactttgtttctttatttcccaacaagaacagcaatggggttggtttgttgattgcctgggcttaactttgatgcaagcttctactgcatggtcaacaatacatagagtctattaggcatcccttccntatgccaatgttgtnaacaggttaaagtactggtttgcacaacaaggggaaanactttctngantcnaaanacaaaagctcaannancaggggantttntcatgaanagggnatancacttcntggggcngngggtttnaaccttaaggcaaaccattggnactaccngnaaaanttccnattcntcaattcgactttgattnngnaaaaaagnancagattttaaagttt

SEQ ID NO: 84291 - DNA, 340 bp, Triticum aestivum
  Clone ID: PAT_TA_84291
ctccaaccttggggatgctctgatatttgctatttcttgtacatccgcattaacaaagtaagcattcaagagctcatagttccacgatccgttctggtttaacaagtcagacacgaaacgaacacgacatcttccctgcggcgagattggtttataggaaaaaggccttgggatccacttatctcgccaaactcgaatgcttctgccattgccaactctccatactaggccctttttcaacagatccaatccataactgatcgcttgccatgacgacgaagcattcccggtgaaaactgtatcatctaacctgcccaaaggataataccttgcttttaaa

SEQ ID NO: 84292 - DNA, 446 bp, Triticum aestivum
  unsure (1)..(446): unsure at all n locations
  Clone ID: PAT_TA_84292
ccacccctctctcggtctcttccccaccgcgtcttcgtcgtctcgtcttcctgcctccttcgcccgagaaaggagagaatggggagcagcgagaagaccgttaccgcttacggcgaagtacacctacgctgagctggagagggagcctactgggccgagtgagaagctgaggattccgattactgggggctggtgggttcattgggattccacatgctccccgtctgaagaacgagggcattacacattgcctctgactggaagaagaacganacatgaccgangacatttctgcatgagttcactcgtttgatctcaaggtcaatggacaacttctcaaagncaccanggnggccnacattctcaaccttgctggcaaatatgggtggatggggttanccaatcaaacatcctgtggnnaatttnaacaaacatgatnantttta

SEQ ID NO: 84293 - DNA, 506 bp, Triticum aestivum
  unsure (1)..(506): unsure at all n locations
  Clone ID: PAT_TA_84293
cttggtcaagcaagcagaagattctgctagtaataagaagccagagaagaaggatatggttggcatgcaggaacaggtctttgtgtggaaaatcatcgagctgcatgacaaatatgtagcttatgtgacagaatgtttccagggacatacactcttccataaggcactttaaagaacctttggaggcttcctgtaacaaaggtnctctggcattccgaatgctgagttgttggtacttcctgcgacaatatcctgaagaaaggtgccagtgaaaantccagtgatgaaccattgaagatcccttttagaagttgtnagattgctgggnaacatcantgataaaacctgtttgccgattcctataggaaaaacttccaanagatactttccnacaaaantgctaaggataacatgagagatattctgacaaantcaanaacatgcgggggcatttattcccaaatggaggatggtacgncttacgtcncagagnnacaaacaattga

SEQ ID NO: 84294 - DNA, 617 bp, Triticum aestivum
  unsure (1)..(617): unsure at all n locations
  Clone ID: PAT_TA_84294
tccaagcttgctaggtggtggcggcagcagcagcctgcgcctatgtacactgcaatggcagcgcgaccgctgcttcttccccctccggtcctcctcctcctggtggtgctggctgcttcgtcggccgcccatggctacggcgcctacggctacggcgacgctgctgctgactcaaggtccggttctacaaggatcntgcccggacgccgaggccgtcgtccgcagattgtcgccaaagccgtccaagaagaccccacggccaacgcgccgctgctcaagtccanttcnacgactgctttcctccggggctgcgacgtccctnctccgtcaatccaacnaaggggaacacgcgganaaaggacgccnaanccaacaaacgctggacccttcnaactcatccnacacatcaaaggagcgtgganaacctccccgggacnctccctgggccgaacctcgcnacgccgcaaggagcgttcgctggcacaagtggtacaaggcgctganaagaaggaactcncaagtganacgcagnggacgcctttcaaacagnngcgtaaaattcgatcaagntgatcgaantancagagtcgttcaactacnnagtttccgtttnaggc

SEQ ID NO: 84295 - DNA, 638 bp, Triticum aestivum
  unsure (1)..(638): unsure at all n locations
  Clone ID: PAT_TA_84295
gtcctgcccctacatcaccgcctcctccgcccaccaccgcttcctcctcgacgaccaccccttctacccaacctcctgcccgctcggcatcacctcccgctccccgatcgacgacaccttcgacctcgacctcctcctcnccctccccctccacgccgccgtctccgcgcccccgtgcgcggncttcgacttcgaccccntcctcctcgacaccctcggccaccgcatctccgtcctcngagcgcgcgctcgccctcgccccaccccgccgcaagtacacctacgccgccgaggcaacggcaggaagtcaaagtgggaccgccgaaggacaagcccgccggggggccgcaacctcaaagtgggaggccgagtcaaagacccgcacacgacggttccacgcaagtggaatgggancaaaggatccgccacggntcaacaaagcaaaggggcaaggantnaaagggaaaaggtngctcnaacntggcaancctaatccgtcnaggagactacgggaggnntcatgccgcacgacaggagaagannaccacgggncanaagaatnaaggggaaaaagancanaganaanaggaagnggaattnagatnaggaaaagcggnngttccataaangtttnatta

SEQ ID NO: 84296 - DNA, 648 bp, Triticum aestivum
  unsure (1)..(648): unsure at all n locations
  Clone ID: PAT_TA_84296
ctcgtgccgctttttattattattaacataactagtgcaacatgccgtccctcaaagccatctcggcctcgcttgtaggcctgctgagccttggtagcgccagcgtcatcccccctgtcaatagcgaggggtacttggttgcctcgacctactttgcggggttccacgccaataggggatttcctgtctccggctatgccctggggacaagtacactgatgtgaagtatgcttttgctgagacttcgcctggatggtccctcaaatgtttccgggtccgcagcctggagaacattcccttgcttttgtcaaaggatgccaaagaacacaacgtcaanctctcatctccgattgggtggctgggactgggaanccgacacttctctacaaacatnggcgatgccaaagaacgcactactttatcaaagaaattgtcaactttggttgagaanaggtttggaagtccnacattgacnggganacccaaccgcctgggnctcgggtgtaacgattcaacgagaagaacgcnactctcgaatctcaaggaggtccaaggaccaagggaagactttaanaatgcgcggntgnctcctgaaggnagntggaancncagantatgnttncagnccataatagcanatagataang

SEQ ID NO: 84297 - DNA, 617 bp, Triticum aestivum
  unsure (1)..(617): unsure at all n locations
  Clone ID: PAT_TA_84297
gtttttttttttttttttaatttcaaacatcaaacttattcatgatttgtcatagttctgggtagtacgcacacacaacacaaccggtccattattaaaccaacactgacacgactcatgacacgaacagcagatactttgacaacctccatatggagagagggcaccagacgacgcaggcacatcggcagcttaaacgacccatgacttactgaccaccacgggagacggagcacaaggtgggagggtgtctccttttggatgttgtagctgctagggtgcggcacctccagtgtttgccgggaagatcagacgctgctgggccggggggatgcctccttgncctgggtcttcgccttcaattgtcatggtgcccgantctcaactccaagggttatggttttccaagcaggncttacaagatctgcatcactctgaggcggagaanagggaaggggncnccttcnggnngtgtagccgcnagagnnggcactcaantgcttgccgnaaggggggccggnccaatcgcctaaggggcgatancgcgtcanggngcgttaaagccgatggaaacctgggtacanttacnctgagaaacccttcgagngggggggggg

SEQ ID NO: 84298 - DNA, 577 bp, Triticum aestivum
  unsure (1)..(577): unsure at all n locations
  Clone ID: PAT_TA_84298
cagacggccccgaacgccggcggcggagcatcaggtcgtcgacctccgagcatcgacccgccgcgattggagaagggaaagggcctcgctcgccgctgggcggtggagctccccgacgcctcctcctcctcccccgccgtccccgacccgcccggcttcaccagatccgcgcccgacgcggacgacgccgctggagcgcgccagcgcaaggactccgaggctgcatggaaggcgcagaaagcttgggaagttgcgcangctccgttcaagaacctgatgatgatgggatttatgatgtggattgnaanggagcaattgtcaacttcttcangaatcggattacttctctgctctggtggaacccctcaacgntctccgatctgttgggaaatttttgaacaatttaaggaccaaaggtggatacnattgtcctaantgtccttaatgcctcaatttggntgcaagggattggtatatggaacttataattggcttcttcaanaatcataagatgggtgctttcnggtctgtcnnaagtgatatccggngaggtcccttaattagncaattcaattaa

SEQ ID NO: 84299 - DNA, 422 bp, Triticum aestivum
  unsure (1)..(422): unsure at all n locations
  Clone ID: PAT_TA_84299
caactacgaggtcgagcctcgcactggcggcagcaacaacggcaataaccagcccgcctgctctgctcagagctcgaacgtttgctgcaacggtctcggctgcctcgtccagatccttggcgccggttgctccaccaactcttactgctgcgagtctgatgcccctctggcagttggtgctctcatcaacatcaacgccctcaactgtgtcaaggtctctaagtgatacttcccggcgacttggacctacccctggggagtagcatgttgggttgttgggatattgggggcatatagggtgtgaggatctggatgggggaaaagctatgccagtacccccgcatgttaatagcatgttggatgtttggattacttccgnatgacttnattttgaggttgatatacatacaggggatatatta

SEQ ID NO: 84300 - DNA, 577 bp, Triticum aestivum
  unsure (1)..(577): unsure at all n locations
  Clone ID: PAT_TA_84300
tcttctcgccttactccctcacagaacccagtaaaatattgctagtcccgccgtcgagatggccccacgccgcctgctcgtcctcgccgtcgtcgccctcgcggccaccgccgccgcggccaactccggcttcgcggactccaacccgatccgccccgtcaccgaccgcgccggcctccgcgctcgagtccacggtcttccgccgcgctcgggccgcacccgcgacgcgtccgttccgcacgtttggctgtgaggtacggcaagagtacgagagcgcgnnggaggccacaagcggttaaggtctctccgagagctccagtcgtccgtccaacatcggaaagctctcctacgcctcggatcaaccntnngcggcatgactggaggattcgtgcgaccngttcggngcaccaaatgtccgcangcttacggaacacggatgacncgcgcgttgcctcggggagaaatgaggagatggatnntaccatgaaacaagganggggtaagcnggctanatacgggatgaggtnatncaagaatgagcatttttnanaaantgtanggnttataaanttgggag

SEQ ID NO: 84301 - DNA, 424 bp, Triticum aestivum
  unsure (1)..(424): unsure at all n locations
  Clone ID: PAT_TA_84301
cccagctccaccacgcggtcaacagagcgaacacatcgggagatccaaagatcccacagctccgtcacacagctcgatcgatctcgttctcgtcttctcctgatctcttgccgcgtgtgggtacagccatggccaccggaggagtagtagtgctcaacctgcgcgtcccgtcggcttcagtggcgccggcgaggccggtgggcggggggctggaggatgaccactaccggacgctggaggctgggcgcccgggggcaccaaggggcgaggcaaagagggcttccnaccgctccgcgctgcagtacacccggacgtccntgcggcgaggcggaacgacgtctggaaagaaatanaccacttccaggggtnaacgngnataccanaggtgatganacatgnccaggngaggcaagtccatatgggg

SEQ ID NO: 84302 - DNA, 611 bp, Triticum aestivum
  unsure (1)..(611): unsure at all n locations
  Clone ID: PAT_TA_84302
caagattgttgtcgacggtgatactgaagttgacttaatggtgcaaacacggcacatgcgagaccgcatcatcctcacgatcagaggcctcgcccagaagttcaacagcacctccctcaacacacttctcaggatcgaggcatgatttgatgggtaggatgcccacatgatagacctgacaagtgtaaaaaccaactattacgggaagctgttccccctgttccgattggtaagagtgcgtggtttaagtaggatccgtgacatgccagcttttggtgtgtatggggtgtgggaccgggccgagcgtgnttggttacagttttttttcnactgacacactctcatatcaagagcanacaactggttgccctgatccctgcgtcctgcncatgaatgtatataggccgtaaaacnaggaaaaaattgggttccttggggcggatttataagcaccnggttggttggggttttccnaggcatcncaaacnaatattggtcttctttttcnggccttgggttgcaaaactttccgggaanaaattcgggngggatgggcaangntgtcaaagccggccaattggtcaaggnanctaggggggtncaaagngttt

SEQ ID NO: 84303 - DNA, 585 bp, Triticum aestivum
  unsure (1)..(585): unsure at all n locations
  Clone ID: PAT_TA_84303
caagcggcgaatcagggctgctgcctttgctgcctgccaccaagagctccagttctgccctccaccttctcgttttccctcctcctctctccttgaagttgcgtgagctccaagcggtcgatttcctgttcaaaagagcacatatgtggtcagtccttcagttttcccttggcatggtcgattcctgcccagttttcttacttgcggtcaattcggtgcatactggattgactcctgtccccatgcagattcatgtctggcgtccgctgcagtctataggcgcttcctggacgccatttnangcctaggcacacctaacatatagggcggtgcaccccgaggttcaacgagacccnagtgcttacatccaatggcggggagacaagggtaactttngcaccaatacaagtattaccttnaatttgcgctgctgatgcantaaggatangaanancaaaaatnnancttccttgggaacaattttagggaaaaggttancagcatagtaggggcaaanatgtgggttaaggatgtatgctcncgaataaaanatctgggantgngtanaaaggtgtttgattttgn

SEQ ID NO: 84304 - DNA, 534 bp, Triticum aestivum
  unsure (1)..(534): unsure at all n locations
  Clone ID: PAT_TA_84304
aaagcgtgatcttgaagataacaatactacagatgtatctaccgagtctaatgatgagggattaaatcccaaacaattaccatttcatgaagttgcacaagattaccaggaggttgatagtgtcatttcggagagcaatgaaaatcaggaccgacttttcactggagatgcaacccatcaggtttcatcgaatgattgttatgaagctgggaattagtatcgcgtcagaggccagtaatttatcattttaaaaactgggcactacatcttggaaaaaaggataatttatcattttattacgttgtatacggactaataatttatcattatattataccgtatacctactaatatttnatcattttattagttggtanactgagtataagtatatgggctagatttttacncttccgtagcatatgacaacgtttgactccccttttagggacttgggaatagtnatgacaagcngttaatcggggatccaanaatcccaaangtggcagagganaagactttggaaataacttg

SEQ ID NO: 84305 - DNA, 642 bp, Triticum aestivum
  unsure (1)..(642): unsure at all n locations
  Clone ID: PAT_TA_84305
cctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggtttgtcaatctgacattgctttgggttttccttctccatttatctttccttgtttgttcctaaagaatatgtgtatgtccatggtcaatgtaccaacatgtctcgaagaaagatgctccgtatgtgaaatgcatccggggtggtatgtatatgcacatgcacatatatatttatacatctgtcnanaaaaanaaaaaaatccccagggggggcccggtaccaatncgccnnaaagggatccgnttaccgnncaatggcgncntttaaacncnngacgggaaacctggggttacaanttanccctngaagaaacccnttcncaantggggaaacnaaggcngacgntgccttcaaaattgnaactaaggnanggaacccttnngg

SEQ ID NO: 84306 - DNA, 265 bp, Triticum aestivum
  unsure (1)..(265): unsure at all n locations
  Clone ID: PAT_TA_84306
ggaggaagaagcggaggagagagaaaccctaatcgagatgggnaagcttctctgcgacccctccgccgccgccgtcgccgaggtcctgccgccgtccccagcccccgctccgcctccgccgctcctcgcttggtcntccncggccccggcctcctcncccgaggcctccatctcgcccanagnaatgggacgactctaggctttctcagtacnantgaccatcgnattttccaccggatatgacancnacagcntcacntctttg

SEQ ID NO: 84307 - DNA, 497 bp, Triticum aestivum
  unsure (1)..(497): unsure at all n locations
  Clone ID: PAT_TA_84307
ggcagtcgatattcttcggtggccccatgctgaacacccctagcctgggcgcccagaggaacgaggcaggcgcaagagcgcgtccggagggaagcagagatcctaatgcccagcagcgtgacatccggggtgagaaagcgaggacaggctccttgccagtatttgctcctgnggacggtccaagaggaacccgccctttgacaaatgacctgctcctgctcatgaanttatctgaagtgcgatgatgccgttacgctggaacaccccagcctgaagagtggcaaatagttagggctgtcctactggggttgncaagactgggcggacaagcagcgttggtttaaagntgctgcctgctggactaagcaagtgctaacgagaacacaatattctcnncatcaangctgaattttcaatgttncgggggcatggatnactgaccaacgggtttgnttaggatcaacaaanatttatcncanaataggaaantnttttgg

SEQ ID NO: 84308 - DNA, 358 bp, Triticum aestivum
  unsure (1)..(358): unsure at all n locations
  Clone ID: PAT_TA_84308
ggacaacgacgccgagtcgtgctgcttcggcggcgacgcggcctcccccgcgaggtgggcgtggtgccgggcgtgcggcgagcgggaggcgtcggtgctcctgctgccgtgccggcacctgtgcctgtgcaaggcgtgcgagccccgcacggacgcctgcccggtctgctccggcgccaagaacacggccatccacatccgcgcccaactgatggcgtcggtccggcgatctccgggcagcgccactaagtaaccgcacnattnacgttacgcaanacagtgatagtagtgtatatgnagtggnaggttacagtaggttatagggccgttaacngcgttcnttccccaanaaaaaaaa

SEQ ID NO: 84309 - DNA, 608 bp, Triticum aestivum
  unsure (1)..(608): unsure at all n locations
  Clone ID: PAT_TA_84309
tgctcctccccggccctcacatcctctttcagttccctctctggatctcttcctgaagagaggcactgccacaccaccacgccacccatgctcaacatgatgaccgatctgagctgcgggccgtcgtccaaggcgaaaggagggcagccggcggcggcgccgggctccggcggcgacagncaggggaaggggcaagatcgagatcaagcgcatccgagaacacgacgaaccggcaggtcaccttctgcaagcgccgcaacggctgctcaaagaagcgtacgantctccggtgtctgcgaagccgaaggcgcgtcgtcgtcttctccaaccgcggcgctctacgagtagccaacaacatgtgaatccacattgagaagnacaagaaggcaacaatgaacttcnattctgggacantgcanaagcnatgttnanactacaanaganctccaagnnggcaancatngatacttgaaaaccaaacagtagacatatgggagtcatcaaacatggcnaaggagttaacanatggnggaagtggnaagcataacaagatngagtgaagaatactctgntctattgatattnaagaagaatgtttaaatgcannt

SEQ ID NO: 84310 - DNA, 381 bp, Triticum aestivum
  unsure (1)..(381): unsure at all n locations
  Clone ID: PAT_TA_84310
tgaattttgactttatttgcgaaatctcttgagaatttgtaaaatgggcataacttttgcgtacgaacttggatgaaaaagttttttatatgaaaaatcatctactcgaaaagttacaccccgttaaacattttcaaaattctcaaaaacctaacagaaaaaagatacggggcttttaagatccggagaggcaaaaaaaaataaaaaaaanttaaacttactaatgggcgcacctaccccatggtgtgccattactacttcccgccttcaaaaatccaaaataanccaaaaaataaaaaaaaagtactaatgggcgcacctggccattgggcgcattaagacctcccgcttcaaaattcaaaataaataaannaaataaaa

SEQ ID NO: 84311 - DNA, 629 bp, Triticum aestivum
  unsure (1)..(629): unsure at all n locations
  Clone ID: PAT_TA_84311
ggatcgcacagcacttgagtggaggctgctttatggaaggattttcaagacggttatcattcttgctgagcagagcaatgcagagcttgctgttgaacgctgcacgttgtcacacgcttataagtatttgcccaaggtttttgaaagatacagtggtgctgatggatttgtgttcctccaagaccacatgggttcttaactactgggaacctgatgcaagctgacaaggaaaaacttgggattacaaattaagatgcacatccttggggttactgtccattggggagacgaataaagaggaatgggttgtaaagcaaggtgatatggncaagcaagtcattggaattccccattcatttcccaaacaaactacaagggagacatgggcnaaagataaattaantccnggggaaggaacatccaactgccccggcgtttgtttaggntttggggacctggnggccctggccggatttggtttgcacanaagttgnggccnaagtcttcttggnaatggccnancaaatttganccgatgcccggcnganatgtcaagcannttcaactaaggaagtcccncattnaaagcaaaaacggggnttnccggaanttnaggattgtttaaaggg

SEQ ID NO: 84312 - DNA, 185 bp, Triticum aestivum
  Clone ID: PAT_TA_84312
gtacccactttccagtcatgtgtttttggaaagcactcgcttgatttcgaagttaaactcttaacacttttaaatcaggtttggtcctcagtctctatgttcactcggcttttgctcttgtcaattacggtattgcaccctatgatatatataagctgtcttgattaaaagggggggcccggtac

SEQ ID NO: 84313 - DNA, 276 bp, Triticum aestivum
  unsure (1)..(276): unsure at all n locations
  Clone ID: PAT_TA_84313
cgcgagtggaactgtggaancgttgagcttttttcttctttgtcttgctgcgcaagaanaagggaaacgagaggcgggcggcgatggcgaacaggctgctcccgtcnctgaaccgggtgctggtgnagaagctggtgcagcccaanaanaccgccggcggnatcctcgtcccggtaacatccaancanattangttgatgtctttcctganactgttgcctcaaaggntaccccaacttatcanngcangtggngcaagatgttgagactgtaatc

SEQ ID NO: 84314 - DNA, 626 bp, Triticum aestivum
  unsure (1)..(626): unsure at all n locations
  Clone ID: PAT_TA_84314
aaaatactatgtcaaaatagacccacaaggagaaggagctcggtggcgtcggacatttggccaggaaatatactcccctctccttcttgctttcacagagcaggatggaggcaactgggcgaattcacatgttgcaaaattctctgcgatggattcaacttacagcttgcctgataatgttgcaatgcttacccttcangagcttgaagatggaagtgttctccttcgggtttgctcatctatatgaggccggggaggacaaggatctttccgtctttancgagtatcgacctcaaagagagtgttccccggagaagaagatggcaaggcatccgnagacaagttatcgggaaaccaaagaacgcgcagccatgggagaagaagcgtttgnaatggnagggcaaggtctgcngctggacgagaagtggttccgggtggcctgtggttcttcnaactcntcnttgactggggcaatgggatccgcaatcaacggcaantttngtacatcantgcaacaacactatacntctcnactaacacattctggataaatgtctgcggntcaaataaaaaatatgggctgcggntcctgtggtaaccatgaatggccgcntggcacnggtcaa

SEQ ID NO: 84315 - DNA, 625 bp, Triticum aestivum
  unsure (1)..(625): unsure at all n locations
  Clone ID: PAT_TA_84315
caacagatgacgcaacaaatacaacagcaacaacaatctctataccagcaacatcaacaaatgcagcatcaacagcaactgtggcaacaaatacaacaacagaagcatcagttgcaacacatggatccccaacaacaacagctgttgtctcagatggtgggtacagaattaggcagtgatgatgacacaagggaagattgggtcacaggggctggggccgcatgcctagggaatccagggagggttaatgagggttacactcactcacttntagggttaagatgtttcctaagtgttttgtccgttaaatcatttaactgataactttccaaaaaaataaccatcatttgtatatttatacgattgggtaaagagttttaattacaccgttatgtttaccgaatactagtanattgtattgagctgggagnaatttttgcaaaaagggggcccgtaccaattcgcctaaantgatcntataccgcctcantngctccttttaaactcctgacnggaaacctggggtaccaacttacgcctncagcaaaccccttngcagtgggtatnacaanaggcccaccgntgccttccaantnccacctaagnaatngacccccgtcggatn

SEQ ID NO: 84316 - DNA, 613 bp, Triticum aestivum
  unsure (1)..(613): unsure at all n locations
  Clone ID: PAT_TA_84316
gaggccgccatggcgtccatcatcgtcatcgccgccgtgctcgtcctggacgtcctcgccttcgtgctcgccatcggcgccgagcgccgccggagctacgtgaactacgtgagcgtggacccggccgggggggtcctactgcgtgtacagctccgacgcgtccacggcgtacggcgtgagcgcgctgctgctgctgctcgccgcgcaggccgtggccatggtcgccacccgctgcttctgctgcggccgcgcgtctccgccgggccgctggcgggcgtggccggcatctgcttcatccgtctgctggggtgacgttccgtgatcgcggagctgtgcctgctggccgggtcggtcccgggacgcgtatcacaccaagtacttccccaaagggcgacggcccgccgccgtgcgccatctcgcaaggctcttcgccgcccggngccgcttaacttctcgccgcgtcttcgccgactgcatactctccacgcaaggcgccagncgccgcgccgtggcccgccacgtcgnggatcggatacccattanatggaaaatgctgtgtgtatccgtgncggcgggtcacctgagnganccgcagngactagtctntctggtt

SEQ ID NO: 84317 - DNA, 619 bp, Triticum aestivum
  unsure (1)..(619): unsure at all n locations
  Clone ID: PAT_TA_84317
ggataccctcgaatccaggacgccgatagtagccccccgggctcaaggcgcgcttggacttggcttccaggcgaagccaaagggcaagtgtggagcgccgcgagccctaaccgccagcggccttgatgacgcgtggcgactgattggacgtgggcgactctgtttccccacactgcctccggcaactgctcctgtctgacaaaaaggggtgccgcctgccaccaggtttcattgctccttctctgtcttgctccataccccttctccccacagcggaagagtcaccagatctgccgatttccaccacatcttctgcttgatgcccgcccgagaagncacggttcctcctcggccgccggtccgcctgggtacgagcaaggctgctggggcttaacgnaaccgggggagagtctaaacaagtcctcctgatggcgagcacataataatgggaagaaaccggtctggtngcaacgccgatcngacccgctgggagaattctcccttcttaatganaagttctcgggntagactcaatctcccttctcngtcatcctcacacaaggctcaacgtcaatatcatgcaatcaaccccttggccctttgctcatgaggatcaggg

SEQ ID NO: 84318 - DNA, 619 bp, Triticum aestivum
  unsure (1)..(619): unsure at all n locations
  Clone ID: PAT_TA_84318
cgatctccggccgacgccatggcagccccctccgcggccgtcataggggtgctcgtcctcctcgtcgtgggggcctcgggcgcgcgcctcccaggccgcggcagcaccacccggggagctgcgctgccgcgcgggggagcgccggccacggcggtgttcgcgctgggaagcttctggcggtcggaggcggcgttcgggtgcctccacggcgtgatccgcacctccgtcggctacgctggcggctccaagtccaaccccgagtaccgcaacctcgccgaccacgccgagtgcgtcaaggttgagtatgatccccggttgattcactacaggcaacttttggatgtgttctgggcaagtcatgacccacgtgaggtgttttgggcaagggcaagatgttggaaacagtatagatctgtcatcttcactaatgggaacatcaaggcaagattggctggncttagcaaggaaaagacaagctaaagacgtacaacgttgttacacacagntcaacattgggggtcttcaacangtgaacagacanagtncaagggtcaaatgnattaatggcnacttaatccggttgaattaanactaattcgccanaattgncgaacnaaac

SEQ ID NO: 84319 - DNA, 415 bp, Triticum aestivum
  unsure (1)..(415): unsure at all n locations
  Clone ID: PAT_TA_84319
gcagcgcgaccgctgcttcttccccctccggtcctcctcctcctggtggtgctggctgcttcgtcggccgcccatggctacggcgcctacggctacggcgacgctgctgctgagctcagggtcgggttctacaaggactcgtgcccggacgccgaggccgtcgtccgcaggattcgtcgccaaggccgtccaagaggaccccacggncaaacgcgccgctgctcaagctccacttncaacgactgctttcgtccggggctgcgaaggtcccgtgctccgtcaactccaacaaggggggaacacggnggagaangacnccaagcccaaacanacgctggacgccttcgacgtcatccgancanatcaaaggaagcgctggaanaaangctgcccggggacctctccctgggccgaa

SEQ ID NO: 84320 - DNA, 415 bp, Triticum aestivum
  unsure (1)..(415): unsure at all n locations
  Clone ID: PAT_TA_84320
ggttcccctgcttctcctcctcctgctgtccgtgttcacagcctcanatgcggcgttctgcgtgtgcangccgggcatgtccgaccagatgatgcagtcggccatcnactacgcctgcagcacggnggccgactgcgcctccaccaccangggcgcgccgtgctacggaaanggcaacaaggtggccgtctgctcctacatctgcannagctactaccagagccgcancggnatgggcnccanctgcgacttcaacggcgtcgcnaccctcaccggcaccgnacccagntccgggacntgcaangttcgcctccggncccagnangtnggcaccggtgncngngctggtatggncaccgncngagcatgcgctggtgtctgcgctggcacgnnatccggtnttggcacggntgcg

SEQ ID NO: 84321 - DNA, 577 bp, Triticum aestivum
  unsure (1)..(577): unsure at all n locations
  Clone ID: PAT_TA_84321
aagctaggggcccttcctgaaggtctgaaagatgctgagaagtgcattgagctagatcccacattctccaagggatacacaaggaaaggtgctatccagtttttcatgaaagaatatgacaaagcgctggaaacttatcaagctggcctaaagcatgacccgaaaaaccaggagttacttgatggtgtaaggaggtgtgttgaacagatcaacaaggcgagcagaggcgaactcagtgaggaggaactgaaagagagacagaacaaagccatgcaagaccctgagatccagaacatcctgactgatccgatcatgcagcaggttttgacggatctgcaggagaaccctcgggctgcgcaggcgcacctcaagaaccccggagtgatgcagaagatcagaagctcgtcagcgcagggatagttnagatgaagtanacggtggtggaatgtccgggtcaaatntgggactgtgctggaatgctgtgaacttgtcattgntcccatttggaactgaaccttttgtgcacatagttggcanggtgttaaggtcaaananggnttccaaccgtatgtccaaa

SEQ ID NO: 84322 - DNA, 325 bp, Triticum aestivum
  Clone ID: PAT_TA_84322
tggattggtttgaagacactggatgaagcagggcgggtgaagtttgtgtctgtgccgggaggtcatcttggtatctccaaaggtgacatgaagaagtacattgtgccttacctgacaaacaaaaaggcatcggtgacggtttctgatttgctagttgccatttggcacgctgtgcttgggctggcactggcagagggtgatgacgctgttttgatttgatgcatgggcttccgacagtggcttggattgttacgctgcctctgcttggttggcttggcactcagtcacaaataagattcatctcatctcatattctgttcaaaaa

SEQ ID NO: 84323 - DNA, 502 bp, Triticum aestivum
  unsure (1)..(502): unsure at all n locations
  Clone ID: PAT_TA_84323
ccgcgacccacgccgggtcgttcaagtgccggctccaccgcaccaactcccagggccacggccacggccacccgcacccgtccccgccggcctcccccgccgcgccggcgcagggcgtctcgtcttccgcttcctcccgcaccgtcgaggccctgtgagtgtccgaggccaaagacgggcgaggcgtggggaaagtgagaagatgatgggatatacttgtcgtgtcagtctgtcagaaggaaaggagtgaagctattattccctcttgntgtgatccgcgctgttttgcctcttcncccctaaccgtttcctcncttcgngctggntgnggntctaaantcctgattgccggacgtcccgccttcntccttgccaagacgagatctcctcctcctgcaactgctaccgtgntcctctcaantggngaactgtatcctgatttggggagaaggtaaacttgnatgccttcangnattanttgctcnctttanattcaagggcc

SEQ ID NO: 84324 - DNA, 355 bp, Triticum aestivum
  unsure (1)..(355): unsure at all n locations
  Clone ID: PAT_TA_84324
gncacctcctgtgcatctcccaccgccggtccacctgccgccgccggtccacctgccaccgccggnccatgtgccgccgccggttcatctgccgncgccaccatgccactattctactcaaccgccccggcctcancctcatccccagccacaccnatgcccgtgccaacagngcgcatcnanagcccgtgccaagctgcaggnaacctgcngagttggcagcanctcgatnctgngncagtttctcgagntcctgnggcatcagtgnagcccgacctgngatntcntactgttcngctcagtgcaatcnatttggnaanatgttccancntcncaggcaggtggagccgcacac

SEQ ID NO: 84325 - DNA, 628 bp, Triticum aestivum
  unsure (1)..(628): unsure at all n locations
  Clone ID: PAT_TA_84325
cccttttcgtccttgttcctcaacgtcgccggtgcgcccgcctcctgcctctctccccctgcgagcgatcgtgaggggatcgggatggcctcccaccattccgagcccctcgaccccgccgacgctgacgacccctcagataacaacccagaattaccatgcccctcctatcatatcgttaccaaacctggtcaactcccagtcgagtttcttgaaccctcagctgcccagaagttggtaattggatttgactgtgaaggtgttgatctctgccgcaatggtgctctctgtattatgcagcttgcattccctgatgctgtttacctagttgatgctattgagggtggaaaagaacttattcaagcttgtaagccgcacttgagtctgatatatcaccaaagttattcatgattgtaaaagggacagtgaggctttgtattttcaagtttggataaaacncataatgtgatggatacacagatgcttattctctgatagaaganaggagaggaaggaaaaaagatgcatctgatgatacattaatanctttgnnagctctgcnanacatatgggananattctgaaagganatcgtcctntaggagncccaanttggnaatagctgctg

SEQ ID NO: 84326 - DNA, 626 bp, Triticum aestivum
  unsure (1)..(626): unsure at all n locations
  Clone ID: PAT_TA_84326
ggcgagttggagcaggtctgggtctggccgcgtgagttatttcccagccaggcatctgagagctttggtcttgacctcgacagagatcgccatggacgcatcggcggaggtggaccacctcgccgccgagaggtcggccgcgcgcttcgacgtcgaggcgatgaaggttgcatgggctggctcgcgacacgccgtcgaagtcggcgaccgcatggcccgactcgtcgcgtccgaccctgtcttccgcaaggataacaggaccatgctctccaggaaggacttgtttaaggacactctaagaaaggcagcccatgcatggaagcgtattgtcgaactacgtctcacagaggaggaagcaggtatgctgaggctatatgtcgatcagcctggttatgttgatctgcattggggcatgtttgttcctgctataaaagncaaggtactgaggagcaacagaaaaaggggtacaatggttacagttcaaatantgggtgtatgctaaactgaatcggtcatggtcaaacgtcaaggcctnaaaaactgcaatttatcaaagatganagttgcatcaagtcaatctactcanaatgnggctgnggttgggaaantcaccatcatggggtagn

SEQ ID NO: 84327 - DNA, 484 bp, Triticum aestivum
  Clone ID: PAT_TA_84327
taccttgagcacctaagcaagtccaatgtctcatgcccagccccttcgtttacaggcccagtggaaacacgtcgatattcaggataaccaagccaatgctatgaaggaaccaggaaccagtggtgggtatggctccccaatgaaagatgacaagaacaaggatgtggatacaatagcttcgaacttcatcaagcttaagcacagggcttgggcactccagaagagcacaaccatgtaccaaccttccacttaaaggtgttgctagttcaataagtcaatactatatacttatgcttgtctctatatagtctataggtcctaagttcaaataacagatgctgcttgcagccttgggatatttgtggagtgaacacattgttgatagcatatggataagaaagtaatgtaattatctgggagatgtgtaattatgtggcaatattatttgcaacaatgatgcatggagtacttcatgtaaaaaaaa

SEQ ID NO: 84328 - DNA, 551 bp, Triticum aestivum
  unsure (1)..(551): unsure at all n locations
  Clone ID: PAT_TA_84328
agcagcgccacaactccacgtcgctggcgatgagtggcagagtggctggcatggtctctggagccgctccgtcgttgaagtgcgagggcgccgtctgcttcttcctctcatcgctgatcatgtccgggttctgcatcatcgcttttggcttgagcttgatcctggtctaccgcacaaagatcgtgtacacaagtctatacgggaaaccgcgtacttgaaggatcaaccctaaagggacacagggttatcaaagcatacttcaatttttaatttattagtctggtaccccatgcctgtacaggtacagtgtcggtcttcccgttgttgtgcacaggttctcaagcagcatttcaacttttcaagtatgtggctgcaaatgggagcttcagtatagcgaagcatgtgagagtagaaagtccgtctgtggctggactggggacgctgtccttggctcaagttttgctgtatttggntgtgaaaattgtgtcacatgtataagctagagacgtttcgacgcatgtcagagtggagaacatatctttagattgttg

SEQ ID NO: 84329 - DNA, 522 bp, Triticum aestivum
  unsure (1)..(522): unsure at all n locations
  Clone ID: PAT_TA_84329
ggtacggcactgagcatcggtgaggcaggcgacgcgcgccgcgcgagagaggcgcctcgcctggggagacagggagggtggccgagcccgagatggccgccgcgagggaggaggacgaggnggcacggccgctgcttctgctgccgcggacggtgcaggaggaccagaagtggtggaggcggtgggcgcgcgaggccgggtgngtggggtacctggccctgcccatggtggtggtgaacctgtcgcagtacgccgtccaggtgtcgtccaacatgatggtggggcacctccccggngtgctctcgctctcctccgccgncatcgcnaactccctcgccanctctccgggnttcaagctcctgatggnaatggangttcatggagcgctatgcgccaagcctacgggcgaancagatcataagctangctagacactacagagcggtctcaccctcctggaggtctggtcccctctcggtctcnggtgttatgtcaaatctggnctcanaggcaggacctcta

SEQ ID NO: 84330 - DNA, 237 bp, Triticum aestivum
  Clone ID: PAT_TA_84330
atcggacttgggagctttgtaaaaacattctcagttcgacaagctactatatgcaccttgtaaaatatcactccgatcacctatatcatataccatctccgtgaaacgagtacctcatgataggctataaaatgtcttcgacacctaagacctgatctacatgtagaaagggaagcacaaaatttcctatcgggcacaaagatggaagtgttgattaattgcgggtgcaacttcgta

SEQ ID NO: 84331 - DNA, 178 bp, Triticum aestivum
  Clone ID: PAT_TA_84331
ggcgacgccactactcctgcctcacgccgccgctcaaaccgcagaagagagaagagaagcacgcccaaaaattccgaggttttcacctcttggagcgcaccaacaccacccggagaccggagcgactcgccaccggcgcggaaaaggagggcggaggctcgatggcggatgaaattgg

SEQ ID NO: 84332 - DNA, 597 bp, Triticum aestivum
  unsure (1)..(597): unsure at all n locations
  Clone ID: PAT_TA_84332
ggctacccacaccgcgcgagatctccgatccccgcccaaatcccacgacgccggcggcggccatgggcggcaaggacctgacggaggaccagatcgcctcgatgcgggaggccttctcgctgttcgacacggacggggacggccgcatcgcgccctcggagctgggcgtcctcatgcgctccctcggcgggaaccccacgcnaggcgcagtcccgggacatccgcggcgcaaggagaagtcaaccgcacccttcgattcccgcgttnctcgacctcatgcgcgcccacctaaaagcccgaccctncnaccgcccgttccgcgacgccttccgctctccgnagnaanggtcccggacgtccctcnnccgacttcggcacncctaactccatcggcgagaantcnagcnacgattcnacgatggttcgcgagtcgagtcgccccggaggnacatccgtagnagattaacctnggatgtcncaaatgtccgtcntctcctgattcgatcncggntaacacccggntctgtcggaagactntcccgtcgcgtattatttgttncgtactattgatatttgcnctntcgnatgaacagncna

SEQ ID NO: 84333 - DNA, 514 bp, Triticum aestivum
  unsure (1)..(514): unsure at all n locations
  Clone ID: PAT_TA_84333
ttttttttttttttaggttaaaccacgggagattttatttaggggtttacatgcatggcatggcacctgctctgctcatgcaggcaggtgcgtacatacatacaaagaccctcgatcaggtagcgttacatggtaagtagatggatggatcgatcaaagatatgatgcacgcggtgcatgcatgaccgatgatggatctagcaactgcagcaggagcagccgcagctggtgccgcacttgcactggggtgcagccgcagcgccgttctccgccgccatctccatgccgccgggagtccccttgtgggtggcggtagcggagacgaggagggtgggcccggcggctccggctccggggtacatgttgcaccgccgcagcgttgccgcactttcaagcgctaccgcaaccgcanttcctccgcaacaagnacntccaagttgctggggatgggtggaactttgatgggtgttgggtaagactctcgggggnngggngcccgtaccaattcgcccaa

SEQ ID NO: 84334 - DNA, 522 bp, Triticum aestivum
  unsure (1)..(522): unsure at all n locations
  Clone ID: PAT_TA_84334
ggggagggagaggtggnaggacccccagaggcggccgtggcggcggtggcaggggtggccgcggcggtggcatgaagggcgggagcaaggccgtcgtggtggcgcacaagcacgccggtgtcttcatctccaagtccaaggaggatgcgctctgcaccaagaacatggtcccgggagagtccgtgtacggagagaagcgtgtctccgttcagaatgaggatggaacaaaagtcgaatacagggtgtgggaaccccttccgttccaagctggctgctgctgtgcttggtggtgttgacaacatctggattgctcctggtacccgtgtgctgtatcttggngctgctcctggcacaactgtatctcatgtgtcngatattgtnaggccggatggtctggtctacctgttgagtctctcacaagatggaagagacttttcaacatggcaaaganaggacaattntccaatattgagntgcaagcatccggnaagnaccggatntggttggatgttatgtaactcc

SEQ ID NO: 84335 - DNA, 641 bp, Triticum aestivum
  unsure (1)..(641): unsure at all n locations
  Clone ID: PAT_TA_84335
tggaagccttgatggctttaatgagctgaaaagagggccaagaagtgggatgtacacaaaccagctggggcttggagctactactgaagtaccagcaaaagagcaggaccttctgtctgctaatggttcacatcctgccatgaaggaccagtataatccgggctgactttgcggaaacatactcaagacgcaaaatcttcattatcaaatccatacagtgaagacgatgttcacaagagcgtaaagtacaatgtgtggggctagcaccccaaatggggtaataaagaaacttggatgctgcctatcaaagaggctaaaagaaaatccaagcgaancctggtttccttccttttccnccngtggaagcaagtggcagtttgttgggttgctgagatggtggtcctgttgatttttaacaaaacagtagttcattggcaacaagacaagtggctgggtgttcccctgtcaagtgggacattgtgaaganttccaaaacagttgctgaacacacatctcgaggggggggccggtaccaatnngcctatnggagcgtatacggcgccacggncgtcgtttaaactcggacnggaaacctgngtaccacttaacgcctgagaaanccccttccactgngaaaacaa

SEQ ID NO: 84336 - DNA, 644 bp, Triticum aestivum
  unsure (1)..(644): unsure at all n locations
  Clone ID: PAT_TA_84336
ctggcctacctaactagacaagaacttccggaggaccaaaatgaggcacgctgcatagtgcggcgatccaaggcctacagggtccatgagggagaattgtacaaaaaagcactaccggagtccttcaaaggtgcatctccgaagaggaagggtgtaatcttttggcagaaattcacgcccggacttgggcggtcatcacgccgcagcccaaggtctttggtaagcaaaggcttcctgtaccgggttcctattgggcaaacggcccgggcaagatgcacaaggctttggcccaacgttgcgccggtgccantcctttgcaaaccaaagcacatgccacccaccgccctcccaaataaccccnntacatgggcctttngcggcctgggggttgacatggnttggcccctttaaaggggaacccacaaagaaaatactttattgggcatgggnggtaatcaaccaaagggtanangcaaaccggttaaanaaccgatcccgaccggtgatagctcanaccggggttgtcacgttatgggtcccaaaacatcatcatgataangnacaactcatgntgactggaaaacncgggnacaaatgggaacaantcgntatgctaatcaacaccaantangttaancagngna

SEQ ID NO: 84337 - DNA, 588 bp, Triticum aestivum
  unsure (1)..(588): unsure at all n locations
  Clone ID: PAT_TA_84337
agttgatggtggaattgaaaccatctgccttgatctgccagcagtgatcaccacggatttaagacttaaccagccaagatatgcaactttgcccaacataatgaaggcaaaatccaaagttattaagaaagtcgccgctgaagaccttgggcgtagatattagattnagacatggaggtgattgaggtcaaatgaaccaccaaaacgaaaagcaggggtgatccttcaatgtgtccgacgactcccttgacaagttgaaaaatggaacacgtgtccctttaacatttggtatatatcccccgcctgaatagggcctgacgtcatttatttaagtccncccnccaaatgtcnagactnnaagcnatttnacaantaaataagggttaacaaaaaaaaggggggggcnggaccaatncgcccaannangagcctataacngcgccnatggcgtcngtttaaacgccgtgacnggaaacctggngttnccaattaacnccttgcagaaaccccttngcancggggtatacaanangccgacgatgccttccanagtgccaccnatgcaatggacnccctgtacgggataac

SEQ ID NO: 84338 - DNA, 625 bp, Triticum aestivum
  unsure (1)..(625): unsure at all n locations
  Clone ID: PAT_TA_84338
gatccccgccgcgtccttcaccgtcttcgccatgctcgcgcagacgctgtggatccccttctacgaccgcctcctgctgcccaagctccggaagataaccgcaaaggaaggaggggttcacgctgctccagcgccagggcatcggcatcgcgctctccactgtcgccatggtcatctccggccatccgtccgaggaccggcgcccgtgccatccgcgctcagccagccgacgctccggcaccaccatcactgggcggggccgatctccggcatgtccaanctggtggatgggtgcacagtcatgatcctggggctgtccggaggcttcaactcatcaancaagttngagtctactacaaggagattcccggagacatcgcacgttggccgggggcgtccccttctggaactggcgtcgggaatactcaanggttcctgggtacatcgtgnacggagacgggtccnggcaaaatggtggngcaagactcaaaaaggcgcctcnactatctacnggcaacgccggatcgggtcttaacttatcaactngtaactggcaagtggtaaggtcaggggcaagaactgtccccaggaacctcgcnaagttacacagtgnggatanggacca

SEQ ID NO: 84339 - DNA, 510 bp, Triticum aestivum
  unsure (1)..(510): unsure at all n locations
  Clone ID: PAT_TA_84339
ctcgtgcccgcggcgaatcacgcgcacgaccggcccctcgcggcgaatcccctcccacccgcgacgaatcccctacccgaacctctcgccaccaccgcggcgaaccacgcgcaaatctctcagccacccccatcctcgtgcaaatctgtcgccaccaccacccgctacgcccgctctcaacaacctccgcctccatcgccgtgcgtctcggccatccctcgactctgagatttacgccgctctcaaagaacccccgtctcaaaaaaccatgctcccaaaggaggtactggcagactgctcgcaanccttgggtaacgcaaaaccgcgcgtcctcaatcggctactccnggnaagccgctcccccgacngttnaactaacccgcggnaactncgggtcggctnggcanattggtttcccccaggngtctnggaaantncagattccatgtacggttganaagngtgcattttacnggggnaattcccnggtggnaaggcatntggggaagg

SEQ ID NO: 84340 - DNA, 311 bp, Triticum aestivum
  unsure (1)..(311): unsure at all n locations
  Clone ID: PAT_TA_84340
aagaagaaaaacacactttcacttgtcatattcaaggagatagtgttaacgacacagactaaatcaacccatattgaattgctagccagtaaagtggttccatttccaagaatccaaaggcactactgaactattatggcagaaatatagcaattactgaactaaaaatgcagtggaagagtgttttaaatgtgacttccagtatactagggagcctagggcaagatacttgggtccttggtgaaancacgttgatcctctacagaaccagaganctactttcccattttttattgggccaaagggggggc

SEQ ID NO: 84341 - DNA, 495 bp, Triticum aestivum
  unsure (1)..(495): unsure at all n locations
  Clone ID: PAT_TA_84341
ggaaattgtataagattaagaaagtataagattaagaaagctcgtgggttagagatatagaaaagaaaaagtagaaaaggattaaaaaaaagagggaattcctaatccaatcaaaaaacccattttggtcttagtgtggatagaggatcttcctatgttatactatataactctcnatccgtggaaatataactctcaatccatgaattggattggatagatccgatattccataatattggaatggatcnaagtattatcaagaagcaaancccacccttggattttacaaagnaccctttttcctcccncatggggattacatccccggagtaattgggtggaaaatnaaaaataaagaggtttggaanccatatcccccgcatttntggctacggcactgtcnattccnatcccnatnctttttnaactnatnatttnangtaaanacanccancaaaatattaattgggntcccaattnaccatggnagaa

SEQ ID NO: 84342 - DNA, 522 bp, Triticum aestivum
  unsure (1)..(522): unsure at all n locations
  Clone ID: PAT_TA_84342
ctcaagctgcccctttctcaccgccgcggccgccacgcgcagcagcaaccgagcaggagcgcagccagcaagctcaggcccgagccctactgcaaccgccgctgctaccgcactgaacaccatggccgacccggcggagcaccgtccagcggaggaggacgaggaagccgcggcggccggcgaggatgaggacaccggcgtcaaggtccgcgcccatccgtgaagttggaggaggccccgttacaaccgggagaggaggacgaggacntattntcgacattaaaggcgaantcttaccgnttcgacaaggaggcgaaccantgggaaagaacgtggcanaagcactgtggaactgctttagcacaaaggaaccgcnaagnccncctcntcatgcgtcaagngaaaccttaaatctgtgctnacacctggtggnggggacnactnaaancaaganacccaggancacaancctgcgtttggacccctggttnnccaacgtgacncaagaggannnttgcaacc

SEQ ID NO: 84343 - DNA, 348 bp, Triticum aestivum
  Clone ID: PAT_TA_84343
ctcgcgctggtcaatcccgggcggattaagtgcaccaccattctgtgattaccgcaccgtttattatgctattctgagaggattggaactctattcccttgtctagtttattcttgttaccatgtattaatgtaacaatctgtagctgatggaaggtgacttccagtcatgttttgggtttgggtgggtgtccgagcaagaggtattattttggggtaaaggccggagtccggacggagctcttggggtaagttgggattaatttatccttggctggaataaagaacacggattggtaccaaaataagaacgtgatatataaatattcctttccccaaaaaaaaaaaa

SEQ ID NO: 84344 - DNA, 639 bp, Triticum aestivum
  unsure (1)..(639): unsure at all n locations
  Clone ID: PAT_TA_84344
nagcctcgccgcgtcggtanggttttcccttggcccanacatcctagctcttccgcattcttgaatttcgtggtcgaggattagggggtttctcgtgcgctggtccaatttcgcgctaatcgtcctgttcctgcctcnggattactccgccttctcgtggccccatctgttcttggcgttccgcacgcttgcccgtgcggccgggcagggctggcagcagcagcccggcagcgcgtgcatcttgccgacccctttcccaagaaccagtggcaantttggcttttccgcctgnccntaccccgaanccccgcnaagaatcccaccccaagaaaaaagcgggcctttttgggtgggctggtgncatccctcnacncccaacgagtttgggtgagntttntgaacnagacantcaacaagacagngagtgccgtgggtgtcctcctccggagagggagggaatttnccgccgcaaacatgggccaagcgggagccctcatntggggnaacgnncactngccgtcaaccaagcgctcaagttacaagatgtctcctgccccgcgcagcanatgcggagtcgcatgtgtaagccncctancacaggangaggcgncgcactcacgcgaagggaacccccncang

SEQ ID NO: 84345 - DNA, 639 bp, Triticum aestivum
  unsure (1)..(639): unsure at all n locations
  Clone ID: PAT_TA_84345
naccgcngccgcatcanccgcccgttgccggccgtcgncgccnggcnagcggcttccgccccnattcgccgtcgnagcgcgccgagccccgttccagatcgccgcggcgcttcctgccgccgtcggcgcggcgcagggttgaaatctatttgaccactccagttataaccatttctgggctgaagatgcttccgtcnaatggacatctgggaaactggtaataagtatgcgctggatcttcctatgcttccaccacctggactatcaaatgggtctttccctgtgggaaacagcccagtacctcttcatttttggataatcttcaccttggttgctccaatggaggcaaagaacgctganttcaagatggtgaanattccttgccttcaaagaagncatttacaattccagatgggagctttcccaaattgggcgtgagcaagatgcaaacccctgcattggaanggtgttagagtggatagccatagcaagagangattgatcngatcctggcatacaacagttaattgggccatacaacccgaaatggaaagtaatcantgcaaaccttgtactgcagggaaanttganggtacnccnctgaangggaattgacaagtgaaantgttcaaaggaatt

SEQ ID NO: 84346 - DNA, 609 bp, Triticum aestivum
  unsure (1)..(609): unsure at all n locations
  Clone ID: PAT_TA_84346
cctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccnggacaacgtgcaggcctccatagtgtgcctctaccccaaagctgtcaacaaancccggcccgggcggcggtttcgacgccgtcctctcnacctttctaagccnccctggccgacctttgcttaaccacttctaccctctcncccggcgcattgtccgtcaacccaagtccggcncccccgantcnaactgccacaacnaaaggcgccgnntcctggtggaanaggtccngcgtcccccttgggnacctggatacggcttnccnagganccctgaagaaatnatgagcctacctgagagtcactctcngggnactgctncttcnctgcgggggtctcgtcntgtggnaaaaaaactctaaacgacgggaaanccatcacattggtaagatnggncaactgnanggcgggggagaatccacgtggancgttataacaaacgcncanttccccgaaccgcgctaaaaanntn

SEQ ID NO: 84347 - DNA, 433 bp, Triticum aestivum
  unsure (1)..(433): unsure at all n locations
  Clone ID: PAT_TA_84347
nactacncaggactaangnantagggtacncgtanaattgagccgcangaaangcatcgcatcnatcgncttctcnatcagtcnatcccgattcccgagtaccattcgattctatattccgccattgttgatcggctccgctccgccttccttgggtcatcactaagtaacggcaggaaaaggagcccgagcatcccatcccaaagttggatccaatgctgggccatgggagaaaggaatcccgccgccngctggcatacggccnaggagactaagtgttccatcccgagcaacaacnccnacggcgcatctctcccaccgacatccccggcagatccaanctggccggcagtttacctgtccccggatggntaacggngacgccangccggacaanatcacccgcttccaacaagganggggaacaagacaa

SEQ ID NO: 84348 - DNA, 491 bp, Triticum aestivum
  unsure (1)..(491): unsure at all n locations
  Clone ID: PAT_TA_84348
ctgaaggaagggagccgaacgagcaagcaagccaccaacgaaggttgctagggccggagtggatggggttcatgctgcgggtgaggctcgcctccttcttcgtcggcgcggctgccgccgccgcgggcgggggctacttcctctacaaggactacaagctccgccaacgactctctggcctcnaaggtgaaatgtctccaaagatccaactgacactccgctaacgaanccttngaaaagcactccctgcttttggaaggcctgcaaaancctggaggctgcacccggatgttggatacccatcctgatttancctgtccctacgaactttgtttacncctgtttccgttgccccattnctctccttttnaaancaantacctggaccaacaacaaataacctagagttcttttgtactgcaangtctgagctggatctcccctaattcatgccaagaaaanacatgacatcaagancggatatcaagcaa

SEQ ID NO: 84349 - DNA, 363 bp, Triticum aestivum
  unsure (1)..(363): unsure at all n locations
  Clone ID: PAT_TA_84349
gagcagtccaggcttcagatcttcaaagcctgcctcaggaagtctcctgtggctaaggacgttgacttgcatgctcttgccaagtacacccagggtttcagtggagcagatatcaccgagatctgccagcgtgcgtgcaagtatgccatcaagggaagaacatcgagaaggacatccgagcgggagaaggcgcaagaaaggacaacctgaagccatggagaaagacgaggttggacgacattgccgagataatggtgnccactttcnagganccnatgaaantacccccggcgnatgtccatggatgccgacatccggnaantaccagctncgccanaacatccaagcancccgtggttttgg

SEQ ID NO: 84350 - DNA, 463 bp, Triticum aestivum
  unsure (1)..(463): unsure at all n locations
  Clone ID: PAT_TA_84350
tgcaccccgacatcggnatctcctccaaggccatgtccancangaacnccttcatcaacganatatncgagaagctcgccggcgaggccgccaagctcgcgnggtacaacaagaagccnacnatcacctcccgcgagatcaagacctcngtgcgcctcgtcctccnaggagagtcgcnaaacatgccgtctccgagggaaccaaggccgtcaccaattnacnagcattggagcagcctgnagcgtcnacggtttgttaggctccccttcttacaagggtcttccgtcgtgtcctctaccctcccggcctagtatgtgctgtgaaccnttgatttcncgtcggggtgaacaaaggaagtactacttgccgggttcaaaaancgtgccggttgtaatggncncttaatttgacccctattngggnatanattgtatcgggngcttccgtgcttaaaaaaaaaaaa

SEQ ID NO: 84351 - DNA, 632 bp, Triticum aestivum
  unsure (1)..(632): unsure at all n locations
  Clone ID: PAT_TA_84351
caagttttgattgaccctaccctgagagacacccatcgtacccttgttgaactaaagcaagaccctctacacgctgacttagtctcagtcagtcagtcagtcagtcagttatacagcatcgccactcagtgggcttgatcagatatctatcccattattacaatcattttccttgtattgccgtcatgtctcctccggctccagagcagaagctcaagttcaaacaacaacacancagcagcagggtcatccatcnaggagatcatcttcctggcagtgtcaaatgactccaaagctgtaacgcctggcgcctaacgcacatctaatacatccccaagagcanactgtccctcggacatcnaagcgacgataacctttactggccgatgggatgcttgcaaccaaaagtccctgtccccgagtctctacgttagatactgaaatcacccacgagctcaaaaacgaccttacagganaattggtgacgcagttgncgcaaganacaacacnaactgactgcagtggacctgcgaactacacggcaacgagntacanactcgaatcgtgtcatgtcctccagctaaaggnagttcgcgaagtcttcaggcccagcttaganantagccangccn

SEQ ID NO: 84352 - DNA, 400 bp, Triticum aestivum
  unsure (1)..(400): unsure at all n locations
  Clone ID: PAT_TA_84352
ggaaagctcatgcggccctcgcttgccacccggcgagcactatttaggaagcatttcagactaagatgtgaatcctctgcgccattctccaagacatgctgtctgagctgtacctccccctgaccttcgggttttcttttcactctacactggccttgcaccaaaaggtttctgtgtttctttccaaatcctgttggctaggttatcaaaggacatttaccccttgtcgtgatattctgagttggaaggcctgttaattgtgtgaatccgtattaccttttgcctgggacgctatttgccttggttttaaattttttccggtgtaattgttcnaactggggcttacttgcagctgcgactttccngaacacaanananaaaaaaaaacnccnaggggggg

SEQ ID NO: 84353 - DNA, 613 bp, Triticum aestivum
  unsure (1)..(613): unsure at all n locations
  Clone ID: PAT_TA_84353
gtcgtgccgtgccgtctgctccttgcctgctctgctggtctcgccgttgccggcttgccccgtccgtgcgtccatctgtttcctccttggatcctcgacaagcaatggccatggaggaggagcagacaccacccgagctgcgctacctctccgggcctggggcaacaccttcacgtccggaggcggtgccggggtccgctccccgtggggcaagaacaaccgctaagtgtgcccgctgggactctacgccgagcantctcccggacctccttnaaccacccccgcngcgcccgggaacctgcgcacgtggctgtaccggattnaagccgtcggtgaccnaacgaccttctatccgggggacccnaccaacgangctccgtcggngantttgaccgcacaacaccgtnncaacnccacgcaactgcgctgggagcccgccgaagtcccctcaaccggggctcgatttaaccgaaggatctanacgttttggggncggaancatctccganacggtaccaccaattntgtgcnaaaanccatgatggtcnctgtnaagcggngggantccatgtccanaggagttttacaaccatgcgangtgggttaacggaat

SEQ ID NO: 84354 - DNA, 589 bp, Triticum aestivum
  unsure (1)..(589): unsure at all n locations
  Clone ID: PAT_TA_84354
cccaaatccttcgccggcgattccactccaagtctcgatcggaaaagcgcagaagagcaacggaatcccaattcccaaagggacaaggcaaagctaacttctccttcttcccatccttcctcatcccgtcggatcaatgccagcgggagcaaattcgaagccgctgccgaaattgtggccggttgaccggtgtttccaagcccatccccccgttgcacgcggcgaggtagaggagttccgccgtcaactccatccggatcggnttangtcgcggggtgccgacaatttgggccccgctccccacttggggcgccacggtcgctgcgcatgcgccggggtccccgcgcccactgggacccggtaacaccgcacggcnctcgctccgcgtgcccgcccgctgccaantccatgccaaccgccgcggctacataggtagctgcgcgctgggctgaangtcctggaatgcgcgttgaaggtttcctgctgttgtgcttccggtngatttccgccgaattgggtggcaaatgattcggngnaatccacganagaagacgcacatggatanaagatggagggatctatcagnttn

SEQ ID NO: 84355 - DNA, 584 bp, Triticum aestivum
  unsure (1)..(584): unsure at all n locations
  Clone ID: PAT_TA_84355
tggacttgcactggtgcttgctcataattactagttcatcagcaaacaacaaacaatggcaccgaggctagcgtgcctcctagctctggccatggcagccatcgtcgtggcgccgtgcacggcccagaactcgccgcaggactacgtggacccgcacaacgcggcgcgcgccgacgtgggcgtcgggcccgtgtcctgggacgacaccgtggccgcgtacgcgcagagctacgcggcgcagcgccagggcgactgcaagtgatccactccggcggggcctacggcgaagaactcttctgggggtccgccggcgccgactggnccggcgtccgacgccgtggntcctgggtgtcccgagaagcagtactacgaccacgacaccaacagtgcgcggaggggcaagtgtgcggcactacacgcaagtnggtgtgggcgcgatccacgccatcggngtgcccgctcntctgcgacacaacgccgggnctcatcatctgcaagtacaacccgccgggaantctcngggagaccctactaacgtaatcatactacaatnatttatatacctaatttactcagcagctgna

SEQ ID NO: 84356 - DNA, 594 bp, Triticum aestivum
  unsure (1)..(594): unsure at all n locations
  Clone ID: PAT_TA_84356
atcacctcgatatacagcttcttcaggcacagaaagcatctcaggcaattgacaacttggtccaggttggggccgacagattctagtgccaagaccttcactgtgcccagagtctgggtgaagcttcgctggatgacagacaaacatacatcttcacaactagaaataacattgatatcaagaaggagaggtataaggcgactgttgtacatgatagtgtagtatttgacagacgaatagcgcaccactttcaatttcggtgcagaaatgacattgattcttgttggnccttgttgatcaactataggtaatttctcaagtgaaagggtgtcctgggatgaccanttgggggcnacttttggggatccnccttgtngnacaagcancacacataantngccggganagcctggaggtganngcaaggcctcaaccaattcacgcctgaaagacgaagactccnaggggggggccggtacccaatcgcctataggagcntattancgcgccaatgggcgtcgttaaangccngacnggaaacctggggtaccanntaacncttgagnaaacccttcgcaantgngtaaacaaagg

SEQ ID NO: 84357 - DNA, 413 bp, Triticum aestivum
  Clone ID: PAT_TA_84357
cgggcttggacggaggcgctgccctggggaagggatggccttgcgtctcctcagcttgactctggcggctctcctgcagtgcttcgactgggaggtcggtgggtgtgttgacatggccgaaggcgttgggctgtccatgcccatggccaagccgttggcggcagtctgtcggccccgggagttcgtccagaccgtgttgtctgcttcaacatgagtagccggatgcggtcttttccctggatacatgaaccagaaggggattgaagaggttaaaccccttctagtattttgactaggaggaggttaaacccctctaattattttgactaggaggaattaacccctctactcttctggatggtgtaaccaaacatccccgaagaataaataagatggtgaacaaaaaaaaaaaa

SEQ ID NO: 84358 - DNA, 581 bp, Triticum aestivum
  unsure (1)..(581): unsure at all n locations
  Clone ID: PAT_TA_84358
gtcagatgatttttcttgaagttcagcagcgaactgtttcttttaaagttgaaggtgtccatggctccctgcattgagattcagcgtgggaagtgtcctgggatgatacgatcagtatcttacaaaatcaaccaggtgtaaagataatggacagttcctcctgttgagatgaaacgacatagatgaagctatggatgtttatgaaggaagatcttgtggagcctggagttagtccaacctttcaagttaacgatcgatggaattgaacgaactttgcacccgttgggggacgtatgggttgcctccgtccgccgtccgttgcaagtggcaggactcccaccttaagnaagaatgggaacctccatagcagtgccgaantcagtcccgatcttcccgcatcaanttgccggcgaatcctcctggncaaacatcctcctccngcgataaacacgaagntgggaatgggacnaanctcaacgacgtaggcnccaacatttgaaaanancctggggatccacaaggatccggtgataccngctggaanaccaagccgtacatattgcgctcaaagggatgtgggg

SEQ ID NO: 84359 - DNA, 533 bp, Triticum aestivum
  unsure (1)..(533): unsure at all n locations
  Clone ID: PAT_TA_84359
gccaccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctccgtgcgtgaggagcactgggctcagctcacttccgggctgcgccttcccctacatcagggcctcctcttccggctgcgaggaacctcgagcgctgagggcgatagcacgcaggcgccccctggccatgccacaatatccgagtgggggagaagacaaagatgggatcaacgggttggggcggttgggaagttggcctggcgaattgcaaccagcagagatgatattgaagtgtggtgtgaagacctttcattgatgctaagtaatggctatattcaagtatgatcantcaaggccgtttaaagtc

SEQ ID NO: 84360 - DNA, 593 bp, Triticum aestivum
  unsure (1)..(593): unsure at all n locations
  Clone ID: PAT_TA_84360
ccagcacctcgtcggtgaagcacagggggtgcatagcccctccgtatctggacatgtcgtggcatgctatttacggttgttgtgtccggggttgattccgaactggtatttgatcagtatgatcgttttggtggccacgatcttgcgccggagcacgtcctctagatccatagatggacctggtcgcactaccctttttgtccaggagcttgtgtaaatcatgtcctggcttatgtgcggtgtcagtagctgctctaccgcggccatgaggtgggtcggtccgggctggatcggccgtattattcttcgggtaagaatgggatctatgacctccgtcgtcgaaattccgagcagcaacttgcgctttggggtaactcctttggngtggcgatcgtccgccataatttttctcaagtgtctaacactttgttcaacctgcggttgagcgtacccggcacggccttaannctttgcttccgctccttnaggtcctcncggtggccataaacctccggtggagtcnctggtccaaangtttcccggatnataatgnacancgccggacaacctctcccggnggaagttgtnatnnc

SEQ ID NO: 84361 - DNA, 381 bp, Triticum aestivum
  unsure (1)..(381): unsure at all n locations
  Clone ID: PAT_TA_84361
cagaagtcggcgctgcgtgaggcgtacaagaagaagaagctgctcccgctcgacctccgccccaagaagacccgcgccatccgcaggcgcctcaccaagcaccagctctccttgaagaccgagagggaaaagaagcgtgagaagtatttccccatgaggaagtacgctatcaaggcctagatcagtgaaagaacatttatcctgtcaagttttgctcaagaagttacttgaatttgagacaaatctatctccatccaagtactatgtagctggatcaactgcatggatgaaaaacgagtacttttgcttgtttaaacgtgctttacatttcagtttccacttatcaccattgggaatggaatagtagtgatcgattaaaan

SEQ ID NO: 84362 - DNA, 468 bp, Triticum aestivum
  unsure (1)..(468): unsure at all n locations
  Clone ID: PAT_TA_84362
gctgcntctgcattgcattgcatgcacaggtcgcgcccancatcagtagcggtcgccgccatgcagagactcgtgcgcgtcctcgtggtgctgggcgtggccgccgcggcgtcggtncaaggtccgacgggnggcgncancgacgcccacgcccacgccggnaacccccgcggcgcccgcgcccacgacggcgtccancancatcacggncgtgctggccaaggccggngcagttcancaccttcatccggatgctcaanntccacgggcgtggcgtctcagntcttcagccagntcgncagngggcgggaatngtgtcaaggtgttcgcgcncaaggncagcgtgttccaagtcgctgccctcgnggtangctaactcggctgttcggncaaggtcangcnacggctngtgcaannccatgngggtgtngcgcnatcccnaanncgtagntcgaatcgtnaggaacc

SEQ ID NO: 84363 - DNA, 376 bp, Triticum aestivum
  Clone ID: PAT_TA_84363
gacggcggaccaggccttcaagtttgccgagcagctcgcggcgaggaagtgggacggaggcgtctacgcgtccataaggatgtccatgtaccctgaggcctgcaggtcagttggaatcgtcgaggagagcgatgaggagaagcggaagcacttcgcttctaagctctaacttcgtgattggctgatgagagggtttctgtggaagcatggaggaacctacacattctgtatctgtacatcggtccaaccattggcgctgtcgctacgtgtgaagtacacaccgtgtacttgtgcagaccttgtaatttttacttgcctggtagcgggaaataaatcgaactcctctcacctttcttgaataattgccccaaaaaaa

SEQ ID NO: 84364 - DNA, 209 bp, Triticum aestivum
  Clone ID: PAT_TA_84364
gccgcccaacttttgggttcacgagttgtacacaccagttcagtcaggttcgtggcttctgtgaattaccgagtcgtaggcgatcaaataggaagttgcagagtttctatactgccaattttctcagctcttggtgtagaaaaacacagttctgagaaggttcatcactggacgctgaccacgttcacgttctgtttaaaaaaaaaaaa

SEQ ID NO: 84365 - DNA, 593 bp, Triticum aestivum
  unsure (1)..(593): unsure at all n locations
  Clone ID: PAT_TA_84365
aggaatacagccgcacgtgaccatctatcacttcgaccttccccaggctctccaggatgaatacaacggcctgctcagtccgagaatcatcgatgattttaccgcttacgcagacgtgtgcttccggagcttcggcgacagggtgaagcactggatcacggtgaacgagcccaacatcgagcccatcggcggctacgaccaaggctacctccccgccgcgccgctgctcctacccgtttgggactggggcgtcacctgcacccacggcaatccacgacggagccgtacgccgtcgcccaccactcctggtccgcgcatgcgtcggtgtgtccctctacagacgcaaagtaccaaggcgagcaaggangacggatgggctgacgttgctgggctgggtggtatgagccaacgacgnaagacccgaggatgtnagaacantgccaaagaaatattctcncttggatggtcatgatcccctggggtacggngataccgcccgtganaaaaggacttggggnaaggcgcctcccttacggccaaatcggcatgggcccggtcctcaattnttggataacantagggnatctgncann

SEQ ID NO: 84366 - DNA, 628 bp, Triticum aestivum
  unsure (1)..(628): unsure at all n locations
  Clone ID: PAT_TA_84366
gtttcctctcgctgagctcctcctaccattagagtgttctccagttgagtatttccggctatggcctagcctaccagccatggtggagtgcactggcacatacacatatgaaggcagtggtttcaaggccaccgctgctcagcagtatgacagctctcccttcctcagtggattgaagtcgatttcttctaagcccttccatcaagctgctcacatttcatccggacagtagctgggatccaagtatgttatgcagcaaagacatgggttgggtggtttggtggggcatgatgatatttgggggcaagtgaagcaagccggaatgttgattttggggtgatgagaccaccacatgatctggcaatcctcatgcgcgcatccggatgancccacaacgaagagagtcaaatccgctccaagggctgggtgggatgatanaccgacggcgctgtggatacatgcctgaggatgaggtgnaagagtgtggccgccgagcanctgaagtctcaaggagaggatgcctgntcaaggaaccagcaaagnccaaccgcaaggncgtnagaggaggaagggacgaagcnacgggactaatggnttggaanccanggncctcnggtctcaagtacgg

SEQ ID NO: 84367 - DNA, 603 bp, Triticum aestivum
  unsure (1)..(603): unsure at all n locations
  Clone ID: PAT_TA_84367
gcggtcgatccactggcgtgactcctcggtgaactcgaaggccgggtcggtgagcagctcctccttgagcgtcttgtagatccgcgcgaaggccgccctggtgtccccgccggcgccattcccgcccgccgccattgcctcctccgccctgcggcgacgcggacggggccgagagcggtcgagggagtgtgagtgtgtgactgggtgtcgccgcactccgccgctgcgcagtggccggctccgtgccgaatccggcacgaagcggacggntcatgggcgccgtgacctgacgatcgcgaacacggcgggcccgnacgcgcaccaagccgttggcgtcccggccacgggcgaccgcacggtgctgggacggcgntggagtgctgggggcaccaaagacacgtgtacgcgcacgcagcgccangtctaacccgggccgcgtggcggnacgttcgcttccncttccggactccgccgcggtgtccangaacgcctcctcgtctgcgcggagtgcngcggagaaggcgagacaccctcacggncaggcgnacgacggcaaccacgggatgtgtancgtgtctaaaggancagataatgcgcttcnca

SEQ ID NO: 84368 - DNA, 613 bp, Triticum aestivum
  unsure (1)..(613): unsure at all n locations
  Clone ID: PAT_TA_84368
gcgacgcgaaggtcagcacggacaactctatccctccgccgcgaccctgaccccccacctcgtcggcgatgagtttctcttccaacggcgggaagaagccggctcccggcggcggccgcaggggtcccgccatccgcacgctcgctgacataagccgtgggcccgccggcttcccaggtgccggaggcggcgacagcggcagcgacgacgacgagccacaggaatactacaccggtggcgagaagagtggaatgcttgttcaagatccaacaagaagaaatgatgntggatgcgatattttgaacaagccagacaagcgggtatcaaaggaatgcctcctcctcttgggtgggcgagcttccaagtctaggagttttacaagggactgggccgattctttacagggggagacatacatctgctgnacctcaaggaaccaataccaattcgagtacgccacaatataatttgtgggacaatggtttantgtggatgatgggccacngagatactacgacgatctgaaatgcaggtcctntagagcttaagatgtcaaagtgcccaaggagtggtgctacgatggnacatgtgatcgtcggtataaagntgaann

SEQ ID NO: 84369 - DNA, 441 bp, Triticum aestivum
  unsure (1)..(441): unsure at all n locations
  Clone ID: PAT_TA_84369
cgaacagcaggcgccgctgctcgagggccgctcgtcgtcgatggtggccaccgcggtcgagctcgcctgcgacgccgccatgctactttcgtgctgctgttgctgcttctgctgcggcgcttgtggtggtgaggaaggacgatcctctaacagctcgctgatgcctgacgctgagcgccacctccaagaaaccaagagaactcaatagatnaagggaaagcatataatgcatgcagctgtaacgggccgtaatcaaattaattggtacatatggagtttccattcttcctgctgtttgtggccccngattaaatgccactgacaagtatctaattgggtcatttccnatttcncaattagaatttctgcaatgcagtccatatttaacctgtatacccaataccgtattattaatttcaangnaagttcaactgcatttcc

SEQ ID NO: 84370 - DNA, 578 bp, Triticum aestivum
  unsure (1)..(578): unsure at all n locations
  Clone ID: PAT_TA_84370
accatgattaaagatagcttcgaactgcagaaacaagctcttgcaacgaacgcagttgagaagctcagcaaccatctgctagcgaaaccattggagacaaggcaagcagtggccatattgcttgcgttatctgaactttgctcaaaantccgatcgaaccgagtagggctgatacantcgttccggcgggaggcatggcgtcccgaaaanactcaanactacctcggncgggnnggcgtccgcggtaacncccgggncngggaagttccccaagcaaggagttaagcctggggancttgcatcatctccaaggagtgttggcccttacaactcctgcccaaacaaagtactcnttcccaacnatgctgcaaaccccaagattaagtttttganttgtgnaaaaactatgctgatggacncanagaagatnactatctaagacananttcaaactgtctcacaagnctgacatgaacgggcaantaattngatttccaatgnacggtcncgnaaaaccacgtttgaanagggcnatcananatcatccaggaattatantaaactgtcantcagaanag

SEQ ID NO: 84371 - DNA, 446 bp, Triticum aestivum
  unsure (1)..(446): unsure at all n locations
  Clone ID: PAT_TA_84371
gcaccctccacctggtgctccgcttgcgaggtggtatgcagatctttgtgaagaccttgactggcaagaccataaccctggaggttgagagctccgacaccatcgacaacgtgaaggcgaagatccaggacaaagagggcatccccccagaccagcagcgtctgatcttcgccggcaagcagctggaggatggccgcaccctagcagactacaacatccagaangagagactctccacctgggtgctcccgcctccgcggtggtcaagtaancatgggtcatttaactgctgctgtacctgggtatctgcgtcctcttggtgcctcctggggtacccccnatatggatgtcntcctcnaanaaatctgtggtttgttttcnataanctggttgtgttccctgggttaatgactgttgttccnccgtgttgttccaaaatctcctga

SEQ ID NO: 84372 - DNA, 527 bp, Triticum aestivum
  unsure (1)..(527): unsure at all n locations
  Clone ID: PAT_TA_84372
aacgacatcctcgtcgaggactggctcaagacgcacggccccaacgaccgcacgctggcccaggggctcaagggtgatcctacctaccttgtggtggagtccgacaagacccttgccacctacgggatcaacgccgtgtgcacgcatcttggatgcgtccgtgccgtggaacgccgccgagaacaattcctctgcccctgccatggttcccagtacaacaaccaaggcaaggttttccgtnnggcctgcactctgtcgctggccctggtcacgccgacgtcgacgacggaagtctcttcctgcgttgggtgggaaccgacttntaagaccggcgacacccgttggtgggaaataagcaccaantcccggcanatctcatcctgtgatatttnacctcctgcatccctaagaacctgctacataaatacccctgctataatcactttccttgtaccattatattatacatctatggaanaagagaactttaattgatatacatccatttgaggactaaaaaaaaaaaa

SEQ ID NO: 84373 - DNA, 293 bp, Triticum aestivum
  unsure (1)..(293): unsure at all n locations
  Clone ID: PAT_TA_84373
tcgtcgtcggcctgcccancaagccgctccaggtgcctgccttcagcctcgtcnccggngggaagcgngtgnccgggagtgccggaggcggngtcggngagtgccagnccatgctcgactttgccggcnancacgggatcaccgangntgtggaggtcgtcnggatggactacntcaataccgccatcacagcgcctagagaggaacgatgtcangtacngntccgttgtcanacgtccccgagcancaagattnggangtagcatcacattcccaatgttctgtcnatngac

SEQ ID NO: 84374 - DNA, 557 bp, Triticum aestivum
  unsure (1)..(557): unsure at all n locations
  Clone ID: PAT_TA_84374
ttcgtctgcggcggcggcggcagcagcggaggaggtagacgagatgctgtccgccgacatccccccaaaccagaccatctacctcaacaacctcaacgagaaggtcaagaaagaagagttgaagagatcgctttatgccctgtgctcgcagtatggaaggatactggatgtggtggctctgaaaacacagaaactgagagggcaggcatgggtgcgtgtttaagccgagattacagctgctaccaatgctttcccgtgggattgcaagacttttgatttcctaccgcaaaaaaatgcgagtanatttgcanaaacaaatcagactgttatggcaaaagaaatggtactatcactaaggagaaaaggaagaagcaagaggagaaacttctgagaaaaacgacgacatagagnacacaagtggcccatgctgctgtgccaaacatggactggtataagctctntctgggaagnttccaagacaactgtccccgaaaaaanctctnatcanaactncaagccaacncncatgtccnaatctgtcaaaattccggtccgga

SEQ ID NO: 84375 - DNA, 530 bp, Triticum aestivum
  unsure (1)..(530): unsure at all n locations
  Clone ID: PAT_TA_84375
gtttttttttttttttttttgtagaatccataccctagcacgaactagtatatccataccaaaggtaacaagtatataaacgttctcagagcaaagtaatgtaagcttcaccttcggttcctacatactcctagtacaccgctacagcagaaaccaacagaagaacagctgacagatcaggcatcacttgcccaggaaatcaatcctgaaagaacattacaatccacgggcatctcaccatgtngattagcatcatgatgccgcccnggtgtgcctccttttggngggacatccggagatgaattatccngtagtatcaaaggaatttaacttcatgctctttgtgggcactttatcagcggtctaaggagactatgtcagctcaacaaacatggaatgggaattcttcngaangacanatccgatggtgtcaatgantgttctcacggtgtttgncnagatgcatacncacctnttgtggngtaaaaacatcgnatatcacaatganactcatttttganatcccataa

SEQ ID NO: 84376 - DNA, 398 bp, Triticum aestivum
  unsure (1)..(398): unsure at all n locations
  Clone ID: PAT_TA_84376
tggagtggtgccgtaagtcatgatgcgcacacatcttccacttaatgcccaatcaccacctatctctgtctaaacttctcatcacgtcaatattttcaaacccattaaacccttgtctcgaatctttccatttcctcccaccaattacctctaaccacacacaacgtggttaatccactgtacatgatcattgtaatgtctaagtattcattcacttggattaacacatttcatatttgtacatgcctctctgttcaagtgtaattactttgnatcaacttgccttcttgggagccgtgtgcctgaaantgcattcttcagcatgggnaaaaactgtgatgatagatattaaaacgaatattgngtgttaaaaaanaannaaaaaaccncaggggggg

SEQ ID NO: 84377 - DNA, 424 bp, Triticum aestivum
  unsure (1)..(424): unsure at all n locations
  Clone ID: PAT_TA_84377
atggnattcatttttgccattcaaaatatgtagtgatcttgttcctcctacccccacccacccaaaaaaaaacgatagccctgctctgaattatagtncaaaaaaggagttgccattattgtcaggaatngttttgcagggagcttgtnatgatttaaaaagcagtaaattgttcctgaagctacttcaaanctgtcctgcctaactgnggaacntgnatgtaatgtcatgcacataccgcggtnnaggcaaaagcttntcactttgggacactcnagtctaagcngcacaagcatcaanngggnaaatcgtaaaacacttgcngcactttcggtgaccatcaaactttanggtcacaaatgttntccntataaagccttcnaanaccaaccaggatcancgcctcaagacgaatgttctctaa

SEQ ID NO: 84378 - DNA, 273 bp, Triticum aestivum
  Clone ID: PAT_TA_84378
aaacggtacaacgccaagggtcgatagacacatgagggctcgaataaacatacacttctacacggagaccacaatagggtattctaagcagcttttattctatgcaagcgatacgctgatctatgcctagatccaatcggaaacccgctgactctaatctctcctctgtttcctgtaagttatcgctgctctccgctgtgcttcctgatgtccccatggtccaaacaaactcaaaacaaaatctgggtgccatctatgtgtggtcaaaaaaaa

SEQ ID NO: 84379 - DNA, 513 bp, Triticum aestivum
  unsure (1)..(513): unsure at all n locations
  Clone ID: PAT_TA_84379
cccgcgtccgctgtgtgctctctcgctctctcggtggaagttggcgacgactgggcgaccgccgccgccgtacgccaggtgctcaggtctccgtcagacccttcgccaggtcttcttcggcggcgagcaccgccagggtgtgcacccaatcttcttcactgggtcctccgctgcttctagtcacgcatctaaatccggagttgccaagcattcgcttgaggtgccggaccacagcacaccatcatgcaggctagcgataggttcaacataaactctcagcttgagcatcttcaagccaaatatgttggtacagggcatgctgatttgtccagatttgaatgggctgttaacatccagagagacagttatgcctcctanattgggcactatccaatgctaacatatttgccaattgctgaaaacgatcnatttggaaganaacttacaattncatgcaaaaaatgctgctcctngnggcttctcccganaaanatgaanntgaaganctactgg

SEQ ID NO: 84380 - DNA, 652 bp, Triticum aestivum
  unsure (1)..(652): unsure at all n locations
  Clone ID: PAT_TA_84380
atcgttttccatcctcgtcattcagtggtaatggttcatctgcaatatatcagaacaagagctccaccacgcagcagatgggtatgcagaatagaagacctacaactacatcagcagctcctacctatcccaataggatgtaccctagcccccgaccgtacacccagtatgggaattcagtaaaaactggtcttccctacgggagtaacggttatgattccaaggatatatggtcgatgtggtcttggtaatgggtatggataacaggtacaggcccagggcatgtagtgggatactatggttatggcaatgagagtcaggatggaacaattgagttaaacagaggtcctagatctggccggttcaaagaaccagaaattgtacggtcatactgtcactattgctgtgaaaggcatctctcccttctagtgaaagcaagaatgatagtgctgtgcctgatagagcaaatacaatagagatgactccctgttcaatacgatgctgcaaagtcttgtcattaaatcgtcancgaggatacatcacaagagctaaatanatgttggcaanacaacaacggaacanaactgagctgctacaagaaccatcaanggattgatgccaaatctgtctccatgatnatngcanttgtgtg

SEQ ID NO: 84381 - DNA, 374 bp, Triticum aestivum
  unsure (1)..(374): unsure at all n locations
  Clone ID: PAT_TA_84381
gcgaattaacccgatgtccataagattatgatatattagaagttcgaaacacggaaatgcggtactcatatattactgtttgacagtggcttagagtggtcgaacccaacaaccgctaacaataagcactaagtgataataatactacgaaactaagcacgtcatccaagaatactctccgatttcttggaccgcgacccaaagactttgccaacggccaccaagcggcggtagcgcctctcaaccgccgaatccgttagagggtgcgaccctggcgcttngagggcgttagacgactccatggcggtgacggtcttgcggcgggcgtgctccgtgtaggttacggcgtcgcggatgactctcnaagggggggg

SEQ ID NO: 84382 - DNA, 636 bp, Triticum aestivum
  unsure (1)..(636): unsure at all n locations
  Clone ID: PAT_TA_84382
gccgtgcatactactcctctcccagactttccttggattttttgtttctttttaatttctcgttcgtccatctccgttatctctgaatttggaggcagaactgaagagagagctagaagcgggtgacccatggcttccagcaagcgcgaatacgaggacttcgtgcctccgcacaaaacggagcgcgagccggccacccacaccctcaccgtcaacctctccggccaagggttcaagaaggagcacgtcagggtgcagatggtccacagccaacggcgcctgatcgtgcgcggggagcgccccgtcgacggcaaccgctgggagacgcttcggctcgagctcctccgtccccgacggctgcgacgccaaggcatccacgccaaggttcgaaaacgggtcttccgcgtcacatgcctgccgtcccgccgggagcaatccngtcgtcgccaacgctgcgaacaagacgtggtgacgtnccgccnaaggcanaagacaacaagcacaaaccgcggaacaagaacnagnaaccctggtgactcgcaaanaccggngtatacaananaacacgggccgtggngtacaancnccctcgtatcaaggtcccaaaancaaatgcacaagggtttcggggncccc

SEQ ID NO: 84383 - DNA, 606 bp, Triticum aestivum
  unsure (1)..(606): unsure at all n locations
  Clone ID: PAT_TA_84383
gctgaacgtggacggctactacaactcgctgctgaccttcatcgacaaggccgtggaggagggcttcatcaaccccagcgcccgccgcatcatcgtcctcgcgcccaccgcgcaggagctcatggacaagctcgaggagtacgagccttaccacgacatggtggcgtccacgctcaactgggaaatgggcaacctgcangggtactgacgattgacaacaacactgcgcatgcaaagagcccgccaagagagctagctaggcaattgcaactagcgcgcggcgcctgaatctgatgaagcacagccggggaacggggcatcnatncgtggattataaacaacgagcaacttaactagataccgtctcaactacattgggatttccttttcttttaataaatcnacgcaagtctccgtttggatgccnggcnaaggaaaaaaaaaggtttggttgcctaactnacaagatattctaactgcaactacttgtcgtaaagatccccngtaataanttgttcacnggatacacatatgctgaagttcttaccaatagaaaaaactgcgntccgcncnccgggtattcgtaaagttaaccgacgcattnac

SEQ ID NO: 84384 - DNA, 264 bp, Triticum aestivum
  Clone ID: PAT_TA_84384
aagaaaccaggtatagagggccattgagctgttcataaggcaccacgctagagtaccaaggtctcaagcagtacatatatatctccagtgatcgattcgttttgctcttgtaattgtggaactactaggagtgtgagtttacgagtctgggttctacttgacatgtttcacctgctcgtgtatgaagaaacaaggccggcgagcttccggttgcgaagagtactgtcgttgcaaccagtatttttttctgggaaaaaaaaaaaa

SEQ ID NO: 84385 - DNA, 632 bp, Triticum aestivum
  unsure (1)..(632): unsure at all n locations
  Clone ID: PAT_TA_84385
tcccagttcactccaggcccagggcgcccggtcgccatgaactcccgctcctcctccggcggcgtgcggtccgagagctcgctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgccgccaggaacagtcggagcaaccattgccagccccaccacagacctttcctacgccgcgccactgcgggtggatggacctcccccaactccgccagctcgcangcctcgccgacgagtcccgatgcttctcggtgaacaagtggaggcgctctttgagctctacaagaagataactgctcataatcaacacggctcatcaaaaggaanaatnanctggactggtcaaaatcaaacgggagatcttttctgannaanttttaattgttgatnanaaaaaaatgngtgatcaagttgatgagttatcatcctaatgtctcaaccctngaacaatnaagnnagtcatcaagcanttcaaagttnattgattaggtgnnactanaaacnggttattacta

SEQ ID NO: 84386 - DNA, 646 bp, Triticum aestivum
  unsure (1)..(646): unsure at all n locations
  Clone ID: PAT_TA_84386
ctcgatcgacacacgcagccgcgacccatcgcgacctgacccgaccctcccgaggccgccagccttatcctctccgcctccgcctcccgccgtcccctccgacccatcacaagcgcgagtagaagacatggcctcgacgttcggtgccacttctacagttggccttatggctgctccaacggggaaagaatgtgcgccttcaagaggagggctaacttcaagagtaaaagcggctaaggagctgtacttcaacaaggatgggtcaagctatcaaagaactcccagactgggagtccaataagctttgcaganctaantttggnttanactccggaccgaagggaagaatgtcgtttttgggaaacaattacgtctcccaagattgttaacgatggcgttacattncaagaaagttnaactggagacctgtnggaaaatttggactaaatttggcaagcaactgcaactaagacaacattttgctgggagatgggacaacactctgtggccttgtcaagggtgatgctaaggtgttaagcntggaactggtgcaatctgttanattacctggaatnagaaacactaagcatagttaaaataaggantncaagaggtanaatacttcaantctcattagtganacata

SEQ ID NO: 84387 - DNA, 200 bp, Triticum aestivum
  unsure (1)..(200): unsure at all n locations
  Clone ID: PAT_TA_84387
ttcancgancagcctagagccganttcaccgatcagnctagagccaaattcaccgatcagcctaganccgatttcancgatcagcctatacccgaattcaggcgctcagctatgagccgangttcaccgatnagcctattagccgaatacaccgatcagcctagagccgaattcaccgatcaacctacanccgaattcac

SEQ ID NO: 84388 - DNA, 610 bp, Triticum aestivum
  unsure (1)..(610): unsure at all n locations
  Clone ID: PAT_TA_84388
tcgagttttttttttttttttttttatcacaaaagcgaatgaatattacgataccaatcacgtacaacatatataggcagtcaggccagaaaataatatttcgccaaccttgttactagcttcacctactaccgactccgactccccaggggatttcggtctttgattgagggttcactactagcagtatacacgacacaaataaaataataacggtacccgttccatgcggtaaatggctcccatttttcgtcaacatcctccccacctttccctaccatcanaacctactcctcaagccctcaacgatgtatgtagcatacaggccatagaggctgtatggttcataagcggcgctccgctgggtagaaancattcacagaactccttgttctcattcttcctgtatcctccgaagaacgcctgatttcagccagcggtgaggtgggagcccttgatacatggtaagctgtcncgggatataacgccacngnatgatttgtaacngctccccgataacacggaaaaggcnaggctccanttgaaaacctganaaggccngataacatcacaagtatgntaaaggtggggaagancaatgnggaaacnt

SEQ ID NO: 84389 - DNA, 627 bp, Triticum aestivum
  unsure (1)..(627): unsure at all n locations
  Clone ID: PAT_TA_84389
cttcaacaaattcttcttcctagcttgcaactaagggcatatatcacacacacacacacacgcgcgcgcacacagaaaaacaaccacacaagggagcaatcgaactgatgtatgcgtagtttgcagggagaaacttcacaccatgatgagctgcaccagaagaacgagtgcgatgaatcttgttgtagttaccttgctcatcgtttccttgctcactgttcacctccccgccgtcgcctgtgcccggcaagttgccgtgctaaacccatacaagaatgaactgggacaacagaggaaataagaacctcggcgcggcgttggcggccaccgcgtcaaccgacgacgacgatgtttagctgccagcggcaagtgttcccaaggcggaagctcggtgcgccgaacaaagagggaacaaagcaccgtgggaacgacaacgacactcggagcangtcacgggcgcggacgtgaanatgccgcaacgcaagnacgcngcgacaagcaccgagatttcgacatctcaggagggataccatcaaggnaaccccgccgccataacaangggcacccctcagtgatanaacctactccaaaattnctcacgtactntaccgnctaaacaantncctc

SEQ ID NO: 84390 - DNA, 542 bp, Triticum aestivum
  unsure (1)..(542): unsure at all n locations
  Clone ID: PAT_TA_84390
ggtcattccacttccaccaatctgtctcccaatctttcttgctgctccaattcgctctctttactcggccagcggaaggggagaggagggcgagatgacggtggagaaggtggacgcggggctttccgacttcgacgcccacttcgatcgcctcttcgcttccccggacgccgcctccgacggcaaggtgaagctgctgctcttcctggccgaccgcaagcctggctcctccctctcctggtgccccgactgcaacgtggcggagccggtgatctacgaacggctggaggcactggagggcaaggaccggtgctcctgcgcgcctactcggggacaagcccacttggcgcgacccggcgcaccgttgagggtggacccaagttcgggctcaagggcgtnccaacgctgatcgctgggangatngcgccgccgcgcccgcctcggngacacaaggncactcaaggacaaggtnaccctcctcgcgctggggnaacgaatatganaattggttccttcggttcactnntaaatggcataaaaat

SEQ ID NO: 84391 - DNA, 478 bp, Triticum aestivum
  unsure (1)..(478): unsure at all n locations
  Clone ID: PAT_TA_84391
gtcgcctgtgaaggcgccgacaaactgatggcacagatcagccctggaggatatggagttatccagcaagtgcatgagccaggatctgacgttgggcttgagcaccagcaggaagtagttggcaaggatcttgtcgtcccgtcccccaagcagcctacaccgcaatgggtgtagatgctgaggaactcccgacggatgctcttgctgtccgtactctctgggtacgtctggttgaantcttcntgctggggcactaacttncccgcagctcacggggtgaacgcaaggcaacctaccgcgttagcaatcccctgggtccccttggcgcatgcattcaacaagagggccaacgcgcttttccgttgactccccttctcgtcngggtccatggganaacancnctcctgctgnccattctnaanaatttggctgatnncaacactccnggttccacatcgtggatcctaccagggttcgg

SEQ ID NO: 84392 - DNA, 634 bp, Triticum aestivum
  unsure (1)..(634): unsure at all n locations
  Clone ID: PAT_TA_84392
ttgatcctcaaggccacccgtggatcttgctgcaggaggtgtgttttggagaaccaacctgagatgcaggtgggttcttgggccgtgctcttctcgagcatgagggccatgaggggtttgctcctctgcccctagggcgaccaagaggtcctgccctgaggtcaagcacgtccacgccgacccacgacgacacgtagcatctccatctccctctgcttgctattgctgctccgaattatacatgttggcaaagagatgtccctgttttcctcaatactatgcactgctatatttatgtggctgtctttgtgtgcatcttattttgaaaccaactgagaactccatcttattaagtggttggccncngtgtantcnaacgttgctctcaanactccccgtccctanatttcaattgcctttgttgcccgcccattaattaataaaacggcagttncctgnaatanggtgtaaaaaaatnaagggggctccacaaaanataaantttaaactgcaaanagctgtgtaccaaaanatgaaantgtgtgttgtncctcatcaaaanacaccttanccatnatggacngatggtagtanatgagnttcntnattaaaaatgagtctatnaaaaaaaana

SEQ ID NO: 84393 - DNA, 573 bp, Triticum aestivum
  unsure (1)..(573): unsure at all n locations
  Clone ID: PAT_TA_84393
ctttgtcgccacctccgcgagcctcttccccgaggcgagaggctgctgtgacgtcccaggcagcgccacccgcgtcgccatctccaccaggcacccaccaccacgccttggccgccgggccctccatgcttggcttggcattcgctcgtcgacacaggacaggaggatatatattgccgtgctcgcccgccttcttcttttaggaatcgtacgtactcctacataagagaggacgcggacgcatcttcttcttccctcccggaacctgagggcaagggcgttgccgcccagccgtgccacccacgatcgggtgcgtaaccatggccgtcgaagcgcatcgcctcctcctgggcaggaggacacaagcagcagaacagcagcaacaactcgccaagcgcgggtgggcttgggccggcgccgacgaaataggtgcccacgacggcaagacgaacaacncatacancaacaacaaaaccgcagnaggattnangtccaaagctctgcttggctctggtcacggtctcnanatcctgcggcggnaatntctggcnaccggggaaanantcaccnttt

SEQ ID NO: 84394 - DNA, 460 bp, Triticum aestivum
  unsure (1)..(460): unsure at all n locations
  Clone ID: PAT_TA_84394
tttttttttttttttagacgtggttacactttatatgccgagacggagtgagtatctagatacaatttatatccattggattggatagaggaaattttgcacactagtcatttgcacattgtttcagtctttcagtgaattctcagcactacttttatcactacgtacctttgctactagccatcaatcaatagtaaaagcatatgtatagatatgcatatatatagcggatgcacacgtcgttattacatcatttattcatacgcacgcgtatctgtccgaagagctcggtagatacacacatgcagcagatcgacgtacagcaacaccacaacggaacacgcatacacgggcttccgcgatcaaagtacgtacgtactgaaccagaaaaaaagcgacccacactctgtccctgtccantgggcatgctgctacgacacaggtatcctcatcntcacga

SEQ ID NO: 84395 - DNA, 445 bp, Triticum aestivum
  unsure (1)..(445): unsure at all n locations
  Clone ID: PAT_TA_84395
gttgaagttcaccctctggattttagcactaactgtggcaaaattcncttctattgctgggacactgctgggcaanaanagttcggtggcctcagggatggctactacattcatggtcantgtgccatcattatgtttgatgtcacttcgaggctgacatacaagaatgttccaacatggcacanggacctgtgcaaggtgtgtgatnaacatccccatcgttctctgcggaaacaaggttgatgtnaagaacangcanncaaagccaagcaagttacattccacaagaagaagacttgcagtactatgaatttctggcaaagagcaattcactttgagagccttcctttaccccncaaggaactggaaggaattaaaccttcaattttccaaaccnttgcctaaaccnccggattcaaattgtttgcatcagaacaacataacc

SEQ ID NO: 84396 - DNA, 609 bp, Triticum aestivum
  unsure (1)..(609): unsure at all n locations
  Clone ID: PAT_TA_84396
ctgagcctggcggttccattgcctgaagaatagctttacgcccttgtgatcaatcgatggccgcgccacgctgttgcggtgctcctgcctcgcaaagaccaccagaaagtcctccggtctgtactcatgcaccgagaaccactccggcgagatgccaaccactgcacccaacgcctcaaccacgaactccggggggtgccgcgcctcgcaccacccacgtacgccaccatcgcaaactgaagccgcctctccaagtcctccatggaatgcatccgccgaacaacgcagagctcggaaggcaagaactcctcgcgctgcgcagcctccatcctggggcggggcagcgctggccacgcaggccaaggtgcggcacacccacggacaccggcggtgacggcggggtcggcggncctctggtccctgcgctgcgcngncggattgnccgccangcctcgctggcaacttggcaaaggccgccttgggaatncttctcgggcgacggactgcnggggcgctngantccttggttcctgcccgggaaacantnaaggtaacactggtngtgnatcatntgcggngcctcctcaaagantgaaaaatcggatccgg

SEQ ID NO: 84397 - DNA, 633 bp, Triticum aestivum
  unsure (1)..(633): unsure at all n locations
  Clone ID: PAT_TA_84397
gagaatccgagttccttctgcgtcccttcacccttctcgttgcgctcaccacaggcaattcgaccgttcacagagaattgaatcatggaaggagggggtagcaacacgcccttctaccgcggcaacagcaccgcactcgccaccaacccttctgctgctgctgctgctgctgctgcgaatggggcacagaaaggggacagggaggctgccatcgatgccgagatagtgagggttaacgacctaccagctcatagtcctacgccatacaccgcatgaaggtgctaaacaaattccgtcatctgctgtccatcaaagaggactacatctcaaagatgaggantccaattctcttccgcaanctttcaatctaaagtgtaccttgataagcaatatttaacctgctaggggacccatccttcgcctactctacggtatgtcgttactctcaaacangcttcctaaagttcnaatgaaggatcccttatngccgtcanaaccaaaanttccaattnattgaggagtgntgncncctccaaactggncattgaagnggaaancccnacatgngttgttgtaatgtccttgacaaatgaattcgncgcaaattttcaatacangangttttnctaaaaa

SEQ ID NO: 84398 - DNA, 249 bp, Triticum aestivum
  Clone ID: PAT_TA_84398
atgccttgtgtgtgtgcttcttctcctcttttttggcaattgccatgtgctagaagctcgaactgtaacatgttttcccttgtacacagtacgtgcaaatatctcgtgtacgtgtgacctgtcgtcatggtagtatgatcgtacctacacggacacagcacagaaggcctccgacatcatctgcgtgctcgtcctgttttttacttgaacaaaaatgaaagatctacttattggtccaaaaaaaaaaaa

SEQ ID NO: 84399 - DNA, 615 bp, Triticum aestivum
  unsure (1)..(615): unsure at all n locations
  Clone ID: PAT_TA_84399
ggttatgggcgagcccgttcgtgctccgggcgcgcatcgcgctcagcctcaaaggcctcacctacgcttactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttccccgccgccgcacctaatttccttccatccgacccctacgaccgcgccattgctcgcttctgggcctcctacgtcgacgacaagttctacagcgcgtggatacccgtgttcaagggcaagacggcggaggagatggcggaggcggcgaagcaagccgtccggcgctggagacctggagcaagcgttcaaggagtgctccaangggaaggcttcttccgaggggaaaccttgggctcntcnactcctgctccgcggcttgttnggtggctgtacgcaacgaggcatctgcgggtgaaggcctcaanccgggaagacccctctggngcttggcggacgtttcccctgagggtgnaagggctatccgacttgaagntctggtaacaaggcagcggccttttgctccccc

SEQ ID NO: 84400 - DNA, 617 bp, Triticum aestivum
  unsure (1)..(617): unsure at all n locations
  Clone ID: PAT_TA_84400
aacacccccttccctcgccgccgccgccaccgccacgacccgcgagccatggcgccgtccgccagctcctcctcctcctcctcctccggcacggactcctccggttcctcctcctcctcggggagcgaccgccgcgtccgccgccgccacagccgccgcaaggacgccgcgccgtccacgtcctcctcctccgcgctgaaggtgcgcaaggaccgcaancccgccacaagcgccgccgccgggagaggcggaancccgttcggacgacgacagtacagtagcgcantcctatgatagtgaccgcgagnatctggagttnacttagcatnagaaagataatttaaggatcctaaggaaagagaccaacaaggtagnatcataacggacaagantaacatnaactggattcttnaacggtgaaaatgggtattggttgctggttgctggttgtaantttgttcccttaatgcgganttttncagaagaaagatgaactctacgncngtcaaattcaaattccttggccccagggnagaacgaaaggnggtttacccgggaaaaaaatataacttaaaacaggaaanangngtgaaaaacnaataatgttatttntatca

SEQ ID NO: 84401 - DNA, 225 bp, Triticum aestivum
  Clone ID: PAT_TA_84401
ctcgtgccatcctcggcggcaccatcagtggtctcagtatcggtgtggaaggcggcggcctcatacaagtgaggttgttcctccatctcctgggacagctcccagaatgccttgccgcccgaaccccggcctcatcgttgtgggccatgtttctctctaaatagaaacaaagtttgggtcaaaaagttggttattgtcaaggaacaagatctctaagttgaccaa

SEQ ID NO: 84402 - DNA, 326 bp, Triticum aestivum
  unsure (1)..(326): unsure at all n locations
  Clone ID: PAT_TA_84402
aagaaaaccacgccaacgaccaaagcagctgtcgataacacggcgtgctacacctgcttgcctgcctgcctgcacaaccctcagcagggccgcaggcgagagagagaganagaggnatngagacagcncgantcggcagnggtntcaagcaaagggctgctacnacctgttnccnancaatggnattaccggtctnccagngaggantcnggnggccgctgcagaanccncagcaatggttctnctggcggccgccnngnccgcagnattgaanatggaggcggnccaggcggcnnttggnaaccncggntgttccgcaactgggg

SEQ ID NO: 84403 - DNA, 648 bp, Triticum aestivum
  unsure (1)..(648): unsure at all n locations
  Clone ID: PAT_TA_84403
caacagttcaacaccacatcgagccgagccgggagaatgggaatccagctcagatttcgcttgtctccctccgccgtggtgagccccccgcgggcgacgtgtgtcccgttgcctttccttcgcttcgacggccaggccacctgttggcctcgcatggctctgcgtcctgccaagcatccaagtccctctcgcccggcggcccagcgccgcggcgtctatatagagcagatncgcgcgatncccgccaatccggcaatccgctgcaccctgcctcaacttctctagctcaaccgcatccctggtccggcatgccttgtgcttctcctcgcattccttcctccttggtanctaccccccttnaatcaacaatcaacnggcaacggcgcgcgttctcncaaattgatgcaaagggcggtgaacaactnanagnaacaatgcatatcttgcnaaaaattgttttccaacanaccgatatttcttgcaaatttgnaattnttgcccaaacttgnngcncctttgcaaaatttnaaaacagtttntttcaangncaattggnnaanttaacggnaaantggaaanatacnttattgaactgngatgtccantnaaaagantctagattatancaattaaagttngatataggct

SEQ ID NO: 84404 - DNA, 538 bp, Triticum aestivum
  unsure (1)..(538): unsure at all n locations
  Clone ID: PAT_TA_84404
tgacggtgggcgcgtcaaccgtcaaccgccggttctcagcgaacgtcgttctcggcagtggcgacaccttcgccggcacttccctctatgccggcacgccgctcggtccaagcaagatcccgctagtctacggaggtgacgtgggctcaagcgtctgtgaagctggcaaactgatcgccagcaaggtcgccggcaagatcgtggtgtgcgaccctggcgttaacggtcgagctgctaaaggtgaagccgtaaagcttgccggaggagctggagcgatcctcgtcagcgcaaaggcgttcggcgagcagcccatcacaccccacacatcaacccagcaacggcgtgacttcgccgttccgaaaaaatcaagagtacataagaacaaacggntccccgttgcnacanccngttnctggaacgtcctcnggggaccctnttcccganaaggatctttcnancgnggccaaactcccgcacggaancttaaccggcntacnccccgggtggnactgccncgtgacnggaaaaccccccgggc

SEQ ID NO: 84405 - DNA, 599 bp, Triticum aestivum
  unsure (1)..(599): unsure at all n locations
  Clone ID: PAT_TA_84405
tttttttttttttttttttttgcagagcacacgtaaatgcatagcaaaccatggagacattgagttcaagagtcagggcaaacaggcctcatccacaatgacgttatcggataccccgtancaattacaagccatgannagtggctacacaatgacgttctggcaagcctgggatacaaagccgactcanaaaattgagagcaaaggtacancgtaaaaactaagaggagagccagcaagctagcattttatttagtaaaatcgttcactcgcaggtacccaatcttctcagctttacacactcgccatcttgaggctgttgcccntctcctgcaggctcacaagtangctgtcaaanctcttcttgaaggagtcaangccttcaagctcaaactgctttcancctcttcccagtcgatgccaaanttctcanggnacngtatacacttcngcctaaanncgttgcataacntcttgaaacgggcntggncatnatgctgcancctggccggnccgngtgactttaaggncantaaagtcacataagangcngataacnggtctgnacgtggnncaaanaacttgtcttgacntcttgc

SEQ ID NO: 84406 - DNA, 625 bp, Triticum aestivum
  unsure (1)..(625): unsure at all n locations
  Clone ID: PAT_TA_84406
ggcgcctccccgtggcgctcgcggccgcattagcgcggagatcgagagacaagagagggaaggcggcggcttgccggcttaagccttctctccctccgtcgtcgcctcctccttacgtccgcttcttcctcctgaatggagacgtcagcgccgcccaatgcccccgctccgccggcgcagccacggaggcggttgccggacttccagcagtcagtgcggctcaagtatgtgaagctggggtaccactacctcatatcccacgggatgtacctgctgctgtcgccgctgatggcgctcgtcgccgtgcagctctccaccgtctccccgcatgacctcgccgacctgtgggagcagctccgcttcaactcctctccgtcgtcgcctgctccacgctgctcgtcttcctctccaacgtttacttcctcaccgcccgcgccccgtgtactgctcgactcgcctgctacaagccggagtcngagcgcaatgcacgcgcgagactncatgnatgctccaagctaacggatctnacggacaaaactcaantcancgcaaatctcnacgtcggctcgggaggaactacttccccgcgtctcggtgccctaacntgatgacaaggctaaggggg

SEQ ID NO: 84407 - DNA, 488 bp, Triticum aestivum
  unsure (1)..(488): unsure at all n locations
  Clone ID: PAT_TA_84407
agtgcaaagctatgcacgtaacattcacattttattttgagtttcccttcagcgattacttgttaatatttcagcactaaactatatttggctgagtatatcaatattcaaacttgtttgtgtcgctttcactattttgtgancctttaatcgctcgtgttcacatcttctgtcttggatactatatctgttatttgacctgactggntgcttatttatgantatcanagntaaaaatgatattttgttangttgtcgatttccttgagaaacaaagtagntgctgccngaatctggaacatttcatggacttgagttattaangtacacngacnatctttattccaacaacatntacattaacagantgtgggatcatntgggctttaacaaangaaaactttcatataggatgtccnttanngagtcaatataaaataattnccccaagggggggnccggtacaaattccccnaantgggcnttta

SEQ ID NO: 84408 - DNA, 627 bp, Triticum aestivum
  unsure (1)..(627): unsure at all n locations
  Clone ID: PAT_TA_84408
gctgtacggtggctccatcggtgccgccgtgcagcagccggcctacaagcagaagggcgccgctagtaagactaacggctcccggcagaaggtatacgggtacggggaagccgtcaacacagcaggggcggggtacggtgctcaccacggcgtcgttggcgccggggccgggcagcagcacggctaccaccagaaagatgcgtacgggaccgggtacggcgctgtcgcggtcgttggcaaagagaagaacggataccagtaccaggaggcgtacggtggaactgacgcgggagggtatggcggcgctcactacggcggtggtggcgccgtgcagcagcatgggtatggcggcgtaaccgccggtggcaaagtgaagcagagcggctaccagtaccaggaggcggcgtacggcggaaccgacgcgggaggatacggcgctcactacgtggtggcgccgccgccgccattcagaacacggtacaggaaggacgttncgaaagcgagacngaaacgaggacacgagagcactgcaggangcttccgccgcgcggggcgaatcaggcgggtcaagtcagacggtacggactanactcgngtgtcncctcatctcaaacccaggacacgacg

SEQ ID NO: 84409 - DNA, 631 bp, Triticum aestivum
  unsure (1)..(631): unsure at all n locations
  Clone ID: PAT_TA_84409
gttaatcgcaacaagagaatttcacgcaagggtagggatgataatggtgatgacggtgatgattctgatgacaacagtaatgagaatggagactcgtcgagccagaagaagccaagggttgtgtggtctgttgaattgcaccgaaagttgtggctgctgtcaaccagcttgggcattgacaagctgttccaaagaaaatattggttctatgaatgtttgagaacatcacaagggagaacgtttcaantcatcctgcagaattatccgctgtttcctgaaaagactcancgncagattcaagcaagcangtaacctaactgctgcattttgagggaagaaccngctttatgtnaacattggactanacccttcaagnatncaatgcatatgggagaaccggcatttncaaccactaaccatttacaaccaaacaccccttncaaggaggancccccgcattttgtatcaaggccggcgccttccaaccactnanattggccaaccanananctgacantccnaggaattcgggggatganaacgnacctgntagggnggcaatncacgaggtacaanaagntttcacggccttnggaatntccanaataaaananantggtttaaaaatttn

SEQ ID NO: 84410 - DNA, 609 bp, Triticum aestivum
  unsure (1)..(609): unsure at all n locations
  Clone ID: PAT_TA_84410
tagagacaaaaacattttcgttggtgggatggatacacctcccaaaatgtttttatctctaatttttcgctttgagctctggcacgtctacaaatcactacctccctccgcgaagggcctttcttttactttacgcaatttttatatttgaaattgagtctccatcctctcttataaaagcaccaactaggggacaatataatcgtacttaagtattgggtgtagctaatattcgactgtgtttcatgaatggatcaatgtttgagcatgatgggctanggataactgttttaacattgatatttgaaagacatggttgcttgttgatatgcctggagtatccaaatattatatcaaaactagactattgctttngaacacataaaagacaaagtccatgctatgaagaaaagaatatgatatgacatggataaacaacacccacatcaaaaatccntttttacacttacacccnagggggggggccggtaccaatcgcctataagagcntataccgcgccacggcgtcnttacacgcntacgggaaaccngngtaccaactatnctgagaancccnttccacnggtatacaaagccccacgttcctca

SEQ ID NO: 84411 - DNA, 580 bp, Triticum aestivum
  unsure (1)..(580): unsure at all n locations
  Clone ID: PAT_TA_84411
tctcggtcctggtggagatcaatgagagggcatacgaggcaagaactggtggtgctctcgagggggtaccgcccaggcgcaggggcgagggtcaggataatatgggaaagtggcaggataactttgtctcgtcacaggggcggcagggtggtggcaacaggtttggatactccagcagaggtgcagtatctggtcaaagtggtggtggacaccaagagggacaggggcaatcagggttaccgcgggggctatggtggcgtttcaaggtttcaggatgcaaggggtcgcaaccagtctaatccatcangcagaggtggtgatggtggtgcaccatggtgaacctgaacaaggttggtaaagtttanaaatgataatttcaactcaaattatccctgaaatcccctaaaagcaaattctgatcactgcattttanaaanttcccgttctgggctgatcatcaactgttcctanattcgttgnacctttaaattaagggctaagaattnaacaanaattggacgtttgtggaatntacattatcnncaatattnnacaacnttaactncntaaaaaaaaaaaa

SEQ ID NO: 84412 - DNA, 297 bp, Triticum aestivum
  unsure (1)..(297): unsure at all n locations
  Clone ID: PAT_TA_84412
ctggcattgaacaaggccgaccagtacctaatcaaatgatggctaatgttggtcttccagatggtggggtgccaccacaagcaccaccgcagcagtcccagtttcctccgcagcagtcccagtttcctcagcaaccaggcattcctatggattctattggcctgcctgatggtggtgtccccccacagagtcagccacttccttcacaaggcantttcttccttcaaaagnacaaggctttcaacttgggaatcctgnccaataaaacnattnttntcangtctcccaangggcctt

SEQ ID NO: 84413 - DNA, 378 bp, Triticum aestivum
  unsure (1)..(378): unsure at all n locations
  Clone ID: PAT_TA_84413
cgagtgagcatcgcttcaccatgcgcccttctctctgctgcgcacctctttttcttctgctactattacatttggcatttgctagacctctctttcctctaccgagtaagacaaagaatgaagagaagaagcccatacagacgtttcggccatataacattgctcatcgtggatnaaatggggaaatcccgaggaaacaactgctgcatacatnaagagctattgaagaaggggcggttttaatagatcctgacaccttgccaacaaaagatggggccttgatttggtttcaaagatgttacacttgatgatacaacngatgtttccaagcgttaaggatttgccaatcnaanaaaacctatgaatggtngggttaaa

SEQ ID NO: 84414 - DNA, 321 bp, Triticum aestivum
  unsure (1)..(321): unsure at all n locations
  Clone ID: PAT_TA_84414
caacaagtcaaagcaggagagagagatagcggctgcagcagaaaagctggcagagtgccaggagaccatattgattcttggccgtcagctgcaagctatgcgtcctccagccgagtcgctaggctcttcacctaatcggcaacgcatggaggagttctgaaggatgcggcaggaacaaccgcaggagaatatttccaagaaaccttcaagccaacctggatacagaccaaggatatgcttgggacaaggaatgtgtcnccgattnagtgggtacaagacacacatgatcccttccngatgcggncntaaccttttcccttc

SEQ ID NO: 84415 - DNA, 615 bp, Triticum aestivum
  unsure (1)..(615): unsure at all n locations
  Clone ID: PAT_TA_84415
ggcggacactgctcaaggtcatcgtccttggcgacagcggggtcgggaagacgtcgctgatgaaccaatatgtccacaaaaagttcagtcagcagtacaaagctacaatcggtgcagatttcgtcacaaaggaggttctgatcgaagacaggctagtcacgttgcagatatgggacaccgcggggcaggagagatccagatcttggggttgcattctacagaggggccgattgctgtgtgcccgtctatatgttaactcctaacaagtcatttgatacactcaatacatggcattaataatttctcaancaagttaagaatgattaacctacaaattgtccctgaattttatcatgaatggatataanaactgtatagttttgaagaaaacaagtattggtggtatgnattcacatttacgtattgatacattgtatanctgacanctnatttnagttgcaataattcataaactgacatcatagtcaacgttttanaattcgggaatattatattatgttgcagcttctaacaatatactgcttagactagattcacatagttaaannttgaacgtgcttcggnaatanccatccaacacagttnaaacttacg

SEQ ID NO: 84416 - DNA, 608 bp, Triticum aestivum
  unsure (1)..(608): unsure at all n locations
  Clone ID: PAT_TA_84416
cgccgttcgccagcctcgagaggctcgaggagatgttcgccgccaaggggctcgacgtcgaggacatggtgacgctctccggcgcccacaccgtcggccgctcccactgctcctccttctccgaccgcctcccgccccacgtatcggacatgaacgacacgctctccggcacgctggccacgcagtgcagcagcggcggcggcgacaccacggtgccgcaaggactcggtgacccccggcggctgggacagccagtactacaggaacgttgctcaaccacgaggtgtcttcgcgttcngacgccgcgctgctggcgttcngaccagacggcggacatggtgtccgccaacgcgttcacccggggctgtngggaaacaanttcaaagnggcatgtgaanatgggcnccttcggatcaagacaacaccacgtgaatttagagnaatgctggtggcaataatactaatcaanatgtgctgttcttaactatggcaatacatcagttaatgctgcatcacttaanaagctantcatgatantaatantggcacatcgtaanattatttccnatacttaatagtaataggtcggaaanantcaacaccttatt

SEQ ID NO: 84417 - DNA, 243 bp, Triticum aestivum
  unsure (1)..(243): unsure at all n locations
  Clone ID: PAT_TA_84417
agaataagcaccaccacctgttccaccgccacaangacggcggcgaggaggaggcgagcgccggcggcaaggtggncnactacaagatcgacaagcaccacaagcacctggggcagctcggcgggctcggcgccatcgccgncggtgcatacgcaattcacgaanaagcacanggcgattnaacgacccccttcaacgcccacggcacaagtgaaggaggaggtttncggnagttgncggtct

SEQ ID NO: 84418 - DNA, 612 bp, Triticum aestivum
  unsure (1)..(612): unsure at all n locations
  Clone ID: PAT_TA_84418
gacatcacaggaagaaccaactatctacattaccacgtgatacacggagaaccatgccgtcctcctccctcgccttcctcatggcactgctgctgctctcttgtagcaccaccatgagtagcgcggcacggtactggaggaggagaccaagcctgcaccgcatcccaccaccaccaccgtgccagagctccccaagcctgaactgcctccacaccctacagtgccggagctgcccaagcccgactacaacaaaaccctacaactgtgccggnttgcccaagcccgantgcaacggaaccctgctntgccgggntcccaaancctaaatgcgaacccncttttccgaggttccaaacctgaantgccgacccngnccggggtccaaacctgattgcgccaaccanctntcaaagngtccggacatttcggngggcnaaanatnttccccaatgccaaccggngtgaaccaancgggaacataccggcnttcaaancaacatgtnactacntgactaagtttttagaaaanatgtgncatgcaaggnttgngttaggtnnacaagggctcaatttntttgccanttnaatccaaaccatcctgggaaaaaaant

SEQ ID NO: 84419 - DNA, 351 bp, Triticum aestivum
  unsure (1)..(351): unsure at all n locations
  Clone ID: PAT_TA_84419
agaaaacgggtaagagctcaaggaagaagagtagcagtcagtctgattctgaagattcgatctcttctgatgccatcattgatgaaaaggaaattgaagagacagatgagccagagattgacccaagaggcaattaagttcaaggaaatgcttgaggcccagaaagaaggctgcactagagaatgagatccggttggaccaatgcactcccgcgttcaaatgggcatataactatgntggtgcactgaaccccgtnaaggtgatccattgccaatatttcagcaagggaancttccccacgngttgtgaggttngcccntctgcaaattaattcnaaattccaaattttgg

SEQ ID NO: 84420 - DNA, 208 bp, Triticum aestivum
  unsure (1)..(208): unsure at all n locations
  Clone ID: PAT_TA_84420
gcgcgacaagttcctgtcctacaaggatctcaagaagcgcctcaagctcatcggcgccgggaacggggctgagcggcagccgaagcgggcccgccgcgacgactccggggaggctgacccngccgcggccgcggcggcaatgacgccagaggaggcggagttcatgcagctcctggaggctgagctcgacaattcactctttttcgtc

SEQ ID NO: 84421 - DNA, 341 bp, Triticum aestivum
  unsure (1)..(341): unsure at all n locations
  Clone ID: PAT_TA_84421
tctcgctctcctcccctgctttgacctccccgcctttccccgccgtttcttggatttctaggatccagacaaccgcccttgtgagcctgccttcctgcctactacctgcgtacgtacaggagggtccttgcttgggtgatccgggtgcctggtttctcggttccgcggcttccgctgctgttggattcgccgagccggagccgccggagatgaccgtcgacgagctgaagctgcaggcgagggccagcggcggccacggcgccaaggaccattccccgtcggcatgcgcgtgctcgcccgtcgacgacgacccgacctgcctcaagntctccgaggggggg

SEQ ID NO: 84422 - DNA, 645 bp, Triticum aestivum
  unsure (1)..(645): unsure at all n locations
  Clone ID: PAT_TA_84422
ggagaccctatctctggatggaaattcttataatggctccctccacattagctcgcgaactcttaggagcatctgcttcagtaattgtcatatgggtaaaagcgaattggttattgaggacacccctcaccttnaaaggctgctttgtccatggttggacggcgaggctatccgggtaagcagggcacctaaactgggacatattgggccctttgtcaccttgcatctccaaatattcaagattgcaaacctaatctttcangggttgntccaaccagcttcaaacaatttggatatgcacagtgaaggtcctggtccccnattttccttgcgctgattngaatgcggtccttgactcctcaagtcctcccctgctttggaaactttatgttangtgggacanatactaaacacanagatgaacaatgtgcgtcattaatgaccacaagatcaatcnaagcctttagaccanctcaaaaacatcctnaagatncaaagngacaacangngttacttgcaantcttgtccnaatggaaatgctaatagtaaattggctgagtanaattaacanaatggtggtgntaaaagcgcagaatgaatgaactccaaactngttaaatgtaacattncataatccagcttnn

SEQ ID NO: 84423 - DNA, 296 bp, Triticum aestivum
  unsure (1)..(296): unsure at all n locations
  Clone ID: PAT_TA_84423
gcaaagcgacctcggatgaccgtcgaccagctgaacatcggctaaccagttatcgttggttagactgtagtatcattttcccccatcttttagtgtggtgaatcatgtttccgaaagagatttaagtgttgtagtgggtatgatcttatttaccacccacctatttaaccacgagatgttgcagtacagcagcagcatcataaanttcctggactgcaagaacgttgctgtanggaaaggaaagttactgtgctanganngtcttgcttacttaaanggttaaaatctgccaaant

SEQ ID NO: 84424 - DNA, 577 bp, Triticum aestivum
  unsure (1)..(577): unsure at all n locations
  Clone ID: PAT_TA_84424
tcgagttttttttttttttttttttcatacaacaatgcaccttaccagtaacagattacaccaccgtgtgttcagccgcttaaaacatctcgtattattacgacacgggaatagcaacagcagtgcggagaaaagcttcagaccatagaaacctagagtgggtaagacaatgatagaagagatgcggcctatgccttcacagcaacaagcttgtcaatgaggtcaagcggcgtcttcaaacggtgggnaattgtctgcgcgctggactcctccaacgctaatgtcnaaatgctccccaaaggccaatcanantctcaaccgtgtccaagcaaacccgcaccaattcaagaaatttccaattcacccacaaattcaantgtgggncaggaaaagcaactgcttcttcaaaatttcnaaaacttgtcnacgtaccttcttgggaanncaaggaacanttccanagcactggttcaaggcgggngaagtgttaccttccancggggaaaaagnnaaaaattgagttgattgcctgacaagcatggcaangnaaaacggaaatcggcaaggagggcaagtc

SEQ ID NO: 84425 - DNA, 389 bp, Triticum aestivum
  unsure (1)..(389): unsure at all n locations
  Clone ID: PAT_TA_84425
gccggcatggtcggcacgcaggccgtggtcgcgttccagcgctccgacggcagcctcgtcgcgtacccgacgctgctcgacagctacgcgccgtccatggcgcccgccgcgcccggggatctggcgttcccggtgtcggacgtggcggcggagtacgtnggacgggaaggagatggtgctgtacgcgacgctggcgctgccggccgggaacgggcagcaagggaacancaanttaaccaacttttgcaanaagggaatgccggtggttaacgaattcccgcggngcaacccaacaacggggaaaaatacttttcancgcatatcattttaacattacnttggaanaaaanaccttgttanacgtggggtcctgattgacaatacccttt

SEQ ID NO: 84426 - DNA, 438 bp, Triticum aestivum
  unsure (1)..(438): unsure at all n locations
  Clone ID: PAT_TA_84426
nacagcccacatcaacaaatggncaggaaagaagtgacgctcctgctcttcctcgtgctgcttgtcgcagccgtcgaggcacagctgcacgacgagcctacggcggccgctgtcgggcggnggcgtggcgcgaaggccgccacggcgccgacgcacctccacttcttcttccacgacacggtgtagcggcaanccccgacggcggtacgcntggtganccgcccggcgtcgtctccgtcncccgtgttcnggatggttaacgtnnattngacgacccgctgacggaanggccggacaaggttnngccccgttcngccgcgcccangcctgtacatggggtccgaccaagcaatatnnggttcctggnaggcatgactcctgttaaccgccggggactanaacgganaagctcgcgctgctcggccgnaatgccgttta

SEQ ID NO: 84427 - DNA, 631 bp, Triticum aestivum
  unsure (1)..(631): unsure at all n locations
  Clone ID: PAT_TA_84427
cccgagtccgacgagtctccggcggccgcccccctctccctctcggatctctccctctctccgctcgccgcgcctccatcggtccactcagccatgtatagtaattacgggaatccttcggggatgcagatgcccccgcaaaactctcaacctgtccagtttggataatccattatacggtgcaagctcgggcctaatcagatctggggataggagtatatggggagaaatttttgggtctaattcaagaattcatgcatagcaacatcaatagatacttctccaacccgcagtattacttccaatgtgaatgatcaatattccgtaacaattgaaattatacgtcccgttcnttcanaaggggcactgganccaataantaaccggtccgtggcgcttgtcctaaaaactccaatctatgacataaacgcacagtttggtnatcctttcaangnatttgggaacttcannatccttcaagggttanatgggttcaagggaaantacncaacagtanaatctgaattanaaggngccancggtggggntcaactatggcctaaagnctgtcnatcatgggggtggnagngcacgcncactggactacgggtattatcccggcatcccccgn

SEQ ID NO: 84428 - DNA, 557 bp, Triticum aestivum
  unsure (1)..(557): unsure at all n locations
  Clone ID: PAT_TA_84428
cccacgccgacaccatcatcagcaacgcctcctgcaccaccaactgcctcgcccccttcgtcaaggtgctcgaccaaaagttcggcatcatcaagggaaccatgaccacaacccactcctacaccggcgaccagaggctgctggacgcgagccaccgcgacctgcgccgtgcccgtgccgccgcgctcaacatcgtgccaactccaacgggcgccggccaaaggcnnttgcncctggtgctgccaaacctcaaagggnagntaancggnttcgnncccgggtngccaacccnanttntcgttgtncnacttcctgngngaaggntcaangaancttccccaaggaggtaacaaggtttccgcaacccnccgcnaaaattaaggaatcttcaatttggaacaacctctttcttattttaggnttccaatttctcaaaatcaagcnccttaanatggcatggaaaacaatgcaaggctcccttgtacaaaacantgggtntccanaggtntcactcccgaatntcccgacaatgaatnacccgcggggatatgccttaa

SEQ ID NO: 84429 - DNA, 291 bp, Triticum aestivum
  Clone ID: PAT_TA_84429
ctcgcaccaccaaccttccggatccagtgccgcacgcctcactccccgtccccgacacccatgacacgcaagaggcgcaagcacgccgccgccaccgccgcctagggttccgatcccttcctcatggattccgctgccgcgtaagcgcaagggcgcgcgcgccgcgtgctccatggccggatcccgccacgatgcgcctgccgcccgcaagcgcacctgccgccgagccaagccgcggcccgagaagaagaagcctcttccgccgatgaaggtccgctccgccccgcggcg

SEQ ID NO: 84430 - DNA, 551 bp, Triticum aestivum
  unsure (1)..(551): unsure at all n locations
  Clone ID: PAT_TA_84430
gtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcaacacgaccgtgtcnagatnatcgccaacgaccaaggtaancgaacaaaacctcgtaantcgccttaaccgatccnanggcctnatcggnaattnggcnaaaacaaattcccatgacccataaaacgtctttgatgcnaacgtccattggaagaggttaangatccccgtcaaaagtgaataaactgtggccttcaagncatcctgggcccgtnanaancaatgataattgttaacaaagggaagngaaaaatttgaacccaanaattccncaaggntccacaanatctgaattctaacttacttggagacattaaaagcgtttaaggcccngcaattaagancaaangnggcccaaagagntngggtntgcgcaattg

SEQ ID NO: 84431 - DNA, 179 bp, Triticum aestivum
  unsure (1)..(179): unsure at all n locations
  Clone ID: PAT_TA_84431
cacaactacacgccttctcgactacttcaacgactactatcctaatctcctgatcacgattcgaaattcctgtttggatccagctcaatccccacacttccaccccaaagtcgaagaactctacctaccaatatgacgaccaacatgactancaacaaccagacacctatgggtggtca

SEQ ID NO: 84432 - DNA, 315 bp, Triticum aestivum
  unsure (1)..(315): unsure at all n locations
  Clone ID: PAT_TA_84432
ccacagagcacggcgagcaggcgtcgtccagggatatcgttggattgaaacatgagtcaggccttattcgtttatgtgcaatcgttcgagctaatcaaagtttatataaattagagaagcaatccggttaggaatcgtttcgacccaccaattcggcacaaacgaacaaggtcttagtgctggattctgtggatcctccatgtgatattagggtcgtttgggactccgttccacattctctactccgagagtcatttttaaatagagtgttcggattcncnaccgagagtgatctatttgccnaaaaaaaaaaaa

SEQ ID NO: 84433 - DNA, 627 bp, Triticum aestivum
  unsure (1)..(627): unsure at all n locations
  Clone ID: PAT_TA_84433
caccaatggtgggtccgggtccggcggtgggtccggttatggttctggcagcagctcgactgcagcctctggccccagcagtggcaactacgccgacgctgagggcaagggcgccggtggaggcatgggcggtggtgccaatggtgcatatggttctggtgctggtggaggcgttggcaagggcgaagggtgtgagtggtgtggcactcgcaccatcgtccaacggctactacaatggcggtgccgccgatgctaccggtggcggttccggcgccggcggtggacatggtggtggcgcagccggactccaactatggaaccggaggcggcctcngcggaggcaaggttaagcccggnacgatggttcttggggtcaagttatctcaaggaatcngtgctggnaaagcggcgttggcggcggcgntccaaggnggtctggtggcgttgaagnnctggtccggtncggaacggtgaatcactaacttgaactaattactaaaccaaaaccccattaagtcatcatcgtggtttgcgcctgtacaaattacnggataaactatggctctatnnatcatagtcaacatcactattatcttatgntacacatntccaattaanttcacatta

SEQ ID NO: 84434 - DNA, 373 bp, Triticum aestivum
  unsure (1)..(373): unsure at all n locations
  Clone ID: PAT_TA_84434
agaaaaagaaaagccaaaggcaaaggcaaaggaatcccaatcaggcaagcaaaaggaagaaccagctgctgcggccggagatgtcgtcgcagctgatcgaggagcaccggtcgggcgcggaggtgcacgtcgggcacgagctgtgcgagcgcaagtcgcgcgagttcatggtggagctgggctccccgacgggtcctccccgctgcccagcctggacgangtgggctacaaccggtccacgggttcntgttgttgcggcaaggccgccggcntaaccaaaatttcgttcaatcgnaacaagntttgtnccaangggaagtnacanggtttccttgagccccggggnttaaagctctcccgggnntaaancaag

SEQ ID NO: 84435 - DNA, 636 bp, Triticum aestivum
  unsure (1)..(636): unsure at all n locations
  Clone ID: PAT_TA_84435
ttttccttcatgatcctgtgagcttcactgccgtacttcatccagagtacttcacattcaagaagggtgtggtgagagtagagacccagggcatttgcactggccacactttgatggatcagggattgaaaaagtatgtttttttttctctctgagtaactcataaaagattgacccgtctgatgttttttagttcagcattcttacatacaccacattgatatgacataaatcctcaaccaaattactttataacttttgggnggtaagcaaaccaaaggcaaaattaccccacatgatctatatgtttccagcagattcaacttgtttcctccctgttcctccctatgctgcaagtgggattccagagaaccaatggtcanggtataaaccgattcaattgcatggacggttgatgtgccaaagncatcagctttataaagaactgctcaatggaaccatgacaaanacaacatttacgactgtcacataacctccctgagtccaaagaaattgacaatanaatgccntccaattgcacggaatantccggactaggagatccaatcctcatataaaggaacttcatgnaaggcagcacatccatacanacaatncggaaagaacagttcaaan

SEQ ID NO: 84436 - DNA, 259 bp, Triticum aestivum
  unsure (1)..(259): unsure at all n locations
  Clone ID: PAT_TA_84436
aaccagttcattgctggttctgctagcaggaggttggatttcagaggcagaagctttcagccaggcgggctcagggcgcgggcacatcaatggctggcaaggaaatcctccacaaggtgaaggacaaggtgaaagatgcatttagttcatcaaggaccaagaaacagggaaaggcaagacaaagttatcaaggcaagcgtgtcaagcatggttaccatctgggtgaanggcaaatctaatcatccaatggaggattacc

SEQ ID NO: 84437 - DNA, 630 bp, Triticum aestivum
  unsure (1)..(630): unsure at all n locations
  Clone ID: PAT_TA_84437
caagcgcgggctccacttcccgccgtggcgcaagcgcgagtacatgcgcgccaagtggctgtccccgcacgcccgcagcagcagcagcgcggacaggacgccggcgcccgccacgccggtttccgccgccgccgccgccttctccggcgagttcgagctgtggttcgacgagaaggagaaaccgaaggcggcggactacgacggcggcattcctggcggagaagacgacggggcgggcaagaagtcacggtcatggtgtcgccgacgccgacccgtggcgtgcggaagaacccgggggcggctagcaagctgtgcccgcaagccaagcngaagtggtgaccgggctggcgtccctgctgccntcgcaactgatnaacatcaaaccaagaggaanatccgtccggtccaaaaattttccttttccaactcnactccaanaaattccatccccccgcntcncattcttccnaggccgtcaagtgtttacngtttcccgnnctcggacaagatgaaaaaagaagaaagaacctccttttcgtcaaattttccttgttgtcncaaananaaattcatttcccccgggaacgaagatcggaattggtcccgcccgttttgaggaaatnaacaann

SEQ ID NO: 84438 - DNA, 388 bp, Triticum aestivum
  unsure (1)..(388): unsure at all n locations
  Clone ID: PAT_TA_84438
cgcatccccgctccccccgccccttctcgtcgccacgagtgtgtgctagggttccggcgtccggcgcgggcggtggcggccattccgatggaggcggatacggggtgtcggttggaggtggacgacgtcctctccttcgccgacgacctcgtcgtagtgctccgccgcagcgacgacgccgacgccaacgcgcaggtgatcgccgggcgcggggttgctgccggaccgcctgccgctccnatccnacnacctcaaccttgcagctnaaagattatcaancaaaaatatnctcctgcaaggacaagacangcaaagcaaaactgaaaaattgctgctaatnanctgatgttnctgcaaantaaaatggaaaaaaatctccaggaaatta

SEQ ID NO: 84439 - DNA, 515 bp, Triticum aestivum
  unsure (1)..(515): unsure at all n locations
  Clone ID: PAT_TA_84439
gtcaaacccgtgacgaactgaaagctgcacacacggagttagccgaggatggtgccattgagattatcatcataaagaccacaggagacatgatcttggacaaacccctggcggatataggaggcaagggtttattcaccaaggagatagacgatgcgctcttgggagggaagcattgacatcgcagtccactccgatgaaagatgtcccaacatatctaccaagaaggcatgatattgccctgtaacctcccacgagaagatgttaagagatgcattcatatgcctggactgcaaaacccttgggggacttccctgctgggtagtgttatccggaagtgcttcccctggcgggagcatctcaaattctcctaataatatccttcaactaaaatttgttaacttcaanaggaatttcaaacacggtttaaggaactttaaagaagagatgtncatgctacattgttggcactgggtgggactaaaacgttaaacatgccaagaacgcaacnccgt

SEQ ID NO: 84440 - DNA, 658 bp, Triticum aestivum
  unsure (1)..(658): unsure at all n locations
  Clone ID: PAT_TA_84440
tcattccgcaccgccgccaacccgccgcctcttctttccatggaagtggacgacggtagccgcgccaccccgccactggacgccgtggccgccgccttcaagtcccaagtcatggagttgcaggacctcgtcctcgcccgcagcatgttcccggccacggcgctgcccgacctcgccaacgtggacgcgttggtgacggcgaatggatcgcaaggtggaaaacatcagccgccgccttcaagagggagcttgacgccatccctaaagggcaaagaantagtccaagcggtccttgaaaggaggaaagaagaaactgcancatatgcttgcaaacttaccttctgggaatgcgcaagaatgattttgctaaatcagcacgaacagagctcatcaaggatgctgcctcaatttaactcntcntttactgaactaatgaatgtgaactgaagattaaggatgaacaattgcaactcctaaggaaggaaaaacactgcactcgttggtaatctaaacgaggacttgatnaccncatcgtacataagggaagatgacttggaaaggtatatccataaataagtgctcaatgagatcatgccatctgtaatgcctagaaaantncagagatcatggaaaannttgacnaggatatgacaatgtg

SEQ ID NO: 84441 - DNA, 631 bp, Triticum aestivum
  unsure (1)..(631): unsure at all n locations
  Clone ID: PAT_TA_84441
tcaaaacgaaaccaagcaagctttcggtcatggccccgccggcaacgaatagcccgggagaggtcgacagcggcggccgcccgcatgtcatgttcatcccaagcgctggcatgggccacctcatcccattcttccgcttcatcgcggctctcgctgggcagagcgtcgacatctctgtggtgactgtccttcctaccgtttctgccgccgaggaggactacttcaccagcctcttccgctgccctcccccgtgtccgccgcgttcnacctccactcctgccgttcgacgcgtccaagctcccaaagcaacgaccgcgaccgttcgttctccgggtgggaagccctgcgccgctcaacgcactcctgggcccgcttaatgccggngccgccccacgctctccggccgtcattacagactngacctgactccaagtnatcccatcgccaaggactccgggtccaatgcactctcttccctcaangcaacaatctctcgtccttgctaaaccctgttaaatcaaaagaaggcnacaaggagtgcatcgggagtcaatcccggtgtgttcnaaacgnatctgtcccgagggcgnttactcaaaantttacaacattatncangcgcanntaaacc

SEQ ID NO: 84442 - DNA, 657 bp, Triticum aestivum
  unsure (1)..(657): unsure at all n locations
  Clone ID: PAT_TA_84442
gttaataatatatcattgttccagatacaatagtatttttcttttccagcgaaaatacaagggcatatcagaaactgaacaccagaccatattctgtcatgaaaactgagggtaacagtatggtattagttctttaccatctggtagatctcattctgtcatgaaaaggttccccaaataagatcttgaggacagagaaataggtgccgactacaaaacaagcaggcatgccgatttgccgtgttaaaaganttctccgtcgcctttcatgttcaaaccttaagtgaaatgtgggtagagtccctatcaatgtttcacatttatgtttcatgggtgatacccggagattcaagattaaagncactttaacctggctggggcattatctcctccaagcaanttttcctgctcaactgtgcttgatcatccgtgtttggtacctcctctcccaattcaataccgatcctcatcctttcaagagcatcccatgtctccacttccaagtncaacactcaatcctcgcactgaaacctccaaggctttggcgccatcgatatgccagaacaagactgaatccaggctcaaatgatgnatctctgcatctccnaacccgagataacattaatnaanactggntctcacaaganatcaccacan

SEQ ID NO: 84443 - DNA, 652 bp, Triticum aestivum
  unsure (1)..(652): unsure at all n locations
  Clone ID: PAT_TA_84443
gagttctcggcttctcgcgagtcgcgacagagagaggcggagttgcggagaatatgcagagcagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaattcgggacagatgccatatatggatccgccctcaacatccgcaaggatctccgatgcccaaatcctctccaaggttccaaaggcccctgggtgctttgcgtcatctctgcttggataacaaggcactgacaagttccctggatgattttggattngaagatatcttaacatgctcatattctgacanttccgtcaacttacatcacaatggatggagntccccttggttttccaaaggactatcgtccnactcnatntaggaataatgttatccgctgcaattaactctcaatcaagtatcatcaatanacatattaagatggtgaatatgaaacggnaactgcatcgttaatgtagtttaacaccnaattaatattgcagttgacttttcggttcttcatgaagcatgancacaattaaaagttntcggtttcagttccaangggc

SEQ ID NO: 84444 - DNA, 646 bp, Triticum aestivum
  unsure (1)..(646): unsure at all n locations
  Clone ID: PAT_TA_84444
ttctcgcccaacatgtcacgccttcgctacaacgtcgcagcaagtctagatggcttcatcgcatcacccgatggttcaacaccatggatcatcgaagatcccaccatcgacttcccagcactgtactccgaattcgaatacttcatcatgggccgcaagacatacgagaccatgcaatcctttggcgctgacaatccactatcagaaagccccaaagagtcagtcatagtagtcatccgcacaatgaccccggaccacttcccaagatattacagtcataaaagaaaacgtgcttgattacatcaagacatctcaaaacaaatgagggaaaggatatctggcttatgggcggaggcatctcgcagcccgatgcctagaagctcactagtgggacaccgtcgaatcccgataatgccangcttctcggnaccgggataccctaatctcttccctcccaacaggaaataaactcaagctattaaacagacagctcggaatgggataccatgactcaatacaaatcatcaaagcagtatagcataacatctccgtagtanctgcgccatacgattggacccaaaganataccgtncatcacaaatcaactattccaagnggtctccnggaaaacgtgngattaccaacc

SEQ ID NO: 84445 - DNA, 623 bp, Triticum aestivum
  unsure (1)..(623): unsure at all n locations
  Clone ID: PAT_TA_84445
ctgccgccgcagcaggcgcctccggatagaaagggccggggcggcgccggtggcggggtcatggagtctggctccagatccagcggcgcggcggggttcgacgacgacgacggcctcaccacgcgccgcgaggtctcctcttcgctccaagatttgacagtaagggtggaccggaagggtgggagctgcagcgatggtggtacggatcagcggccaaacacaccgcggtcaaaacactcggccacagagcagcgcagacgcagcaagatcaatgataggtttcaagatacttanggagctgttgccacacagtgatcaaaagagagacaaagcaacatttctcttggaggttattgaatatatacggtttttgcaaagagaaagtgcaaaaatatgangcaacattccaagaatgggaccaagaaaatgcaaaagatgcttcatgggtaattgcttcnttcncaaagctccaatgcttgcnagttctactgcttcaaggaaagaanatcaattctgattgccgttcngaatgtantaacatttcatcaatagtatttcattatcggaaaatccaataagcaatccagaatccgctacctnaatnanagaatgtccccgattat

SEQ ID NO: 84446 - DNA, 279 bp, Triticum aestivum
  unsure (1)..(279): unsure at all n locations
  Clone ID: PAT_TA_84446
gcggggagccaggctccgcgcgcaggcgacgtacaaggtgaagctggtgacgcccgagggcgaggtggagctggaggtccccgacgacgtctacatcctcgacagccgaaggaaggangggattcnanctgccctactcttgccgcgccggctcctgctcctcctgcgccggnaagtttggttccggcganattcaaccaattccgancaaaagttnctncaacaanaacaaattgaagnaaggttggttgtnaacttgcaagcctnacccaaattcga

SEQ ID NO: 84447 - DNA, 552 bp, Triticum aestivum
  unsure (1)..(552): unsure at all n locations
  Clone ID: PAT_TA_84447
gttgagtcgaggcggctccaactccggctcgtggcctcgcggaccaacatggccgccccttcgccctcgccggtggaggctaccctaccgcctgaggccgcggccgccgccgaggaagaccagtgggatgctgatggatatgttattcctaatttgcccactcaagataatgatgtggctgagcctagtgtccccaaagaaaaagatcctgagcctctacaggcaaacgatgagaaaatatatctgggacctcatggantccaccatctcaagcaaagcagcaggagctgaacaccgtttgccgcaagcagcgntcccggaacaagctgaaggagcagataggaattccccggnaatgctcaaggagaacaagtggagaacctaagggactgatgggtctanagtggtacaacctgcctaaaagnctcctcctgattggtcattcgcatgccatgaaccgaatccacagaaaacaatanatgaccggnaacatcaactgcgtttactgaaggtgataccttacatggtcaagtttatcncaatacaaatact

SEQ ID NO: 84448 - DNA, 568 bp, Triticum aestivum
  unsure (1)..(568): unsure at all n locations
  Clone ID: PAT_TA_84448
gagaaaacttctcaacaatctcggcgtctcgccggcggccgccaccacgatgatcagcatcctcgcgcaggagcgcctcctcgggttcgccctgggctccgtctccatgggcgggttcgtcctccaccagcgccgctccatctaccgctcccttgccgacgccgacgcggcctctgggggtgcatccttctcctaccagacaagtgcaaccaccgggtagaggagtttcaagctgagatggctcacgtatggaacaaggcagtggacgagacacttggncggcttgttgtgtaccttaactctccgtgggatggnaattcaagcattgagagtgaagcactactccctggatcacgggttgttgttctaaattgagacaatgtgctctgcaattctcaagtaccaangttgatcataatgcttcctttgcnttaaaaatgggtgtggaggataatatcagattggacaatggngcctcctgctacaattgtccccaaatgtanntgggtcaggggtacagctaacctgttaaatgttattgttaagtataccggctaaaaaaaaaaaa

SEQ ID NO: 84449 - DNA, 617 bp, Triticum aestivum
  unsure (1)..(617): unsure at all n locations
  Clone ID: PAT_TA_84449
gccaacttcgcaacgatgaagatgacattctacttatgtcctacactcccatttttttgcaggttcttatgaccaaaacactctcaggggggccccatggcaagttcagtcacaaggcgctaacactgacatatttacgggcaaccaacctcaactagctagcatggctaatcaaggtaatgcaaaaccaaaaaaaaacacatactgccatgggacgtgaaaaatgggacatgcaaaaaaactgtcaagaggaccacgattatcacgggtgaaaatgcagggccttcatgcagcacgtngacatcaagccagcacccatgttcctgccatcgacgtcatacacagtcatccataaaaaaatgaatttcngagttcaattagcagaagggcatattggcactccaaattgccatgacgggcttctanattgccatgatttaaaactacatttgcanccctggacaacgttttgcancaatgggcactncattgcatggagaaagaatgcattgcatgcanacaatacagtgcaagtcacncaatgcattgcatgagganaatgggttcanccntgcactatatttcatcantaactgattcaanaggnantgatttct

SEQ ID NO: 84450 - DNA, 540 bp, Triticum aestivum
  unsure (1)..(540): unsure at all n locations
  Clone ID: PAT_TA_84450
gaaagttcagtggacagatacatgtggaaaggagctttttgagataagggagtttgaaacaagcgacgagggcctgtcggatgatgatgcagaaaacgatggtttccggaaatgtgaatgtgtgattcagtagatttcatctctgcacaacaagcctgacagaaacatctcatgggaagcctgccctgctgggaaagatgtgccacggagactactttgccgctgaaatgatcgacgacagtcgaaacaaaacaaacagccatgaatcgatatcgtgctagagtatttgttggttatatgcttaactagtctgctcagcagggttatagtttcgatgcccacctgtacaatatcaagatcccctttctttcttttctgtcacatttattttctcgctttccattgtgtttcacgcccgctgtacatatgaggctgccatgttactcctccaaggattttgggttcctgacatcatgctgtttaatttgttgctccgactattaangatggcttgttgataanttcgncaaaaaaaaaaaa

SEQ ID NO: 84451 - DNA, 408 bp, Triticum aestivum
  unsure (1)..(408): unsure at all n locations
  Clone ID: PAT_TA_84451
tattattctgcacagcaacgcatcagccttctggaaccatctcgccgccgccacaccacaatccacaacccgtcgaagcgaagcaagcaatggccggagtcggatcgaaggccctcgccgttgccgccgttctggcggccgtctccttctcggtggccgccgcggccgaggcgcccgcgcccagccccgtctccgccgccgtcgcggngtcntcgcccttcgccgcggctctcgtcgcctccgncnccgccttcctcttcgccgccgtccgccactnagccgatggggcctcntncctgcaggctacctancatacttccccgacgccgccgccntccncctagatctacttntggagtgctatccagtantnctaagtataagtnngatttgttcnntnctgtcgtg

SEQ ID NO: 84452 - DNA, 537 bp, Triticum aestivum
  unsure (1)..(537): unsure at all n locations
  Clone ID: PAT_TA_84452
gcgcaatcagggaagggttgatgataacattgaaactatcaaaaaaaggttcaaaacctttgttgactcaactctgcctgtcattgagcattacaactcaaaggacaaggttaaaaagattgatgctgcaaaaccaatccccgaggtgtttgaagacgtcaaagccatttttgccccatattctctaaaggctgaatagagcaatctaagggacatgataaaggtgatacatggtgtctangcaccacataaacatatctgtgattatgatggaccctttaatatagaacaaaattttgggctcatttgagctaccagcgtaccagtaggcaattccgatttgttaccaacaacaagtgatctgatcccaatggncctgctagagtaacattttttacaacgtctgttgtcaagtacctttgatatgtgttgtacaaatgtgcaattacccaatggacggatggacattgtgcatccatcaacagatttatgtggcgttatggaaacatagacgctgcatatcttaaaaaaaaaaaa

SEQ ID NO: 84453 - DNA, 292 bp, Triticum aestivum
  Clone ID: PAT_TA_84453
ggactctagtatacagtctggctcacttctgagaagctcctttggcgcacatacctttgttcactgtgccagacagaaaagactcaccaggacagtgtagactaaggagcattttagaacgagcgttgtatcaaaacggttctgagctgtaatgttatttcccaacccccagtgtaatcttggtgctatgggattagttcggtgctaagcaagaacaaaaatgttgcatactacgcgtttttcagtcaaacgacacctcttgcattaaggaactgaatccaaaaaaaaaaaa

SEQ ID NO: 84454 - DNA, 445 bp, Triticum aestivum
  unsure (1)..(445): unsure at all n locations
  Clone ID: PAT_TA_84454
ccaccttgtcctgcgtctgcgtggtggcatgcagatcttcgtgaagaccctcactggaaagactatcacccttgaggttgagagctctgacaccatcgacaatgtcaaggccaagatccaagacaaggagggcattcccccggaccagcagcgcctggatctttgctggcaagcagctggaggatgggtcgcaccctccgccgactacaacatccagaagganccaccttcacctgggtgctccgctccgtnngtggcaantaattccctctcactccacctgctgctgctgctgnacctgttctcctgtgggntccctttgttcaaatgctgtccctttgtgtgaatcctactgtgtccnggtttaaagggacatcnatcctgtggtttggtgcaaacattncaagtacatctcacttnattatgataatcaactttnaattnn

SEQ ID NO: 84455 - DNA, 630 bp, Triticum aestivum
  unsure (1)..(630): unsure at all n locations
  Clone ID: PAT_TA_84455
aagcaatcgcctcactggtcaacctgactgaataggtgaggtgaggtgaggtgaggtcagtggtggattgagaagggaggctatcggattcggttgcttctcttctcctcttcctggaggcgtttgggtggtggtgctcccagctgctgctgacgcggagcggccggacgaggacgacggcggcggcggcgtacccgaagatggcgcggccgccgatcctatccgtcgcgctgccgtctgacaccggccgtgtgctcagcatccagtcccacaccgtccaggggtatgttggcaacaaatcggccgtctttcccctgcagctccttggctttgatgtggatccaataaactctgtacagttttctaatcatacangataccaacatttagagtcaagttcttaatggcaaacagtctgggacttantgaaggactggaggaaaatcattgctcaatataccaattataacaggtatataggccaattcctttanatacgtctcaattttgaaaatgcatagtaacctgatctgtaangtttgtaccaattcagggatnaggaaatantgtcccaagagtaaaacgttacacaaagtgtcaatnctnagctaacaacaatttaatnacatt

SEQ ID NO: 84456 - DNA, 636 bp, Triticum aestivum
  unsure (1)..(636): unsure at all n locations
  Clone ID: PAT_TA_84456
ttctcccccaagttcatcttgtgcagttgtgctaacacgcggcgccccaggccctccggcgccgcccacctccaccgcctggaatccaggacatccggcgccgcccacctccgtcccctgtctgctgcctcgactcaactgttttgctgcgatggggttattcaggggcagcttcactctcttggtgggaatgggatgtggtgtctatatagctcagaactacaacgttccgaacgtcaagaagctattcaacacatatgtttttctggcaaagcacatcgaggaaacctaccgtaagccgaagaagaaagacgatgattgatcctttcacatttggtatctctgttatgccctgggagcatgtggaaatgtgcatttttgaaattgtgaaggcaattttggttatggacaaattttttaactccagtggaaaatgttagctgtgaaattcaattgctgtaatagttttggtcntaatggacatgggcttcaaaacctcccttttgctcgggtcctgtgcctggaaatcacggacttgtgttgaangcnggatgntaaccaacacacatggttttcagttacaaaggtgggnganagttantgaccaaattccaataaaatgcaagtctcgaaaaa

SEQ ID NO: 84457 - DNA, 272 bp, Triticum aestivum
  Clone ID: PAT_TA_84457
gtcatgctggcaaagaggggtggtgctatcaggcaagagctcgctaagttgaagaagacacccatgacttaatggttatcttttagtggatgtcatgttagagtttttggttctaagttggatcagcaattcgattgagtgtcgataaagacagaagtactaatatgttccctgtgaatacattttaaactttatcaagcatgggtgtgctctagatattttatcgtgaataatatataatatataaggtagcttgcgtcaaaaaaaaaaaa

SEQ ID NO: 84458 - DNA, 238 bp, Triticum aestivum
  unsure (1)..(238): unsure at all n locations
  Clone ID: PAT_TA_84458
tgcagatggtcgcctgctcgactccttacaacgctaagggcctgatgaaagctgccatcaggagcgagaaccctgtggtgctgtttgagcacgtccttctgtacaacctgaaggagaaaatcccggacgaggagtacgtgctctgctttggaggaaggccgaaatggtgccggcctgggnanaacttgncnatactcaaanactccgcacattagngtacacgttgtncgcagcagca

SEQ ID NO: 84459 - DNA, 642 bp, Triticum aestivum
  unsure (1)..(642): unsure at all n locations
  Clone ID: PAT_TA_84459
cgtcgatccagcggtagcagcgcacataccgatcgatctaggagagggagagaaccaaccaatttcatcgccgatcaaacaaggaaaaaagatcccggccatggcgacgcggtcgctggagctgacgctgatctcgggcaaggacctcaaggacgtgaacctgatgtccaggatggaggtctacgccgtggtgtcgctctccggcgacccccggtcgcggcagcgggtcnaggccgaccgcaccggcggccgcaacccgaccttggaacgccacgctccgcttcgccgtcccaaccactggngccggtccctccaactcctcctcccgcgccgaacgcgccctccggcgacgcgatttcggcgaagtcaaatcccgctgttcnantcctctccgggngccccgaaggcctttcccgccaattcgtcgcctacaaagtgcgaaatttcctccgggnaanccaaggaanctcaactcncctaaaantcgggaagtcgccaacgggtancccccgcttcgccggcaattcgctaagccatctcaacganggcgctaccgctcttaagaaggtgaccctanggctccgccggtaccgctcttcggaaggcnactaccccccngnacanacccggacaagngncttc

SEQ ID NO: 84460 - DNA, 530 bp, Triticum aestivum
  unsure (1)..(530): unsure at all n locations
  Clone ID: PAT_TA_84460
tgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaataaagggctaatacagcagcaatttatgctagggaagctctgcattgcttaccatgtgtattgggcaagaaaacaggaggcactttacaaagggtgttaactctgcgatggctgcctctcaangtgtaaatggttccgtttaacgctgcttttgtccgtatatttaagatgatttggactgttgctacttttggnaactttttacatttacaagatatgtattatcaacataaatataatatagttatccctaaggctaaatnatggtgattaacataccaanccttttacaagntaccccttttctgggaacaaggtcaatgctaancttccctcctgtctgaatgtgatggtgcctgaaaaaanaaaaaaaaaaaa

SEQ ID NO: 84461 - DNA, 582 bp, Triticum aestivum
  unsure (1)..(582): unsure at all n locations
  Clone ID: PAT_TA_84461
ttcacattatccgcgcgcgcgcgagcggacgtagcgtgtgggtagcgtcgccgtgcggacggtctcttggtgccggtgcgggccgcgtgacggtgcgtgtgccgcccgcggggaggaggtcgttcggttggttggccctcggcgacgatggcggtccacggcggagaggcggtctccgtcgcgctcctcttctccctcgctttcttctgcgctcgcctcctgctcgaccgcctccgtctacaagccattagcagtctaccttttcaacaccaaagttctaagttgatgaataatgaggcaggcaagcaaagattgtcaattctcaagatccatttgggaacttacctactanctctgttcaagcatggncccatgataataaacaagaacaaggcattgggatatgatcaatacttnatggtgggccaacaaccatcgttctcaatggagctttccanagtgcaatgtggatttaatcaatacaacgtgcctggtgcttgggaaacccaaaaaaattgcntaatgatgtccacantataaatcacncaattgngttanatcgacnggttttccaattggaca

SEQ ID NO: 84462 - DNA, 574 bp, Triticum aestivum
  unsure (1)..(574): unsure at all n locations
  Clone ID: PAT_TA_84462
ccgggaaccaccagcgctacctggccaccggcatccgcgtcggcctcgcctcggcttccgcctgcagcgacgcctgcgacgcccacgactccgaccaccacgccccgcccaaggccaccatcgagccaccgcacgccgccgtctccgccgcggtgcagcaggtgccctcgccgccgcagttcctgccgcagggctgggccgtcgacgagtcctgcattctccnactacgagtccaagcgacaagctgcacaaggagcgacgctcggntcaaaggagtggatggtcgcccgacatcgactcttccacgagcaagcgcccaaagcagcaagactttgcggaggtgccggactttttcgggatacaagcggcgaacacccgcgtataanaggcggcaagccgccgccgggggcgggctgggttccccaagacaagaagccggtttaaggcacgacgacaaggntactcatatcctgntctgggtaaataagaaaccaggagttgtttntcnccgattgtcgngtcaaagaanaatttcnggtnaanctatgtcaatgtgtgaacntnaggtagtccn

SEQ ID NO: 84463 - DNA, 645 bp, Triticum aestivum
  unsure (1)..(645): unsure at all n locations
  Clone ID: PAT_TA_84463
cgatcctgcgttattttgccggtaattgattgatagatggcgtcggagaagagcaagatcctggtggtcggcggcacggggtacctgggcaggcacgtcgtggcggcgagcgcgcggctgggccaccccacctcggcgctcgtcagggacacggcgccgtccgacccggccaaagcggcgctgctcaaagaccttccaaggacgccggtgtgacgctcctcaaagggcgacctgtacgaccaaggctagcctgggtgagcgcggtgaaaggngcggacgttggcatctccgtgctccggattcgatgcagatcgccgaccaaagccggtcgtccacgccatcaaaggaagccggcaantcaagntcgtgtcctgcttgtccntccaagcttctagcgtgttcttccatctttctctcccttgctgcgctgctgcaaatctgcaactgcatgccgaatcttgtaccgctcctccntcctggcgcntgnancaaaangtctcccgtcggattcggctggactggacgcacggcactggaacggcaatcatctagggncaagtgggatcgcncgcaacaggcgcggatactaacaagcgtgcgntnttcgctngtccaaangganctccccgcncncgagggntctcg

SEQ ID NO: 84464 - DNA, 292 bp, Triticum aestivum
  unsure (1)..(292): unsure at all n locations
  Clone ID: PAT_TA_84464
agatcataggcgtgaaggccaacagttaccagaagctgactgtgtgatagatggaccaaacacgttcgaagacgacccgcaggacacgttcgagcaagagggtgatgaagaagactttgcagatgatgtcgatgagaactaagtctaacgatgcaccagtcaccttcctatggaagagtgtccatgtttaattctattgtactttggatgatgatacttttaaagacactattgtctaaatgatgtaataaantactctactctctttacgcctttaaaaaaaaaggggggg

SEQ ID NO: 84465 - DNA, 425 bp, Triticum aestivum
  unsure (1)..(425): unsure at all n locations
  Clone ID: PAT_TA_84465
gttgcagtcacagcatcagcactcgacaaaccagttggtgcttctggctgtcggtgggagggcacagctccctactgtgacggcgagtgcgaacctggctggaccgagagaggacgcagtcaatgcggcgatggcagctgctgttggacaggcagcaaagccctctgctgtgaagacgaggatgcctccagaaattgggtgcagcagcaggacaaagtttggcgcttctggtnttcgatgggaanggnaacaacttccttactngcgaaaagccaattccaaccttgcttgattaaaagggacccaatcaatttgagaatggnaaccgcctttgacttgnaanaaaggcctttctngnaaaataccattncaccggtttccaaaatatttcccatattgggaaacaatccatccttnaaaaaaaa

SEQ ID NO: 84466 - DNA, 616 bp, Triticum aestivum
  unsure (1)..(616): unsure at all n locations
  Clone ID: PAT_TA_84466
ccgccgtctagcattttcctacacccaatctgatctgaccaagccctctgaacaccaccgcccatcctcctcctcctccgccgccgccgcccaagatgggcttcgacgtgggcctcgtcccctacaaccccgacgggtggggtccacctgaagttgccgccgcgccgccttccctcggtggtggctcctcgtctgtccccttcgctcccttctcccgctccgacaagctgggccgcatcgccgactggacgcgcaacccgccgggccccggggctttcgccgcagctcgcgacgccgtcttcgatttcgcggggctcgaggactccatcgggctcgcgtccgcggacgactcgtccttccgcctcgtcgatggcaaaccgccgccgcggnaaccgcggtttggactcgctgggcgcttcaacaacggnccaactccgcaacgccgcgacaanagtcaagntcgggtccgaagccanaagganncgcccgccgcnacgcatggaacaaaacgcgnagacacagtnaacgcgnggcctctntctcncaaacgtcttaataaccnatggccgtaagacantcttncanctncaanttctccgtccacaccagttcttnt

SEQ ID NO: 84467 - DNA, 170 bp, Triticum aestivum
  Clone ID: PAT_TA_84467
ccgaaaactgcggctgcaagatccactagagactcatccaatcaaccatggccacagccgatggacccttcttccatatgcatgctctcctccgtccgtccgcctagcttgctacaagcaggcgctaataagctagcaagctgttgttgttgtttaaaaaaaaggggggg

SEQ ID NO: 84468 - DNA, 526 bp, Triticum aestivum
  unsure (1)..(526): unsure at all n locations
  Clone ID: PAT_TA_84468
gctagggaagaactgagaaaagcaaaagaacatgacaaagagaagctctgtaatatcagccgtgccttggctgtgctcgcatctgcatcttctgttagcaaggagcgtcaagagtttctgagcctcgtcaataaagagatagagctatataactccatgctcaaaaaagagggtactgaaggtgaagaagcagctaaaaaagcatatatagccgctagggaagacccagacaatgatgctgaggctgctgcagaagaaaagtctcgtcggcgttgattgagaaggttgatgctatgcttcaagaattagaanaggaattgatgatgtggatgcacaaattggaaaccgttggaactgcttgatanggaccacattgcaaagngactcctaagaggtggcccaactgctgnctaacttaaggcaacatccggaaggaagggtncaaaagctcancaacaaccttntaagggacaaaaaggaaattcccctggaaantccgagggntcatcccaaaanngggnacaag

SEQ ID NO: 84469 - DNA, 281 bp, Triticum aestivum
  Clone ID: PAT_TA_84469
agccagagctgagagccgaggagggaaacgaagaagcggccatggcgatgaagcggccggcgcgcagcgacccacacctgccacccgaggaggcggcacgggtggaggccgaggttcggagctacttcgacagcgtcgcgccgaggcgcccggccaagccgccgcgcagcgacccgtcggtggacaccttcgcggaacccgccgccgtcgacgccggggaccacgacttgccggagctccgcaagctgcgcgacctcgaggcgaagccccagaagctggcg

SEQ ID NO: 84470 - DNA, 603 bp, Triticum aestivum
  unsure (1)..(603): unsure at all n locations
  Clone ID: PAT_TA_84470
ccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaaggagacccgcggcgtgctcaagatcttcctcgagaacgtcatccgcgacgccgtcacctacactgagcacgcccgccgcaagaccgtcaccgccatggacgtcgtctacgcgctcaagcgccaaggccgcacctctacggcttcngcgggctaagctgatgggctcctcgcgatgttctccccttctgcaaatgcaacttttctggncgtgccanaagtcttgcggtcaagaaatttcaggaactcntgttaagtcactctggctgtggnaggttatctgaatcctganatantaggnttatctgaatcccangctacnagnttactgatcataacatgatgaattatggtgatcgatttggaancaactgtaagnattnttcnctgatcaaaaaaaaa

SEQ ID NO: 84471 - DNA, 371 bp, Triticum aestivum
  Clone ID: PAT_TA_84471
gataagagcaaggttatttttattttttattgtgtgtgtatatatatattcttgaatttccatgcgcaccactatgccttacatgttcatttttctatcccacgccattaagaatttgtaggtgatacctaccttttgttagtgtagtttaactctttgtgtgttgttgctaataataacattgttttttgcttcattactatgaatcagggtcctgttgttggtgatgactgatgaccttgttcgaccattggtgatgttcctttgaatgttagcagcagcatgatcggtgatgttgctgtagatgcttctaaggtttgtttttctgtgctttcattaattttatatgcagttttcactgctgggggggg

SEQ ID NO: 84472 - DNA, 250 bp, Triticum aestivum
  unsure (1)..(250): unsure at all n locations
  Clone ID: PAT_TA_84472
ccgctttccctcanagctgaaagcacagtggctgcangtaccacagcagttcttgtncctgcnatttcngctttcaactgatgacaggaatggattcattactatngtaccannatcgctggttggtgtattcttttttttctcctantcnaaataatctgantgttgtagccattactgtacttttgagcttaagaaagaantacttcacggcaaanaactcngaaaagtaacaaactcnanggggggg

SEQ ID NO: 84473 - DNA, 611 bp, Triticum aestivum
  unsure (1)..(611): unsure at all n locations
  Clone ID: PAT_TA_84473
cttgagtctgccaaagaagaggttgcatcagcaatggaccagctaaaggaggcagagtctgaaacgaaggctctccgatctatgactcagagaacggtcttaactcaagaagaaatggaggaggttgtcctaaaaagatgctggcttgcacgctattggggcttagcagttcaatatggtgtgtatcccgaaattgcggtatcaaagcatgaacattggtcatcattggctcctcttcctcttgaggttgttctttccgccggtcaaaaagctaaggaggaacctcgaaaacaaggtgacaatgttcaagggagaaataaacttgcacgagaaatgagtgatgtaatgggaagaaagnaatatagagagcatgctttcaattgaaatgggccttaaaagagctttctcaatgaangtggaaaatgctgttgtagtgcaattgggcaacatcgcaaanctaacatagtcgtcaattanatcaagattnaaatcactggggaaccaaatactggaggcattgtcttaccaaaaaaggtgaagatgtagcttaacagnatgnttaaaactctggagaanacaaancaagggttaggaaanatgcnatacggtta

SEQ ID NO: 84474 - DNA, 603 bp, Triticum aestivum
  unsure (1)..(603): unsure at all n locations
  Clone ID: PAT_TA_84474
cggccaagggcccctcgcccacgcgtcgcctcctgccgcagccgcacttggccgtctcctcgctggtggcctccatggctctgatccacccttcctcaacacccaaagatggttgacgtcaccttcgccgtctcctcgccagtggcctccaccagccccgcagtccaagacaaagccgcgacatgagtcaacccaagtccggtcgcacctacaccgatgaccgtacccaacaagttgagctttaagaggaacgtggtgtcattgtcatcagagctcaagggtgtgaggagcaagcttgcttcctangagcagctgtttgtaanggaatctcaaactggaaagcttgcggagacaaaaacaaggagcatggaagaggaagtatcaagctgcataaatgcttacaggacaaggatgaacaactgcatcaatcacaagtagcaacggaacaagaaccaactgaaccttcaaantgcttgntctgggaaatctgtgancaancantgtcctcataatggtatcacatgagcccatccctgcanaaactnggaaaggacatgantttatgggaatgaataaatcctctcaataaacttagcacaattt

SEQ ID NO: 84475 - DNA, 521 bp, Triticum aestivum
  unsure (1)..(521): unsure at all n locations
  Clone ID: PAT_TA_84475
ggaagatgcagattatgctattaagactttgaacatgatcaaactatatgggaagcccataagagtaaacaaggcttcccaggataagaagagcttggacgttggagcaaatctgtttattgggcaatcttgatccggatgttgatgagaagctcctctatgataccttcaagtgcatttggagtgattgtaactaatcctaagataatgcgagatcctgaaacaggaaattctagaggctttgggctttgtgagctatgagtccttttgaatcatctgaccaagcaatagaggccatgaacaaccaacatttngtgcaaccgcccaatcactgtctccttatgctttacaagaaaagcacgaaaaggagaacgccatggcacaccaacaagagagactgctggcaacaaacatccaagatctcaaaaagaataggcacacacaatgtttgcaagtggtccgccgaccaaggcatccaaatgggggncgcctgtgcacggcttatggaatgggnaatcctg

SEQ ID NO: 84476 - DNA, 593 bp, Triticum aestivum
  unsure (1)..(593): unsure at all n locations
  Clone ID: PAT_TA_84476
gcgacctggtgtatgactgcgggcagagcctaaaccctgctgtagacttgggccagatcgagggctgctttgtccaaggaatagggttcttcacgaacgaggactacaagacgaattccgacggcttggtcatccacgacggcacatggacgtacaagatccccacggtggataatatcccgaaggagttcaatgttgagatgtttaacagcgcccctgacaagaagcgtgtcctatcttccaaagcgtcnggcgagccgccgctgggttctcgcagcctcggtgcactgcgcgatgagggangccatcanggcggcgangaaggantctcggtcaacacaancccgcgaaatccgccgtcaattccanatggacgtgccggcgacgatgccgtctcaaaggaactctgcggctcgactcgtggagaagtactcnaaaactgtctgccgcaatgccggccaaacanacgaagnatanntcaacaagctcagntgnatcggngcatgcaaaatattgtgtgccnantnattaangnaaaaattgggaacaagactcaggnnataaattttnggaaanaatacctcaantaacaa

SEQ ID NO: 84477 - DNA, 600 bp, Triticum aestivum
  unsure (1)..(600): unsure at all n locations
  Clone ID: PAT_TA_84477
caatcttgcagctagaccaggaagagtggtaggcccagtattgccattcgagagcgcaagcgtcaccgatcaacacatcgcccgacgggtggcaaggaacccagctgttcctccagcaacgaacacctcgtcagtctactgctaccacctcaagtcggacagctccgacaggcaggagcatcatctagagcgtggagaaagttcgaaggcagtataggccagggcagatttcatggatgccaagtagcccctgagatgggcccgggatatacgcccggtcaaagtatatntcncaaagggnttgcccaaagctnttctaacagacaggcaacctccaatagangnccttcaagggntgcnccttcaatggaatcncaaccggcgctggggttanagcaagccgggttctcactaaggattaaatttgtactaagncatccttnggaaggtatataaatgggaaaccgatgattcaactcccctccanctggcatgctggaancgacaccctactgtcacatcattgtcggaaggattcagtggaacggcatgtacttattgnctgtttatactatgggatgcttgcactttattattaan

SEQ ID NO: 84478 - DNA, 408 bp, Triticum aestivum
  unsure (1)..(408): unsure at all n locations
  Clone ID: PAT_TA_84478
cctccccgtacacaacacgcacgccatctctctcgaagcttccgcttcctccagccgccaccgacccgaacccaccccggacgcggcgcctcccccgcaccctatattgttccccgagctccagccgccaaggattggcgaaaggagccgggcagatattgaaactcgtttcagatcggatccgaggactcgagaaattgcagggaaggaatttgaggatggatttcgagctgcggcaggcgcgggagaagctgggagcgcgagcaacgggagcggngcagcgcgccaaggccaaagcggacgcgagacctggccaagcaanangcggccgccgccaagaacgctccagctcccaccgcaagcgacatccatccgcacgggccaagaaangtgaccggacaatggaga

SEQ ID NO: 84479 - DNA, 373 bp, Triticum aestivum
  unsure (1)..(373): unsure at all n locations
  Clone ID: PAT_TA_84479
gtcatggacaccaggctcggcgggcagtaccccaagaggcaggcgcaggacatggccgcgctcgcgctccgctgcctccagaacgaccctaagagccgcccctccatggccgacgacgtcctaccctccctcgagctcctgctgcagccaagcgccgccaagtccttctcctcctcctcgacgacgacgacgtcgagatcgccggccgcgtcggcggcgctgggtgcacagaggccaccgttcgaaacaaagcctagctagctagcttaggaactccgttcatttaattactgngttcaattagtgtgttcctctgtgcaattagaatagatttgtaattgggaattgggaacttttcctcaaaaaaaaaaaa

SEQ ID NO: 84480 - DNA, 378 bp, Triticum aestivum
  unsure (1)..(378): unsure at all n locations
  Clone ID: PAT_TA_84480
caatgatgattcttgcaatcattgtgctcctcttcagcaccatcacagtgatgacatccttggtggccctttcattctacggtgctagccagatcaagttccactgggtggagcgttacgacaagatcctcgtcggcacggtgctgtgccttgttggagtcttaacatatgtgttccatcatcacgatggtgatgagcatgtgcaccaagaaactccgtatctccctaagatgcatatatactgaagttccatctctgttgccccctattttgtatacaatcctgattatcgacttactctgccgctccggttttgcctggagatacgtatcatctgatcaaatgaatatatttggagcaanaaaaaanaaaaaaaaa

SEQ ID NO: 84481 - DNA, 341 bp, Triticum aestivum
  unsure (1)..(341): unsure at all n locations
  Clone ID: PAT_TA_84481
aaaaactctgtttgttagcgtgacgtgcgtgaggagtctggagtcggacggaaatcgaaaaggcgaaaactcagtgtctcgagtttcctcggagcggaggcgngctnggggaaanggganggaaaggcttgctcnccgcgaagactacggcggccaagtccgccnagaangacaangggaagaaggccccaatctcacgctcctcccgcgccggnctccanttccctgttggacgtatccaccgtcagctganncaaaggactcangcaaatggacntgttagtnccancncatccgtntactctgctgccatcctnaantatttgactgccnaggttctg

SEQ ID NO: 84482 - DNA, 610 bp, Triticum aestivum
  unsure (1)..(610): unsure at all n locations
  Clone ID: PAT_TA_84482
gcttcttcctgatacaagggaaaggatagtagcaacagaagtaactgcttggtggaggtatccctttgaacatgtttcgcagctcccatcgaagccattctgcttcacgcagagatatcaggatgtaaagaaagtccttgcagagacgttctttggtcctccggatgttggtgtgtatagtccatccgtacaaaatacgctatacctcatggccaaggaatccttacaaggttcccaagatatatccgtcatccagcttagaatgccgaaccttcactttctgcctgtcaacttgggggagcaaagaactccgctggtgaagtttgctgatgatgtgtacctgccgacggatgaacacacgggacgattgaacaactttataagcgtccaantcaaagctgtaaaaaaatgtatcctcaagcgggtataaactccncttnnctcccaacaccccaagcttaaaatggcantagctgtaaggaaaataacgtcataacgtaccccnagcttagttgggggnggaanaatcaanactgtatggtgtgcactgnaccgtagggtcaacttgtagttccacgtanctgtnatcnccctgntgaacattanactt

SEQ ID NO: 84483 - DNA, 608 bp, Triticum aestivum
  unsure (1)..(608): unsure at all n locations
  Clone ID: PAT_TA_84483
gtcgacctctccgcgccgctcctctggcggggactcagcttccccgtccgcacccctcatcccctcgccgccgacctccccggcatccggcccctccggtggcccgctagggcggctcacgagcctccgcggcgcggcgcggttcatccgccgcacggggagccggcgcctgatgagggagccctccgtggcgtgccgggaagacggccgccgagcacctccgaggagcgccagaccgactggggcctactccgaagcccgtcgtccgtgctccgacatgctctgggaacctcgccttccgtcgccgtcgccgcggccntatcgcccgcatccggtgggcgaagcggccaccgtgccgtccgtnttctggtncgtaggtactgctccatgcctcctcaactatcaagctcaccgtcnattaaagngtccaccaagnaccgacaagaaggaacggtgatnaggatttaaantcatatggtgaacatnggatnncaaaacattttcctcaanatgtggttgttggtccatgggtgtcgcaagnggaaanttanaatatgnctancttatggntaaatgtttcgngttgagtttttngctcggtncctgat

SEQ ID NO: 84484 - DNA, 313 bp, Triticum aestivum
  unsure (1)..(313): unsure at all n locations
  Clone ID: PAT_TA_84484
gtgacccangcgttccncanatcagatcggnaaggcnaaacngagatctcgagctttcgcgccagcnaccacancanagaggangccacancactananagccccatggntcntactctcgtcgcatcgncagcantganggnaatatgtcttcggtgtncagcggtgatttgancgcncccttcttcggcttccttggaccntcgtcactctcgttttctcatgacatggnaggtcgcatacgggactgacaacagtngcgtcagtgtggagtccangggtgtcatgngccaaaaatngttaaagacgttca

SEQ ID NO: 84485 - DNA, 241 bp, Triticum aestivum
  unsure (1)..(241): unsure at all n locations
  Clone ID: PAT_TA_84485
cgggccggccccgaggtgctggctggtgggtggaggaggggattctaaccaaagccgactggtcaaaacaaaactcggcaagaagaagacaatccaaagaaataaaanaaangtgactcancataggcgggggcttnntgcgggaatanagntccttnncgaatcgctantcctccaaaaaantgctgtnnganagataattnaccatgaagtccanctcttctttangcatatcnttttt

SEQ ID NO: 84486 - DNA, 438 bp, Triticum aestivum
  unsure (1)..(438): unsure at all n locations
  Clone ID: PAT_TA_84486
ctgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaacatcaagaatgacttcacccctggaggaggaagaggagatccgcagggagaaccagtgggccttcgagtaaggaggtgctggatctattgatgcctaagtttgggtgggtgtctactactatgtctactttatgttgtcctaatggttgtaagtattttgggatcactttgcttgcgaatgtctcnccgtaagactatgttggtcaatggcgnttattaacttattaccaatgaaacacttcgtctgctgccctaagagtttatcccaaaaaaaaaaaa

SEQ ID NO: 84487 - DNA, 605 bp, Triticum aestivum
  unsure (1)..(605): unsure at all n locations
  Clone ID: PAT_TA_84487
tgcaggtgggagttgtatctgccactgttggggtggaacagattgactttattttctggatttcgtgatcggggtcacccgatctgctgcataagaatttatggtccattctcttctcttagctgtttctccttcagagtctatgcagggaatgttgagtgaattcatcgtgcctgaagaagtgcaaggtcatcgctctatggaactgggtaaaaccttcggagtggcaaaggaactaattgctgacaggtgttccactgtggttatacagtatactgcattgtcatatcattgcccaagcaagaactcaattatttaacttaancaaccttaaaaaaatcnccaaaatnctgggaattcaaacannnggcccgggaaanatggntncaanaaggggatgacaaggctgaaanagctttctncaaaangaaaaaggactctgaggnccncggcactgtntaacaaaaactaaatgattacaactgcttccaacacatcatntatcanagagctgcaaattacanagtatcccaagtaaacacactgtgattccagaataactgtacaaaaatgatacctttttagnaaaactatattagnatccg

SEQ ID NO: 84488 - DNA, 284 bp, Triticum aestivum
  Clone ID: PAT_TA_84488
aaagtgcgggagctggcacaagaggttctgagccggatggggagccctctgcggctgtccgtgaggaacaaaggccggctcgtggcgaagcgagacagggtgaaacaatggctggccactgagtggacttccatggtgcctgaggagagcacggatcagtcacccaattcaagtgatcagcaacaatttttgcccaatcttttaagaaaactcgggcagtttttttcctcatttgtgccagtttccagatgaatggcaagctgtttattggtaaaaaaaaaaaa

SEQ ID NO: 84489 - DNA, 628 bp, Triticum aestivum
  unsure (1)..(628): unsure at all n locations
  Clone ID: PAT_TA_84489
ttttggcgcaggggggaacgacaatatcatttcagtcgtaataagcagtttcaagtttactttcacggacagaaagcattctgctaaaacacacaccaactttcgtgccgacagcgagttacgaataagagctatgcagggaggattacagatccagacctagtaaatctatatcgcccaatttctgggtaaccttgttcgctccgttactttctagcattcttttcttccgtgggtgccctctagcagttgggtgtccgtatatggccaggccttgtactctgggaccttccaagcgcggntcttctcaaagttgctcaagaggaatatgctcaaatggtccagacgtggggaatcgtccccgcacaaacattacttgaaacatcaacaacttttgagactaatatccaacgantcccttgggatgggccaatcaaatgatgccattgagacgcaagatacaaggactcaacttcccaaggcaagagnattgtccccnaaagttncctggncaatcnaactataancctcaattgcaacnaaaaggatgtcctgaagtatctaaaaantcagtacganagccaattccaagtaggacantgcagtaatcaatncagntagngggang

SEQ ID NO: 84490 - DNA, 629 bp, Triticum aestivum
  unsure (1)..(629): unsure at all n locations
  Clone ID: PAT_TA_84490
ttcagatccacacacatccgcatccctctctcctcggtttcctctcccaccaccaacccccagatcgcagcgatctccgccgccgccctctctgggattccgcgcgacaaagtcaggcgtagagnaggnaangganggagggaaggcgcagcagggcgggtgggggagatgttcctctgggactggttctacggggtgctggcctccctcggcctgtggcagaaggaggccaagatcctcttccttggcctcgacaacgccggnaagaccacgctgctccacatgctcaaggacgagcggttggtgcagcaccagccgacgcaacacccgacgtcggaggagctcancatcggcaagatcaattcaaggcgttcgactcggcggcacagatngcgcgccgcgtgtggaaggatactaccaaagttgatgcgtantataccngtagatgatatgataaggacnattctgaatcaaagaaggantccatgctctctgtcgatnatctttggcaatgtcaatttccaacctgggaanaagattataccatanctgctcnaaaagantaggatcactaggcttanaattanaccgggaaggaagtaactggnatcaagtcgtaatnagtttaa

SEQ ID NO: 84491 - DNA, 628 bp, Triticum aestivum
  unsure (1)..(628): unsure at all n locations
  Clone ID: PAT_TA_84491
gtcgactgctccaccgtaagcgcctgtttcaccgccaccgccgacttcggttggtcctcacccgcgcgtggatggcgcacgcgcctctctcctccaagtgcgccgtcgacaccaagctcccctgcctcaccgcgcgatctccagccccgccgcgctcgcaagtcttgagatcgagcagatccaccatcctgcgccctcgccccatcacgcactcaccttggccccgcatccctgcgccgccataccctcggctcgccctcgcctcatcctcccctgcccccgcaccgcatccaaacgcgtaaattcaagcgtcgtcgccgcgatacctgcccatgcaacgngcggnaaacccccccgtgccgttcgcaaactacgtggnatttcccaacctggccccgtcctcctcacatcatcggtcccccgtcatccatatccantgggaatctctggcgacaaangatgacgtctccggggtggtggccgccnganaccgttgccccaagccattccnaaacctnaactgtaatnacggaggatctcatggaggatnaatacagttagaatcaggtctacatatcaactctcggatcgacggaaattntccggnacctactaaaagggggagngg

SEQ ID NO: 84492 - DNA, 621 bp, Triticum aestivum
  unsure (1)..(621): unsure at all n locations
  Clone ID: PAT_TA_84492
gcggcctctccgccaaacatcctcccgcccaagcgcatcacctgcagagagcttcttcctcccctagtcgcggctgccctcctccgcgaccgtggcaccgatcgatctctcattcttccagctctagttgtttctgcggattcgttcgaagcgcgagccagcgagcatggaggggctgacggagagcgaggtcgccggcttcgcggtgggcgcctttctgctcggcgccagcatcgccgcgcaagagggtcgacggcttcgtcgccgcttcgcaagagaagtctttaaacatgtncaagcgctgtngtgatcttcnggatggtggatgttcacantgcanaggagtngctccgttnangaaaggcgaacttcaattccggcgtncttgangacatttatgaactcctgggagctgaaacaaggaactgattggccctngctcaaatgccttctaaagncgctcccgtttncanatgcgcaagncaaangacattggaactttttgtataatgtnaaatangcattaataattgtgattgtganacaagaaaactgccattntaaccnaaagtcgganganaacatgtgatgcttaaacnccaaaaaaacananaaaaaaaa

SEQ ID NO: 84493 - DNA, 332 bp, Triticum aestivum
  unsure (1)..(332): unsure at all n locations
  Clone ID: PAT_TA_84493
ggcaaagaaggtcaacaccttgatcaggcctgatgggaagaagaaggcttacgtgaagctgactcccgactatgatgctcttgatgtggccaacaaaatcggaatcatctaagtgctgcattaggcatctgttgtttcctagttcaatctgttgtgtcctagttctatgtgaaaccagagttttgtagctatggatctcaatcgttccattaccatgtgttatgcacacttctgaatttgatatcatccaagtgaccggttgaactatttgcgttctgcacttcattacacttggacaccgtcatctttaatgaccaaanaaaaaaaaaaaa

SEQ ID NO: 84494 - DNA, 365 bp, Triticum aestivum
  unsure (1)..(365): unsure at all n locations
  Clone ID: PAT_TA_84494
tatcctcccctcatcccccgtacaaaaccgcgctccctcccgcccgcccgccgctcaagccacctacaccaccacctcgccggccacactcgtctttctcacgagccacagcccacaggtaagcgtcgttgcttcacgccccgttccaattctctgcactgcattacagtcacagcgcgtccgtcctgactcctgagtcctgacgctcgcgcgctgctttgcaactcctgattgtcactgccggtcttgcccgtcaccaggcacaggcaggctctcgagctcaatccacccatccangggatggntctngttcnncgtggnaacggtcccgtncctggnggccccggcggcaanaaanngtccgg

SEQ ID NO: 84495 - DNA, 633 bp, Triticum aestivum
  unsure (1)..(633): unsure at all n locations
  Clone ID: PAT_TA_84495
gccgtctccgacgccgtgcacgcatccatacgacggtcgagtatccaccggttgttgtttcaatatattcaacgcccggttgaatggagtgtcccacttgggcctcgccaatgcctcagacggcgagtcgcttttggccgcaatccggtgctgctctctctgcaaaaggcacaaggatcgtttacaaatatgactaacgtgtgcagtccgaattgatcagaaactaaaataccagcatctcatgaactccgtaatgaccggtgttgtctccgtaaacttcttcactggggtcccaacggtgccgggccctcnaggaatcacgctcctgcgggacggtgaatccgccnaaggggtctgggatcccaaatcgcggttccgntcctccttggccaatttggcccctttccgctgtaacaacggttcccaaggtgggnggncccaatgtaaacccttgaaacccttcaagtacttaaattgttttggaantcngcttgcaaccccttgatttgnaacgggcttcctgatgtcggtaaccttanaactaanataggtcctctgtcnatatctgctttanncagggggccgtacaatcnccaaaggatctatacccctacgcgtctttaantctacgga

SEQ ID NO: 84496 - DNA, 636 bp, Triticum aestivum
  unsure (1)..(636): unsure at all n locations
  Clone ID: PAT_TA_84496
cccgagcggcaccagcgcgcccgccccgccatggctatccccaacgcctttgactcccccctcgcggccaggtccgccgtcggcgcggcgctggcggccgtcatcgccgtccgcgcggtccgccgccgctccctagacgcctcgggcggggtcgccggcttcgtcgtcatggcggtccacatctcatgcggctacaggtacggggcgctgctgctggccttcttcttctcatcgtccaaggtaaccaagatcggggaggaccacaagcgccgcatcgaggagaacttcaaggagggcgggcagcgcaactggttcaattctagcaaatagcacaattgccactgtactgggttgtgatatttgcactaaatgactgggagggcaagattaagtgcatggactcaaatggttcaaagcttataactggcatcataagtggtatcattggcactacgttgctgcaatggaatacttgtcatctaaatcgtgtgctaataatgaacaaccaaggctataatccttaactgtaagaaagtacaaatgggcatcactanaaggattctctcaaagaggagctacaatggccacttcgtgtttgcgtnatgtaaattctcatagcataggaancananacat

SEQ ID NO: 84497 - DNA, 639 bp, Triticum aestivum
  unsure (1)..(639): unsure at all n locations
  Clone ID: PAT_TA_84497
gtcaaattcgtatcgcaaaagttgcgttaagattcgtcgaagccaacaaactccaagtctaagggtatctcccacgtgggtcatcaaaatgtctgggccagacgatccggatacttttagagcttcaacaaatatctaggtctagatgcctgaaatcccgtatacctaaaccgagggtaactttggggaagtagattagtgtgacatgtgaaatctctttttcctcttgggttcgtctcacatacctgaaatcccacagcccacgtctcccgctcatctctttttcctcttgattcgtctggttcactgtcagtcatagatcatagctagactttaggaacatggttgacatgtgaaatccatatcccaaaagttgtgctaattttgtggaagccaacaaactccgagtcggagctcaacaagacaaangtacgacctaattggttcgcagaaaagagattgctcaaattcaatataaaacatagctaacattgtttcggctatgatggttttgaagtacccctcaatttcttaatatcaatataacaactcatagatncaatatagtgaagaacacccaaantttanccatcgaataattgnggtnanccaaatttaanataaggcatanattacaaa

SEQ ID NO: 84498 - DNA, 575 bp, Triticum aestivum
  unsure (1)..(575): unsure at all n locations
  Clone ID: PAT_TA_84498
gcattgattgctgaggtcaagaaagcatccccgagtaggggtgtgctcagggagaactttaatcctgttgaaattgctcaagcttatgaaaagaatggagctgcatgtttgagcattttgacagatgagaagtactttcagggaagctttgataatcttgaaaaggtgcgcagtcaaggagtgaagtgccctcttctctgcaagganttgtcattggacaagtggcaaactataatgctcgctctaagggtgctgatgcaatcctactaattgctgctgtgctaccaaattctttgacatnaagaatttccttccanatttnccnaagaantttgaatgacagtcctaattgaggtccatgatgaaagaanatgaacntttgcngaaaaaaaatgngttaacctaattgggatcaataaccaancctnaanttttgttgttgnactcctaaancaaaantgccaagggggggcccggtncacaattccccaaaaggaccttancccgccacnggctcgtttaaactctgannggaaaccgggtaccactaccctganaacccttccacnggaaaa

SEQ ID NO: 84499 - DNA, 514 bp, Triticum aestivum
  unsure (1)..(514): unsure at all n locations
  Clone ID: PAT_TA_84499
ctgtcgcagagcttcgagtacaactacggcgacttcatccccgtgctccgccccttcctccgcggctacctcaaccgctgccacgacctcaagacgcgccgcatgaaggtcttcgaggacaacttcgtacaggagcgcaagaaggtgatggctcaagactgggtgagatccggtgcgccatggatnacatcctcgaggcccgaagaggaanggcgaagatttaaccacgacaacgtcctctacatcgtcnnagaacatcaacgtcgcagcgattntgagacgacctgttgtccattncaagttgggcatcgccgagcttngtgaacaacccggcatccacacagtccgggaangactcgctccgtgctggggcccccggcgttcccttnacggagccgacttccangctcccctacttttaggcatcntcaangaaacctcccgcctgcgcatgcatcccgctgtngcccccaaaatgactcaacaacggaactcnccggtntaaatcccgccg

SEQ ID NO: 84500 - DNA, 551 bp, Triticum aestivum
  unsure (1)..(551): unsure at all n locations
  Clone ID: PAT_TA_84500
ttttttttttttttaacatcaaattttatacatatctattttaaaatattaaatttgttctaacagttcggattaccactttcatccctaatctcaggtagcaaaatagcccagaggacgacggaaaaaagggcccgcaggccacagacttgttcgaacacttgggaactggggccagcctctgtgcgttcatgcaatctacatgtgagaaatctgctccttttaggagctcaacactccgggaaggttaagccgattcgaagagaaccaagaaaactctgctcaagtacactgtacaggaaaccgactcctgcgcctccaaggtgtgggattgtacccttgccattggagcaccaacantcacatcaacccaccgagttttttgaaccaagctgantatccaacccgactttaanacnggnaaccaaaccattcccctggaacccccnatcnaanccttgcctccaattnccangtttttcngcaagaggaatanatacatnattacgctcncaacnaaaataagtcacngacatcatnccnantcacga

SEQ ID NO: 84501 - DNA, 589 bp, Triticum aestivum
  unsure (1)..(589): unsure at all n locations
  Clone ID: PAT_TA_84501
ttttttttttttttgaaaacataaaccactagatgcatgtaataagcaatatagtaaagccaaaactcggcaaccatttagcagaacacaacaagagatattanccatataatgagttcttcanatctcanatacactccacattaagttcaactcccatccgaggntcaaagcattttataagtaacataaaactccctancacataatcaattgatngcaaaaacttagagcgataaaggngttataagnggtntggcaccatcagattttccncgaaggcctatncatttttccngtganaacacccnttagnggcggnggcaccaacaaaggagggggggnacntcgtagaaaattaactcacttngtttgtgggcgggccccgcctgccntccnagaancatncgtccttcctantnaactttagttnccanacatgacttggnaggggggatccacttcaaggnggaccttnactcccgcgggtttccnccaactggntnaccaacgangggganaccgnanatttgcccnaggccttttgggcccnaaactnaaccctcncttgggtgggaagaannanttt

SEQ ID NO: 84502 - DNA, 576 bp, Triticum aestivum
  unsure (1)..(576): unsure at all n locations
  Clone ID: PAT_TA_84502
cgtcccctagccccgtcctcggaccacggccgagcttgccgccgccgtgccatgtcattgccgtggccacagtcgcccccacccatttttgagcatgcctccgtgctcaccgagctcccaggagccgaacacgaccaacaccggcccctgccgtgcaccgtaggtccttctcccctccctccgagctccggccgccgctggctccgacgtcggcgtcatctccgaccaccccccgcacacaccgcctgcaccactccgacgcgcgatccaccccgcagaacgtttcgcatctccgccgtccattttgtccacgggaggacaaacccgaacccgccgccgatctggtctcgccggcggtaaacccgtgggttgaccgcttnacaatgggtttgaccccgtctgccaaggtttgaccctctctctcnctgacaattggccatcctgttaattaangttattaattangtnantaacaantatnnatatcantaaanctggccccgacnatgaaactantagggtagttagcntaattaccaattgntaatgatcacnacaatggtcanaggnagtttn

SEQ ID NO: 84503 - DNA, 496 bp, Triticum aestivum
  unsure (1)..(496): unsure at all n locations
  Clone ID: PAT_TA_84503
caccggcgacacggtgtacgcgttcggcgacggcctgagctacaccagcttcgcgcaccacctggtgtcggcgcccaagcagttggccctgcagctcgcggagggccacgcgtgcctgaccgagcagtgcccgtccgtggaggccgagggcgcgcactgcgaagggcctggcgttcgacgtgcacctccgggttgcggacgccgggcgagaggtccggcgggcacacggtgttcctgttctcgtcgccgcccggcgggtgcacaacgcgcccggcgaacacctggctgggcttccagaaagtgtcccctggagccccggcaagcggcgttgtggctttcaangtggacgttttgcaagactcaacgtccnttgacaacttgnaacaggaagttgcctccgcagcaaacctgactcggactnaacaacctcaanttgantctatgccaaaagggaatgtacnatncaactnangatttgatttnnaggtggatgtcc

SEQ ID NO: 84504 - DNA, 489 bp, Triticum aestivum
  unsure (1)..(489): unsure at all n locations
  Clone ID: PAT_TA_84504
gggtcgtgtcccatacgaaaagtcggcgtttacggatcaacaggccgaacaaaggtcctgggacattaacctaggatggttcttggagccggttgttcgtggtgactatcccttctccatgagatcattgggcaagggaacgactacccttcttcactgacaaagagcaagagaagctaagtgggtcctatgacatgttggggttaaactattatacctcaaggtctctaaaaacatccgatatctccaccaaactactccccnattgctccaacactggacgacgcatatgccattccaagaaacgaatgggcctgacgggaccccattgggcccttgggatgggaattcctggttcaacctanatcctgaaggctaaggntnngcttaagttnatnaaaaaaaattcggaacccacccactaaatcnctnaaaacggatggtgactttnacaagggatttacccaggaattnccttggttacccaaa

SEQ ID NO: 84505 - DNA, 552 bp, Triticum aestivum
  unsure (1)..(552): unsure at all n locations
  Clone ID: PAT_TA_84505
gcgagggcggcctcgactacctcggcaaccccagcctggtgcacgcgcagagcatcctcgccatctgggcctgccaggtggtgctcatgggcgccgtggagggctaccgcgtcgccggcggcccgctgggcgagattcgtggacccgctctaccccggcggcagttcgaccccctggggcctcgcccgaggacccccgaggcttcgcggagtcaaggtgaaggaagattnaagaacggcgctcgcatntctccaantccgtttcttcnttgcaagcatcttcaacgggaaaggccccttcnaaaattcgccaaaacttnncganccctttaanaaaanccttggcttttncaaaatttnttccccggnattangctttagttcaatttaagccaaatttcaagnntaatgatctctnagtttctcccaanttctgtnctncctttcgnaatnantatcccgatgtaatttcatttaggcanccaataagattggtgtttaataaaaagggttgttanaccggtatttcanataacaggatccgtctcgtaaa

SEQ ID NO: 84506 - DNA, 358 bp, Triticum aestivum
  unsure (1)..(358): unsure at all n locations
  Clone ID: PAT_TA_84506
gaatatctcgagttttttttttttttttttttcaaaacgaacgaggcctaaatagtttattactatcattgcagtcctgtttatttaatcagtagcagtagtagctgtgcttgcgacagttgcaagacgctacatgttgcgttttattcatctcaagtaaggccacgcgttttacaacgacgtcggtctctgcatctgcctgcctgcatgcatggatgcatacatacacaagaangttctngcttgaacncngtttcccaaacaaggcaacaactgggaatccaactttaangggggccaaacnggggncccttccctttgggngcaattttcccttgaaancntcccctnacccaag

SEQ ID NO: 84507 - DNA, 601 bp, Triticum aestivum
  unsure (1)..(601): unsure at all n locations
  Clone ID: PAT_TA_84507
ctcaaaatcttcagggagtcgtagaggagcagcaggtgcaccaaaaggatggcagcgccaggctccctgcgacttctccaggccccgtccttcgctgcggccaagtgccagccggtgggttggccgggcatccgcgcggcgagcgccacggccactgttcgccgttgcgcgcctccggctgctgacgccgccaacagggatgccgtgctcaaagccttcccgccgagaacagggtctcaaagataattcccggccttcaaaacttttgacaagagcattgttgcatcctgttttcacaactgcagattagggaaggtgcaacacatgttttacatagcaatgtnacaaagactttatnaacttgccatggttcttaacaactttccattttgttcccaancngtanattccttcaacgttccattctgcaattanaagcangactaaatggttnagattggaacatatctttttaanaaatggatngantcccctccggacaaatactgaaactaacaaggaaacaggaaatctccaaaatcactnacaataacantctcaacactnntttgcaaattagatagactacanacttcncaan

SEQ ID NO: 84508 - DNA, 317 bp, Triticum aestivum
  unsure (1)..(317): unsure at all n locations
  Clone ID: PAT_TA_84508
cacactttctgtaagcgtgctttcccacttcccagggttactactgtttgcattttctgtagttctttgggtcggtcggttaggacatgggagtggatcgttctatgctcatttgaggtagattaagttatatgaagagaaagcatcgcatgcggggctgtcttgtttgcagattgccactacctcagttccggttccaggtttctcaaaggtatccgcccgagcatctgttctgggtgtccggntccgantcaagtccttggtaactggatcaaaaaacccgaactaatatgtctccctttaccaaaaaaaaaaaa

SEQ ID NO: 84509 - DNA, 409 bp, Triticum aestivum
  unsure (1)..(409): unsure at all n locations
  Clone ID: PAT_TA_84509
cgacgttgaggaaaatatttccaaatctcgaacaaattgattcagatatcatagcatgataactagctaatccttgcccagatactaaggcaaagaaggctttggggttccccggagaagtcattaacagcaatcaacttgtgaggcgaacaatanacagtaatttgatccttaaagtcttcattgccaactctgctcgtgttgtggnagacattgngttcggagtttgtaaccttgagccgttacgggcttaatatagtgattggtaaccaaataattataggtgtacgaggatgtcacagatccataccgtgttacnatttttaaatgttccattccattcccnagatatgttgatttttttccncccaaaatgaggcaaggaacagcaacattcattccggtaatt

SEQ ID NO: 84510 - DNA, 599 bp, Triticum aestivum
  unsure (1)..(599): unsure at all n locations
  Clone ID: PAT_TA_84510
tttgaaactgacattaagcaaacatataggcctgaactgctcaatgcgaatagcctctgtcttcttaggaagaagagttatcgttccaaaattcagctggaacaaatgaagctgaccatcgaaaaactcatgaaagatcggcatcaggtctcccttaatgaagtgccaacactttttgtaaaactccgccggaaacccatccggtcctgggcgccttattgtttttcatttgtgcaatggcctcaaatacctctttctccataaagggagcagtcaaaatctcattctcgtccgtctcaagttgnaggaacatcctcaacccttgnactcatccaaagacacaaaatctcttcccgaagtccaaacaacggcttaaaatagtgngaatgtaaacttcaagtttccctggacaaactacgtccctttgtcntgttcnaattgggaaatccctcctaacgatgcttccattancaatcatatgaaagattgatgtancctccctggncatttacaaccttaccccaaagccattnatcctctcgggaaacccttaagccgnaatcggccattaatccaactacgggacaanaagggtcann

SEQ ID NO: 84511 - DNA, 567 bp, Triticum aestivum
  unsure (1)..(567): unsure at all n locations
  Clone ID: PAT_TA_84511
ggtcaacacaaggccattaacgatgaaggtatgcctcagcatggccgtcctttcatgaagggccgtctgtttgttgaattcaacgtggtgtttcccgagcctggtgcgctctcccctgcccagtgccgatcgttggagaagatccttccgccgaaaccagggagccaactgtcggacatggagctggaccagtgcgaggagaccacccttcacgatgtcaacattgaagaggagatgaggcgcaggcagcagcaagaagaagcaggaagcctacgatgaagacgangaggaggatgctcaaccaaggggtgcaatgtgcccagcaattaaacccgtgttccnttggactgtcccccaaaanttcaacagattttttaaccancctgatnatccccatccntttttggcaaaaatataaccttttaaaaacttnaaccgttagtccancccaaatgttccngggaaaaattaaaccccggatggangtccctggtttaacncaagcctgatggggttantaancccgcccatttatttgtgncccgtnaaaagtnattcagggggccc

SEQ ID NO: 84512 - DNA, 342 bp, Triticum aestivum
  unsure (1)..(342): unsure at all n locations
  Clone ID: PAT_TA_84512
ccgcaggcagccgcccacgccatccctgccgccaaggataaggagaaagtcgacgaggatgacctttctcgccgcctcgccgagcttaaggcccgcggctgagaggttgtttcaggctttatcagatgcgattcaggcttatgctgttgagccgcaatgacccattgtcctgtggactgctactcatgtttgggtagattcctaaatactactgttatatgcttgaaggcgtgtgttggcattgccatgtngggttttgtgtnacccatggaacttgctgtccttattgtacttttaaaacccaatatttttccccattgccgacatctgtgattcccaaaa

SEQ ID NO: 84513 - DNA, 561 bp, Triticum aestivum
  unsure (1)..(561): unsure at all n locations
  Clone ID: PAT_TA_84513
gcagcaccaactttcctagctaatttgcaaatcgcgtggaagagggagaaagagagatcagcgaccgagcatggacaagagggcgtcgtccacctccttgctcgtgctcatcagcatcctactcgctctggcagaccccgtcgcagcggggatgaaggccacgttcgcggcgggggttgggcgttcgccgccgacacggcggtgctgcggcatctgatgacgacgangctggaggacggcgtttgcgccggactcacggttggtgttgaacttcaccgcgcttccttggcccggnggttttccttaaatcaaaacntcttaattccaananaanggggcttcanaaantccttcccaaccnccggccggccntanaacngccngggttgcattacatntacaattccccccantngactacactcccanaantattctccgcccaagggtatacaccannccttattgttacccntngtgttgtcatttccggtgngtccacacnaattttggtngcaactataacatnnctgaanaatnngggatnttaaaaaaaaaaaa

SEQ ID NO: 84514 - DNA, 477 bp, Triticum aestivum
  unsure (1)..(477): unsure at all n locations
  Clone ID: PAT_TA_84514
tcgtcgatctcctgctaggtgctaagcttagctcgctcgctggcaacaacaatgaaagccgcaactggctcatcatcagtctctcgcgctcttgcgttgctcttggcggcgtgccttctctggaaggaagccgcgtgcttctcggcgtccgggctaaacaagcgttcgccaccttctaatggcggtaagcgacgcttcaangaacgatgggtnggggctttgtgggtaacggcaacctgttactccnacggggtaacggaacggacacggcggcgctnaacaangngtcttnaaacgacgggcctccctngcggcaattctaaccggatttccctgcgaataacnaagcggccgccggttttgatccgcggaagtnnggtnacaataacgcaacaactgtgcctcccaaataagcgttgccaanaanaangggggttnntaaacccccngggaaaattttaaatggccaaccggctt

SEQ ID NO: 84515 - DNA, 413 bp, Triticum aestivum
  unsure (1)..(413): unsure at all n locations
  Clone ID: PAT_TA_84515
cgcgttcgacgagcgctggatgtcggagctccacggcatcgacgccgccgtgctgtccgcgggacactggttccggatccccagcgtgtaccaccggggcggcagggtcgtcggatgccacggctgcgacgactacgcggccgagttcaaccgcaccgtcgccgaagagtaccagcagttcttctccgttttcnaaggaacgcccgtcaagacggacgctccccgaagcccgccccgacggatcctcaccaatatatggncccccnggaggaaaaaaaacccgcagcttatggcgttcaacacttctcnaccgttcgcacttnccaagggcactggaacgaaggggcgccccttncaagaaagaaagccgacaaggagctttaggatacacccaacgggatgaggaaatctcc

SEQ ID NO: 84516 - DNA, 577 bp, Triticum aestivum
  unsure (1)..(577): unsure at all n locations
  Clone ID: PAT_TA_84516
ttcccctaactccgccgccactgccgtccgcgctcgccgtcgccccgaacctatcgcccactgcatttttccggcggaggtatgcgatgaggctgctgcaagcggaggagctatttcggaaggttctggaggtcgggtcgaagaataaggcggctccggctgctgggggctccgacgtccggcagcaagtacgtccggggtggcatctccgatgagaagaacagggtccgctatgcctcctgagtgttttgtgtccngacaaaaacaaacatcaacttnatggcagatgatttccaaaacatttggttccatgttattcccatactgggttcctttgttggctatccattcaaaatcctaaggcaaccttttgcaattcatcccaattatccttgctgggaanttngtaaacaagaaacttgatatntgcccnaccatattggaagaatttcanccaaatgtgtanaacctcttgatcccngaactaaaaactnggnnatgcaaaacattacaaaattnctgatcgtanaccaggtactgacacagacanaaatggatcaagtaatcaacanaggng

SEQ ID NO: 84517 - DNA, 272 bp, Triticum aestivum
  unsure (1)..(272): unsure at all n locations
  Clone ID: PAT_TA_84517
cgccaaaccctagtccacggcggcgaggcgaccttgcgacctccgttcctctgcgctccggctgagttgctgatttgggataatcctgttctctctgagtgaatcaacatgtctgggaatgatgataagccacatgctgctgcagacagaataaaggcagcacgttatcaagtggctaaagggatttaagcaagggctcaaagctggaacgggctgcgactggctgctgccccgcaatgttaatgcctangccaagnnaaggaaagaaggag

SEQ ID NO: 84518 - DNA, 329 bp, Triticum aestivum
  unsure (1)..(329): unsure at all n locations
  Clone ID: PAT_TA_84518
tctgggtcttggattacagaaatggatgagatgttctccttgtcttgggcttcaaaccattcctaagtaaaaatattttgacggggcgtttggatcccttcattttagagaaatttgaattcactcaataaagtaacttatttaagtttgngnatttgacattccaccactttccaaaagttcacatataancctatctcaaattaaagaaggtgggaggatganaaatgatttangcattagtaaatttgtttcaantccggtacttacagacaccctcaacncatccaccnntagtaaaatgttccacataaatacccggtnacctg

SEQ ID NO: 84519 - DNA, 503 bp, Triticum aestivum
  unsure (1)..(503): unsure at all n locations
  Clone ID: PAT_TA_84519
caccatcctccttcctcccatccatggagcagcagccctccctccatggcgcccaccctctccaatggtggtgctcgcccctccctcccttcttctccattggtgcagctccccttcgtggtggctgtccctgtccctgcgcatcccctcctctgctctccatggacgccagccatggcagcccctatgctgctgngtgatggctgggaggtggaggttagaagaaagactccatgaggctatgacaggtaccccttaaggatgattggttngatggtgttactttggcttcaacccccgccaaccggatagatggtcnnagtgggttaactgcttcccggnagganaggaccaggaggagtantgttggccaagttccccatgttacccgttttcccccgttnattatttcccgctgcattaaatttaagatataattcccaaaaccccgataantatcactatnatactttataatttgnnggataagctttaaaaaaaaa

SEQ ID NO: 84520 - DNA, 478 bp, Triticum aestivum
  unsure (1)..(478): unsure at all n locations
  Clone ID: PAT_TA_84520
caagcgccatacctctgctccatagtgggcacccgtgtgtcacgggcacgacgagattcggcggggatggcgcggtggcgggcgcggcgcctgctgcctctggccaccttcgtcacactcggcatgatccttggatctttgcttcagttagcacttcttcatccgactagatggtatcaattgcatgcagatagttgattccanagctgttcttcttcccctttggtattttaagcctgaattttcaacttggacnccaagngaaatgtttcccataatttcctnatttcaaaggagttgtgattaacctaatggaatttgctagaccaaactcccaaatatccactgttatggatgtttncaacaagaaanggtgttaaaangatgttttcgacaanttctggatgttttgtgaattcncnaaaaaaaaattcccatcctttaagggttaaaaaanaannatttttttcccaaaacc

SEQ ID NO: 84521 - DNA, 439 bp, Triticum aestivum
  unsure (1)..(439): unsure at all n locations
  Clone ID: PAT_TA_84521
tattggcagagcaatcaggcacataaatgactatgctgcaatgctattggttgactcgcgttatgcacagacttcatcaaccaagagtttttcctgcccggctgataagcttcctcaatgggataaaagcacgactctcttgtgctcaaaaactatggagaaattcatagtccgttgcatcaattccttcaaantcaaataaaaaaaaatgtttgaaatactcccaagaaaccaaccaagcattgccattggttggatccattggcaaacaaaatacaggtgtatgtacncccgtnaaacgtacattggtttggngtanccttaagctgcttactttatacaaggttnaancctgcgcccggcaagcatnnaagattangttcanatttanggggacatanccttccccccttnaggattanggtaaattcnaattcct

SEQ ID NO: 84522 - DNA, 234 bp, Triticum aestivum
  unsure (1)..(234): unsure at all n locations
  Clone ID: PAT_TA_84522
ccactcctttctcctcattatttgctttaggtgctgtcatgtctttctccactgggcttgccaatatcagcttaaagcataacagtgtaggtttttatcagatggctaagatagctgtaactccaaccatagtggtagcagaatttattcttttcaagaaaaaggtttcccttcgaaagggggggcccgggtacccaattcgccctataagtgatccgtattaacgcgcgctcn

SEQ ID NO: 84523 - DNA, 470 bp, Triticum aestivum
  unsure (1)..(470): unsure at all n locations
  Clone ID: PAT_TA_84523
atttgcgtctcaccgccgaagtcaaccaccagatcaagggagatgactccccccccccacccccaagacctttcgatgaccatcgctatcgtggagcctttccatcttcagaaaggcaccgccgtcttgtcttcctgagcaggacacaacccctaacgaaacttngaaggaacatctaaagacagagcctcccaccggtaaagggcgggattccacgctgtcatggccctaaacaaatggngacaagccaatgggatgactacaaaggcgagcatggccggtttggcggacagctttttggctgccataatccaaatgcattggatgcttacttccnacgggtgggnaacccaaagacagcagnttggacaactggttcccccaagaatgtccanagaccttgggtttgcnaanagntaagatngnatactngtttaaaanatancngttcaccggaattanccggatga

SEQ ID NO: 84524 - DNA, 253 bp, Triticum aestivum
  unsure (1)..(253): unsure at all n locations
  Clone ID: PAT_TA_84524
tccaaatcccaccagcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatcccggagctggcgaaggangggcngcgtngaagcgcatctcnggggctcatctacgaaggagacccgcngcttaattccncccaagggggggggggggccng

SEQ ID NO: 84525 - DNA, 598 bp, Triticum aestivum
  unsure (1)..(598): unsure at all n locations
  Clone ID: PAT_TA_84525
ctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttcccgtgagcacaaacgcatccccctggggttactaacgatggccgtttctgggacaatgtnggaagctgcctattttcngggtgcaaccgacgccacaaaaggtgatnnaacaaggttggaanaggtcaagaaggattaccctgacccttacttcggatnaatcggntntaacacatncgccaagtgcatntngttaactttaannccttttaancanccgggttgcaaagattccggnaaggccnaanagtcaaccacaangggccanattaaantccattgcggtttttnaanccganattctttggtttnccnccccaatttactttcctgttntcccaaaantttttttccantnaantccaaatttcccaaaaaaagccttnttaaaanatccggggatt

SEQ ID NO: 84526 - DNA, 386 bp, Triticum aestivum
  unsure (1)..(386): unsure at all n locations
  Clone ID: PAT_TA_84526
gcaatcatgcaccaacagagagaatgtgcatgagagatgctgctgctgcgattcgcaggataacggatagctatgttaaaaataagacaaactgaggaagttgttgcaactgcacataacacaaagcattttgctgaaacaagatcagcacctgaaacatccaggtcaagcccccctgaagtgggcggcatgcttaatttgctttgtaagtggtatgttttgcattcccaagtgtgggtgttgtatatgttaatttcctgcccaaccattactttttaattacatacatattatttgttccnaaagaggcccaacgaatgtttnaaggcttaacctaagcaaatcggctttccaacctaccccccaaaaaaattttnttaatggaa

SEQ ID NO: 84527 - DNA, 295 bp, Triticum aestivum
  unsure (1)..(295): unsure at all n locations
  Clone ID: PAT_TA_84527
gaaaattcatcagaaacgaccggcttggaatgagcccgttgaaataacagtctgggtgttgtgcttgttgatcctgagttaccaatggttggttcaccagttcttggtgatgattagtgaaaattttatttaaaccgttttattgtattttagaaagcttatttgggcctccgacagagttactgtaccttttcatttttaaatgaaatcctgggtctggggttttgaantcccaagatgtaaatgatttgccaaaaaatngcagaagggttccaaataaaanaaaaaaaaaaaa

SEQ ID NO: 84528 - DNA, 564 bp, Triticum aestivum
  unsure (1)..(564): unsure at all n locations
  Clone ID: PAT_TA_84528
cgcgtccctgtttcgctcgtgccgttgcgctgcgccaagcctccccacctctctcgtctcttctccacccgccgccctcgtgggagtgaaaccctagctagggttctgcccgccgccgccttcgatnaaagacgcctgcagccttaagcgcgagcccgccatgggacacaggacgcnaagcgcatcgcgccggggggggcgccaacggcgccgggcggcccgaaagcgcgcnaagagaatccggagacaactccaaatgggttttaggaagcaaaaccaagccgtcaccaatttttttnacatgcgggttgtccctttgggttnaattgcatttttcnccaaaaatttcccggggngggaactggggggttttnaaagatacaaattgggttggcaactgtttncggtcccccaanaagnggcctatggantgngggcccgaanggnacttaactgtctnaaacccctgtgtanaantaaaactcaaaagtttatggggaaaaatccctttncatgaaaaagaanttgaaacctgaaatggaatcatggagncccaaggtcagg

SEQ ID NO: 84529 - DNA, 602 bp, Triticum aestivum
  unsure (1)..(602): unsure at all n locations
  Clone ID: PAT_TA_84529
gccaaacaccggaccacccctcccccctccattcctccctctccctacacctccgctccctctcgccgctttcccccacccaatccgaccgctgggccgcctcctctccgccggggccggcgattccccggagattccgcgcgattcggctcaagatctggggctcctcttgtgggttcctccggcgaatccggcgggattngnggactccccggctgggagaatcttccgtctctttcgctaactgtttggattatttttaacgtgggagattgcatgccatcacttcccttgaaagtngaaaaatatatgggctgattcttgggattttcaatgggaggtttttgnaagatgatgacaaccctcaaaaacgcgcaaganatcctccagttaaatccgcaattttaacanacntttcctggtttttaaaatctgcatccttttgggaattacaatgggcaaacttttccttccccaanggaaanaactatggttgttccaaaggtgttattaagaaggaggattngtnangataacaacaaatcngtanatctgggtataaaaaatggncaatntggaaaggatcanggatacttaataac

SEQ ID NO: 84530 - DNA, 210 bp, Triticum aestivum
  unsure (1)..(210): unsure at all n locations
  Clone ID: PAT_TA_84530
gtcgaacccgcgcgccacgccgccccggccccgctgctcgtccgcaggccccggccgtctctggcggtggcgagggcggtgagccccgacgccgccaccggttcgtcgcggtcgcccgcctccggcggccanatgctggtgttcgtcccgccgcacccgctgataaaacactgggtctccgtcctgcgcaacgagcanacgccctgcgcc

SEQ ID NO: 84531 - DNA, 548 bp, Triticum aestivum
  unsure (1)..(548): unsure at all n locations
  Clone ID: PAT_TA_84531
aggtgctggaagcaatattcacatgtccggaatgggtaattcttcacacagcttgaatggttatcctgcacaaagttatatggattttggttctagtgccgctttcagcaaggatccagcaatatttgctcctcaaaataatccaccatgccctaccctttttgttgcaaatcttgggtcaagactgtttcctgatcatgagctgactgatgttttctcaaagttatgagggattcataaagctgnaagatgcaaaacaattcnggacanccagttgcatttgttgatttccaaaggacattcgcattcaaactggaagccctgatccgtctccnaaggngcnattcctanaancatcaatttgggcaaaggcatncnttttaaaatacncnaatcnccgganggtcntgcccnaacaancntgaaaccgnccctaaatnnacngaaacgtgttccccctttggntgggcnnaatgcgttaaancctgatgccaanctaatgcgtccaatccttgccctaattttngtttnnaaagggcttncggccc

SEQ ID NO: 84532 - DNA, 538 bp, Triticum aestivum
  unsure (1)..(538): unsure at all n locations
  Clone ID: PAT_TA_84532
ctccggcggaggcggaggccccgtcatctactcgtccccgccacctcctgctgcttccggcggcggcggcggccttggtggcggaggcttctactacccgccgcctaccggcggaggcggcggcagtggcggtggcgcgtcgcancagggcggtggtgtgtacccgacggcgccnccgccgcccaacccgttcctgccctacttccccttctacttctacagcccgccgccgccgttgcactccggcgcgcgggccgtgaccgccgcctcgctgctgccggtgctcctcctcacaagcatgctgctgctgctgtgtcaagacccgtnaagggtccaagattttgcaagagcgagcatcaatcaatgccttctgcacctgcattcatgcatnnctgttccaattccnacaaggcgtgatcattcanctggcatcaatttggttgggggtgcngggttcnacggtacaaatggaatgtgttttttanatcgtcattctcgctcttctctccttcngatcctacanaattaaagagggggg

SEQ ID NO: 84533 - DNA, 477 bp, Triticum aestivum
  unsure (1)..(477): unsure at all n locations
  Clone ID: PAT_TA_84533
gcatggggcacatcatgatcatgaccatgatcatgaccatcacgatgaacaaaagaagcatgaacaaaccttcaacgaagaagcagaaaaaatgatcaagagtgtgaaacaagcactcggaaatggtgaaggctgccgagtctatgggatgttggatgtgcagagagtggctgggtaacttccatatctcagtgcatggtttgaacatttttgttgctgaaaagatttttgaagggtcaaaccatgtgaactcatcatgttatccacgactgtcatttggcccaaagtaccaagaatccataaccactggatgaaactcaaaggtacttcatgacacaagtgggaccttcaaatactatattaaggtgttcccgacggattacaatatcntcaaagaanattgccaacaatcattttccngccacggatatttctcccatccntccaacngacaggcctggcaacgttactcccgta

SEQ ID NO: 84534 - DNA, 448 bp, Triticum aestivum
  unsure (1)..(448): unsure at all n locations
  Clone ID: PAT_TA_84534
tgggggtcgacttccgccgccgaactccgctgtgtgacctaaagggaatcgttctcaacggcggtgggagcgatggatccgagttccgggaagcctgaggaggtggcggcttaccaagagcaaagaggccaagcaggcgaggcttcagtccatgctcgccgcgctcctccgacgaccccatacttgccgacgtcaccaaggaancctccctccgccgacgtccgacactcctggataaacctaagantccggcancgccattgagctgaccgttttcaatttnggtaaacttccttcnatgttgcggtgttttaattccgccactgtcaaggttttggagctngtatccaggaannaagataattgaattnaacaagagaagattggcatcgtcatatctcaatggaacatttcngggataataacnctttcacatcacaatagaatt

SEQ ID NO: 84535 - DNA, 383 bp, Triticum aestivum
  unsure (1)..(383): unsure at all n locations
  Clone ID: PAT_TA_84535
gctagactcttctcctgctcggtgttgctctgcttcagcagttcagctgcgcctcctgctttcaagtttcaatcatgtttggcaacgtacgtacgctcctcctgtaacctttgctagctcctcggctaccatttgctgatcacatctgataagagaatggatggatgtacaaatagatgagcactggagtagtagatttttttcacttcagatttctttgctgctgctgctgctgctcaatgaccatgcaccttgcaccagatatcattgctgtcaggtcaggtatgcatttctgcagcattccccagcgagtccattcatcagtgtaaataaaaccaagaaatatattctgcaaaaaaaaanaaaaaaaccccanggggggg

SEQ ID NO: 84536 - DNA, 282 bp, Triticum aestivum
  unsure (1)..(282): unsure at all n locations
  Clone ID: PAT_TA_84536
ctcgtgccgctcaaatcggctaacaagtaataatcctctcgatacccgaatcggtgaaggaaaacaagacgagtccgtcggtcgtgatcggtaccaatggaaggcgcagcggggatcaggacgaggccggcggtgtgcgtgaccggcgcgggcggttcgttggctccgttggctccgtccgagcgcctcctccgcccggcggcccgatacatgggtccatggcaccgtccgtngattcccgggcgacgccaaagaacgcgcaccttggcggcgaatggacgg

SEQ ID NO: 84537 - DNA, 183 bp, Triticum aestivum
  Clone ID: PAT_TA_84537
cggaatcagaggaaccgaacggtggaagagtacgcctcggaatcagaggagcagcgaggaagctgaaggaggggcgaatctaagcccaattgaagcatgagggcgtcgattaatcgtcccccgacgccgagcgcggaggaggattcggggacaagcagcttctctcggagagatcattaacat

SEQ ID NO: 84538 - DNA, 583 bp, Triticum aestivum
  unsure (1)..(583): unsure at all n locations
  Clone ID: PAT_TA_84538
ttcgtctcctgtccatcccttgtgcgctaccgctcctctcccttggcaacgacgactggcgccgccgctgccagacttcgctgggcatctcgccggcgacgagctcccaccaggattagagaaggtgatggcgaaggagtgacagctgcctggcgcgcgtgggtgccggagttgcgatcggtggcgcnggtccggcggagccgtcnggtgcttgttaatgggaactttggaggcattccaagatacaagattccctgggatttgctaaagatnnagacatattccgggcaaactactgttgggcagcgctgcaatttttggcttttcccttgggggctgggagcttgatcaaatggcggaatcctactagttgtttccctcctttttccggaacacactttnnccaatggcttcaaaaggaggttcccaaatttttgacgcancctgaatggttcaaatggaaacatcnaccctgtacaatttaacaactatactcaaggtttgnaaaanacnattantccgnttggggtggagggaaancccccatnaaanttaanaaatcctttaatanaaaaaaaaaaaa

SEQ ID NO: 84539 - DNA, 383 bp, Triticum aestivum
  unsure (1)..(383): unsure at all n locations
  Clone ID: PAT_TA_84539
ctgagattaatatgactgggtccttgaaaacaagttcagccaattaatcaactaaactagcgtacgtcaagtgtaggtatcttgtctgctttcatggtttttcttcattcgcaactatcttagaacatatgtgtgtgtgagggttaagattaatctcacaaagcgatagatagctgatcacaattaacgaccttgggcccgggccaagtaatttaagggtgttgtnagtatgttaaatcaacccatgttatgggatgcatgagtagaanttggtttgggtagcttgaaccctatatattanncccctttacacgcggtttgagctaatacatgtaatgtagtttgtgtgttaatgcaaatgatgttattaatccaaaaaaaaa

SEQ ID NO: 84540 - DNA, 425 bp, Triticum aestivum
  unsure (1)..(425): unsure at all n locations
  Clone ID: PAT_TA_84540
cggggcccgacgcccggcggctttactcagggcaccatggccttctcttcgtcactggcgccgttcttcccaccttctggaaccttccgagcccatcccgctaggaggctgcgggccgatgcacccgggaagattccgtggcgtcctgcttgccccctcccgacgtcgtggtgacgcgccgagcagggaaagaacgccaggtcatctccggcgctgggaaaagcataatgtacaccctcntggacttctcctaattaacattttnaaggccctgatacagatagcttttaaattnccaacttatgacaagttcgactgggttattgtaactcccctgaggactgatntncttcaaggatggaagntctggatcccnaanggcatactttntttgnaaagacncaggttttcaagaanngcccaac

SEQ ID NO: 84541 - DNA, 380 bp, Triticum aestivum
  unsure (1)..(380): unsure at all n locations
  Clone ID: PAT_TA_84541
cattttccttgcaaccgattgcctatccccctcccaacccaagaccgatggcgcccaaggccgagaagaagcccgcggcgaagaagccggcggaggaggagcccgcggcggagaagacgaccgccgggaagaagcccaaggcggagaagcgggtccccgcgggcaagtccgccggcaaaggagggcggcgaagggcaagcgtnggcaagaagaagggcaagaagagcgttggagacgtacaagatttacatctttcaaggttgctgaagcaagntcaccccggacattcggatctccctccnaaggcatgtccatcnatgaatcctttcatcnaacgacatccttcccagaagctggcccggcgaaggcccccanctttc

SEQ ID NO: 84542 - DNA, 325 bp, Triticum aestivum
  unsure (1)..(325): unsure at all n locations
  Clone ID: PAT_TA_84542
ggacgccaccgcgccggtggcgggggccgangctgtggtcgccggtgctggcgancaggcgggaatctccgccntcatcccangatggttctccgagatcagccccatgttgcccngtnaggcccactccttgaaggtgganaatgttctgttccanggcaagtcaagactaccaaaatgtgatggttttcaatccctccacgtaccgnaaagtgttntcctcacacggnttattccaggtgacnaaagaaggatnaattcgccgttaccaaagagatgattacncacctgccccttttgctcccattaaaaaccccaagatggg

SEQ ID NO: 84543 - DNA, 246 bp, Triticum aestivum
  unsure (1)..(246): unsure at all n locations
  Clone ID: PAT_TA_84543
ccagcccgtcgcctgcgcgcatctctctacacttctactgcttcatactctcgtagagagatccccgcggcccaataaaaacccgactcgctagctgcactacacactcgcagatggccggcctcaggatgaagttcgtcgccgtngccgncatggccgccgcgctcgtggngtccgccgcagccgccgaggcncccgncncggccttcgcctcggacgctgcggccgccgtnnntctcgcatcgg

SEQ ID NO: 84544 - DNA, 562 bp, Triticum aestivum
  unsure (1)..(562): unsure at all n locations
  Clone ID: PAT_TA_84544
cgggattgttcggaggcagcagcaagcagagcggccacgcggtgtcgttcctcctcggcgcggcgctgcccactgccctactcttcttcctcgcgtccgaccgcctcggcgagggcttgtccaccatctccagcagctggcggggcaacgggtcgatatcgaccgcgcagcagcctgccgcggcaaagccggcgacgaccgatgctcatgctctgtccgccgccgccggccgacgcctccgatgccccgtgccgcgcctaccaaagattcacaagtagatttcgcgggcttgccgaactgctggcganagtggcgacggaggacaagacgttattaataagttcggtnaacgaatatggacgcggccaattcgcttgcccanatcttccctccgcggcttttagggccgccaaagacacaggactccgttcacacttctcatcncacgttnangccgtccttnaacggtgcaagcctncacccgantgcaccncagggnggcccgtacatncccanatatctatanccctanggctcttaaactctacngaaactggtacat

SEQ ID NO: 84545 - DNA, 614 bp, Triticum aestivum
  unsure (1)..(614): unsure at all n locations
  Clone ID: PAT_TA_84545
cagcagccctttgcccttccccctcacctccccacactagcagcaaggatgtcgcctgttccctggtggccgaacctggcccctgcgcccagcccatctccttggacgccgccaaccctggtgcttgcccgggaactgccctttcctgtccatggtacccaagctctgctcgacaccccttccagcgcgcgtccttgctccctttgtcgctgctccccaccgtgccgagtgtccagctccgtcggccgaatccctcaacgccagctccatgggcagccagcgtccattctccctgcaagcgccccctcacgggtttcctcattttgtgacaagcgccgctccctggncccgatcccaatctcaacgcgacactccaactccggggaataatggcatcccaantctcnagtcccgtgggtgctccgtcnactcaaccnaaccgangcntgtaccaacacaacctcggttcctccgggtcnnagctcatcaattngaacctgtgcgtcattgtgatcccaagtctngattgctcgccggttgtaactcgtgccccgtcgattaggacntaatgtaagtcatgaaacaatgatgtccattatgtangcaantaatgt

SEQ ID NO: 84546 - DNA, 263 bp, Triticum aestivum
  unsure (1)..(263): unsure at all n locations
  Clone ID: PAT_TA_84546
accccgcagcaaccactcccaccaccaccaccgctgccgcccatgcagcagatccaccatgcgtaccancantacaacccanatgtnatgnancctctccttccccagnttgcaatgcagtacatccttaatanccagcagcagctccctttggtccagcagnagcagcttcagccttcgcaaacatggcagcagcagcagcagcctgggtgcctgtntggncggcganggcgcancaggttgggcanggngctnccggcact

SEQ ID NO: 84547 - DNA, 594 bp, Triticum aestivum
  unsure (1)..(594): unsure at all n locations
  Clone ID: PAT_TA_84547
gccgtctctgccgccgtccaggccgtcgagctggagcagcagcgggagcaacggcggtgtcgagtacacgagcctccgggatatgctcgccgaggccggtgccggtcccgggagcggcggcggcagtttctgggacacggccggccccacgatcgacttcgacgcgtccaacatcaacatccgcaaccaactgctgaagcacgccgcgtcggctacctccagtcngcgattctcctccccgcccgcggaccgtnggtgcctcaagcaatttgtggacgtttgctgctgcaccgcccggcggtgccgcatccctgctgcgcccgtngtcccgaatgctgcacgccggggaccancgcgcttctngccgccttccgtttncccgttcnggcccgccngttcggngccttcctctccggtgcgttcctcccccttttggacataanaaatgcgtcaacgatcnccatccattggaggtaaggngaatgcnaatttgttataactgnaacatacatcgattgaacaataatttacngnggagccaagaagaatgnaaatntcanatccccnagtgaacggaaatacggcaaaagacgn

SEQ ID NO: 84548 - DNA, 377 bp, Triticum aestivum
  unsure (1)..(377): unsure at all n locations
  Clone ID: PAT_TA_84548
ctcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatgggcattcaggctgacggtcagatgcccggtgacaagacattggggaagtgatgatgctttcaaancttcttcaattgaaanggtgccnggnaacangtccccgtgcgtttttggtttaccttgaaccaatggcanccataagggttaaaactngaactaacgcaanttttttcaacccggagnaatcaancantgggaaaggggggtcaa

SEQ ID NO: 84549 - DNA, 607 bp, Triticum aestivum
  unsure (1)..(607): unsure at all n locations
  Clone ID: PAT_TA_84549
caccaacacaaacggtgtaactagctaccttataacaactagctagtctctctcgatagacatctaactagcttaccaacaagctagctaggctctctttcagggtcccttatatggcttccgcacacaaaatcgtgttcgtgcttctcttgctgacagcatcgtcgtcgtccatgctgcaagccaggacgatggcgccaagtcatgaccgccagcatgcacaaacagttcatcaagcggcannanaagggaaggggaaanaagctttaccgagcccttcttcccaagcaactggaccanagatacggcgccgttcgacgacgccgccacccgcaccgcctgctagcaacactgagtcgccgtcgccgtcgccaaggtgggggaaggcgatggcgcatccgncgccgacggtcttgcccaacccccggatagncatcacaaangctacaataactgcgccaacaaattgtntgtcnangttccatatattagatcaaataaaactagactactttctcatcaaannattgcgccgataaatcatactgtcaaacagatttcanatttattnatttcagcantcgggattgggtctaaaaaaaaaaaa

SEQ ID NO: 84550 - DNA, 249 bp, Triticum aestivum
  unsure (1)..(249): unsure at all n locations
  Clone ID: PAT_TA_84550
ctcgtgctgcacggcgagagcgtgctcgtgggcaaggcctctccgtcaactggggtgcgcgatcgatcgatcgaaatatcgaactgcagttgccaaaaccccaatccggtcttctatttccnntngagccgcaaaggaggcaggaagaaggccggcgcaagcgcaggcgcngatggcgatgggagcgacgttcncgcgggggccgcngacccgtngtgacttcctntgtngctgtgcgcctcnggcttc

SEQ ID NO: 84551 - DNA, 637 bp, Triticum aestivum
  unsure (1)..(637): unsure at all n locations
  Clone ID: PAT_TA_84551
ggctgcggtagcagcagcaacgatgggccctctaaggaggattagataaggatagttagatataaggttagttgagattatctaagagattagttgagattatctaggaaggttatcagttagtagttgttgagagtttttaggagagtgttaaggagataaggatctctagctagatagggacggccaactgggcctatttatgtaatcaatgaatggagaaataaagttagacaagaatagaagggaagaaacccctcctgctcccgcccgtntggcaagaggccccggccggctcctgttaacagtaaccgtnaantactgttcaacgtntgaacataccgcacaactccatcaacagcccaaccacgattcctcctccaactccaccgttntaacgacatnacacattgtgtcnaatttatacacatttgattgttccaaatattaattttgatttggcctaataagcnctattgtccaagcaatggnacccaagatcntnggaaccaanaacacaagatcacttccacaaaatcacanttgaatgcggtttctttctgctttccaatggntgatacctggttccttctacattattngnggacaaaaggntcaggnnccccgnttatttttg

SEQ ID NO: 84552 - DNA, 452 bp, Triticum aestivum
  unsure (1)..(452): unsure at all n locations
  Clone ID: PAT_TA_84552
ataaaatcaaatattttattttaatatttttcctccaatatttcatttattttggagaattcatattatctcctctcatatattttaatatgaaatatttttcggagagaaaaataattaanaccaaaaatcctcgtttcaataattgataaanctcaaatatgaaaactgagaaatccccaactctctccgagggtccttgagttgcttangatttagaggatcgcgaaacgaaatgcaagaaaaatatgatatgcatganngatctangtngaacattctanattgaaaacttggggatgttacaggattataacatttcactgcatattcatgctgatctcttacgggtcttgttnaggcttancgtngtccaataagttnagctaagatcttgtcantaggtaacactgttcacagttccantcancagccaagctacccacaggctg

SEQ ID NO: 84553 - DNA, 409 bp, Triticum aestivum
  unsure (1)..(409): unsure at all n locations
  Clone ID: PAT_TA_84553
ccgagatcaatgggggtttcctcgccgccggcgggcccaggcagcaccgcgggggcctcggctgcggccgctgtttccagatgagatgccgagacgcaaggctgtgcagcgccgggggagtgcgggtggtgctgaccgacttccacaggagcaaccgtacggacttcctgctcgccgggccggcgttcgcgggcctggccaagcccgggatggcccagcaattgaacaagcgagacccctctccgtagagtacaaaaggatcccctgcgattacaanganaaaactgtccattccgggttggaaaaaagcgggcgacaaggacccggggaaactggtggtnaaactgctnttacaaaggcggggaaaccgacttctggcggtggaggttgnccccntggggcctcncca

SEQ ID NO: 84554 - DNA, 524 bp, Triticum aestivum
  unsure (1)..(524): unsure at all n locations
  Clone ID: PAT_TA_84554
cgacgacgagagcctgacgagctgcccggcattcggcggcgtgcccaactacatgacgcctacgatgtcggcgtccgccaaggcacgggcacgggcgcacctgcaggagcagcagaagaacaaggcggcccaggagaagcccaggttctcgttcgggctgggccaagagcatcgggagctgggccaagagcccgttctggaaggccgctgtgccgtccgtcgagggtgggcacgccggcggcgtcgatggccggcgggcgacaccgatttgacgccgtcgattaagcggcttaacacggatccaccgtgtccatgccaaccaagntccggacgaggcctttaaattngatacacatgtcggancatcnttgcttacattgcattgcatctccttaaacncttctcgaccattgtgcttggaanggnaccattgattgatggngtggnttgttntgggatacaaaaaaaaaggggggcccgtacaatttnccaaaangatcctataccncccaatggcgtcntta

SEQ ID NO: 84555 - DNA, 504 bp, Triticum aestivum
  unsure (1)..(504): unsure at all n locations
  Clone ID: PAT_TA_84555
agcagccaaaacctacctagccgccgccgcaggcggccccccatcgccgccaagatgcagatctttgtgaagactctgacggggaagaccatcactttggaggtggagtcctccgacaccattgacaatgtgaaggccaagatccaggacaaggagggcatccccccggaccagcagcggctcatcttcgccggcaagcagctcgaggacggtcgcaccctcgccgactacaacattcaagaaggagtccaccctccacctggtgctccgcctccgcngtggcgccaagaagcgtaagaagaagacgtacaccaagcccaagaagatnaaagcacaaagcacaagaagtgaactctccgtgctgcaattctataaggtggacnacgcaactggnaaggtaaccgcctccgnaaaggatgcccaacacanatnccgggccggcgttttcatggcaaacaattngaacgcaatantgcggaaattcggctcactatnttanaacca

SEQ ID NO: 84556 - DNA, 363 bp, Triticum aestivum
  unsure (1)..(363): unsure at all n locations
  Clone ID: PAT_TA_84556
cagatgaagagaaagcttttattctcaaagcgttgataaaaagccgagcgaaaaccacgtgcacacatatatagacacaccacatatatactatatcagtagagagagaaaaaacgcagagtaggaaaatgtccatgcagagacacacacaccacacatccgattaccaaacacgccgttacgaagtaccatgcacacacatcatcaagtaactacacatgatatacatagaccggcaatcaaacccccgttactttcgttcgcctnccatgcatgtcccttctgggccctngggancaanctaantncccagtaattttantttagcaacaaccgtttaacccaanaattgggnttcttctt

SEQ ID NO: 84557 - DNA, 583 bp, Triticum aestivum
  unsure (1)..(583): unsure at all n locations
  Clone ID: PAT_TA_84557
ctctctcctcggcgccggaatggcgaaaagcggcggcgagtccactgtggaggttcctattcccgcttccgcgtcggctacgaggccgaaggcgaaacaccgtatagagatcgaggggtaccctgtggatggcgtctccattggcggtcaagagacttgcgtcatcttcccgactctgagcctcgccttcgacatcggccggtgcccgcagcgcgccgtctcccaggagttcctcttcgtctctcacgggcacctcgaccacatcgggggccttcccatgtatgttgccacccgggggctcntcaagctgcgttcgccaacatcttcgtccccgcgtgcctccgggactcntgganaggtatttangtgaacgcgccatggacaatccgagtcaacaaaactgtccccctgaagtcnggaagattacaactcaagagggactcaagtaagcttnaagactatangccataccagcagggtattnatatancgtgaacaaaacttacaagantaatggctacaagaacaantaacggtaaacatcagttggataaaatagntcanccgaatnnttcnggaaaaa

SEQ ID NO: 84558 - DNA, 620 bp, Triticum aestivum
  unsure (1)..(620): unsure at all n locations
  Clone ID: PAT_TA_84558
ccacagcgtacatgtacgacggcacgtcggacgtgatgcaggccggcgggacggtgaaggcggcggacgcgttcgacgtgggcgcggggcacgtggacccgctgcgcgcgctggacccggggctggtgtacgacgcgggcgcgcgcgaccacgtggtgttcctctgcagcctgggctacacggaggccgcgatccggaacatggtgctcccccagccggcgctggacacgagctgcccccgcggcggcggcggcggcggcggcccggaggcggacctgaactacccggcatcgtgctcccggacctntggcggacggtgacggtgaagcggacngtgacaaactttggcccaaccgggacccgtgtacgcgccgccgtntgcaacccgcaaggngcccccccccaagttttgccccgnanctggcttctcgnncncccgggggcacaagctctataatngacntaaccccgcgaactttccgcggcgctcnactcggcaagtgtctgtccgacggtncacgcgtcgcanccgctctctaggtgacaactgccgacaacgctcaagtgtcagcccaagcacgcaacggttcagcnccctanccccactcncgntnagaggg

SEQ ID NO: 84559 - DNA, 617 bp, Triticum aestivum
  unsure (1)..(617): unsure at all n locations
  Clone ID: PAT_TA_84559
ctcattagtagtgtggagggcttgcaattgcagtcaactcctgaaagttttcagattaatctgctgaggctgagggctgtgcagagccaattccaacaggtgatcgtgatcgccacaagcatgctcgtcctgcgccaagttctgatgagcgagaactcgagggccactcctctggaactggaaaatgccatctcagaactcgtcaaggctctcgcggacatactgcacagctcacccgattccggcacggaagagattgtgcaaggcgatgtcaatgcacaanctcaattggctcaacatcanaggagaaaggtcaaaggcaagatgcaaatgatnanccgggtgttcctcnaagagctccaaacccgttacttgtccttaaaaaaggatcccttcgtccaaanngccttccttgggaacaactaagttgaattgtcccaaagggcaaaaactggngaanctgaatncccccaatcgggccacaatgtntcanaaggtttnaaaggtgctaagngctatnaaagngggaacgttcaaaaagncaaggncctggaaaaancnaaaancgaannacataaantaangttgcttnttaaaaaacgngaatgtaanctttt

SEQ ID NO: 84560 - DNA, 540 bp, Triticum aestivum
  unsure (1)..(540): unsure at all n locations
  Clone ID: PAT_TA_84560
cgaggacacgactaagagaagggcctccaagagcaagagtttcaaagacgccgagaacttcgaagtcctcgtccttgagaagagctgcggttgcaagttcaagtctttgaggatcttgctcatagccatcatctccgcgacagtccttacccttgtaaccccgaccttatacgagcgccagttgcagtcagcctcccggtacgtggatgtcgggtggatgttgggacagagcgagtttccgattccgcggtacgcatccttctgccgatgttgggttggaaggatttnttcaaaagcactggggaaanctaaagaaancggtaaaccgccanaatcatctcaaaantttgggtccttgaattttaaaaacaacnaattatgntccctggaccaattgctcccaaactggaaagcaacnttactccaacggtnanggtccaanancccaanggcaangtcacctggaaaaacccgntncccgaatgggttacaggggggaaaaacgggnaaacccctttccctttctnccggggccaaact

SEQ ID NO: 84561 - DNA, 305 bp, Triticum aestivum
  Clone ID: PAT_TA_84561
ctcccctcgcgactcgtctcgtgcgtgactgcgtgctcgctctccttttcgctgcgctcatctcggtatctgtgccagcgctcgcctctccccgccggcccgccctccttcctttccttgtctagccgaaggccgaagccactgcgcgcgcgtgcgtgcgacgatgtcgtcggcggtggaggccatctcctgccccaaggtcgacgtccccgccggcccggagccgggggagccggccaaggaagcggcgccgcccgcggagcactgcgacacggcgcccaacggcaagtgcgcgccgctgcggg

SEQ ID NO: 84562 - DNA, 224 bp, Triticum aestivum
  unsure (1)..(224): unsure at all n locations
  Clone ID: PAT_TA_84562
ctccaaaagagagcccaatcctaaattcccaatccctcaaaggaaggaggattcttcagcgtctcgcttgccggccccgaatcgcagtcgccgcccggatccgaggaaacaagtcgtcgtcttgctccaccgtccgcccgccgccatgagcttcatcttccggcaagaagaagaccctgctgagctgctgcgggagaataagcggatgctggacaanccacggg

SEQ ID NO: 84563 - DNA, 573 bp, Triticum aestivum
  unsure (1)..(573): unsure at all n locations
  Clone ID: PAT_TA_84563
ccaccgccagcagatcgattcgcgaaagagacgaccgccgccgcatcggaccgtgcccgagccccccttctcctcgctgactcggctcccctcctccgccgtcgccggaggcgaagcaagtggggaccacagaagcattagctgggtgaacccactcaaagggggcagggaatgtgtgctattttgaatgggctgctacaaagttcaagcctttgggaacaacccggctggcccaaaacatcattctggggcgccaacattcaaatggggatcacattgccaacatagccacttttgctnaacaacctgaaagatatcttacctcaacaattgctgttgcatgcacggccatttngcaaagtacacttggtatcacaccggaaaactggacttttcatgttaactttcaatgggggtanagctgtacaattcaacggaatnangcaagnactatccnatgagaantcgctcaaaatggaacataatatgacacagcaaagataacgnttgaagctgatccaagatcaccctgatttttttntgaacaaaanaangtgggncagttttttccgt

SEQ ID NO: 84564 - DNA, 621 bp, Triticum aestivum
  unsure (1)..(621): unsure at all n locations
  Clone ID: PAT_TA_84564
ggaaaacaatgtttcgctttatctgatgagaattgcgtacagcacacagcgtgattattttttatccgtacaagttagctaccagacaacacttttttcggctgagtatgacagattctcagctggctgtttttgtaaccggctaaatgatgatcgataataaatacggtcagtttcttcgttccttcaatcttttggtttgtcttgtctttagcgttactcaaaaatgggcagatcaaacggcttattctttgggcaggccttcagtgtctcttgacgatgacgacagggaagagcgcagaaaaccctttgctggggattcttatccatgtccaaagaagaaacgatgccatctggagtctgatgtcaattccgggtgggaaagcaattgcaaggatgttcccttgccgcactgcaacaattacccgatctttgaataccctctcctcaagtaccctcccaaatgatatgtaagctgggtcgtcaacangaacaaggnatccgccaatattcaacatctggacctactcaatatacagngccgtataatanacgcggatgtacatcctctcctcncnaacttgnacgnaantcgtccaacttgaacgancaaaagttcgg

SEQ ID NO: 84565 - DNA, 590 bp, Triticum aestivum
  unsure (1)..(590): unsure at all n locations
  Clone ID: PAT_TA_84565
gtgtcgtcgccgtcggcaaatcgcttccgctcttccccgccatctccactgacaaggctgtctagtgagcgcgcggccctgctcgctggagccagccaccaccatgcccattgtgtgggcggaaggcgcagcacagggccagctgtggtnggagaangagggcaaatccgcgaccttttcatctgagtaagaagcatcggcactgcggcggcctctccttgcccatcctctctttcgatccttcgaagccaagttaatcgtcgtcccaatcaagaagccgtacaatcccatngcccaaaccaaacaacattatncagcaacacaacttaanctcacnttaaacttcgaacaagaggaagacaagaaaacccangggttttaccgnaaccggggagnttacccttggaaagcttcctcttccggcttnnacgccgcttcgncnttgagggacccgatagagtgatactccccnaatggggnctgtgtcgntccggcntccaacgctggtcccatacggcgctngctatcacccagatacttgcaagantcaancttatcccaaatttntcctcggaancaaaacaagggag

SEQ ID NO: 84566 - DNA, 577 bp, Triticum aestivum
  unsure (1)..(577): unsure at all n locations
  Clone ID: PAT_TA_84566
gacaaacccaccctatcgcccctcctctgtctcctctcttgcccacccgccccaatgtcgccgcccctcgagccccacgactacatcggcctctccgccgtggccgcggccgcgccgccgaccccgaccccgacctcctcctcctcttcgtcctcctcgccggccccccgtctcacccttcgcctcggcctgccgggctccgagtcccccgaccgcgaccgggactgctgcgaaggacgtcgccgccacgctctccctcggcccgctgccggcggccgccgccgtctccgccaagcgcgccttcccggacccgcccagcgccccggcgcttcaaagctaacgacgccaagcaacangctcccccgccgcgccgccggccgccaaacgcaagtggttggatggccgcccgtncgcaactacggnaaaatacctcgccgccggaacgctcaagagcaaggnccggcggaagaagccncttcggactggccattacttaagtganatgatggccgcctantaagaagggganacaanttttcaantanaggatccctggncncaaaaanttaatgttaac

SEQ ID NO: 84567 - DNA, 622 bp, Triticum aestivum
  unsure (1)..(622): unsure at all n locations
  Clone ID: PAT_TA_84567
ccgcagcaagtgcccagaaggccagaaccagaaccaagcagcccgtgcaacctcatatcatcccctgccacgcacctccgtccgccgcgccatggaatcgaggaggagggccgtgcccaccgtgacggcggttgcggtggcgacgctgctggtgacgatgatgatgtcgtcgggcgtgggcggcgacttcgcggcggaccgggcggagtgctcggagcagctggcggggctggcgacgtgcctgacgtacgtgcctttcctgctcctgcttgggtagataataattactttacgcgcggccaacgcccgagtcccggcggtttggttggcgccgcgcgttgccgactgtggtgtgcttcggngtgcgtgctncntgtgtggtggggtactttcacactatattggaaaagaantattacctttaatgaaaaaaagtgtatcgttgtntaaaaaaaanaaaaaaaccccagggggggccggtaccaattcgcctaannatctataccncccacggcgtcgttaaantntacgggaaacctgggtnccaactaatccctganaatcccttnccaatgggtancaaaagcccacgtnccttcaanttncacnaangaangaccnc

SEQ ID NO: 84568 - DNA, 544 bp, Triticum aestivum
  unsure (1)..(544): unsure at all n locations
  Clone ID: PAT_TA_84568
ggcgactggaacggcgccggcgcgcacaccaactacagcacggagtcgatgaggaaggagggcgggtacgaggtgatcaaggcggccatcgagaagctgaagctgcggcacagggagcacatcgcggcctacggcgagggcaacgagcgccggctcaccggcaggcacgaagaccgccgacatcaacacgttcagctggggcgtggccaaccgcggcgcgtcgtgcgcgtgggccnggagacggagcaaaacggcaagggctacttcaangaccgccgcccggcgtcaacatggaccctacttgtcactccaagatcgccgagacacatcatctggaancctgaacccnccgccttgcttncaagtcccnaaacgatncaaancatggtccttccttccnttgctatatggtatancaactagtatctggggtcagtctcttgttgcaaaacagacacanaaagaggagaagaaaaaaaacaaactgtggcttattanacancaatatggccttcanactgtggacttcnttaaaaaaaaaaaa

SEQ ID NO: 84569 - DNA, 407 bp, Triticum aestivum
  unsure (1)..(407): unsure at all n locations
  Clone ID: PAT_TA_84569
cgagttttttttttttttttttctctcggaataattcccccttacagtcaacagcataatcataatagacaagtactcataactttcgcatcacaaataacattcggcatttgttccatgtattcccattccactagaggaaatggaactcagaacttattatatatatagcacactcttttgcacacaccagttcttgctagcgtgtgatgaccagttctacagtcatctggatgacctgggcacacgaatgggtagacgattcagagggtcaaaggagctggattgtcaggtcctgggtagaaatgggctaagagaaccatgaggaggaggatatgcgttgatgaacccccaccaatgcaaagatgctggtaatggaaanactccacaaaagcgccggggggggg

SEQ ID NO: 84570 - DNA, 607 bp, Triticum aestivum
  unsure (1)..(607): unsure at all n locations
  Clone ID: PAT_TA_84570
ctcgagttttttttttttttttttagagtgaaagatagtattcagggaacggatataaataacccgacaagtacaattttttgtgatgaatatgagcatcaaacttttttgcccaattttttaacaaaataaaaactaaacatgttcaatgaggcgtcagcaatttccgccataatggcaacagctgcttccgcaccacagagttcaacaaaaactatggaaggtgtagtcctattccaaatatcttaagcgccaacgttgtcagcgacagacaagaaaccataagacaccatataaatgccaggagaactccagatagggtgcaggagaaggantgttgtctantgcgggaattcttaaggangtcccggttnaattgcccttcatccgatcttggtcccgcatatctcgacccggccnttcanaacacggggaatttaanctcacatcgcccctaaacggacgtcacaaaccaagccctgtaccggaactangaaatgaagccacgtcgggtcaaaaaagcctggttctgggaataccaaaatcctaaacaaggtcnaccnaggcntcccccgttgtatacaccanccacgttcaccagtnttaa

SEQ ID NO: 84571 - DNA, 593 bp, Triticum aestivum
  unsure (1)..(593): unsure at all n locations
  Clone ID: PAT_TA_84571
acctcatcgatcagcctaaaataaaaagagagcgactttgaagcgcgcgggcctctgctctgctctcgaacttgcgctccatgttctgagaagattgtttctgctgtgcgccgcagggatgctgaagcagacgccgcgggcgtgctgcggcgcgccgggcgtgggcgagtacaacttcaacctgacgtccaagtgcggcgancgggggcgttacgccgttccccggaccctccaaccactgggagctgggacggatccacctcacggaggccgcctaacggcacatcgccaagggtggtctacggcccttncgccgaccgccatctcgacgccaanactccgntaacttctcatccacgtcttctccnaagccnggccgcccgccaattanaaaatcctcccggtctngcccttctagtgctccttattaccgactgcattgnntggtgctgtataaagtttaaagagnaacaaatnatacaacacaacaacggagagacataggcccctgcggcggtctcantctccngtanacgtcatatcatctncagaacttacagaaaaaaaaggggncgtacatcccaagntttacc

SEQ ID NO: 84572 - DNA, 593 bp, Triticum aestivum
  unsure (1)..(593): unsure at all n locations
  Clone ID: PAT_TA_84572
ccaacatacaccaacctcaataggctcgtttctcaggtcatctcatccctgactgcttccctgaggtttgatggtgctctgaatgttgatgtgaacgagtttcagaccaacctgngtgccctacccgaggatccacttcatgctttcctcctatgccccagtgatctcagctggagaaggcttaccatgagcagtctctgtcgctggagatcaccaacagcgcttccgaccttcctccatggatggcaagtgttacccccgccacggcaantacatggctggctgctcatgtaccgttggtgatgtttgtgcccaaggatgtcaacgctgctgtgggcaccatcaagacgaacgcacatccattttggttgactggngccccactggttcaagtngtggtatcaactaccaaccaccancgtctcccaagcgggactcgccaagtccaaaaggcgttncatgtttccaanccacaactttcnaagctctcccnatnacaaatcnactgagtcctanntcctctcacggactggtaggatgagaggtattctagcctagtttcgccnaaagcataaattgctattccagcagcg

SEQ ID NO: 84573 - DNA, 347 bp, Triticum aestivum
  unsure (1)..(347): unsure at all n locations
  Clone ID: PAT_TA_84573
ttttttttttgatatgcgaacatccataaacagtgcaccgtttttgctgctgcaactccaaaaaactggaggcgggacagtgttctatgtctgctcggtatacaatatttgctgatgtcctgatgtcacaccttcataaatcacaacgaagcttcatgtgagagcgaatccacacaacacatcacaacggtgatttaacgggtacggttactaaaagctctaaatctgcacgcattccgccgaagcaaattaacgcaaccatcaacaagtgggctattccaagctcacgaggttnnagccgaggctgcctgcgacgtccatgacgaagcgggtaacggacgttcgtt

SEQ ID NO: 84574 - DNA, 613 bp, Triticum aestivum
  unsure (1)..(613): unsure at all n locations
  Clone ID: PAT_TA_84574
cccattcgatcgggtcgccttcagacctgacctctcaaatcaaaccgggaccgggtggcctcttgccctcttccgttccgtctcattctcatccccgacccccgcaccgcagcgtaaaccctaagtccccggcggcgaccttgcggcctccgctgcgctctgactgggtgcgcgtttagacgaaggagctgcggcggccaaagaccaatccgaccatggctaccccgttatccanttggaagaacaactggtgaattgggtgttttctccaaagctggacaaatgcttactgtccgggtaacgattggaggtcaagagacttctacagtgccttttaaggctgaacttgcaaatgcaatccctgttggccaaaactctattgggtggcactagataataagcactttngtgtttgggaacaagatngcttctattgcaatactacaaccgacaaantnaacatccgaagattctgccnntantgggttaacnatnataaagntnctgcctngaatgcaaacctnaagacagtgactancacctgacntanagaatagantatgaattctggncaggttagaacatcgaanactgngatacgcctccaaggggg

SEQ ID NO: 84575 - DNA, 506 bp, Triticum aestivum
  unsure (1)..(506): unsure at all n locations
  Clone ID: PAT_TA_84575
ctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaaggcggcgggtggcggatacggtggcgggcgccgtnatggaggcggtacggcggttggcggtggaggctacggcggtggcctggagtacgggncggcggtnggggatacggttngtgcaaaccgcggcggcggtacngcaacaacgacggaactggaggaactgagcggtggggtccgctnaagcctaattatcctgttcgcttctgctaccgtgttcacctaatctagaagggtttancttcgtctgtggtctctcgntccgtattttctttcntgttcttgtgttttgccacttttttnacgcaactcctcctctangttgtaatgattcnaaatntccaaaaaaaaaaaa

SEQ ID NO: 84576 - DNA, 626 bp, Triticum aestivum
  unsure (1)..(626): unsure at all n locations
  Clone ID: PAT_TA_84576
ccctagagcaggcgctacatgatgaaggcgtgggaccaatcgacctacctttcatgcttctcagggccatcacaaaagatttctctgatactcaactaattggcaggggtgggttcggagaggtttacaagggaatgcttccaaatgggatggtccgtcgccgttgaagaagttcttggacaagattcgatgtcctaaaggcgaatttccaaagcgaggttcttttcncaatagaggtcaancacaaggacatatccgattccaagggtaccatccgagaccaaaattttaaggaacctacnaaggaaattttcccnggcanactcccaaagttnttttncttccaataccctnagcaaaggagcctttccatatccnacccggggattttgaacnatttnttgagcacaatcatcaatttcaaggggncatatacaccaagggnttaaaccacggaatcctgacngggataaggatcacaatgtttacaaaggctgaaaactggacggcatgttcaacattaggaancatcgctacanaacaatnaattatcctagatacataaatncatacatacccagcanagctacatcaggtattncccatncataacgncccaaantcca

SEQ ID NO: 84577 - DNA, 626 bp, Triticum aestivum
  unsure (1)..(626): unsure at all n locations
  Clone ID: PAT_TA_84577
ttcacaggcgcacctggaaagtatgttgagcttaaggagggtgttcaaagtttccagggtgttctggatgggaaatacgatgacctttcagagcaggcattctacatggttggaggaatagaggaggtcattgccaaggctgagaagattgccaaggagaacgcttggataagaaactcctctttacaagcaacctgcaatttaaccttttccgtggtcaacctgttgtgcttttactgtctgttaaccaagatattatttaagaacaagagcccggcctgctgatggattttccccctccacttttccccccaataagatttgcaattacctgtttaaccnggttaacgcctttcaaggaaagatgtcncttttggtgacacattaacggcaacctttgcttgtccnccgggaaaaaaataccgaatattgtgtccaaaaaaaaaggggggcccgtaccnattcccctanaatgaccctattacncccccaatggcctcntttnaactcctgacgggaaaaacctgngttaccaacttaacccctncanaaatcccnttccactgggtaaaacaaangcccacgttgcctccanattccacctaagnaatggacccccgtcggcn

SEQ ID NO: 84578 - DNA, 642 bp, Triticum aestivum
  unsure (1)..(642): unsure at all n locations
  Clone ID: PAT_TA_84578
cttttgacaagtgccattttccccttctcctttaatgttcaccttctcccaaatagtcaaacttattgccctaaaccccaccgccaaatttcacctcttttgggaatgttttggttaggttttaaaatggctcaagtttgaatttaattcaaacttgaattatttttcttcctctaaaaaattgccaaaccaatttattcaaattctgcatattctcaagactccagggatattttcttttctaaaatattccacctctagcacctctttcttttctcctaaattctggttgaagaattaaggaaaagaaaagagagatggagaagccagcccaactggggcctcccaagctaccgcagctcggcccagccacccgcgcagccaagaccggccaaggcctaagccacagcgcccccctctaacctagttcccgatnccctcanctctccctcccttcgcctcttcancgcgccatcaccacgccgttcatcgcctctcctgncgatccanctctccccgcganccgagtcctgcantcgacgcacaggagagccctgagcacggcgcgcgcatctcgcgtgcccgnggcttcttccgggctctctgcantcctttgcgacgtcagaaggacccccagggggg

SEQ ID NO: 84579 - DNA, 267 bp, Triticum aestivum
  unsure (1)..(267): unsure at all n locations
  Clone ID: PAT_TA_84579
gccgccatcatagtgctgcttgtgttcgcactcatccagatcctgttcccactgggcaagctctcccagatgatctacggcgggctggcgtcgctcatcttcagcgggtacatcgtctacgacacaaacaacatcatcaagcgctacacgtacgaccagtacgtctgggccgcatctcactgtacctggacgttatcaacctcttcctgtccctggatgaccctcttcaagggcagccgactaggcntctgctctaaaaaaaaaaaa

SEQ ID NO: 84580 - DNA, 626 bp, Triticum aestivum
  unsure (1)..(626): unsure at all n locations
  Clone ID: PAT_TA_84580
cggacgccgccacaccatctgaaactgacggcggcgggcggccgctgcttcctctcccttctccgttcagatccggctactggcgtccctcctccgccatcttccctacccccgacgtggcgacgagctgtgagccgtngagctgttccaacattcctgtcctagttcaagctgaaaggagaacataaaagaggagaggtagggttttgggcgtcccgagaccaaacaagtctctcccggcgacggtgagggtcngatatcggatccnattangcggtccctgctgctttccgcggtccctaatccctctctccggaagtgttacagatggcgtccggcggcccggcgctnnaaccggctccntcaacaancatctccgttatcacaacgatggccgaanatcntgggtacctcaaggnttccatnaangcaacaaattatacccaanancccaataaangncatccaaaaangaggatccaanaantgttcttggccgtncattacaagggtgacanataacttgtggcaagttataaaactggttaaattggtattcaactaaggggnccacgaacctttntcatnggccntnttnttggaaantgncggngggggcccntatn

SEQ ID NO: 84581 - DNA, 599 bp, Triticum aestivum
  unsure (1)..(599): unsure at all n locations
  Clone ID: PAT_TA_84581
ctcgtgccgaatcggcacgagcttcatggtgcctctatcgttgctaccatactcagggacagcgagatgttcaacgaatggactctggaactgaaggccatggctgataggatcattaacatgaggcaacaactatttaatgcgctgaaatccagaggaacccctgngtgattgngagccatatcattaagcaaattggggatgtttacttcaactggggctgaatagcgaacaatcgcattcatgaggcangataccacatttatatgacatctgatgggaggattcagcatggcggttttagcattaagactgtgccccatcttgcagatgccatacacgctgcattactccaactgaaatgaggatagtatcnccactttccgtggaataaaacctgatccaccacaacatttctaataccaaccaatggtatttacnggttgactacgtatttgctccggataaaagtttttacctccggggcatttntacggggggtcaaaggccngatagggcttcgaatnaatatacccataantttctagntcaaaaaggggcggaccatcccaaanntctttcccnccaggcgtnttaat

SEQ ID NO: 84582 - DNA, 636 bp, Triticum aestivum
  unsure (1)..(636): unsure at all n locations
  Clone ID: PAT_TA_84582
ggaaacctccgatcgaagcaaagccaaggctctctcgtcctcctcctcaagatgcagatctttgtgaagaccctcactggcaaaaccatcacccttgaggtcgagtcttctgacaccatcgacaatgttaaggccaagatccaggataaggagggtatccctccggaccaagcagcgactcatcttcgccggcaagcagctcgaggatggccgcaccttggctgactacaacatccagaaggagtccaccctccacctgggtgctcaagctccgtggtggcatgcagattttcgtcaaagaccctcactgggcaagaccattacctcgangtcgatcttctgacacgatngacaactcaaggcgaaagatacangacaaggagggattccccgggaccagcaacgcctcatcttcgccggcaagcaactanaaatggcgcaccttgctgactacaacatccagaaggatcaacctcaactnggtgctcaagcttctgggngaatgcaatttcatcaanatcngaccggaanacanaacctgaggtnaatctcggnacattnnaanttaagnaanttcangnaagggggaaccccggcaaaaanccgntttttggaaaaatttgggggccncctnnc

SEQ ID NO: 84583 - DNA, 502 bp, Triticum aestivum
  Clone ID: PAT_TA_84583
acttagcactacaggttgccattgggtcattctgtcatgtaatgtgtatatacaaaaatgcaaattttaaaggcttacacagaagagatataactgtgacatacagatgtaagatttctgaaccagagtaaaacagtactgcctatcagtccatgataaggtgtcatcttattctacttctaagaagacttgtcgcgccaaatgcgggacacctcgtccaatacctccttcaaaatcagcgggcagctagctacgagatgcttgaatccgtcggttaacatgaccgggccaagcatgtccggcgaggccatgaatctgatgcaggctcctcgcagctgcgagcagtggtgttgctctgctaaagccaggtggttgacactgtttccacatcaattgcatcgctcaacttcctttcacacagcagccttagcctgtcgacgccgtaccgattcgcggcgacaacatgtgctgcataaccgcagctttccatctttgggggggg

SEQ ID NO: 84584 - DNA, 642 bp, Triticum aestivum
  unsure (1)..(642): unsure at all n locations
  Clone ID: PAT_TA_84584
tttttttttttttttgcgagatgaaagacaaccttgttcatgcatctctgttccatacttccattccacagattggttccatactgtgcattaccacttatacagattacgaactactacatggtactagaatcaacaagaccagatagccccttgtaagccatactcatattctgataaagatccacatgaaactgctagtatgaagcaatgaggtgtgtaacttacccttgtcctatgctccaatctcaaaggttctccatctgggatattgctcctgaagtggcacgtactccccaaggtaccctccaaggtgctcatacaacgcaatccggtcaatccgctgggtnttggaaggccttgcaaggcgtagtaaaaagacgctctgcacgagcaatcccaagcaaaatngacacaggccaagaaccacagcaacacggngccnacaagcaaccgcccggcaaggcaagacgaaactccctcctccggggcgcccttaacaacgggggacggaaaacaggaggtacccccaaacgcaaatngnaacanaacttgtgcgtccgtcggccngacaatcttgnctggcatggcgnaatcnaaacggtcanacgnatacctgcagggcaaccgnnantaactgnt

SEQ ID NO: 84585 - DNA, 376 bp, Triticum aestivum
  unsure (1)..(376): unsure at all n locations
  Clone ID: PAT_TA_84585
cgacgtgacgcagttcggctacttcaaggtgctcggcaaggggatgctgccgtccaggcccatcgtcgtcaaggccaagctcatctccaaggtcgccgagaagaagatcaaggctgccggaggcgccgtcctgctgaccgcttaggtccttttgcatcttgtttcaactatctgcgctaaagaaatatctatctttttttgggtggatctatgagaccctgggttttgacacttgggtaacgaatatgattcgattatatcgatgctgcacaactcttgctgcatgtatatcaattccatgcaattgcattcaagtnggctgtgcnactgaaaatnaatgttttggaatttttcngaaacttctaaaaaaaaaaaa

SEQ ID NO: 84586 - DNA, 571 bp, Triticum aestivum
  unsure (1)..(571): unsure at all n locations
  Clone ID: PAT_TA_84586
ggagcggggcgagcttgcgcggcggctcggggacgaggcacgggcgtggttcctggcgttcgtggagcggttcctggacgcggacgttgcggcggccgcgccgtgggaccgcgaccgcgccgcgaggatgctcccgcagcttaagcgcgtcaacgactgggctgagcgagattcgggaagtccngcagagatggcgcccgcatcccgccaccggaagcggacngcgaagccnggcggcaccaactgccaaacggcggcgccgccagcggcgttcccgganggagacatagagaggtcaagaagaagattntacgatactcctcacaacgtggatcctgctccgcccttcttccgcggttccaaattggcccgacctgattnncgnaaaaagggtgnccataattngccccaaggaaaggcaatttggccnttacttngtngacccaaaattgccgccnggatttaatgtaaaatggccggtttaaatcatggtgnttgggaattttnngggtaaaaaataaggggccgtccaaattncccaanggnnttttaccccaagggctttttaatt

SEQ ID NO: 84587 - DNA, 456 bp, Triticum aestivum
  Clone ID: PAT_TA_84587
cgatactcgccgaccatttcggcctggaatgggctggctacgaaggtgaggagaacaggttcaagctcgaggaggccatggccgggaaggaagctgtctgggcagagattgtcagggaaaacgaccttatagccacggagcttgacgagatcacgaattggtggttcgtcgatgccatgtttgctgtggagacccagcttctggacagcatgaacaaaagcaaggagcatggcttcctcggcttcaggaacactgtcagctctttcaacacatggatcgagaagctgaaggtcttcaagattgttccctaataataattcatccttgctattcacttctatactgttgttctgcatccttattatcctgctcatttatcagcaccagttctccctgtaatcaaacatcttgctatctgtgcaagtttgcatgttatatactagggaccaataaggt

SEQ ID NO: 84588 - DNA, 618 bp, Triticum aestivum
  unsure (1)..(618): unsure at all n locations
  Clone ID: PAT_TA_84588
ctgaagctcaccgcacctcccctcctcgccgcggatcccccactactccggtagaaaatggctgacgctgaggatatccagcccctcgtctgcgacaacggaactggcatggtcaaggctgggttcgccggcgacgacgccccgagggccgtcttccccagcatcgttgggcgcccgcgccacaccggtgtgatggtggggattggggcaagaaaggatgcctacgtcggcgacgaggcgcagtccaagaggggtatcctgaccctcaagtacccatcgagcacggaatcgtcaagcaactgggacgacatggagaagatntgggcatcacaccttctacaacgagtccgtntggctcccgaggaanacccgtcctcctaatgaagcgcccctgaaccaaaaggtaaccgttagaagatgaccaagtnatgttcangacttaaaaacccgctattnagtccatcaagcctctgtcncgtatcatggtctacanagtatcgtctcnatccggaatgttcagcaaattccatcacanganagcctcccaagcatcttttcactgctgcggactacgatactataanctaacnaancggtanctnncacaggtacgaatnn

SEQ ID NO: 84589 - DNA, 619 bp, Triticum aestivum
  unsure (1)..(619): unsure at all n locations
  Clone ID: PAT_TA_84589
gtttttttttttttttttttaaattataactatcttttcaataatcacttatcataataagcattatgagcacatctcaacaccatatgttcgtaatgtgcctcaaacaaagcatacctagagtttccaaccaaccaccacaactcagcgggagcagcaacaacaacaacacaacgaggaagacaacaatgataaggaccatttacaatctcactcaggccaccacgcattcccaaagactgcagcaatcgcacagcctgaatataaccctataagtctataacccttttttcaagaaatatgattgtttctcattttgggagctaaggtgtaacagaatcagcatccccaaaactgaggaccaagatcatggaagtaggtgcacccgcttatcggcggtgcaagcacgctcattatggtggactttgtcatgggggtacgggttcactccatactcaancctncagtacaattgggtttcggtcncgtccggcttgggtnaaccggttnncaagcgcnggcnatggtcgaancggcatttaaatctcacantcttcanantgctgcaacggaacgcanttcgcgcttccagggggccgtacattccctaaagggngnt

SEQ ID NO: 84590 - DNA, 629 bp, Triticum aestivum
  unsure (1)..(629): unsure at all n locations
  Clone ID: PAT_TA_84590
tcaccatcgacttgaactcaagcgactacagcaaacttgctgagactgcagctgatcatggggtcgatgacatggttggcggccgtgctggcagcactcgtcgtcgccgcctcctcatcggtggcatcacacgcctcgccgccggggaaacttgaggtcggtttctacgagcactcgtgcccacaggccgaggacatcgtgcgcaacgccgtccgccgcggcatagcccgcgagcccggcgtcggcgcggggctcatccgcatgcacttccacgactgcttcgtccggggctgcgacggctccatcctcatcaactccacgcccggacaacaangccgagaaagactccgttggcaacaacccaacatgcgtgcttcacgtcgtcnaacaancccaaggcgtctccaagngcactgccgcgcacgttcctgcgcnaaatntcgcgttcgcnggccgttaaanncctaactgccgggggctggacnaaaagnccctctgggcgccttaaaggccnctttcaaaaagatagnggtcananaantcctgccnactgacagtcacangtcaacaanctnagccangggtaancnacaatgnaaccccngggaacacgggtcaagtcncttagg

SEQ ID NO: 84591 - DNA, 510 bp, Triticum aestivum
  unsure (1)..(510): unsure at all n locations
  Clone ID: PAT_TA_84591
tttttttttggcaaagaaagaaatttggtccattgaaataaggttccaagatacagatcataatcttttcgaaaacattgctaaagcacaaatggtgacatgcttcctctggctctcaaggtttgatgtgaaacttccatgtttactctccgtagatccaagggtgctggctgctctgccaatcaagcaanggcctccngggaaccacanggcaactcccttaattaacacctccaatgctgtcacttccaatgaaatgacattccctgccaatgtccaacanaaattccccacggatgggtgcccnggtcaaaaaccagggttttgttgggccaatgattctttccgcanttttacaacctcttcctcccaaaacaatggcacaaaaggccaaaatatgtttccacnaagcctggaaaaaggtttgagnaantttggtnatgttccaaanaaaagannccacttnaaaaacttaaaggctttaggtaaaaacctctccaaanggggatg

SEQ ID NO: 84592 - DNA, 417 bp, Triticum aestivum
  unsure (1)..(417): unsure at all n locations
  Clone ID: PAT_TA_84592
ctgtaacctgtatggacctagacgatgctgagcttagagagaaaatggcacacgactgcgtcgtcccctggcttgagactgtgcgccaccaagaatgggtgtctgggactccacaacgacgtgtcgaggtggcacacgaccaacgcctccatgtccggcgtcccgccatcctggggctgccagcttcaccaaggtacgttgccgctggttggtcntgtggcaattagaacacaacgttagggtacgtcaagtcaatngacccgccgccgtcaatgacccggaaantttctgcacggccgtttacnttatacgcccccgcttntnccgaacntgccggnagatttggtggcaanttccccgganaancggnactttccttntccccaaagnaggacgggggtacctggcaaacgggnn

SEQ ID NO: 84593 - DNA, 579 bp, Triticum aestivum
  unsure (1)..(579): unsure at all n locations
  Clone ID: PAT_TA_84593
gttttttttttttttttttatttcatactttcttcaataacaaggattcatgttcggaatgacttacaggaagaaacaccagaggctgggaagcaatagcagacaagaacacgttacatcaatgtaaacgtcggctttacatgtccaattattaaccagccagatttcaagttacaacaaatacaggctttaaacagctgatccttaaatgaaaaatgaactttatccgtgccccccgtgacatgatggattcaattgcctgcaacaggcctttaccaaactcaaggcggngtcacaattagccgggggatcatttccaaagttgtaacgctctcgccgacnttcaacctggaagtcttcaagatctcgctcctcctcaaanaattcttcaaccttggcaacttcacctcttcgcttggacatcngnatatacacggcgacagatttccctccttgnacgccggcggactgntccctggccnactgganagcatatcaaaacacnaagtggnangaaatggcggcctgnccccagggggattcggggcaacnacgggcaaaccccggggggcctcttga

SEQ ID NO: 84594 - DNA, 271 bp, Triticum aestivum
  Clone ID: PAT_TA_84594
gttttttttttttttttttttttttttttttaattttgcgtgtcgcatcgacaaataatggataggacatttatgcttcggttcattgagttgctgaagcttatgatgtattctcacttctgtattgaactctgttcgtttggttgtttagttgatttgatcttttgttttttgctggcactcacatgataacgacagccgtgctgtcaacagtcaactgatgctcggcagaaaggtttatgtcgttggctcgttgcacaaaaaaaaaaaa

SEQ ID NO: 84595 - DNA, 556 bp, Triticum aestivum
  unsure (1)..(556): unsure at all n locations
  Clone ID: PAT_TA_84595
gccagctagagaagggatgtctgggtcgggctcgggctccggcgtgtgggtgttcaagaacggcgtgatgcagctgcagccggagcagccggcggcgggccggaaggcgctgctgtacgtgcccaccggcgagaggatgacgacgctggagctgctggagcggcgcctccggcgcgcacggctgggaacgctactacgaaaaacgcacatcttcanctccaacggccgcgaacggnggaatccancttantttccttccccaaaggantttaacaantttccgctccaaccanaatttacaagnttctccttcaaaaaaccttnacannttcaaggccttcaattncaaatttaatntacctatccatnccaaantaanttccttttattttccaatcgacaantgttttgcaaaaaacccncccaattctttttcatttcttaagggtnaatcaaggggggaacnctnaaggtagnntnaagattattnttccttaaaattcatttncttnttttggtttttgcccnaaagngaaacctttntacaactttnaaa

SEQ ID NO: 84596 - DNA, 619 bp, Triticum aestivum
  unsure (1)..(619): unsure at all n locations
  Clone ID: PAT_TA_84596
cttgacactcctgtcctgctcctcccactcccacgctcccaaccgagctcgagcgcacgcacacgcgcacaagcaggagctcctgtcccgctagatcccaaacagtctcctgcccgcgcgcgtttggggtggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatnaacagcaaccgcactgctggcaaggcatcttctgtttcggacaancaaggtttgggatgcatcgctctgcaatacatcaaaagcatacgaaggcantgtgacaagtgggacgacaagaagccgatggatcaagctnaacgacacttcgcccngactgtggggtcaaagcanaacctctcaaanttacggaagntgtggttgcaatccaatactggntcaactaaggcttgggtctgttgtgaacgaccnaaggctcaaatacnngcaacaagacaaacgagtcgggcgntgtaacgnacgatgcgtggacgtactcgggctctgtcatnacgaancatacanttaagggg

SEQ ID NO: 84597 - DNA, 591 bp, Triticum aestivum
  unsure (1)..(591): unsure at all n locations
  Clone ID: PAT_TA_84597
tataacccaacagaaaacagaaaacattaaatccaccgcaccacaccatcagcagccatgggcaacatctgcggaaagacagagccagaggctttttcgcaacctggcagagtcttgggttccgctcccgctccagccgcgggcacagcgcctgttccaaaaaaggcggaggccgccaaggacttgggaagttggcccggctgtggaagcttcaaggagatacggatgaccccgggaggaaaccgcggaactgcagaaggcgcgcgcnaagncatcctcnaagcaagtngaaatttgcagacacaactagcacacannaagaacancacnttcaaaaccctccaagncgttagtccaaacatttccaanccttagntgtttaacaacttnaacacgatttggcatgatatnntttaaagctgactncacaaaatnnanattactggtnacgaattnaaagaactctacacatgtgntaatcaatgggtcaactgtccagattcgtcaagttagtggccctattcaagtattnaacatattaanatnttttttnaaagccantaaaacntgggggttcannttaaaaaaaaa

SEQ ID NO: 84598 - DNA, 410 bp, Triticum aestivum
  unsure (1)..(410): unsure at all n locations
  Clone ID: PAT_TA_84598
ctcgtgccgaatcggcacgaggtttttttttttttttttttttttttttttttttagcatatgaatacgataacgataaacgccgggcgacgacggaccatatttgatgtacaggtgaataaacagccaagttcgtggctgcgagatggcaatagcgcgccggtctatgttcttgctctgtcgccaagcaaatggtggctcaactttttaaacatgtcatagatgtttttttcttcccttcctttcccttaaggaatggcaatacatctcaaatgtttgctgccctgtagttcctgaagataatgggttccgtgtanaccntgagtattaatagtgttccggatacatactttgtaaaggcaaagcaataataaagtgaaggaactgcatttcnaatcaaaaaaaaaaaa

SEQ ID NO: 84599 - DNA, 594 bp, Triticum aestivum
  unsure (1)..(594): unsure at all n locations
  Clone ID: PAT_TA_84599
tgccggcgccggcgccgccaaacgccaggtgctgaggccttcgccagtgtcttcgacggcgacgagcacgtaccagcaccaagcatcatgtcggaaagaggtcgcctggcaggacgattgattgataaccgcagcagagggtaccatgtagtccctctagttgaggatcccagaggccatcctgaagtcctcgtggatggggatcggaggggctactctgacattcgtggggttcagcagcgtcggggctaccctgacaccatctgcttgaggaacctaagggctacctggtgttcgtgtggtcnacataggggctatcctggcancctggggttgatnaacgcaaggctatcctaactcaacaagntcaancataaggcggtctccccttaaccagttccttcaagataactnaattaaagaattaatccggagctttcgnanaaacctgcncaattaagacctgaatgttaacaggaaaacaactgaaanatagtccgcactnatgnatatctaattacataaagaactattagtactatgcagagagactaactaatnggcatnacctttataggcagactcnggaattna

SEQ ID NO: 84600 - DNA, 323 bp, Triticum aestivum
  unsure (1)..(323): unsure at all n locations
  Clone ID: PAT_TA_84600
caaccccctccagctggattcagcgcaggaggatggagaagccagccctcatgagagagcggcagacagagaggtagaggacgataattatacgcctccctccgaagacgaggcaagcctcgacgatgacgaatttgtccgtgcctgaggatcccgttcgaacaagagcgtttcaaacgcangctttatggccacggcaagcagcctcaaagaaaaagcaacaacatctttaaaactgacaagaatttctaancccaanaattgntnaattcccttnccggcccaaaaatatnattcaanccccttccnaaangttncccaaa

SEQ ID NO: 84601 - DNA, 588 bp, Triticum aestivum
  unsure (1)..(588): unsure at all n locations
  Clone ID: PAT_TA_84601
cccatgcccatcatccagcacgcacacacagacacgtacagagctggtagataggataaaagcagtaatggcttccacgaccaccaccatgtcctctcttgccatggccctcgcgctgctgctcttgagcggtggcatcggcggcgccgcgcggcagctacaggagtcccgaagcctgacctgccgccgtttgcccaagcctgaggtaccaccaaagccggacctaccgccgctccccaagccgaaggagcagcacgttgcccagccggngctgcccggtgcaacggcagcaatccccgtcccgccgcanccgttgccaatcccancttgccggtgcacggagctttccccttccaacggancantcccttccgcgcancgttgccaatcccactgccgtcacaggaccctcccgttcaacgnaccctgccgaaccgacaatcnggtgcacnagcctcccaacccaatccgtccgcgnaccatccaaaccnacttcgtcacgaacctgcgaaccgaatccgtcancagtctccaaccagtacgtcaagacctgcaactacttcttcaaancncaactggggcggcang

SEQ ID NO: 84602 - DNA, 429 bp, Triticum aestivum
  unsure (1)..(429): unsure at all n locations
  Clone ID: PAT_TA_84602
gccgtggcctccatgcttcatgcgccgtctctcctggcagtccaacccttcggcggacagaggaatgctgccagcgccaaccgctcaccgagagcggcggctttcagggttcaaggcagccaagcttcctgccggagtccaggtgccaaaggcgcaacccaagctgagtgagccttcctggggttcaccaaagaccgcggaggtgttggaactcccaaggcctgcatgatgggctcatcnggacttcatcgttggagctgatatttaacaaagggttctttgaaaatatccgtttccaaantgggaaagctcnaatnctttgtatctgtctcctccttgcctaagggatattgatactaagaccacataaagttttttccaccaatngaatgctatcacatntaatatntaacactctacattcatttt

SEQ ID NO: 84603 - DNA, 480 bp, Triticum aestivum
  unsure (1)..(480): unsure at all n locations
  Clone ID: PAT_TA_84603
cgaccacccgcgcagcgcaggacttggggagcaagcaaggcgaagcggcctgccatggattccttctcgtcctcgccgtcgtcgtcaggtcccggcgctaacccggacgttgttatggaacagatcaagacgcagctcgcacaggcttacgcgcaggagtttctccgagaccgtcgggaacaagtgctttggaaaagtgcgtgaccaagccaggatcaagcttgagtgggaagcgagagcagctgcatacacttgtgttgaccgctacattgaggcactgggtattgtcagccgcgcattgttcacttcccaacgctaaatcacatgaataagnaatggtttcnaaattgctccttagattatgtcnccatgattttttgacttttccngatacatgacattttatcttggtattcaaaaaaatctgcctatanntcagttccttgtcactatcgctttataatagaaaactgcccattt

SEQ ID NO: 84604 - DNA, 562 bp, Triticum aestivum
  unsure (1)..(562): unsure at all n locations
  Clone ID: PAT_TA_84604
ctggaacatccatcctgtttattgcagcaatgttgtgatcagaaacgtgactatcctagctccacatgactcccccaacacggatggaattgatccagattccagcagcaacatctgcatcgaggattgctacatttctactggtgacgattccatcgccatcaagagtggctggggatgagtatggaatccgcctatggccgcgccantctgggcatcaccgtgcggcggtttacaggtcctccccgtttgctggttcccggccggaagcgagacatcangtggcgttggaaactccttgcagacactttaattcttcaactcaaggttttggattcaatgtccaagaccaacacaagcaagggcgttncatcaagnaatcactgtctccggatttacctggtaactcccggtacggctgcggtnntttgcgatgtccgaatcaccccacgacantacaccggatcntcccattttnaccccttaaggtaaanatnccaaagncaaaactcaaggaggtggctgtnaaaggnncccaancggctnccccggtntccgtcaa

SEQ ID NO: 84605 - DNA, 332 bp, Triticum aestivum
  unsure (1)..(332): unsure at all n locations
  Clone ID: PAT_TA_84605
ctacgatggcctcataggcatcgacaagcagcatcacacgactgggacaggctttatcaaagtggagagatccaatggcagcaccttcagtgtgatgactaacggctacccacctgccagctctgtccgctgcacgagcaatcctgcgacaaatgattgggataccatcttctgaatcgatcatccctgcttccgaacaagcccagcaggagcgactcctgaccacctttccttgccttgaagtgccgtggattgcttacctgcaaagataataaaatgcactgcttccgtgtggtataccgttagtaatgcacacccggnagaattctgat

SEQ ID NO: 84606 - DNA, 617 bp, Triticum aestivum
  unsure (1)..(617): unsure at all n locations
  Clone ID: PAT_TA_84606
cgctggcaccttgctcgaattgatggtgatgcacgacctgccttggtgtgaggagtatttttgtagtttttatttgtaggatgagtgttcttcctggaaaaaaagggaccaatgtctacgctacgcagttcctctgattgtttttacatctaatttgttgacttgctacttatagagtcagtgattgttttaagtgaaacaaatctaatttgcttacttacatgggctgctcttagccccaacattgttttgggtgacttcaaaagcagaaagcttaatggaattagataactctatccagatgattttaattcaagatgaatgaatgatcttgcttatgatcttccctatcaantacttcaatatctatgatttattttgaaaaatanattattggttaattaacaattattccatatcatacttcatatatgacacaagacacataattttaatttcaaatactcacctaacttttacacgccttaaatgangtcaagcattaacatgacatgggtattanatacnagaaagaataaaggtgtactaaaaccttaattaagtgcgtaaaananctaacaatgaacaaaccttaacaattccgnaccatncaaaac

SEQ ID NO: 84607 - DNA, 448 bp, Triticum aestivum
  unsure (1)..(448): unsure at all n locations
  Clone ID: PAT_TA_84607
ctaagttaggctagggttcgaccagctagcggaaatggtggccttcaggttccatcagtaccaggtggtggggcgcgcgctgccgacgcccggcgatgagcaccccaagatctaccgcatgaagctctgggccaccaacgaggtccgcgccaagagcaattctgggtactcttgagaattgaagaagttaagaagacaacggcaatcctggcatcaacgaattttttgagcctaacccgacgacaatcaaaaactacggatctggctcgctaccaaagcaaaaccggtaccacacattttncaaggantaccgccacacaacccttgaatgcgcttttngcaaatttcaacgaatngctctcccaacgccttagggcccctgatccaaattatcaaaatgcaacgtgacttcanctctgcaagaggaaaactaaaantncacacaata

SEQ ID NO: 84608 - DNA, 653 bp, Triticum aestivum
  unsure (1)..(653): unsure at all n locations
  Clone ID: PAT_TA_84608
gtccttgattcgataacgacacatcttggaattggctcctatgctgaatggtctgaggagaaacgccaggattggctgttgtctgaactgaggggcaaacgtccattgtttggttcaagatcttcctcagactgaagagactgctgatgttttaggcacatttcatgtccttgcagagcttcctgcagattgctttgngcgcgtatatcatctctatggcaactgccccatcccgatgtgcttgcngtccnacttttgcaagcgttgagtgccatgttnaaacacccactggagagtgttccactttttgganaaacttgcagatcttttaagcaactccaacaactgttncacgnncttttcaattnacnggnacatggatangattaatggcaacaggaggcatgattggtattcaaaccccnggaaaaatccgnggncnctctgcanaatggnaatgtttaagcacaanaaaccaccaaaatggcaaacatatggnnnatttacaagttctggaanggtggacaattgcaaangagtggcaaccactggcaaatatncagcacagcacatcatggttattcgtaattaggaattttgcncccttgtaagaccctggtaaattanccaacggnacctaagaganccccctt

SEQ ID NO: 84609 - DNA, 494 bp, Triticum aestivum
  unsure (1)..(494): unsure at all n locations
  Clone ID: PAT_TA_84609
caggtgttgtgcngggcatgctgagttcgatgttcattacggccttattcagaggtatgtatgggttgttgcncgctgccgccangtgggctgtgaggaagcattgcatcagagtatttgccaancggttgaagcgtgcctgccttcttgtcgcctatgtatccgctgttggctggatcaccttgcaagtacagcaaattatcgagggttaaagaaccttgncggattctgaatcatggagaggtcttttacgctgtaatgtatctccggtgtatatngtacttgtaataccattccggcatntaagaaggtcntctcctctttttgatgngaaacaatgctcngttgtacattattncatgccattgccaactacactgntgtctgtcananccgtngttcaagccaattttacaagganactntctgacaactgatacctgactctctgacatcacctttttcccctgggaaatggaggatntatttcacaa

SEQ ID NO: 84610 - DNA, 419 bp, Triticum aestivum
  unsure (1)..(419): unsure at all n locations
  Clone ID: PAT_TA_84610
ggagaggttactgttggcaatccacgaagcaaatgaaggtttcggatttggctaatcagtcatgctcgtttgtccgtgagagtctgtacagatactgagcattgcaatgggcgagcagcacgtgtgtgctgatccttaccacattctgaactccacgtgtttgatggccggggagaacatagaagaactccgtgggagaggtactggatgagagagagcgactatttgtgttcataatatcattacttttttacttttttccggccttgccccgttccgtanttttgccttacatggnctccgctccatttttttctctgctttccttcaatagacgggtgttagatttaccgaacactatgtcaaaatgcaaacacctaaggccctttcgattattacggaagggagnatggataaaa

SEQ ID NO: 84611 - DNA, 646 bp, Triticum aestivum
  unsure (1)..(646): unsure at all n locations
  Clone ID: PAT_TA_84611
gttctgtcgagttccatttccaacaactggctagtgtttgtacagaattacgaggtaccatacaaataaatggcacatcgatgagatatttacaataagccagcaccagaggcatataactcttctcaaatagaaataggataacatctatcacttcaataattgcactttggattaaatgcatgggcacaatacacatatcttggacaaaagatgcaagccctaactctataagtattgctattggaatagcactaatgctaactgggactccactttaccgcacaaactcccagcatagttagggtccgcacccgaccaaaaagaaagataaacatccgctttggcaaccacctaattggtagacatgttatgccntccctaactcctatacacatctccctaaaactacaaaatccaaagccccaaanaactaaggagtnagncacatgggaactacaactgatccataaaagantaccgactaatagaantccttttggacaatacatccatacaaatttgtgcangnccgnatatggncantcaanatagacctaactgatnccaaggggcccgtaccaatccctatatggtctatanccgccacggcctctttnactctgcnggaaacctggtnccacta

SEQ ID NO: 84612 - DNA, 499 bp, Triticum aestivum
  unsure (1)..(499): unsure at all n locations
  Clone ID: PAT_TA_84612
aaatgttggagtggacatttttttatcgactgctttgtttgacatgcaacaacatgcaggaagaggagctacactgacactgcaaacttcactctgcgctgcggggtgtgccagatcggcgtcatcggtcaacaggcaaggctcttgtaaaccgcaaaaggtttcaactcccaactaaaaatccgcaaacatggttgtactgaacgttccaactgtctctgcgcaatgcaggaggctgtggaacatgcgcaagcactgggcacgtcaactccaagaatacaaatgacagtacaaatcagactgnttgtgctgtaaacttngaccatcatttgggtccaactgatatctcctcccctttgggtatggttggggctacattgtacacagtgtatccttacggggcaaacagaataaggcacttcgtccnggacaattcanctgcctgccaagtcngtgaaatntaagacctacaaccatggtcgtctacaaaaaaaaaaaa

SEQ ID NO: 84613 - DNA, 452 bp, Triticum aestivum
  unsure (1)..(452): unsure at all n locations
  Clone ID: PAT_TA_84613
gtcactgcctaaacctaacctaatccattagcagttcggcactgcgggtctacggcggccggcggcagcagtactacggagcccccagccagccccaggttgcggcagcggcagcaggtggccaggttgcggcagcggcgccctggggacctgggtcggccgaccctgctccgatgctcggcgtcacagttctcctttctacgttcagcggntcacangttcaagcattccagcgccacgccgccgtcgccccccaancagtttttcaacgctcaagggtncctttgaantaccctactttttnccatgaagaatcatcnanttccttccaactgaattttgngcataanggtgcacacatctaatggaggtgttcttggacnaagaacttttacctttaaaatagagntacaaaactgattgtttcctaagttttnnacgctttaacataa

SEQ ID NO: 84614 - DNA, 438 bp, Triticum aestivum
  unsure (1)..(438): unsure at all n locations
  Clone ID: PAT_TA_84614
ggcgcccggcgtgaggcgcggcgcgctgccctggcacgcgctcttcggcctcttcgtctacgttctggcgctggcgaccgcggagctcgggttcctggagaagctgaccttcctggagagcggggggctcgacaagtacggcgccgaggcgttcctgggtcaacttcacggcgctcgtcgtccgtgctgctccggcgccttcgtccgtccgtcgccgcatcatcccggcgcacgcccgagacgccgggggctacccccgatcnataaaaggggggaaaangnaantttcnctggggcaatcaagaagaaggcaactgtttttgtttttgaattgaaccatgaacataggcntttncttcctcncctccggtttacttcnaagcngacccacggtttccgccaatgaatgaatacacccgatgggcgcactttccacaa

SEQ ID NO: 84615 - DNA, 617 bp, Triticum aestivum
  unsure (1)..(617): unsure at all n locations
  Clone ID: PAT_TA_84615
ctaccaacaagcggaggcgggtcgagaaagaatcacaagcaactccaacaggcctagacttcattagcaacctcctcgatgatatgttgacagtcatcatatccctcctctcagtgaaatatggggcgaggacaactggccttttccagtggtggcgccccctatggatcctcacccctgtcgacctcctcgacgcccacggactctgccatagctattgcaaaagttccgatcgttctcctagatcatcggcagtcaccatggcccaacaagaggcttatcacgggcaantccattccaatggcaaggaccgcgccaagttgacaagtggtctgattccccgccataatcactcaaggantcagtgtcaatgatgggatatcgctgctgcaaactccgcgcatccttcntgccaagttgctccccccaattcatgaatgcatcccccctcctaagaccgccntctttctacacaacgaacactccnttcttcctcncacctaaagatgacanggacccgntcccggttatgatccaagggggccgtacaatncctaaagatctatagccntanggcgtnttaaactctgacggaaacctggtnncactatncttan

SEQ ID NO: 84616 - DNA, 448 bp, Triticum aestivum
  unsure (1)..(448): unsure at all n locations
  Clone ID: PAT_TA_84616
ggagaacgagttctacgtcaagtacctggagccgcggcaccccgggatggaggcgtacgacgtgtcctacacgacgaaggtgcgcgacttccgggacctgctggcggcggcgcgggcggcgagggccaaggagtgccggcccgtgcagaacctgctcttctccgagtgccgcctcgccatcaacgacctgcccaacgacctctacgacgtggcctgggacgttggtcctcatccgacgggccgtccgggctgggaaccccaactccgccccggccggatgccgtccatcttcaacaccgccgttctggcgcgctcccggcgccaaccgcgggctnanggcccaaccgacttctcctgcacacttcaatttcaaggtgggcaagtgctgagcaggattcctgtncgacgagacgcctccccggaaacngaccctnnctccggcattttc

SEQ ID NO: 84617 - DNA, 523 bp, Triticum aestivum
  unsure (1)..(523): unsure at all n locations
  Clone ID: PAT_TA_84617
ctccgctagcgagcgaatcgctggctcgaggcggcactccggctggcgggcgtcgggccgtcggctgctgtccacggctgtcgacaagcaagcaccgtccagcgtccacctcggcacctcctgttcggctgttcctaagccgctggctgagaagctaattagccaagacccaaagaagcgagcaggcaagcagccacgaaagacgaaagataaatgaggaatttttcaaccacttccaagggggcccgcaatttgtggccaagataataataatccaataatgtccaataattnatggtttgctacactggaaaagaattnttcaaatccgttttatgatgangttattatcccacatttcaacgtctccaaaacttagaagatcaattcctcccgtcnaacaaaactttacggagttgctttttttnaaatgttttcccttaantttgtacangtnatgganataacttttttttgcgacatatttttacngnaaggtgattacagggatttggccaacann

SEQ ID NO: 84618 - DNA, 326 bp, Triticum aestivum
  unsure (1)..(326): unsure at all n locations
  Clone ID: PAT_TA_84618
cagtcacgtacagccaagcagccaggtaccagctgcctgagggttgggtagatgggtaagctgtgctgcagcaacgagccggaggaggaggccgggttcaacctcctggggctgctggtcgccgccatcatcgcgctggtgttcatgctcctctgcgcgccgcccaggaggcgctgcgtcgccgtctacccgtgctgctgacccctcagtcagcgctccgcgcctcctcgctgtgccgctgccgctgcctggcctcctccgtgcgggacaagagcttctggattcaaccaacagtttcggattaacttcaacatgtntncaagggt

SEQ ID NO: 84619 - DNA, 555 bp, Triticum aestivum
  unsure (1)..(555): unsure at all n locations
  Clone ID: PAT_TA_84619
cccggcgatcctcgaactaatgcccgcgtgcccgggtcttgccaccgcggccgcgggcctcgtcgccgaagcggatcctgaccaggcctcgaggctgttcggcgtctctatcggcatgaagcggatgcgcgacgacgacgacaccggcgaggaacaggcggaccacggcgccgcagcggatgtgaagacggaggcgtcggatccgcagcatcgcatggagccgtcgccggagtcgccggaccaacatccgtggccatataccggctagcccgtgtacattcgatgcggcctgcaacggcggccaaaggcgccggtcccgaccaagacggtcnactcaagtgatttggccaacgaacttgtanaacttccaattccaattatcattgcanatcgggactattttanccnanagaacatatatacaanttctccgttttcctttgccaatttggattggactccnccttgttggnaccgngctaaaaacaacgntaaaccatgaacggcggncggngtattaattaaaaaaagtctngtgtaaataaaaaaaaaaaa

SEQ ID NO: 84620 - DNA, 646 bp, Triticum aestivum
  unsure (1)..(646): unsure at all n locations
  Clone ID: PAT_TA_84620
tttgattagagtagaggtcgcgagagagcagagcgtaccgccctgccatagtcgcgaggatcttaatagtcggtcgcgactgttgtcatagtcaacgacggtttaaacttccaggaaaaaacttcgaattgggagggcgatcctcccggtgaactgaccgtaccccaaaccgacacaggtgaacaattagagtatactaagggcgcgtccgagagaacatgttcgaaaggaactccggcaaaatgacccgttactttccnggagaaggggtgctctccctatcttttttgattaaggaaagcggcacataccaaggggtaacgactgtttatttaaaaacacagnctcctgctaatttgtnacacatgtttagatcctgacacctgccccgttctggaaggcccgaagngaantttnataactttttaatggacccccgttaacggggcataancctacntcctaaggtaccncncnttgtcncataatttcgactgcacatggtntacaatgccccttcncgaaatggaccgtgaaatgaatctcntaaaatcgngtacaacggtaaacgtanacctgacttcaaacttncatncaccttttaanttggaagtggnaggggcacacacacctaancncctttnag

SEQ ID NO: 84621 - DNA, 598 bp, Triticum aestivum
  unsure (1)..(598): unsure at all n locations
  Clone ID: PAT_TA_84621
caccggcgccggccccctcgacaacggtggtgcgtgcgggttcaagggcaccaaccagtacccgttctcgtccatgacgtcctgtggcaacgagcccatcttcaaggacggcaagggttgcggctcatgctaccaagatacggtgcctgaagagcaaccacccggcctgctccggcgtggctcaagacggtgatcatcacggacatgaactactacccggtggccaaantaccactttcnacctngagcggcacggcntccgggccaatggccaactnggggccctgaacgacaactcccggacccgggattatcgacatcatttcaagncggntgccttcaacttccccnggccttgacatcactttcgcttcaacacggtccaacccaatgtactggcctnctcatccaacacnaaaacaagacggaacttgtcaaggggataatcnaaanatccngcaatggaaccatnanatccttggggncatctggggttnacccaacgccgcccttggccntccatngataaaacaatcggaggnactgtggaaaaatatccgcaataatccnagnaaaacnccctnccaatanaagttac

SEQ ID NO: 84622 - DNA, 591 bp, Triticum aestivum
  unsure (1)..(591): unsure at all n locations
  Clone ID: PAT_TA_84622
gcaacagagggtggaggaagatgggtcgttcatgaacgagatcaggttccagttcgaagtcagtcgtcacaagaacttggtccagctcctgggatgctgcctagagaccgacattccgatcctagtcttcgagtttgtcgccaatggaagcctggaggacatacttcatagtgccaagaaacatgtaccctctcgctgccggagcggctgggacatccgccattgggtccgcggaagtatcgcctacatgcatcccttggacaatcaaaaacgtgtccatggggacatcagccttccaaaatctccttgacgatgactcaatccaaanccccgactttggttcctccaantcctgggatccatactacactttaggnnatggctgcaaatataggtacatggccaattattatgaaacgncattcacattgggangcnagtcanacttcnggntggngttncgggactcacncaaganaaggcaactggtatgacaagtcacaaaggaacagtctcccatcaantcgnaantcttaaggacacgtacgntgtcatttntaganacttattccactgcagatgccaactcat

SEQ ID NO: 84623 - DNA, 632 bp, Triticum aestivum
  unsure (1)..(632): unsure at all n locations
  Clone ID: PAT_TA_84623
ttcggaagctctgaaacgaatgcacatgcttgcatgcgaccctggtgtaattgcgatcatgaaaaagcataaatggagagtcggaatcatgactgagatggctcctgttggatatgtaggcatcagtccaaaatgtattttaggtttcaataagaacatgggagaggagatatctcttccgcctgcgaactggatgattttgaagggatcaaggaagtatgaaagtatcaagaaaatcctactcaatgacttgcacatatggngcactcctgaacatggatgcaacttttttgcccttaaataagcattttaacgaggaactgctttccaatggactggnccaatcctacagncatatgttgagtggccctaatccttccattcatatgaagagatttgtcccaaaaccaagaatacgttgctggcacaagtccggggaaatcaattccttgccaacctcctncttnctggactgcnctnacaacgttccgnaagcnccgcaattggtaagctcagnacaaaatgaaanattcgangagtttcccagggccgtacaatcnctaatgatcttagccccangcctctttaactctacggaaccctggtnncactaaccctgaaaancccttccn

SEQ ID NO: 84624 - DNA, 260 bp, Triticum aestivum
  unsure (1)..(260): unsure at all n locations
  Clone ID: PAT_TA_84624
gcaggacagtttggacgccttagaagaggagcgggacgtggaaaaggctcgttctgcactgtatcagtagcaggctcgaaggtatcaaagcaaagaagtacgggccaaaacttacaatgttggcgaacttgttctacgcctgccggacaagaaaaaggacaaacttaacccaagtgggaaggcccttcatcatccgagcaancctgaccggcggagcatactgtctatgtaacgcatctaacatcccaaggggggggggc

SEQ ID NO: 84625 - DNA, 462 bp, Triticum aestivum
  unsure (1)..(462): unsure at all n locations
  Clone ID: PAT_TA_84625
gtcggatggtcagccatggcttgggctgggacctcagatcgccaaccctgatctgagcttgtccaaggaggcgagccagtgatcgatgatccagcatcaccatcttcaaaactgcgatactcaacagccatgtgtggaagtgttctgttttggggcccctatcattccgggtttttttccgcatggataaataggtgtacgaaagtaaagaacacagctaatgacggctcaagtaaaggataccggcgctggggcaagtttggctgattaaccttttgctggcctgaccaatggcatttttanaaagatgaaatgtatgtataatttcctanacaatttganccttggangttcngtgttgtttgnttttggactggggctgcaatgtcccnaacattatttcacanaaacagcaaanattttnanaccccggtgnccccgttggtataaacaaatttctcn

SEQ ID NO: 84626 - DNA, 627 bp, Triticum aestivum
  unsure (1)..(627): unsure at all n locations
  Clone ID: PAT_TA_84626
ctcgcgtgcgctccctctcccgtctgcccctccctctctctctcgtggagacgactgggccgccgtcgttgctgccctacgcggctacacccacgtcttcttcgggcccttagccgcgacgagcgccaccagggagtagaagaggttaaccttctgggttgggaaacgatgtacttccgaaggctatggcttccgtgggaagtacttccgagcaagacatatccgctgctatcctgcgtctttcaatccgacaagcacaacttngaggccggtggacaaaattataatgccaccatcantccttggatcncttggcatctcctgcatatgaatacctatgctattngaanccaanaaggcaannacaaaacganttccattgtggnntccnggattcattgcanaagaagnatgatctacatgccatattggatgatgcaactccttttgcaagaggaaatgggtcaataaaaagcaactcccaaagggaatattaatncaacnatnaaanatncagatttaaaccaaanaactgnnaaattgcggaatttctgcactaagggaacatangtgaaataagatcaattatttaaaaaccncagcanantntaacattgagtattccan

SEQ ID NO: 84627 - DNA, 635 bp, Triticum aestivum
  unsure (1)..(635): unsure at all n locations
  Clone ID: PAT_TA_84627
gccaagatgaagtccgttgtcgtagcgtcctcggatccacgtccaccgcgtcgcagaccaaggccgaccgggccaagctcgacgtacgagtgcatcctctgcgcctgctgctccacctcctgcccgtcctactgggtggaacccggaggagtacctcggcctggccgcgctgctccacgccaacaggtgaacagggcttcagcagggacgctggttagcaatgggaggcgatncattccttatctgcttcaaaatcaattatccaatggtgatttcaaccaatccttcaatgacagtaccaagaaaggaaaaattagatcncaaggcaatctcaaggtgatatnacttcatgggaacccacgacatttaattcacaagaatnaaacccctccanctttaaggtcnaantaggancaacgaagaacaacccatctcatcatgaaggaaggaggcacccaccangctgacaangaccacngaagagaaggccacaaccaaggagaaccccaaggaactttattaggggcctgatccgggaannaggaattgganactatgcctgtcgttnacattaacaatttcttgncccnngaagngttatcaattatngtaacatggttggtantaggatcagn

SEQ ID NO: 84628 - DNA, 459 bp, Triticum aestivum
  unsure (1)..(459): unsure at all n locations
  Clone ID: PAT_TA_84628
aggaggtggtggcgttctgccggggcaggctgccgcggtacatggcgccgaggacggtggtggtggtggaggagctgcccaagacggcgaccggcaaggtgcagaagttcgcgctccgggacaaggccaaggccatgggcaacctctccaccaagcaagctctgaatttactatcccctgatctgttctatggtgattgcaaccatgtttgggttgggaataatgggagttgaacacaaaataatgtttttgaattcgctgacaaccgtgttccgacaatatgtttgtacaatgtgatggtacgaaagaaaaataaaaataaatgcatgctacctacaaataaattttaaatnacaatttaagattttgtatccaaacatccatacactttttttngattggtgatggtgcatggcaaaaancagatttttngnattttnaaaatnccntttgttatat

SEQ ID NO: 84629 - DNA, 541 bp, Triticum aestivum
  unsure (1)..(541): unsure at all n locations
  Clone ID: PAT_TA_84629
gcaagtggaagcatcgcgaaccgtttccccttcctcctccgagaaacagcaacttttcccattcccactccgagccgcacccgacggacgcgaccaggccctactgcgccaggagccggagcctcagccgacgtccctcggccacccgatcaagcaacacccgctcgcccaaccccgacgccgccaggcaccgtgtaccgcgcccgtccctgccccgcgancccgcccaagcccctacaacgcttcaacgngccaaagcaangcgcattccctgcctcctgcgctgctgcaaggaccgacaagcccggccaagccgctcgcaactgttgggacttgtcctcaatgcatgatcaagaaaaggaatataaatgttaatattgaaggcctcgtcctcaaataataattcctttgggnaaatgaactnaggcaaggcataagganttctcantnanatagaatggaaacttacaattngaantacnaatncgnaaatatataaaaatcaattgaaatggtnnaagaattaatnaaaaaaaaaaaa

SEQ ID NO: 84630 - DNA, 597 bp, Triticum aestivum
  unsure (1)..(597): unsure at all n locations
  Clone ID: PAT_TA_84630
cttggttccttcccgctctccagccaaagtcgccgctcccgctcggacacgcgtctagaagcttctggatccgtccctgacgccgatggagcagctcgactacaagttccacgagaagtacactgctctgaagaagcggaagctactggacgaggggctggagcggaagcgggaggcggaactcaatgagctttacgatgccatgaaagattgggtcagcgaactcaggaaagacaatgcggaactcaacgagaagctggtggagaagcaggatgagctcgagaaggcccgtcaggaattccttgaagatattcgtacaagggacgctgaaattctgaagctgaagcaactcttanatgagaangntgaaaaaaacaantctgcaactacnggtttccctgcctaacgcctgaaactgtcctaaaaaatcaactccaattgtcanctaaaagaaagacacaatttccaacggaagcaactagaatgtccanaagacataaccatctcaaggaatagacaacananattcggatgccaaaagctttcttgnngnttaaacttaattccataaattccggaatgtgganaaaantttgt

SEQ ID NO: 84631 - DNA, 537 bp, Triticum aestivum
  unsure (1)..(537): unsure at all n locations
  Clone ID: PAT_TA_84631
cgacgacgatccatccatcttaaagcaagcagagacatggagtcgtcgccgctgctgcagctgccggcggcacgcgtggaggctctgagcctcagcggcctctccgccatcccgcccgagtacgtccgccccgccgacgagcgagccggcctcggggatgccttcgacctggcgcgcacccatgccaacgaccacaccgcgccgaggatccccgtcgtcgacatctccccgttcctcgacagcagcagccagcagcagcagcgggacgaatgcgtggaggccgtgcgtgccgccgccgccgactggggcgtcatgcacatcgccggccacggcatccccgccgagctcatggaccgcctgcgcgccgcaagaaccgccttcttcgcctcccgtcaagacaaggaggctacgccaacgacccgccgccggccgctgcaaggctacggaagcgcctgccaacaanactgcggcaacncagtggangatactctccacttgtgaacccaacggcncccaaaaaccttggctggtaccccn

SEQ ID NO: 84632 - DNA, 584 bp, Triticum aestivum
  unsure (1)..(584): unsure at all n locations
  Clone ID: PAT_TA_84632
gaaggaaatgctgcttttcgctcatattcatctgtagaagtggctgtcttgctttggacttgacatcgacccctaaccttgtctcaagacatccgactctcaccagtttcattatctcgaatacacaatcctcacaatgaagggtgctgttctttccgtcctggccagtggtgccgctgctcagatcacatcaatgccttttgctgccctcggtctgggtcctcatgtcttccagaacaacgccatcaaccctaccgaccccgaatactcgacctgccagcaagctgttgggattgtccaggactgtgtttcttctgttggtggtctcgacgctgctgccactgctgatccttcagctctcatggcttgcgcatgctgtgatggacgcagcaacgctgctcctccttactcaagtctgctccaactacctanaggatgagntcctgagaacactctcaatacaagcttatggaatccgtanatgcttgaaatnaacgcaaatgtacnggngggtctggtggnatggtggtctgtaacaaaacntccnaaagaactnagacataagttcntacatattcgcacac

SEQ ID NO: 84633 - DNA, 552 bp, Triticum aestivum
  unsure (1)..(552): unsure at all n locations
  Clone ID: PAT_TA_84633
cgcaggctcgcagccggcctctccgcctccggctctcccctcctcgagcgctttcggcaccgtagttcggtacgatggcagcggcggccccgacgagggcagaggtgctgtcgcttttccggtccttactccgcacggcgaagcagttctcggactacaacatccgcgagtacacacgccgacgcgccgcggacgccttccgcgaaaacagcgccctctccgacgcgccgtccgccgccgccttgtttgcggtggggaagcagcagctagaggttgcgaagcgacaagcggtgatttactcaatctacgcccccaagggcaagagcgtgatggagttgaaggtgcaatgatggacaagtgctgcgccctttctcctcancgttttccnttccgaatcgtttctttctgtgacgatgaaacataaacgttgcattacactttgctggatgatgtcagaatactctacgtgcaataaatacaaattatgcaaaaaaaaagggggccgtacaatcgccnaaagatctataccnccnaangctcnttaaantcgan

SEQ ID NO: 84634 - DNA, 221 bp, Triticum aestivum
  Clone ID: PAT_TA_84634
tccaaaaccagtagaccactcaagggtccttgctgaagagaaaggccttggcgttgggtcgaaatcagcatcggcttgcgtaacagagaaggcctgcattcttttgtttcccgcatatggtacgatgtaatggttatggtgtcttctggcagcccccatcatctgctgttgtctgaggccttctttgtccgtgtatgtctggcaggtacggacttgctggt

SEQ ID NO: 84635 - DNA, 298 bp, Triticum aestivum
  unsure (1)..(298): unsure at all n locations
  Clone ID: PAT_TA_84635
aagaaaaccacgccaacgaccaaagcagctgtcgataacacggcgtgctacacctgcttgcctgcctgcctgcacaaccctcagcagggccgcaggcgagagagagagagagaggaagagagacagcgcgaagccggcagcggtagccagcaaaggcngttanagctgttgcccatgcaaggcgagtaccggtcttccagcaaggatcngcggccgctgcancagccgcatccatggctcctctggnggcngccgcggcccannattgaanatggaagcggancaagcgcgatattaa

SEQ ID NO: 84636 - DNA, 568 bp, Triticum aestivum
  unsure (1)..(568): unsure at all n locations
  Clone ID: PAT_TA_84636
tccctccccaagctgcttagccgccggctgggcctcagacctgcgtcaagcttccggcggcagcccatcgagcaccacaatggcgtccggcggagcggccatctcggcggggcctacaccgccgtcggcgacggcgtcgtcggttgagtggcaccagcggccgccgaacccgaagaaccccgtggtgttcttcgacgtgaccatcgggtccatcgccgccggccgcatcaagatggagctcttcgccgacatcgcccccaagaccgcggagaacttccggcagttctgcactggggagcatagaaaaaatgctttgccacaaggttataagggctgccaattccatagagtgatcaaagatttcatgattcaaggtgggtgacttcttgaagaatgatggtactgggatgcacataatctacggtacaaatttgatgatgaaaatttnatacaaaacatacaggcctggacgctctcaatggaaacatgggattaatctaatggnttcaattcttatacattncaaaggtgacnggctnaaacaaaattggtaattggaaatcttgna

SEQ ID NO: 84637 - DNA, 592 bp, Triticum aestivum
  unsure (1)..(592): unsure at all n locations
  Clone ID: PAT_TA_84637
gcgggcaaatgaaatacctgatgaatactttgtttgcttagttggtgatatggttactgaggaagccttacctacataccaaacaatgcttaacactcttgatggagtccgggatgaaactggtgcaagtccaaccacgtgggcggtttggacaagggcatggacagctgaagagaacagacatggtgacctccttaacaagtacatgtaccttactggacgggttgacatgaaacaaattgagaagaccatacaatatctgattggttccggaatggatcctggaactgagaacaacccctacttgggtttcctctacacatcattccaagaaagggcaacatttgtgtcgcatgggaatactgcaaggcatgccaaggagtatggtgatctcaagctggccagatatgtggcacgatacaaccgatgagaaacgccacgaaacaacctacacaagatatcnagaaactcttcgagatggacctgattacacantgctggcgttgctgacatgatgaggaagaagtnacatgcagccatccattncacgtaagacanactgttcaacactncgcncgtggccaaagntggc

SEQ ID NO: 84638 - DNA, 567 bp, Triticum aestivum
  unsure (1)..(567): unsure at all n locations
  Clone ID: PAT_TA_84638
gttgctaccgccccgtacctcgcttgctttcccgtcgccgaaatgacgaagcgcaccaagaaggctggaattgttggcaaatatggaaccaggtatggcgctagcttgcgtaagcaaatcaagaagatggaggtatctcagcactccaagtacttctgcgagttttgtgggaagtttgctgtgaagaggaaagcagttggaatttggggatgcaaggactgtgggaaggtcaaggctggcggtgcttacaccatgaacactgctagtgcagtcactgtcaggagcacgattcgtcgcttgagagagcagactgaagcatgatttagcttgctacatcanggttctcctagttgctgttgtcgggaatgttgagctcctctaattggatcacgagactggctaaaattgggtgctaagatttgtagttggttaccgttgtgaattctcaagtgatataacctaagcttgtccaatgaccaaatttggttgtggttccaagctttggcgtgtcaatggttgcattgtgaaatcaacctaagctgccctanaaaaaattttaaaaaaaaa

SEQ ID NO: 84639 - DNA, 589 bp, Triticum aestivum
  unsure (1)..(589): unsure at all n locations
  Clone ID: PAT_TA_84639
gaaaaatgcacaggcaagtgtttgttgctaaaaaatgcatttgccttgccgggtcgataatgctgtgtcaatagttttgaaccatcatcttaggcatgcttgttattcttgtgctgcagagtaaaggccaaatcccaggagattccccgcctgacccttcacatttcgtgagaaatggatcctcccctggatctaatttcactgggaaactcgatgataatcacacatctgcagctgcatcaggggcactggaccaggcagaaactaatcacgtggctagcggctgctacagatcatcagaaactccggcgaatattacaaataatgctatatctcagtcccaacctcaatggacaagtccgtccctgtggatgactctgcaatgaaaagtgaaatgcttaaaaccaagaattggnataaatgaaggatgntnattgttccaattacnattcccaaaantacttaccccttgcnaaacccttaaaancaaagggtgggtttntccaaacaaaaacccgtggaaattaacctggaaacttctggaaaaanttcancgcnggggggttcncaatccaaggacacaacgtna

SEQ ID NO: 84640 - DNA, 581 bp, Triticum aestivum
  unsure (1)..(581): unsure at all n locations
  Clone ID: PAT_TA_84640
cagacttcttgtgtcgtttaaatgacgatagaaatgtacgtgctttgtttgagagggcactgagcttacttcctcccgaggaatccacagaggtatggagacgatttgcacaatttgaacagaactatggggatttatcaagcatgcttaaggttgaacaaagaaggaaagaggctctatctaggacatctgaagatgccttatctgcatcggaaaacacacttcatgacatagtttctcgatacagttacatggatctttggccatgctcatcaaaagaattggattatctagcgagacaagagtggcttgcgaaaaacattgttaagaaggttgagaaaccagctatgttaaatagcggtagcatgctagacaaagtgctgcangatttagtgcgagtgcgangttattacacaatctgccaaagttgttcgtcctgagactctcaaatgggtanttatgatccaagacagatgaaaggccagagtttgcaacaactagcatgggtacacgaaggaggtnaaaccacctcaaatgctacnccgtcaatgggtcctttataaaatttccgcnatgaaggn

SEQ ID NO: 84641 - DNA, 521 bp, Triticum aestivum
  unsure (1)..(521): unsure at all n locations
  Clone ID: PAT_TA_84641
ttttttttttttttttatcagatcaatatcgtatcagcaccgagtagtcacattcagcatactgtcgaagttacatatttgacgagatatccttaacaaatgtccacagcgtataaaaacgatttgaatagtctgcgatgatgcaggtacaggctcagcacaagatgcgcaaatcaaacttccatgaaatttggaagctatacttgaatacaaccaaaccaaaccaaaccaaaccgacacacatggatcgatcaaaccaaagaattaaagaatactgtactaccgaggaagagctagcttatagctaagtggccacacgacggtcgccgaactcagtcctgcttccggccggcggcggcgagcatgggcgacaacgcggaccgcgtccnggcnaaggcgcgacggcgaaggtcccggcnacaacggaagtccgaancancccaacatcgcgcngctacacgcncggggccnnggcaaggtctggngccaaaacgngnggtcaaganagggnacatccgcca

SEQ ID NO: 84642 - DNA, 570 bp, Triticum aestivum
  unsure (1)..(570): unsure at all n locations
  Clone ID: PAT_TA_84642
agaaacccagcagcgcggcggatctcgccgggcggcggccgccactatgatgagcggtagctcgcctccgccgccctcgcttcctgccgggagtggaggcttcttcaggggatacacaaagctgtgcaagggcctcgccgtcatattgctcattgtgcaccttgtagtccagttgtttccgtccgccgtcacctatctcgcgcttatccctggaagaacgatcccttttgcttggaacctgataactgcaggctatgtcgagcaaacaattccagggatggttgtcagcatcattgggccttcttttatttgggaagttgttagaacctctatggggttcaaaagagttatcaaagttcatttttatcgtcaacctttcaacttctgcttgtgttttcaagactgctattgtgctgtactatataactcancaagagatctacctcctatacnccttttctggattttaaggggtcnacangattgttggtgggcattaaacacttttaccgataaaaactaatctttgtgcnaaaattagnaaatggatcanctctgttgcatgaaaca

SEQ ID NO: 84643 - DNA, 553 bp, Triticum aestivum
  unsure (1)..(553): unsure at all n locations
  Clone ID: PAT_TA_84643
gctgttggtcagctcaaggagtttgagggcaagaagcttgtctctgccaccaaggagggtctgaagcttgatgagactgaggacgagaagaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccnaggctgacaagaatgacaagtcagtcaaggatcnctnatgctgctgttcnagactgctctcctgactccggcttaacctggatgacccaacacttcggaaaccggatcacgcatctcaactcggtctaacatcatnaggacaactnttagcaaagctgaatcccactnaggacacccggtgaaaca

SEQ ID NO: 84644 - DNA, 590 bp, Triticum aestivum
  unsure (1)..(590): unsure at all n locations
  Clone ID: PAT_TA_84644
tttttttttttgcaaaccgccaaggcgccaaggcacgaacatagtatataaatattacattgttgactccatagcgctagggtgatcatctgcagtcaaccacagaaattgacaactagagtcttatttattgtgtactctaacgttgggaatcagtgggctactatcagcaatgggaaggaccacttaattctcagatctgtcgacgaagatgcgcaataggaagaaccgcctaattctcagatctgccgaagaagatgatacgttgtattagaaattacgtgtcatctttctgaaccttgcgctgtttgatcttcttgctcaagattgtcgcacaaactgtcctcggaccgtggccgctgctcaacaagcctcttcctgctttggtagcgaacctgctccaatcggcgccgcctcgcgcgagattcgctccgcgtgccccgccgccgcgctgctgccgagatanaaggtgtcctcccggcatcgggttcacggagantgttgattggggtacctgatcaaatgggggtggatnaatcncttgaccttcaacatcgtcccgtccngctgcttggcacataanagcttcc

SEQ ID NO: 84645 - DNA, 550 bp, Triticum aestivum
  unsure (1)..(550): unsure at all n locations
  Clone ID: PAT_TA_84645
gtgatattcagcataatcaatgtcctcagtggcctgatgctcttcacattgctgatcggaaacatacaggtatttctgcacgcggtcctggcaaggaagcggaagatgcagctgcggttccgagacatggaatggtggatgagacggaggcagctgccgtctcggctgaggcagagggtgcgcaaatatgagcgcgaacgctgggccgccgtcacgggagacgaggagatggagatgatcaaggatctgcctgaaggactgaggcgggacatcaagcgctacctctgcctcgagctggttaagcaggttccgctgttccatggcatggacgatctgatcctggataacatctgcgaccggctgcgggcactggtgttctccancggggagaagtgattcgananggcgaccccgtncancgcatgggttcatcctgcaaggcaaactccggagcaccaaccgctgacaaaggccttgtggcaantncatgcaagggcggcaacttctaagcnacaactcttctggtnctgcccgccctctggacggtccc

SEQ ID NO: 84646 - DNA, 418 bp, Triticum aestivum
  Clone ID: PAT_TA_84646
cgatcgagctgctccgtcccgagatgctgcggctcaaggccatggagcccgtgctgctggcggggcggtccaggttcaaggacatcgacatgcggatccgcgtgcgcggcggcgggaagacgtcgcagatctacgccatccgccaggccgtcgccaagggtctcgtggcatactaccagaagtacgtcgacgaggcggcgaaaaaggagatcaaggacatcttcatgcgctacgagcgcaccctcctcgtcgccgacccccgccgctgcgagcccaagaagttcggcggccgcggcgcccgcgccaggttccagaagtcctaccgctgagcgccaacgcctgccggaccgctgtcgtggctccgtttaactacgacttacagaactctgataataacatggttggcgattcgtaggct

SEQ ID NO: 84647 - DNA, 309 bp, Triticum aestivum
  unsure (1)..(309): unsure at all n locations
  Clone ID: PAT_TA_84647
ttttggacaaaataagctctgctgctcgcataacaccgacaatatatagttcatccgttcgacaacaaatttagacagaacttccaccggtcaagtgcatgactgcatgaacaatctaagttgccaacaaatagcattttaagctcagaaaaaagtaagaaatacgcatgacatttttagtccatctttactccaacaaaaccttaaatgctgctagggtacatgaacactctgaccttgcgccccatagactcaagcgggangntcnacttnaacttngngccgncaacgcccgagttnccgtncngg

SEQ ID NO: 84648 - DNA, 660 bp, Triticum aestivum
  unsure (1)..(660): unsure at all n locations
  Clone ID: PAT_TA_84648
ttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattgggttaaaaaatgagctgatttaacaaaaattaacgcgaatttaacaaaatattaacgcttacaatttangtggcacttttcgggggaaatgtgcgcggacccctattggttattttccaaaatacattcaaatatgtatccgctcatgagacaataaccctggataatgcttcaataatattgaaaaaggaagatagagatcaaattccgtgtccccttatccttttttgcgnatttgcctcccgttttgccaccanaaacctggtgaaataaaagngctgaagtaatgggtcacantggtantcaacggtncaacacggaaatctnaanttcnccnaaaactttcaagagacnttaagttcgcagtgcgggataccctttaccggnaaaaatcgcccnaaant

SEQ ID NO: 84649 - DNA, 677 bp, Triticum aestivum
  unsure (1)..(677): unsure at all n locations
  Clone ID: PAT_TA_84649
gccgagcccaaccgcacaagcgcgcgaggcaggagagagagagaggcggggagcaaaacaatgggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctgggtccttctaccgcgcgggcatcgccgagttcgtcgccaccttcctcttcctctacatcaccatcctcaccgtcatgggcgtctccaagtccacctccaatgcgccaccgtccggcatccaaggcatcgcctggtcctttcggaggaatgattttccgcgctcgtctactgcaccgccggcatctccgggaggaacatcaaccaactgtgactttccggctgttcttaaccaagaactgtcctgactaaggcctcttctactcntcntcaatgcctgggtgccatctgtngagctggatnntgaanggctcaacaaggacttncatgggcaacgtggtggncaatgtgtccactggtacacaaaggtgatggcttgggctaaatgttggacntatctatcaaactntttacncgtncagaggatcaggntncagttcacntccntcattgttcgttctgcactt

SEQ ID NO: 84650 - DNA, 591 bp, Triticum aestivum
  unsure (1)..(591): unsure at all n locations
  Clone ID: PAT_TA_84650
cttcgctcagcttccgccgatcggcttgccccgtcgatttcgccaacccctcgacccgatcggctccattgatcgtacctcgtcgtccggttgtcgatggccaggacctctttcaaaatggagcacgacctcgagaaaaggcagtccgaatctgccaggatcagggataagtatcccgacagaattcctgtgattgttgagaaagctgggcaaaactgatgtccccgagattgataagaagaataccttgtccctgctgatctcactgtcggcattttgtctatgttggtgaggaagagaacaagctgacccaagagaagcactttgnctttgtgaagaaacttgccacaaacgctctttgatgtctcatctacgaagagaacaagacnaggatggttcctttacatgactanangggngaaaaancttngggnctgcaaaanaatnccctgcaatgtaanaacnacataagggcgcgnnatggnaacttgaaaactatcncaatagcngcgccggtgctcaaggntaagacnctanttnacgntgattccgggaatatctcgacaaaattntatccntaaaaaaaaaaaa

SEQ ID NO: 84651 - DNA, 520 bp, Triticum aestivum
  unsure (1)..(520): unsure at all n locations
  Clone ID: PAT_TA_84651
agcagcaacagctagcaagccaagcctagtggtgctcatctagagagagagcagcagcaataggatatatacaatacatggggtccttgggcttgctggttgttgtggcggtcgccgcggtggtgctggagctcaccgcagccgactcctggaacggcggccgcgccacgttctacggcggcggcgatgcctccggcactatgggttggcgtngcgccaagcaaggttggcatccggtcaccgttcaacggcatcctactncgtcctgctgctcatcaagaacgttnggcggngccnggcgaccttaacgcggtatcngttnaaaggtccncggacgggatggcaagaccaattgancacaacttgggggcccaactggaaaacgggcccttctgggacggcaaggtttctttccagtcaacgggnacgacggcgactnnacttcgaaaacnccccccgtggatgactacgcaaactaacggnacaatctaacggccgtcctgttccttgaacgggtctc

SEQ ID NO: 84652 - DNA, 671 bp, Triticum aestivum
  unsure (1)..(671): unsure at all n locations
  Clone ID: PAT_TA_84652
gaggagaggcggtcgctggccgtcagaacgggggagctgttcctggggctggcggcgctgctgctgcgcgggaccggggccgagcgtagcggtggggccgcggtggaggagatggaggcgagggacggggtagtgtggggagcagcgcccccaggacgtggacgcggagcggcggcgacgggagctcactagcccaggtttcagcttctccgccgcggggctgctcttcccctaccacctcggcgccgcgcaatgcctcatggaccgcggatacatcaccgagacaactcccgttaactgggtcaatcaactgggtgccataatcctgtgcagtgatcccatctggggaacacaatgcaagatgctctgcaagtgaccaaattctaactgacaactgccgaaattaaagcacgctttccnccttgggggctgtaccaaggattccttgttgatttctcccaaatgatctcacatttnnatcaatggaanatcntgttctataancaancttctgnaggctaagcctnctggtggacaattnnctcaaanaagngnataatcataataaatcccccttatctgatactacancagcaactacttcttctatagtcgaattatgggctaattntttccccactttctaaanatcaaagtctttcacactttga

SEQ ID NO: 84653 - DNA, 234 bp, Triticum aestivum
  Clone ID: PAT_TA_84653
gccgcatctccaccgtcgccgccgtcgcgccaattacatcgccgccgaaccaacttcgtcgctgcggcgagagagatgcgagtgcgaccacgggagccaccacggcgcaggggcgacggggtgggagaaagaggcggcgtgcttgaacgcagggagaggcgcgcagacacagtagcacgtgcgagcgcgagaagcggcggcgaggccattcacgcgggcgtgtgcgccaggcag

SEQ ID NO: 84654 - DNA, 491 bp, Triticum aestivum
  Clone ID: PAT_TA_84654
ctgctttccagatgaagtggagatcccaaatatggatgccaatcaagttcaagaggaatgaatggatgagctatgttattgcactggatgaagggggtctggaaaaggtgtcactttcatgtcatttagtggtgtcatgaagtaatgaattcgtgagctacttgtgggcaaatccagtgccgaaggctccccacatgagtaccttctggagaaagggctccccagctgctgcgaacccacgacctcagacagctcccatcactgcatcaggcctgaccttctgaatttgtgagctactgtataaaataaatttgtcctgaatcatgtgatcttgtaataagactagcctaaataaaaactacgattcaccgtctctctatgctatccggatctggaatgtatgatggtaaacatgctccatataactgatatggtgtaaaccaaaacgtgtatatataacattcaagtataatagttccaaaaaaaaaaaa

SEQ ID NO: 84655 - DNA, 619 bp, Triticum aestivum
  unsure (1)..(619): unsure at all n locations
  Clone ID: PAT_TA_84655
cagtagcacaagcatagtgcaggggcttggcacctaagtaaggcctgagagccatggcatccaaggccgtcctcttcttggctctcaacctcctgttcttcacggtggccaacgcctgcggcagctgcccgaccccaacgcccccggtcgagccaccgccgccgcctcctgctaccccacccccttcgtccagcggcaagtgcccgctgaacgcgctcaagttcggcgtgtgcgccgatgtgctcggcctcgtcaaaggcgaggttggcaaggtgcctgccgagccgtgctgtaccctcatcaaaggccttgcggacttcgaggccgccgtctgcctctgcacggcatcaaggcaacgtgctcggcgtcgtcgtcgatgtcccatcaagctcaacgccctcgtcaactactgtggcaagtgcgtgcccaagggctactgtgcgcgtaagtaacanctccgggcagtacacgctcgtagctgtacgtcacgtacaagatatatatcaccacctgcatggtggacaatcatcatgttcgctganaaacttccgtccaatgtcacnttggtcanaaactaaacattcagcaaatattgagtcaatccagtatgcctgtaatc

SEQ ID NO: 84656 - DNA, 619 bp, Triticum aestivum
  unsure (1)..(619): unsure at all n locations
  Clone ID: PAT_TA_84656
gaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtggagaaccacggcgtggacgcgccgctgatggacgaggtcaagcgcttcgtctacggccactacgaggagcacctggaggcaagttctacgcctccgccctcgccatggacctcnangccgccaccanaagtgacactgatgagaagcctccgacnaggtggactgggaatccaactactcatccaanaacaacccaaagacaaagtnnnccacttccaaaanttaanccgcgacacaaaaaacctggacncttacntncgcaaaatggtgtcctcccgaacgtctggccaattgataacctcaaactgggctcccggggccaagtcccgcaacttcggccgcgtctgggcacaagtcgcatgnccgtctgccgcnccgaactgtgtggctcccgaaacanccggggatactgtccagacantctg

SEQ ID NO: 84657 - DNA, 618 bp, Triticum aestivum
  unsure (1)..(618): unsure at all n locations
  Clone ID: PAT_TA_84657
ggacatcatcccggcagtgattgttgttggtgtggacgccatatgccctacgcggcttatctctccgaattagttcacagagtgtgtgctggaagaggcttggctgctcaggtcctccatgcacacgtcatacaccgtacgtagggtgagggttcagtctgttgctgtgtgttctgtacaggccacaccacacacgcccccatggaaaactttttcagtttcgagtgcccctccctctcggccggacggtttgggtttttggacgacgccggcgaggaggcggcgctagcacactaagtagctccgtttccgtgtgttctttcatacttggctttgggttccgtttcaatcttcgggcctcggtcgtcttgtctcgactctccagggattcaagtatacacgaacatggtacatgctgtgtgctgttccantgtataaagncaaagaatacaatacgatcgtcnctgttcttgtnaaaaaaaaggggggccggtaccaantcncctanatgatcgtattaccncgccantggcgtcgtttanaagtccnacnggaaaacctgggtaccaactaaccctgcanaanccctttccaactggntaanacaaaggcccccnn

SEQ ID NO: 84658 - DNA, 284 bp, Triticum aestivum
  Clone ID: PAT_TA_84658
cgagtttttttttttttttttttttttttttttttagaaaaaaaagattcagtaaactgaaggcagtcttacagagattaacatcagcatggacattagtacttatacactgactgatgaaacccaaggaaaaaaggagaatctacagcagtccttcccatcatctatgatcctaaaacctttatccttctagtaactgctttgcttctcgacaaaatatttaaaacttctttatcctgctgcttgcaagaggggggaaaaacaatacaaatatacaagtcttt

SEQ ID NO: 84659 - DNA, 358 bp, Triticum aestivum
  unsure (1)..(358): unsure at all n locations
  Clone ID: PAT_TA_84659
cgtcgccggcggcggcgacgacctcgcggccgccgagtgccaggtggccacgatgacggcggactgcgccgtcatgacccccgccaagcgcgccgccatgcgccgcttccgccgccggtacctcctctacacggtgtgcnacaanatgtaccgcnacaacggaaccgtcttccccgattgcnacgccaacggttcggaacgcnacaacttcaaaaattggggcnagtcaaaccgctttnctccaacnancggcggtnanancaacaacaacaaccnnccggcaaaggcgtcnccgttnccgcgcctggccggcccaaaanttggccaacctnaggacataactntccaccaataatga

SEQ ID NO: 84660 - DNA, 627 bp, Triticum aestivum
  unsure (1)..(627): unsure at all n locations
  Clone ID: PAT_TA_84660
aaaataccgagtcgagtcagcgatgaatcccttcgccaaaaaaccaactccgcgagaggtgatgcggagcagcaagcgggacctgacgaatgctacgcgagggatcgagagggacattgcgtcattacagcaggaggagaagaaactcgttgctgaaattaaaaggacagcaaaaactggcaatgaggcagcaacgaaaattctagcccgtcagctgatcaggttaaggcagcagatttctaatttgcaaggtagccgagctcaagattcgggggattgcgacacatactcaaggcaatgcatgccaacacttcantggctactgggtttacaaagtgcgagcaaagcaatgggagcttttgaataaagcaaatggaactaccaagcaagatgaaaattatgcaaagaatcccaaatcaatcagcacaatgggtatgncaatgaaatatgccggatcaatccaaaagtctaaaccttgncaanccgagganaaacngaaaactgcaaacaggtcgggttanattgggtaaanttgaacaagttgccncggncccaagggaaattntggaanaggtnagttgatgganttcgattggggaataaaaaaantggtgnccaaaatcaaan

SEQ ID NO: 84661 - DNA, 340 bp, Triticum aestivum
  Clone ID: PAT_TA_84661
agttgctgttggagtcatcaagagtgtggagaagaaggacccgaccggcgccaaggttaccaaggcagctgccaaaaagaaatgatgcaacctgtcgttaatcctgtatctgcttttgcaatacctgacttgtcactccatcccgaagttttgtatgcggttgttactgttattgtgtactgttaagctctgctgcggcgtgccctgttgtttgggtagcgtcaacgtcgagcgccacttgcgggtgtgcctttgtctgctatcaagtagcggcaaaaattgaaagctctcgagacttatgtcccttttgggcgccgttgaactgattaaaaaaaaaaaa

SEQ ID NO: 84662 - DNA, 592 bp, Triticum aestivum
  unsure (1)..(592): unsure at all n locations
  Clone ID: PAT_TA_84662
gcggcacggggacgtcctggtgctggacggctgcgccgagaacatgaacgacggcaagacgtacgcgtacctgtcgtcggtgccgcgcctcttcgcggcggagccgtacgactacgtgatgaaggccgacgacgacacgtacctgcgcgtggcggcgctggcgggcgagctgcggggcaagccccgccacgacgtgtacctgggctacggctacgccatgggcgggcagccgatgccgttcatgcacggcatggggtacgtggtgtcgtgggactggcggcctgggtggccggcgcgcgggaaattctggagcgcaacgacaacctgggcccgaaggactcaaggtccgcaaatggntcaacctcgccggcaaggggcaagaaccgctacaactcaaaccccggatgtacgactcaactgggacatggacaactnaaggccganacgtcgccgtncaaangctcaagacgaacnccggtgggcggcgggtcaagtactnaangtctcacncngggatanccctcgtccaacttacaactgcctgattgtccaacattgacaaaactttttttttgaatnctcaaccttcaat

SEQ ID NO: 84663 - DNA, 612 bp, Triticum aestivum
  unsure (1)..(612): unsure at all n locations
  Clone ID: PAT_TA_84663
ctcgtgccgcaagcccggcaattcgttgatctccgaatctcccgcccgtcagtctcgagtctccacacctgaaacgtctgagtccatggccgaggccgaagtcgacgccagggccacggccgacgacgagggccgcggcggcagcagcagcaacgtcgccgaagacgggcagccggctgcggcgaaggggcgcgcgaccatatccgtgacggtggtgctgctcgcgctgctggtggcctccgtggcggcgttcctgacgtcgtcgctgccgcgcgccggcgacggcgacggcgagggggtgcanggagctgtgcaaaggncggnngaagtcgggaaacgcgccgagcccgtcnagcacccgtcgcatccggggttcaacanccggctggacgcgttcngcacctggcngcgctgactngatgaagctccggcggcgcgctgctccgacgagcacgtacacaacatgtgccgtcgctctctgggggacncgctaagaaaacttcanatggcaagganacgttgacaagcgcggcggcaagggaaggcaancnggaccccaaanangcaagaaaagtgaaggataatnanctagnctgancttaacatgatgat

SEQ ID NO: 84664 - DNA, 567 bp, Triticum aestivum
  unsure (1)..(567): unsure at all n locations
  Clone ID: PAT_TA_84664
tttttgtatttgtaacgaatacttgctaatgctgggtcgtttctaatcttttctctacctggaaaataatcgtggctagctctaaaccggcagtgaatgcattgcgacgtgatcaacagtcctgattgtattatatcatatcattaatgtgtacgtatgtattttgtttcggaagccctagctgcctgtgataaccatgtggatgcgacgatgctatgcagcgacgggctccacttcaccccagtaggaaacaagatcctgttcgaggaggtggtgaagacgctggagacgagcatcggtttcagccaggagcggctcccgtcggacctcccgctgttccacgagatngaccccaaggacccatgaaagccttcggagcttancttgggccttatcggaggagaccacgtcgttggataagcacgtctgctgcattgagttctctcaatatcccgaggctgctgaggcattacangaacantgagcttaataaacgtgtttcaataccgttggttgcanccatcactgttgttggacacgtggttgntaaaaatcanacctccgtcg

SEQ ID NO: 84665 - DNA, 595 bp, Triticum aestivum
  unsure (1)..(595): unsure at all n locations
  Clone ID: PAT_TA_84665
gcctggccagccatggacccgcccaaccctaaccccaacgatgccccgtcgctcccagccgaatccgcggccagactcgccgccctctccctttgtggcaccagggaccttcccccggacttccacaccgccgagatcctcgacgacgacgagggctacctcacctccgcgtccagaggcgggagcagcacctccgcgtggaaggaggcgcccgagggactccacgacgaatgacaaggatggggacgatgtctcccagcccagccccagaagcagcggatacgctggcgagcgcggaagcagccttgatgacgacgccgacccgacccgacccgacaagattgggcgcgcggcaagaagcatcccacgangacatcttctcttcgttggaggaagangaaaaaacatttcttcattctgacaatctggcaagcaatatatccaagtatggggatgacacaactaccggattttgcnagctgaaacaatcattcttgtcaaaacatgngacattcaantttgagactgnaaaataaatanttcctgtaagggcaaanattattttaactccanaaatctntaagacnaggggaat

SEQ ID NO: 84666 - DNA, 215 bp, Triticum aestivum
  Clone ID: PAT_TA_84666
aacaagggaggtgtcagcagctgtatggtccatccaaattaactgattctactgttaatagttctgtttatgcatggtgtaccaatatcatttattaacgatgttcgcattgctgcagttacaattcatagagacaacatagtataaatagtagaagccgttacggattaaagccaaactagcaggctctatcttttataagtaaaaaaaaaaaa

SEQ ID NO: 84667 - DNA, 604 bp, Triticum aestivum
  unsure (1)..(604): unsure at all n locations
  Clone ID: PAT_TA_84667
gagaaggcaaggaaatacgccataatcaaggagcttgatgagccagttaccttgaaggatgggacagtggtcctgcagtttgaagtgagacttcagaatggccttgaatgcggaggtgcctacattaagtacatccgccctcaggatgctggatgggatgccaaggagtttgataatgagactccatacactattatgtttggtccagataagtgtggatcaaccaacaaggttcatttcatccttaagcacaagaatcctaagactggaaagtatgttgagcatcatctcaaattcccaccatctgtcccatatgacaagctctctcatgtctacacggctatcttgaagccagacaatgaggtcaaaattttggaatggggaaagaaaagaagaaggngaacttcctttctgctgatgatttgagccaacacttatcccatccaaagacaatcctgacctgatgacaagaaaccggaggactggatnanagagtaaaatcctgatcaaatcattaaacctgatgactgggatagatncccatggnaatntggtataaccncaacctanggatgttgttatacctaggaatgtatctagcacn

SEQ ID NO: 84668 - DNA, 642 bp, Triticum aestivum
  unsure (1)..(642): unsure at all n locations
  Clone ID: PAT_TA_84668
cgacgacttccccattcccgccccgcaacccgcagggctctgggttcggaggaaccgagggcgggggacctccgaccgggccgggcgacatgttgggcgacctcctctccaggatcctcctgctcctgttcggctacgccatgccggcgttcgagtgcttcaagacggtcgaggcgcgccccaacgacgcccgcatgctgcgcttctggtgccagtactggattatcgtggccatggtgatagctgttgagagcgtgatctcttggatgccaatgtattcagaaatgaagctagctttctttgtgtacctgtggtaccccaaaactaagggaagtgacgttgtatatgacacctttcttcgcccataattatcaatatgaaccgaacatcnancagagatgtcatctaagggaaaatctgggcantaattccttcacatgaagaatttgccgataaaggaanagcttctcaaggattctccgttagtctatctaaaaactgaagatcaatcanacaaaggacaagaatccggtggaccctnccnacaacgccacacattcgcgccgagcctctnaaacaccggaccncgtgcaaccaggccnctgncacgtnaaaccgggtgncaagaaactntaaggaatt

SEQ ID NO: 84669 - DNA, 552 bp, Triticum aestivum
  unsure (1)..(552): unsure at all n locations
  Clone ID: PAT_TA_84669
ggagatcaaagagaaaaagtcgtcaggaaaaaaggtgacaaaaggtaaaggagaatcagctgaagcagttcttcccagcaaggacgatctgaggaagaccattactgaaatcctcaagaaagttgacttcaacacggcaactttcagtgacattctgaagaagctcgacaatcactacaaaatggatctgaccccaaagaaagaagccatcaaagttatgatccaagacgagttgaccaagctatcagaggaggtgaagaaagganagggagacgaagacgccgggaagaaacagcagcagcctcaggcgcaggagatcgaggcatgagggatccgcggaaccccgtagctgtagtanccactgttaattatcctgtacttagtgcgtatgtgtcncatgtacangcatcctttgttgattcagccacancttganaacccacccctgattgtgtntgcnaaanacatgatgtgttgcaaccncacacctttactgacngttggggantacccttagcaanactttgttcaaattcaaangggtctgaaaac

SEQ ID NO: 84670 - DNA, 384 bp, Triticum aestivum
  unsure (1)..(384): unsure at all n locations
  Clone ID: PAT_TA_84670
acgangaacacntaaannctgacgtnacgttcttggaagaatgcctcctcanaaganacaaactgngcaccangatntngcgcatgncatcncgatggcttacaacggnaagcgcctcnccactgcatcctctgataacacantananatcattggngtangtggnacctcgcagcagcaacttgctactttgagcggncancagngccnantttggcaaatctcgtgggctcatcctaagtatggttccatgcttgcatcctgcacactagnatgggcgggttanaatatggnacagaaangnggcaaacctgatgagtggacacacgctcacacttncactgagcanaaatnctctgtaaatccaatgcttggctgcctcaa

SEQ ID NO: 84671 - DNA, 629 bp, Triticum aestivum
  unsure (1)..(629): unsure at all n locations
  Clone ID: PAT_TA_84671
tctggtgacagtaaaggcactatcattgacagtgggacaacactggcatatcttccgagggaagtttataggactttgttggctgcggtctttgataagtaccaagatttgcccttacataattatcaagacttcgtgtgttttcaattttctggaagtatagatgatggatttcccgtaatcacctttagttttgagggagaccttacactgaatgtttacccagatgattaccttttccaagaacaggaatgatttatactgtatgggattcctgggatggtggtgtacagactaaagatgggaaagatatgctcctcttaaggagacctgggtcctctcaaaacaaactaagtagtttaagacttgggaaaaagaattattgggatggacagactacaactgctcctcnaagcattaaaattgaggatgacaagactggctcagtgtacactgtcgacgcacaaaacatctccgctgggtgggagattcaatggnacaactcctaantcgttgataataataangncaactggaactgttgggtatacctaacncgggtnaagacaaaaccctttgttcctcagatanataaccacnntggtaaaanccnatgncgctaaatacaa

SEQ ID NO: 84672 - DNA, 655 bp, Triticum aestivum
  unsure (1)..(655): unsure at all n locations
  Clone ID: PAT_TA_84672
cggatatgcagtcacgctggggttctgtccgtcaagaatctgcttttacagaccgatttaaaccccggcgaggaatcagcagtcgtgtagtctacgacaatgcttttggtgatcccgtgaacgtcgagaagatgagcagcgaggagggctataagtattaccaacacgaggcgtactcttcatttgtccaagccgttgttggtgctgtttacacccactctggtcaagacgccgctcgcgatttcgtcaaagctcacgtccttgctcgacaagtcgacgtttctaccatgttcgaattcagtctacctacacgagaactctccatgttgtgcgctcgtgaaggatttgaggcacctattgctcgtctanagagtgagacangtcngcattcacgaactcccgtgttcaatgttgggatttacagcggttctgagaaacttggtgaaagtggcggcctaacctggacntgcaaatggaaggnacnatgaaccctcaaactggtactctannccccgnaanaagtccggtgccaatnacattncaaccggntctaacctgganacccccatatnatatgggaggcacaaacaaaattctgggttggtaanantncaaacggtacagntcggcctaagggnaagaaattcccgtggnn

SEQ ID NO: 84673 - DNA, 654 bp, Triticum aestivum
  unsure (1)..(654): unsure at all n locations
  Clone ID: PAT_TA_84673
gttttttttttttttttttttagaaaccagaagcaaatttgacgtcatcatgatagtaataggatcagatatcacttgtgaaattcacaacggtaaacaagtagaaatcttagcacccaacctttagagatcctagagcataacccaaaaatgctggagtactgtctcggctacacagccaatatagtggaccccagtatgcctgacaagcgaccgatcatgcttcagtctgctccctcaagcgacggatcgtgctcctgacagtgaccgcactagcagtgttcatggtgtaagcaccaccggccttgaccttcccacagtccttgcatccccaaatcccaaccgctttcctcttcacagcaaacttccacagaactcacagaaatacttggagtgctgagatacctccatcttcctgatttgcttacgcaagctagcacatacctggtccaaanttgcaaaaattccggcttctgggtcgctcgcatctcggaaacggaaaggaacaggggcccntgccgaatncggacancactccctgagntccccgactttggcaagcaangaggggcaanaggncacgatgngacaagncacncttcngngcccaacgtgncccccgtgcttcctttgccgcgaaagtnaaaggggggg

SEQ ID NO: 84674 - DNA, 517 bp, Triticum aestivum
  unsure (1)..(517): unsure at all n locations
  Clone ID: PAT_TA_84674
agcgtccgggacgggacctgccgtaagagcgccaacagcccgatgatggtgaaggctctgcagcgcaagccggcgatgtatactggcggcggcggcggcggcgagcaaagcgggaggagcagctggtgaggagattgagactgtggtggtgcgtggcgtgtactgttcatcgttcagacagatgacttgctggccatgctgtgggctcaggaactgcttcttcacagtggcgatgttctgatctgtaatgcacgaagcacgatactatttgttgtatatgtatgtatgtgtaactacagataagattaggaacggtgtgaaagaataaagaaaccgatggaataagtgatttgggaacaatctcagaatcaatttatgcagccctttaagataacttcgggaacatcctgcacaaacaacaaggtaataatgcatcaccntctgttagttaaacatttctccagaacaaactcaaattcagtgaatanatcccgaattcaattcnaaaaaaaaaaaa

SEQ ID NO: 84675 - DNA, 449 bp, Triticum aestivum
  Clone ID: PAT_TA_84675
gaaatgctctgaagaatcatttgcacatcaagtgaagatcagagatcctctcaagattggttttcctaatttatgggcgttgcgacttgcacgccagctacttgtgtggcatcctgaggatcggctaagtgtcgatgaagcactaaatcatccttacttccaggagccaatgtaatgtaaggagaggagattagtgataactaaccgacgaatcttcagctcagtcctttcaagttcaagccgcatgcatttggttagaggaattcatgaatcgtttgtaatttaccatcctaactgtgtcataagatgttgtgaatataacatgaagtaaaagatagtagcataagtgaaatacatgtgtaacgactttgcccttacaagctacagcattagccagacgcctttggttgcaatcactaatgaggaagaacttatctaaaaaaaaaaaa

SEQ ID NO: 84676 - DNA, 424 bp, Triticum aestivum
  unsure (1)..(424): unsure at all n locations
  Clone ID: PAT_TA_84676
cggacccgtcgatcccggcggcgttcctgtcggagctcaaggcccggtgcgcgcccggtgacttcaacacgcgcgtaccgctggaccgcggcagccagggcacgttcgacgactccatcctccgcaacatccgcgcgggcctcgtccccatcgcctccgacgcggcgctcgaggccagcaacgccaccggcgcgctcgtcggcgcctacctcggcgcggcgtcttccagcttctcgcaggattttgtggccgccatgatcaagatgggcaccatcggcgccatcaccggcgacgccggggagatnaagagacgagtgttcggcgttcaacacgaactgatcgacacgtcattcctataattcatacgaatgatcgcattcatattactgtaaatctctcgcgggaaacatgaatcattcaagat

SEQ ID NO: 84677 - DNA, 389 bp, Triticum aestivum
  unsure (1)..(389): unsure at all n locations
  Clone ID: PAT_TA_84677
ttttttttttgcacggggttatcgcctcggctttgtacaaggggttacatgcagctgaggcaagacctgtacaaaagggtggttgtcgggcactgccctagcagcctcgcgcctaacaggtagcacttgtggagatgctcaatattccatgagttttgcaactaagtgccatctccggtctccagacggactgtgccaggtctggtgactcgtaacacatggtaagggccttcccactttggtgatagcttgtttgtaccctcgacggactaaacgcgcctaaggacaaggccaccttcctcaaaatatcngncatgaaccctgangctgtgatancggcgctgggctttctggtancgtgtancacncatagcaacccggagacattc

SEQ ID NO: 84678 - DNA, 664 bp, Triticum aestivum
  unsure (1)..(664): unsure at all n locations
  Clone ID: PAT_TA_84678
aggatatttctatctggcatgaaagtagtctgggacggttgcacaactgaatgcgcaatctgtgtaagtcggttcgtcccaaccttggtaaagattttgaaactaacagtaagcaaacaaataggcctgaactgctcaatgtgaatagcctctgtcttcttaggaagaagagttatcgttccaaaattgagcttgaaaaaatgaagctgaccaatgaaaaactcatgtaacatcggcatcaggtcacccttaatgaagtgctagcaatttttgtaaaactccgccggaaacccatccgttcctagcgctttattgtttttcatatgtgcaatggcctcaaacacctccttcttcgtaaagggagcagtcaaaatctcatactcgtccgtctcaagttgagaaacatcctaaaccntgactcatccaaggacacaaaactctccttccggaggtcaaacaactgcttataatagttgataatgtaacttcaaggtttcctaacaactatcgtccctcacctggtcnaattgggaaatctctctacaagcttcataacatcatatgaagatnatgtgtccncccctggncnattncaactactccaagccaatcaatctctncgggaatcttaatgaacggccattacncagcacggacaaaaang

SEQ ID NO: 84679 - DNA, 346 bp, Triticum aestivum
  Clone ID: PAT_TA_84679
gctagtagaattaatcttattgtgtatggatggtgaatttaaccgaacaaaggggtttgggggcaaaggatgttgctgtagggatatagataaggttggaaggatgatgtttgaagtagaaattaggaagtctcggttgtaattagtgaactacatgtgtttggtttcgaggaggagagcaggagtttctggcagctgtggcgtgagggatgtgccggaatttggttggtgggttttttaaagtttaaactggtggattatatagtggtatagatgaacttgtgatggtgacctgctgctgttatgttgaaacactgcaacttgttccaatggcaaaaaaaaaaaa

SEQ ID NO: 84680 - DNA, 175 bp, Triticum aestivum
  unsure (1)..(175): unsure at all n locations
  Clone ID: PAT_TA_84680
ccgtctccggctctcccacacactctctcgctgtctcacaggctgtctcaccgccgcacagagcanancacaatggccgctcctcacctcgccgtgttctccgtgctcgccctcctcgccntggccgccacggcgcangcgcccagcggcnctccagcggcggcgnncaaggccc

SEQ ID NO: 84681 - DNA, 572 bp, Triticum aestivum
  unsure (1)..(572): unsure at all n locations
  Clone ID: PAT_TA_84681
ccggcgcctaccggagcgtcctgcaccgcgtcgcggccggggaccagggccgccgcctgtccgtggccacgttctacaaccctggcaccgacgccgtggtcgcgccggcgccccgcagggatcaggacgccggcgccgcggcgtaccccggtccctacaggttcggggactacctcgactactaccagggcaccaagttcggcgacaaggacgccaggttccaggccgtcaagaagctgctcggctaagcgaacagctgcaagtaggcagaggcagcttagctcgtggactatgcatagtttcaagcttgctgcttgcttcttgttcgatccattgtctgcatgcgtactgttgcgtgtttaaatttagcaaatcttatacgtagtcgttacnggtacnacgtatccgtgggtgacaataattgttgccgnttaagggccaccctttgggggnaaaaaaaagggggccggtaccaattcnccnaaatgagtctttacgccgcnannggcgtcntttaaacntcgnacnggaaaacctgngtaccaattanccctggagaaaccctttccaac

SEQ ID NO: 84682 - DNA, 607 bp, Triticum aestivum
  unsure (1)..(607): unsure at all n locations
  Clone ID: PAT_TA_84682
tttctctctgagatagtctttcgaatccatctctagggctcctgtttctccccatcctccccccaccccaccccccaccaaacagattcaatccgacaagacaagcatccatgtcgtcgtcacgccggagctcgagccccgacagcaacgacacgacggacgagcgcaagcggaagcggatgctgtccaacagggagtcggcgcggcggtcgcgcgcgcggaagcagcagcggctggaggagctggtggcggaggtggcccgcctgcaggcggagaacgcggcgacgcaagcccgcaccgcggcgctggagcgcgaactgggcaaggtggacggcgacaacgcggtgctgcgcgccgccaagccaactggccggccgcctgaatcgctgggcggngtctcaagtgctcaaatggccggcgccgccgtcnaatccggaatggcaacgacaacccatntccgccctggaaccgtctcccccgatganccaacgggtttgaaatctagctaaccgnggaaaancaattnttctctgcccttcaacnctatggaaacatcaaanacctgcaggttgctctgcatgtaaaattctttgtagtaaattgcanc

SEQ ID NO: 84683 - DNA, 531 bp, Triticum aestivum
  unsure (1)..(531): unsure at all n locations
  Clone ID: PAT_TA_84683
cagagacccagaggaagcaaaggagcaggaggaggaagctgctgcggcccctgagtttgctgcagtcactgattaccaaggagctgatcagtggggcggtgaccagtggacctctgatgtggctgcaccacctgttgctcctactggtgctgattggggtgctgcaccagctccggttcctaccggtgatggctgggatcaaactgtggcccctgttcctgtggatggcactgttcctccagtggtcgctcctactgggttgggaatcagcagcccagcccactgcccaaggctgggaatangcgttgaggcatcactttgagactcttgtgcgggattattccacngtatgaatgcccgagtcagacacatattttgtagctaatttgcnngctttgtgcacttatgttttaagggcttcaatttaaccggtgccctgtccgttttaaaattgatgctataaananctataagtataantactaccccttgtttcttcgaccgcatccatgnttggttcaaacgttcatg

SEQ ID NO: 84684 - DNA, 650 bp, Triticum aestivum
  unsure (1)..(650): unsure at all n locations
  Clone ID: PAT_TA_84684
ggaagacaggttatcagcacagctaggacatgcaatgttattttgattgttcttgatgccataaaaccaataactcacaagcgtcttattgagaaggagcttgaaggatttggcattaggttgaacaaaacaccacccaatttgactttcagaagaaaggacaagggtggaatcaacttcacatcaacagtgacgaacacacatttggaccttgatacagtaaaagcaatctgtagcgagtacaggatacataatgctgatgtctccctgagatatgatgctacagcagatgatctcatagatgttattgaaggaagccggatttacactccttgcgtatatgttgtcaacaagattgatcaagataacactcgangagctggaaatcttggacaaacttccccattactgcccggttagtgctcatcctgaatgggatcctgatggacttctggagaaagtatgggaatactnggattgggtagatatacacaaaactaaagggctgaaccagattatgaggttctgttatcgatcatcaagaagaaacntggaagattcgcnnagaaccacaagncatggcaacaattaataccccggaagggtcaatgtgaananacccaaaaattgaagncatactnacataggcn

SEQ ID NO: 84685 - DNA, 365 bp, Triticum aestivum
  Clone ID: PAT_TA_84685
gcggcggcggcggctaccggatcgtctgcgatgaggacccctcctacgcctgcgccatcatgtgattcattgtcccgttacgcgcccacaacccaccacaccagtgtcagtcatctcgtcatgccgtgccgtgccgtgcctcccgtataatcgccgtacagattcatcatacacacacacacactcatattatatatatatacacagcatcatgtataccgtacgtacgtccgtacctgtaccgtctccttagcttgcgtgttatgttgtgcttcaattaagtacggagtatcatatagtagtacatatatgttaggcaaagtgagagaataaaataagcgatgatgatgttggttaaaaaaaaa

SEQ ID NO: 84686 - DNA, 539 bp, Triticum aestivum
  unsure (1)..(539): unsure at all n locations
  Clone ID: PAT_TA_84686
gtttagaagagttgcgtcctgaaggttttttgaacgaaacatcatgctctattatactgaggactgcccttgttgcgtcaactgtatgcattgcctttcttctgccgttctttggtcttgtgatggctctcattggatctcttcttagtatacttgtggcggtcataatgccagccctgtgcttcctgaagatcgcacaaaacaaagcaacctgtccacaggtgatcgcgagcgtcggtatcgtaatactgggcgtcgtcagcgccgcgctggggacctactcgtccgtgaaaaagatcgcagaaaactactaggctcttgggacagtttctctccgcagaggctactaccacacggttccacgtacgtccggccggagctggggaatggcaaggtttacgtacacatccaaattttgctagaactaccgaaatccctgtagataatacgtatgatcggncacatatcactntncancaaaaaaanaacgcatcacactcactnggataantaacaagcctcnttttaaaaaaaaaaaa

SEQ ID NO: 84687 - DNA, 487 bp, Triticum aestivum
  unsure (1)..(487): unsure at all n locations
  Clone ID: PAT_TA_84687
aggacgccgccgtcgtatcaatgaacgatgaccttgctggtgaaatcccggtcgccttcatcgtgcggaccgaaggttctcaagtcaccgaggatgagatcaagcaattcgtcgccaaggaggtggttttctacaagaagatccacaaggtcttcttcaccgaatccatccccaagaacccgtcgggcaagatcctgaggaaggacttgagagccaggctcgccgccggtgttcactgaggcccgtatgcagcttcttctcggacggccaccacgctgctgcgaaaaaaaaggcgatgtaatggcggtaacactactattcatgaactgggcaacaagaagggacacgtattcctgtggaacacatgttgccaaaaagaggtttagtttgtcngtttgttggccctgtgtgtaatgttcaaaaacatatagactctcncnaagttgttttgacccaaagaacaacctgattacggaaaaaaaaaaaa

SEQ ID NO: 84688 - DNA, 613 bp, Triticum aestivum
  unsure (1)..(613): unsure at all n locations
  Clone ID: PAT_TA_84688
gatggatcgcgcgcagttgctcctcgtcggactcccggccttgctcttcttctccgacctcactcacatattcgcgccgccgcctccccacctccgccacccccatcaccaccctcctcaccaccaccatccgcatccgctgcatcatccccactcgcctcatccccacccgcacccgccgcatcatccccacccgcacccgccgcaccaccaccagcaccccgacccctccacggcaatcatacangagccacgtgtggatgaggctggattcngcagcacagtggagctgcaattctgtgcctcctgctcgtacaagggaactgcagtgaccatgaagcgcatgctggaaactcatttcctgggcattcatgttatcttgcataattatcctcctcaattcccaaagcgtgtatcaacaaagttatccaattgttaaattggagccttgnaaaataatggctggtgacanattttccaaaattggaanggtgccctcaatggacaatccttctgcaatanattgggacatggaaaatcggcaatngaacttgccancttnnaaaantcggggcttaatttntnaaggaattggatccaaattgtacaagtc

SEQ ID NO: 84689 - DNA, 621 bp, Triticum aestivum
  unsure (1)..(621): unsure at all n locations
  Clone ID: PAT_TA_84689
taaaccctccgcctcctcgcctccctcccttccatccaatcctcggaacgagcgcgcgggcgaggaggacccccgacggaggatggcggcggcggctagggttttccgcgggtccctcttcctgatgtccccggcggcgggcgccaaggcgtcggcagccaagaaggcgggcgcggcggcggcggcggcggcggtggccaagaagaccgaggcggccactacgaagccgagactgccgaccgggatcacgaagccgatgccggtctccgatgagttccgcaagttcgccggcggcgcgcccgaggtcgcacgctccgaggccatcaagctcatctgggcccacatcaanggccacgggctccagaaccaagccaagaaaacggagatcactgcgacgccacctcaaaactgtttggcggganggacaaggtgggatgctggagatcacagctactgaacgctcacttccgaagaactacaagcaanatcctggtgcaatgatccncttggtaaaggacttctgtggtggctctggnggcattgaatccaatccacnagtgtanaccgaaacatgtatcattagatanaacttgtacattggntttgggtatcagtaaagat

SEQ ID NO: 84690 - DNA, 628 bp, Triticum aestivum
  unsure (1)..(628): unsure at all n locations
  Clone ID: PAT_TA_84690
gcaccgtccattgacccccatgaggcgatgccgtggtgtagcatgtgtagtgattatactgtcaacagcattcctgttggtagtttacttggctcctattactacttttgctgtgcggctgttcagtgtgcattacagccgaaaggcgactcctttctatttggaatgtgggttatctttatggccgttcttgtttgagaagataaacaaaaccaagttgtcttctccggtgaaaatgtgctcccaaaacacntgtatggtaatttgctaaccacaagaccgaggttactggtgacttgtggaatcttgcactgaaggaaagcaatttanggaaaacaagtcaatctttaaaacaaccttataatttncnaattttaacctggatttaaatttttgagtttacccccggtnaacggaatggagattgatnaacattttcacnacaantatcaaattttaagaccnaganctcnaccnggtnggggtttccgaaaggacggntatcgagaagaatcacagagcagatagctcagaacatgctgctagcaganagtccctcaagcaaggctcatnngttgaaactagattcctancattagagcaatanaanatcacccaattttggaan

SEQ ID NO: 84691 - DNA, 383 bp, Triticum aestivum
  unsure (1)..(383): unsure at all n locations
  Clone ID: PAT_TA_84691
tccacctccaccaattcaaacagtggcacacaaaaaatggacagagtaaatgtgtcggtgtggataattatgagagatccgttggtgctttgagatattgcagaaaaccccctgggaaaacttaaaaacaattacagaaatgatgcttccctcccgtagtagcaaaaaacatcttgtttgtaagtttggaactagcaagttaggcagttgaggaaaaacttcaaaaacttttgccgaagacaaaaaaaagacaaaataaattgggacattggacaaaaaactttaaaaaattggagttnaaaaaacaagttattggtagantatttgagctggttacaaaacccaatggccaacttggcaataaaaancccaccaaggggtgc

SEQ ID NO: 84692 - DNA, 637 bp, Triticum aestivum
  unsure (1)..(637): unsure at all n locations
  Clone ID: PAT_TA_84692
atgggaccgaatacatctctccacagggtacattaaatccatatcccgctcagcaatatcttcctatttatggagtctcagctgcagcaaacacagccaaccaaacatttaaccagttgaatccatacatttctggtgggggcaatggttatatgtcggttcatagttacaacatgcctggaaatcaatatgtgcagctcactggatcaaacttcagcagtgcgtcaccaacagctcaaccttcctgtcaagacccttttttaagtagcgacacccgttcctgcacatccacacctaataattccagcccctcaacccagtttaacacaagctagtgggtcaagaccaaaagagcaagctgaactgtgcatcccaacattggaccttgangnaccttanattgcagcaaggactaaaaagagatgtttgctgtatcaanagtttggtctgccttccaaccggttaaacctatactgtgaagggaccagtcacttaagatctgtacnganactctggaagtaccaagcggacgntcacatagtagaggntgtcacgggataacacaggctagngatgtncnaaatcagtgggngncanccatcatggnaggtngngcaatntcattnaancgggccgg

SEQ ID NO: 84693 - DNA, 643 bp, Triticum aestivum
  unsure (1)..(643): unsure at all n locations
  Clone ID: PAT_TA_84693
gttagctctcagaggaaccctcctgcagaagccaactatgaagagagacctgcaggatgaccttcgtttcttggtatgggagagcctcaaaggttcagtgagatttgttggtgctttagcagcactacagttagcagttgagaagtttggcagcgccaatgtttgtgttgctggggcacccttggggagctggctttgcacttcaaatctgcaaagagcttgccaaacaagggnttttgtggatgccaccttttcatccaccttctgtttcactgggcatgggtgttaaggagcatgagtgagaaagccactacctgtggnaagaaancaaaggaatctgccatttgaaggaagagcacacactttagactgccaaggccgaagcaaatgacaagaagaattgcgcaccgagataatgggtgcacatcntttgtcaacaacaacgattaatctgcgccactanangnccctccttgccttcaaatcaacaaaatgtctccgannaacancaacaacaaccaaggaatgagatgcaatgatgtgtccaaacncttggcanaaaaggccaaaaattccttnggcatggntnaaaaaggggcaattgaagggcttnaggggccntaaaaaagccaaaagantaanc

SEQ ID NO: 84694 - DNA, 645 bp, Triticum aestivum
  unsure (1)..(645): unsure at all n locations
  Clone ID: PAT_TA_84694
cggagacagggaagtagcgtagctagatccagagctcggcgccagagatacccgacatcctcgtcatgtctccggttgcaagcaagggagtagtgatggacggtgcggtggcggtggcggcagtggccgccgccgtgctgctgtgcctccatctgccggcggtggcgcgaggccagctgcaggtggggttctacaacacgagctgccccaacgccgagtccctggtccgccaggcggtggccagcgcgttcgccaacgactccggcatcgccgccggcctcatccgcctccatttccacgactgcttcgtcaggggctgcgatgcgtcngtgctgctgacctccgccaacaacacggcggagcgtgacgcgccgcccaacaacccgagcctccacgggttcaagtgatcgacgcggcgaaagcggcgtggagcaaagctgcccgcanacgtgtcctgcgcggacatctggccttcgcggngcgcgaaacatcaactcacggcaactgccgtacaagtgcctccggcccccggacggaacttcctcanacggggcaanacaactgcgggcaactnaaccgtccaactggggcaactccggcaaaactcccgacangaatgcatcncccgggcaaacgtggcgtctt

SEQ ID NO: 84695 - DNA, 605 bp, Triticum aestivum
  unsure (1)..(605): unsure at all n locations
  Clone ID: PAT_TA_84695
gcgcatcaacacgcaacaaggggtgtgcgtctacgcgtcgcgcacgctgctcttcctcagggacgacggcgccctcaagcctcttgccatagagctcagcctgcccggtgacggcgccgaggtcagcagcagggtcatcctccctgcgaccccagggacgaccgatggacacctgtggtggcttnctaaggtcatgtctccgtcaatgattcaagctaccatcagtcatcagcactggntgttcacgcacgcaacggtggncctttnataatcgccacaaaaaggcaaattacnccattaacccattnaaaaattgntgggccccaatttaagggnaanatgcatttaaaaactgggnaagaatcttgntaacccggggnaccttgaaangcntttccgggaaattccaaggaattctccggaactacccnatgggtnacnggantcctgccaaaattctcaaaanggatggtcaaatngggggggcatcccctcacttgnggatacccttccgtggcggatgactttggcncaacaaggtggtagactatggccaatttaaaccaacccggggccccaccgnttaaggntngggaantccccnc

SEQ ID NO: 84696 - DNA, 497 bp, Triticum aestivum
  unsure (1)..(497): unsure at all n locations
  Clone ID: PAT_TA_84696
attccttccacaaggcactctgatccagacagtgctggctcttccttttctattcttctgggcaattcaccgcatcttgatggccagtatgctgtatttgggagggtcactaaaggtgacgatacattgactaaactagagaggcttccaacccggagagaaggcatttttgtaatgccgatcgagcgtatcaacatcctatcaacttactattatgatattgatctagagagctgtgaagcagaaaaatctatctccggaggagactttctgaatcagcatcagaagtgagcgatggagaaagaaaatgctttgcttaatggtggataanggacggcaatcccgttcatganctggatgtttcctgaggtggtattgacacgtgttgaatttatncgctgtcctatgcacnacgtanattgataatttaatnggcccaagtccanagntctgttgtancanacaatatgttcataactcatcttantttctcgntn

SEQ ID NO: 84697 - DNA, 181 bp, Triticum aestivum
  unsure (1)..(181): unsure at all n locations
  Clone ID: PAT_TA_84697
cttttctatgttgcctcgtcctgtcctgtcactaggttttttgtttgttcaccgtcagcttgttcgctgcggcttgctgcggctgcaatccggctgcggctgcggcttcnanagtatttttcnctctatggattgcagctgcagnantccaaacagctgcaanagtgtcggnttgtancca

SEQ ID NO: 84698 - DNA, 218 bp, Triticum aestivum
  Clone ID: PAT_TA_84698
gccagaacgcaacctcggctccgaaaccctagccgcacgcagctgtccacttctactcccctcgcctcgccacacccgccgcgcggcacgatcagacgccatggccgccgagaactactggaggtacgctgatgcgcggcagcagcagcaggcgatggtggcccgccgcggcggccgcagcggggatggtcccgcggcgaccgtcgccgcggccaagg

SEQ ID NO: 84699 - DNA, 442 bp, Triticum aestivum
  unsure (1)..(442): unsure at all n locations
  Clone ID: PAT_TA_84699
ctgaaccagaacccaagcccaagccgatgccaaaaccaaagcccaagccctgctccaaaccgaagcctgagccgatgccaaaaccggaaccaaagccggagcccaaggctaaacttgaaccgaaaccgaagccgcctccaaagtgcaaaccaccggcaacgcacaattggatgggatacttatatatgacacttggatggaggagaacccgttacggagccacactatgctatttttaagaataagtaatgcatattccctgtatcaattcctttcctattgttcccatgcacgcctngatgantattagtaccctgtaattattatttgcttggttgggatatgttcatcctactttggtatatgacctgaccatagtcntttggagtatcaatgcatgattggtgttcatccccatggaatgactatttttccaaaaaan

SEQ ID NO: 84700 - DNA, 586 bp, Triticum aestivum
  unsure (1)..(586): unsure at all n locations
  Clone ID: PAT_TA_84700
ctgcgacggggataagtacgtcttccagatgacgacggcggcatggccgcggccacgcttcctcgtcctcccccagcctggattcctccgctcggtctgccacggcctctgcgcccgctgtctcttctgcttcctgctgctcctcgccttcgcctgcagctccagctccggacgggggtggtcaccaacttgcctggtttcnacggcacttcccttcaacttcgaaaanaggnagttgaagntganggaaggacccgggnttgagtccttcnaataattcgtcaaggcnatttccgggcccccnccgccnnccnttaaancttttncctttngggcaaacngggggaacnnggtctnttttaaagggcccccaanaaattggccaataanttctcctgaactaaaagaaactgccgcctgnaanaacaaaanctngcaanggtaaaaccttngncttacgnttggccggttcctccnaaatncaaaggtcattgngaattggctacgaacaagaatccanatggtatataccatactncatccttaatgggaccattcgaaactcgtccgaatatttaggntattg

SEQ ID NO: 84701 - DNA, 554 bp, Triticum aestivum
  unsure (1)..(554): unsure at all n locations
  Clone ID: PAT_TA_84701
gccgctgccagccagcggcggcccagaggaccggcggctgcaggtggtgggcgtctccgccgccgccggatccggcggcgatgactactacttggacgtggagagcggcagcgcggcggtgccgctggtgcagcagcagtacgtgaacgggcggctcgtccgcctccgcaccttctccgtgttcgaggtgagcatgatggccgccaagatcgcctacgagaacgccgcctacatcgagaacgtcgtcaacaacgtctggaagttccacttcgtggggttctacaactgctgggaacaattcgttgggcgaccacacgacgcaagcgttcgtgttcaccgacaaaggaagaggacncaanctngtggtggtgtcnttcccggggcacggagccttcaaaattcngaatgggtcaacggacgtaaaccgtcttggtgggcatgggccaaatgggcaaattcaanttgggttctcaaaggnctggcctncaagaaggagacggaaaggaccaacccggngttccaaaggcnccccaaancntccgggaaaccctgct

SEQ ID NO: 84702 - DNA, 504 bp, Triticum aestivum
  unsure (1)..(504): unsure at all n locations
  Clone ID: PAT_TA_84702
cgccaccgcaacatcgtgcgcctcctcgggtgggccgcgaacggcggcacgaggctgctcttctacagctacctccccaacggcagcctgagcggcctcctgcacggcggccgcgccgccaagggttcgcccgcggacgagtggggcgcgcgctacgagatcgcgctcggcgtcgcccacgccgtggcgtacctgcaccacgactgcgtgccggccatcctgcacggcgacgtcaagtccatgaacgtgctgctcggcgcgtcctacgagccgtacctcgctgacttcggcctcgcccgcgtcctggccgccgcgagctcaaagctcnanaccggnaggcagcccgcatcgccggctcgtacggntacatggnaccagagtacgcgtcaatcatcggttnagcganaagangnttttanacttcggcncgtntgctgganatttaacgggcggcaccgctggacccgaccttcgggcgggccactggtcattggtgccaacact

SEQ ID NO: 84703 - DNA, 623 bp, Triticum aestivum
  unsure (1)..(623): unsure at all n locations
  Clone ID: PAT_TA_84703
ggtgaaaagaacccccagtgggtagtgaaatagaacgtgaaaccgtgctgagctcccaagcagtgggaggggaaagtgatctctgaccgcgtgcctgttgaagaatgagccggcgactcataggcagtggcttggttaagggaacggaacccaccggagccgtagcgaaagcgatcttaatagggcgattgtcactgcttatgggacccgaacctggtgatctatccatgaccaagatgaacttggatgaaactaagcagagtcccgaaccaactgatnttgaaagatcaaccgttaattttggttaggggtgaaatgccacnccnacccaaaactacctgttttcccccaaatcctttagggcaacaatttactggcatctagggntaacacgtttcggnncggnttcgccaacngtaccaattcaggnatcntgatactaattnaccccaaatananggcaaggccgcaattaacatnggganacttacctcananggaaaaccggtacaactaggccnaatacgccatataagagtgggtcaaaaacagaggttctaanancacctttagatctataccccgtnacccttcctaananggnaactttccacttgattann

SEQ ID NO: 84704 - DNA, 322 bp, Triticum aestivum
  Clone ID: PAT_TA_84704
gcggagaggactatagaggatacctcggttgaggcaccagatgtacaagcaggtgcaagtgagtaaaccagcttagcgatcctttgcattcctgtcagtttctgttgatatcgacgtagtttgctcaactgattctcttgtctagatgatgtgttctgtatagaaaacctggaaccactttagcatcataaggctgttaggttttaaataacttggggcatctatattttgccccttatttttcctatataaacttcatctagttgtattcgatgcgcacgtgtgatttgtcataaacacaatttctcctaaaaaaaaaaaa

SEQ ID NO: 84705 - DNA, 321 bp, Triticum aestivum
  unsure (1)..(321): unsure at all n locations
  Clone ID: PAT_TA_84705
gcaacttgcagtaggtgacaggtgttaacaggagctggctgagcttctcttgcttctgcaagtagtagctgtagccgccctgtaggcagagagaggagagacgacgtacgtgagggagcgagcgagcgacgacagcatcaggcaggcgttgacggccatggcttcctccggcagcggtggcggtcgccggggtccccgtgttggcgcctgcaatttcctgcggcgcaattcgccgcggatgcgtttcctccccacttttgcgcccgaggacgggcgggcaattcgcngcatcanaaaggtgttccgngccaacaangcgca

SEQ ID NO: 84706 - DNA, 608 bp, Triticum aestivum
  unsure (1)..(608): unsure at all n locations
  Clone ID: PAT_TA_84706
gagacgcgtcgcctcctcccttcccccaccccgccgccgccctcgcgtccgtccgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactcccncgaaggganngaaggaaggggctcaaacgancacaaacgtcgtcgtcaagtgcgccgagatcnagaacgccatctccgaangagcaacatcgtttcttttcaccgagtacaatatgttggtatcttcaaggctatcttcgctgttgtgatcttcctcttcctggntcggttgaaggattcagcacgaaanagcaagcctgcaatatagcaaggacaagtatgcaagctgcgctgttantgcatccttaacaatggtccttctgctggagcatactctctgncccggttccttggatnaaatgcanatatcaatgcaaaatacctgaactagnagggttgaaggtttacatgcttcgcc

SEQ ID NO: 84707 - DNA, 419 bp, Triticum aestivum
  unsure (1)..(419): unsure at all n locations
  Clone ID: PAT_TA_84707
gggatgggtcgtgtgcaacgactgcagggacacgacgcaggtcttctccggcatggcgggccacaagtgctgccactgccagtcccacaacacctgccgggtggcaccccccgtcctcccgtagccaccaccaccaccacatcattgttgttggaattggatgcagccagccaagatacccccggccccagcagctacgctattattaccagtagcgcctgcgcttttacgcaccgctccgttccagtccatgatgaactgcataatttcgtgccatgcangtatgtacgtacactgttattggagatcggaagatttatccgactcgggacgcattatttgtaccacaacaaaacacgtgttacactattgtaataccagatctggatacgaaactattttttaggaaaaaaaaaaaa

SEQ ID NO: 84708 - DNA, 309 bp, Triticum aestivum
  Clone ID: PAT_TA_84708
caggaagcagaggatgctgttctcccagggtccagtgaaaacatgttcttagaaactgtatctgaaatcatggaccgtcacctcgacaaggagtgagtttagaaattcagaataactgatctagttgttccagttccagctgtatccggtttgttgtttctattgttgacaagcactgatcaacagactaataatttgatttgtttgtacctctcaaatgtttctttcggttgtaatgctcgagtactttgcttagcacactttgtgaataatatatttgttcagttagacattaacaaaaaaaaaaaa

SEQ ID NO: 84709 - DNA, 399 bp, Triticum aestivum
  Clone ID: PAT_TA_84709
cgcaggaacacctatttcatttggctttgatgagacctcaggtatcttcaagttgaacttcaccagcgatcctaacatcgatgcaccgactgagattattcttcctacttctacgtttccgaacgggtatgaggtccgagttctacctggtggcagcctgttgcaatacaagcttgacgatcgcaccctggcattgttcacatccagggctctcaaacagaaaacggagatatctgttaggatttcccgcaaatgagatttctaacttctttaccattcctatatctaaaccaaaatgccctattcgccttctgtataagtaattccttgatatcactaatgctaactcccacgccgcaaagtagataagccactgaaaatgatattagtagcctaaaa

SEQ ID NO: 84710 - DNA, 660 bp, Triticum aestivum
  unsure (1)..(660): unsure at all n locations
  Clone ID: PAT_TA_84710
tggaggtggagcagtgggcgctacagcctccatcagctagctgccttgccgtgtcctcctcttcctcctgtcggtggcgatctctgcggaaacccgagcttcgtccaagccgggcagtagtgcgcgccgcctgggcgtaattatggattcttttgagggctctgatcatataactcaaagaaaggtgttcctgcaaaacatattgcattggtttgatggnaaagaatgacctgctgtagagggggttcctaatggnttggcttgaaaagaatgcaagcctaaaaagaaccgatatngttccanagtccaagagtgacactttctanattgattcaatccaatnggtacgaattcactcncctcaaggatgtncaacgctatccttngaatcctggagaatcnagtaaatgtnnttagattgccaaaacaaagagaaaaatngagnactgcatactaaaagaggacaatctcatcatgtaagttcancctcaagtttgggccanatctgaattgcctccgatctgtgtaactgcnaaatggatnacaattggntcaatnaacaaggggttattctaaggnatatgatcntttaggaaaggttagaattcattgacnattncanccccnaaatncaaaggttacaaatntattggagancaa

SEQ ID NO: 84711 - DNA, 171 bp, Triticum aestivum
  unsure (1)..(171): unsure at all n locations
  Clone ID: PAT_TA_84711
gcccgaggnccttgccccggcncccaaggccgaggccccgacccccgagatgagctccccgccgatgcccacggngggccccgcnccnacgccntccgccnaggtgcccnctgcccccagcgccnccgcngccgtctcccccgctgncgccaaatggttcgccgncgctgc

SEQ ID NO: 84712 - DNA, 574 bp, Triticum aestivum
  unsure (1)..(574): unsure at all n locations
  Clone ID: PAT_TA_84712
ttgcgatccgccgccatcgcttcaagcagcgaaccctagccgccctcagcgacggattgcagatctcccagccatgacgttcaagcggaggaacggcggacgcaacaagcacgggcgcggccacgtcaagtacatacgctgctccaactgcgccaagtgctgtccaaaggataaggctatcaagcggtcttggtgaggaacattgttgagcangctgctgtgagggactgcangaggttgtgtgcatgatggaatgtcttcccaaattgtacgcaaaggtcacactgttctcatcgcaatcaatcgcaatttccgtgtccgcnccnttagaacaagaggaacgttnagccccgcanctttcaagngccgggattattgccaaggcaagtcaagggccacgcgccaaatnctgctgcanancantcccctggtgcgtctcntactaantcaggatcttcaaggctaatctccactatggganaanggctttccngtttnaaaacaagtngtacccctgantcaaattttnanattgnggtctctcntacatnatgngngtgttaaaaaaaaaaaa

SEQ ID NO: 84713 - DNA, 174 bp, Triticum aestivum
  Clone ID: PAT_TA_84713
ggttagggttccgagttttgtgctatgtttgttagctatattcgcggatttggctcggaatccggtcgtgtaaagggtccagcccccctcctctataaaaagaggtctacggccgatttgtaatcatcaacaatcgaatcaatacaacttctattcgcatttaaaaaaaaaaaa

SEQ ID NO: 84714 - DNA, 642 bp, Triticum aestivum
  unsure (1)..(642): unsure at all n locations
  Clone ID: PAT_TA_84714
ctttgctgctgccactcggcgatccgatcgttctcgagcaaggtcggtggccatggcacgctgccgccatcacctcctcctcctttccgtcttacttgccttggctgctgctgctgcgcggcaggcgcagagtcatggaaaagcctccgccgtcttcatcgatgcctcgtcgcaccgctaccttcgggaccagcaagccgaccaccaggacgcttcaatgtcgttaaatgaagtttctgcggttgtttctgtcttgcttggtttccgcaccgtcaacatccctaccaagctatttcttcctcgaagttgaacaaantcttcctcctaatccatttgatagaccgcgtgctgttttcctcngtgcaaattgatgggtcaatgttcctacttcgtaacctgaaggaacaacatttcaagacaagattgaaggngcaaacacgctnatacaaggcttacagataagatgactaattgcatcatcaagatnaacnctaaattctctccataaataactgatatnaacttcaactgggaaacggtggaggatttacanaatcacggnaaacaatcatcctngngaaggaanatctacttgaantntaggancncaaggatcagtcanctggtnctctancatgaagg

SEQ ID NO: 84715 - DNA, 606 bp, Triticum aestivum
  unsure (1)..(606): unsure at all n locations
  Clone ID: PAT_TA_84715
ccggtccccgcgatcgccccaggatccgtcggcagcagtcaacgaaacaattgcagttgacgaggctcaagatgaggaagaggacttgactttaggttctgacgctgagagctctacggcttctatttcatcgagcattcttaattatcgtacgatcaatggcaggacgtttcatagtgagaggggaaacgcaacctactggggatcgaatgatgagcgccaaaagtgatgcatggatatcgctcaacacatatgactcccgcccacgacgganactatactttgcncctttgggaagacacattccagaaancccttganntcggaactggactgggaaccnggctatcaatttgccgncaattcctgggtgnaagncatcggaacgtttncaccaacnaaccaactggnccaactaactngaattccaaattaaattgcnccaanattggcttccancgancattcataanccacttgttacnatcgggggattcanacggnnaacttnagcaacanaaaacccaaccgtggngggtgaacttgaattccaacncagaatacatgnccttnaatancncaaggcatggaaggttttcagctaaa

SEQ ID NO: 84716 - DNA, 639 bp, Triticum aestivum
  unsure (1)..(639): unsure at all n locations
  Clone ID: PAT_TA_84716
tgcgaagattcgtgcttgagaagcgtgcacgatcgaagcttgcacctgctcgaacatacctgctcaacatattgaatgatgtcaacaccctcgcaaatgtcaatcaggaagttgctcaatcggaactggagcgagtgacccaggagttgaaggagcttgaacctcagttggaatccagtcgaagggcaaagaccgaagtaagcgagtcagttgatgccaacgttgaggaaacatgcaaggacgtctacgactacactcgaaacactcttaactcggccattctccattctgggaagcagccactacgatgtaccctaccccggtatctggaatgctttcaatatgcagaggacctcaaggaagctatgctgtctcgcatcgcaaattctgtttcgaactgcgaagagtatgctcgcagaaagacgtgtatggcgtcaatgctatcaagcaactgggtatcctgcacttgtgatgattcagaatctcaaatccgactgatttatgttcgaccaagcanatctcttgctcgcaagtcatatcccacagaatgatgacttgtcacggncnactttncannacagaaaattctggacggnaggcctaattccgggcctttgcccgatattganaaaatgatgg

SEQ ID NO: 84717 - DNA, 431 bp, Triticum aestivum
  unsure (1)..(431): unsure at all n locations
  Clone ID: PAT_TA_84717
tcagatccttatctttctttcgcatcgtctgtgaatgggttagctgggccactacatggccttgcaaatcaggaagcgcttctatggctcaagtctataattcaggaaacagggagcgacgttacgacagaccaactcaaagactatgtctggaagacactgaagagtggaaaggttgttcatggatttggtcatggagttctgcgtaggacggacccacggtatctatgccaaagggagtttgccctgaagtatttgcccgaggatccgcttttcaaactgctgtccaagttatatgaggtcgtgcctccgatcctcactgaagctgggaaaggtcaagaacccatgggcccaatgttgacgctcacagtggactccttgctgaacaactttgggactatctgaaacacggtatcanacngncttgtccg

SEQ ID NO: 84718 - DNA, 595 bp, Triticum aestivum
  unsure (1)..(595): unsure at all n locations
  Clone ID: PAT_TA_84718
cgccgccataccctcgaacccgagaggaaccctaacaccaaaacgcccccggaggcagctaggagagctcgaatcaccagccatgtcggagcacgacctcacggcgctgatggcggcgcagctggaccgccacctggtgttccccctgctggagttcctccaggagcggcagctctactcggagtcggagatcctggaggccaagatccgcctcctcagcggcaccaacatggtcgactacgccatggacatccacaagtccctctacggcaccgacgacgtgcccgaggacatggtgaagcgccgcgccgaggtcgtctccaggctcaggtcgctcgaggagggccgcancnccgctcgtcgccttcctcnagaacccncagctcggtgcaggagttcaggcccgacanacagtacaacatcacatgctccangatnnatacagatcggtcctgaccanattgacgcctgtatagtatgccaaattcagtttgantgtggnaactactnagggctgcgatnccttacantacntgcttgncaaacanttagnnaaatngagtgccctgggnaaactggacaanaatctanncnt

SEQ ID NO: 84719 - DNA, 505 bp, Triticum aestivum
  unsure (1)..(505): unsure at all n locations
  Clone ID: PAT_TA_84719
gccggacgcgggcgtcgaggtgcgcgcgctgcccaccagggccggcacgcgcgtcgtctccgccttctggcgccaccccgcggcgcggctcacgctgctctactcccacggcaacgccgccgacctcggccagatgctcggcctcctcctcgagctccgcacgcacctccgcgtcaacatcatgagctatgattattcaggctatggtgcctctacaggaaaaccatcagagtacaacacatacaatgacatagaggccgtttaatgattgcttgaaaaaggatatgggatagaagaagaggtttaatccttgnatggggcaatcanttnggaagtggaccgacatttgcatttaacctcacgtctgggaaatataagagggttgtgcttcanaatgggatactctccnggatacgggttctgtttccaatcaaaggacactttggttcgacatcttcaaagaacatcgacaantaacaagtnactgcctgtgttggcaaaatgg

SEQ ID NO: 84720 - DNA, 564 bp, Triticum aestivum
  unsure (1)..(564): unsure at all n locations
  Clone ID: PAT_TA_84720
caaaaaggaggcgccgcgctcctcttcttctacgccgttcactctctctagtctctcccttcccttctccacgcctccgcccccactcgtgagaccctacctagccctagcgccagcaccacccgcccaacctcccggagagagagaggaggaggccttcgccgccgccgttaccgtcggccgaggcgccagaatgttcgggtaccagaagggcctcgacgtcgaggcggggacatcgggcgccgccgccacgggcggcgcgcgccagctctacccggggatgcaggagagccccgagctgcgctgggcgctcatccgcaagatctacgtcattctctccctccagctgctcctcaccgncgtcgtcgccgcantcgtcgtcaaggtcgcgccatcccgcactcttcacacacaacgccggctcgggctctaatcttcctatatcnccccttancgtgctgtgccgctgtaatctncacgagaagcaccaatcaacntgatctgctggctctnacgttgcataacttgcgtggcagaattgctcacatngaaggcatccggagt

SEQ ID NO: 84721 - DNA, 599 bp, Triticum aestivum
  unsure (1)..(599): unsure at all n locations
  Clone ID: PAT_TA_84721
gtggcttctcttacaagattgtagcagccttttaactctcgaagagggggccccttcaattgtgagttttgagaagagccaattgctgctaccttcatatcattttgaggactggaaaaggtggaccagtgtcactcttagcatctaccacctagaactttagcccaatggtggtttatatgttgaaattcatcaagtataaaggcgagaagggtagtttcgttgcccacagttaacttgtagggagagaaatattgagatctgtggaaatattggctggagcagcagaatcactcaataattttgattttggatggtagaataagttggcgtaaattggcaaaaaagaactaaaacagttcnttcacatcaaattaagtgttctgaagatccttccaaagttaaaatcaacttaacaantagccttgggcaagaaattacaattctttgatcccgangatgtcaattgcaaatagtatcaatggtgntgggaagaaaaagatctanttgaaataagtgaatgatnatgttggaacaagtcattatcataagagaacaaagganacaatttaggaggaccttaacaggtggggtcacat

SEQ ID NO: 84722 - DNA, 612 bp, Triticum aestivum
  unsure (1)..(612): unsure at all n locations
  Clone ID: PAT_TA_84722
cgaccctcccttgttgcattattgaaacaacatcggcgccttccctgtcctccgtgcatctagatctggtaccacaggtaatcgctaatggccagatctcgtctccatgtcattcccacatttagatctggtatcatcggcaacagaggataccttcatcctctcgatggttagatttgggtcttcatggcatccccatgtttagatctggtctcatcgacgacatgggatgcctgcatcctctcgatggctagtctacgtgctcgctcntctcccgattcgccaccgtggtcangttaaagcaactttctacnatgntcatgttaactaatttantccccatcctccttggtccaaggtcaatttgattctcgtatccaagggcagtccgtctcatcctccttcgttcctggcggattaantggaacacaccgncaatgaatggatttnaataattgcttgtccaattggnaagtttgcttaaacttgggcatcnatcntctnccaagtggancaggacactaanagttggcaattaaangttccggatnacantnccgnaaatgtataattaagtttctgcaanccatatgcccngggggccggcacatt

SEQ ID NO: 84723 - DNA, 299 bp, Triticum aestivum
  Clone ID: PAT_TA_84723
ggaggtggtggctatggtggtggcagccaaagctatgatgcttgaggggggcaggatcctattaagtgcattatcaaccaagatatttgaaataatgaactttaggacttggtatgacgttttatgttaagcattgtcaggttttgctattcgtgttatgctgaattgttggaactcctagatgcagaatattacgtattggttttggttccttcgagaagtgcaaatgcaagacgcatctattcccattgagtgaatacaggactaccacatgaagtatttgcttgaaaaaaaaaaaa

SEQ ID NO: 84724 - DNA, 265 bp, Triticum aestivum
  unsure (1)..(265): unsure at all n locations
  Clone ID: PAT_TA_84724
gcgtanacctggcccgacaccgctagcgcggactacggnggtcgcgactgctggtcctcctcgtcaccggaggagatgaagatatccgcccgcgtcgagtcgccgccagccgacgagcatgacaaccccagagtctgagggcgacgtctcacgagccgccagatcccgccccggaaccccctgccggcgccnactcccangacttgcccatcgtcnaaaatgtncgngcccaacggncntatgcaacaaagggngccgactggcc

SEQ ID NO: 84725 - DNA, 233 bp, Triticum aestivum
  Clone ID: PAT_TA_84725
gcggcctcggcccgatccagaggattctcctgggaagcgtgacaaactacgtgctgtcaaacgcatcgtgcccggtgacagtcgtcaaggggaagtagcggcctggacagcgtgccagtgatatgaatgaagatgctagcgtgcagtttgtgtgggttatagctaaacactatgttccgtcttgttgctgcatttcaataaagcatgtgtcttctagatttaaaaaaaaaaaa

SEQ ID NO: 84726 - DNA, 224 bp, Triticum aestivum
  Clone ID: PAT_TA_84726
ctcattctactactgcctcagagaccaagctgctgcaaccggagaaggagatctattctacaaagtgaagtacttagcttgggacatggaaaccgtcgtgggagacctcatggcgaccgagctgaggcttggcctgccgggcaccgttggacgactgcagccagcaccagcagcagacccagctgaaggtggccgcgccgccgtccaacctactaggggcaaga

SEQ ID NO: 84727 - DNA, 240 bp, Triticum aestivum
  unsure (1)..(240): unsure at all n locations
  Clone ID: PAT_TA_84727
tttataagcactctctgggcatttttagttacctgaacatataaaacacatacgcaggtgcctgctttcagttgcctacaacattgacacgggcatggtggttagtattgactcaaaaacacagaaacaatatggctttgattttcaagttctcttttgacaaaaaagcaacgcaatgtggacgatttgcctataatagggtgtgggaaaaagcacccancttggaacagcttgcctatc

SEQ ID NO: 84728 - DNA, 499 bp, Triticum aestivum
  unsure (1)..(499): unsure at all n locations
  Clone ID: PAT_TA_84728
gaacttgagagagcgcacgcgagatggcagcctccatgatcacctcgccgattgtggcgccgacgagcgtgccgtccctctcccgccggggctcctccttcgccgtcgtctgcagcggtggcaagaagatcaaggtcgataagcccctcggactcggaggcggcttgacagtcgacatcgacgccaacggcaggaaggtcggcaagaagggcgtgtaccatttgttgacaagtacggtgccaacgtcgacggctacagccatctacacccaagagaatgtctgatctggtgaccgctacgcccggcggaacaacggnttcttatctggcgtnaacctcgccnggctcctcnggggggntctcctcgtctaaaanacaaggtctcgcccggtaagaaacactaactntaaanaggccggncnctgcttgaagacttnccgtacngcgtactacnccngtnattntgcatcaagatcaaattatgtcgnaaaaaaaaaaaa

SEQ ID NO: 84729 - DNA, 429 bp, Triticum aestivum
  unsure (1)..(429): unsure at all n locations
  Clone ID: PAT_TA_84729
catgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaangtggtcaaggtcgctgactgcggacagctctcctagatctctcctgatctgggcnggttcggccgcctccctccgtcatcgtcgatcccctgcgtccgttccttggtnctgaataaatggtngtgatttgattggtggctaagtta

SEQ ID NO: 84730 - DNA, 600 bp, Triticum aestivum
  unsure (1)..(600): unsure at all n locations
  Clone ID: PAT_TA_84730
cccccatcgcatcgagagccaggccagccagccacctctgctaggtctccatggccgccgcgctcaggtccccggcctcggccaaggtctcgagccccgccgccgcctccaaggtgcgccaggcgtccagagtcgcggtgggcgggttccggcagcatccgcggagccgtgtcggccccgtggccgtgcgggcgtcgctgttctcgcccaagcccgcggcggccaaggacgcgcggccgaccaaggtgcangagctgtacgtgtacgagatgaacgagcgggaccgcgagagcccgcgtacctgcgcctcaacgccaagcagacggagaaccgctgggcgactggnccccttcacaaacaaggttacaacggcacctgggacaagcgctgggcatcaccgccggattgcttctcanccaacacttccccgacgcaacggcgacggtacaagcatctacacttcncttcgngatacgcanattccgnggaagggcgtactgactacaggatctactggcgtacggcggtcgntctcaaggcctacgcagtaagtcacaatgtctccntaaatntcaactnactcgggatccggctcaagac

SEQ ID NO: 84731 - DNA, 268 bp, Triticum aestivum
  unsure (1)..(268): unsure at all n locations
  Clone ID: PAT_TA_84731
tggctctgggagaagctatgggcaatgtcaacacaggcctggccgatgaaaaagtttccgagtgcgtgaaagaagtggtctgctgcagttctgaccacacgcagatggaccaagacgacggaagctgcgccatttgcctggaggactacagagacaaggaggcgctgggaatactcaagtgcaggcacgacttccacgccggctgcatcaagaagtggctgcagacaaanatcntgcccgtgtgcaaagcngccgcggctaataggaa

SEQ ID NO: 84732 - DNA, 613 bp, Triticum aestivum
  unsure (1)..(613): unsure at all n locations
  Clone ID: PAT_TA_84732
cgctggaagaagctcttgcacaagctccaaatgcagctcttgtgatggggcataatggaatatttcgcaatgacacaacagatgtatatgaaggggctattccgaattggggaaagaagagacctatcaaatcaatagttgttggcaggccaatactgcttgcactggaagatatagatggcagtccttcttttctgggaaaaagctttgtgtttccttgagaaacatggaatgaaggtggaaggaattttgcgtcaagctgcagatgttgaggaaggttgacaggagattgcaagaatatgagcaaggaagggacagatttgcaccagaagaggatnccaagttgtttgtacgtgtaaacantccccgtgagcttcaactccccngttcancttcntctgtcacattttggacttccgtcgggaacaagganccaaattaaatcagctngaacatatctgaacattcctganctaatagcgntgcacagaactttgaaaatgatcanacatgctccaaacgcnagaatanangancacagaattctcatgtaggnccctctgtgctccctctgctgaatcaaatgagtgctaactgaggnaatctcnactan

SEQ ID NO: 84733 - DNA, 638 bp, Triticum aestivum
  unsure (1)..(638): unsure at all n locations
  Clone ID: PAT_TA_84733
tcgagttttttttttttttttttttgacgaagccattcttctttctatattttaagcagagtatatgactactacagaactttgaccagtaccaaacaatcggctgcaaatgcatggctacaacggaatctcaacacctcgctgcaaatgccatcaccctcttctctctttttcgctgtaccataacaattgactagtacacaatttaaccaataaacctcgcagacaaagaagcggaaaaaaagagaaactaagaacatccgtattattccgttcgctgtgaactggaatactccatctccagaagacaaaagtgcagagtatnaacgctgggagggagcaaagcatggtcctataagaggactgatggncacaagaagttctcancttccgcggtgccatggcaacnaggcgaggctcctgtgtcacaacattgtcaaccgcnacttcctcaagaacctctcgcaagctcctctcctgaaacctgggagatctgataccggaaggngactcaaaggctggactgcacnaacagcttcaacagtggcaaggtcgtactggccaaggaactggaataacngggaagaaatctaanggatacctaatcatcatggtccttganaccagaagcactanta

SEQ ID NO: 84734 - DNA, 243 bp, Triticum aestivum
  unsure (1)..(243): unsure at all n locations
  Clone ID: PAT_TA_84734
tgtgcgtgcgctccgtgaacgctggagtatatatatatagttcggttcctttagctactctgctcagaantcagaaacgggagtgtcgatctgccaaggtgctttcggttgaacacagctcgtttgtgacctctccgcaatgtaccatgtacctanttgtctaagatctatgtcaactttctgtgcactggttgaatggttccttgcctctgcaaaaanaanacaaaaaccccangggggggg

SEQ ID NO: 84735 - DNA, 615 bp, Triticum aestivum
  unsure (1)..(615): unsure at all n locations
  Clone ID: PAT_TA_84735
tgcggcaacggcatgaagctcgccgtcacggtcgccgctgggaccgccaccaccaccccggcgtcatccccgcccgccgctgactcgcctccagagacagccacgccgtccgggtctacgcccacggcaacgacgtcgccgtcggcgcccacgacgaaagcccacctcgagcagcactggcgctgcctgcggtgggaaaggcccggctcgctatggggcgttttgggcctgggccgccgggcctcgccgggctcgccctgatgggttaagcaagagnaatgctgttccgttccatgctttcctggtgcaaggttttgnggccgttntgttaatctgaatcactctatgnctaagctccatcctggttgttcgaatcccgcttataatgtacgtatcntgaaccttcaagctngactgtccaancgtctgcaatattcatanattacgataaanaaaaaaaaancnaggggggggccngtaccaattcgcctaaatgatctataccgcgtnatggcgtntttaaantctactggaaaactgngtacaactaatccctnanaaancctttncagtggtatnacaaagcccacattcctcaaatttnanctaaggang

SEQ ID NO: 84736 - DNA, 590 bp, Triticum aestivum
  unsure (1)..(590): unsure at all n locations
  Clone ID: PAT_TA_84736
gcctaacgctagtgctggtagagctcttcgttggctttctcatcgccttttttcttgtggggaaaaaattntgggaaggagggaaggcatttgtgttccagaaaaagcctgtggtcaagataattgccggcttgcagctgcatatataaccatatcttttcttacaactgaaggctacgactgaatcaatcgggtgcattaaacaattccaaataaacaaaacgttcgcgtgaacggcgcgcgtgttattctattcccaatgcaaaatgaaaatgtggctggtacaantnatgctggnacaacattatctaagcccacttggggtaatctgcccgtnatacataaccctgtcagttcatctacttttgttnaaaatgtattcccaagcaaatnangnattttnactatccttataccgncaataanaattcggtttactgcacgacgaccnaacnacattaccacgtagganaaataccccaacaactcttcaaaaagctttgagaattaagctcaccaattgagnaaaaagngaaataaactgaatcgctaaacactagcacttttcaccataatactgcaatttttaa

SEQ ID NO: 84737 - DNA, 624 bp, Triticum aestivum
  unsure (1)..(624): unsure at all n locations
  Clone ID: PAT_TA_84737
gccgcgtgggcgtcgcgctgtccaaggacctgatggcggtggccggcgaggcgctgcgcaccaacatcacgacgctgggcccgctggcgctgcccatgtcggagcagatcctgttcctggcgtcgctggtggcgcgcagggtgttcggcgcccgcggcgtgcggccctacatcccggacttcaagatggcgttccgagcactctgcatccacgccggcgggagggcggtgctggacaccatccgagaagaacttggggtcaacgcctggacatggagccgtcccgcatgacctctaccgctgggggaaaacttcaagcaactccctctggtacaactccccaacgnagggnaaaggccgccttcgccgcngcaacgcgctggaaatttccttcggtcaagttcaaatncaacacncntttggcnggcgctccacatcgacctgccaagganaacccccgtggnaccctggtgggcnantcanaaattccnttgagggccaagtggaaactctcatgtctccnanatnacaccacggggcaatacattctgtatgaggctcccgaaacaanatatgnggctncaagtntctaanacaatnttataacattaaagntttctancaa

SEQ ID NO: 84738 - DNA, 516 bp, Triticum aestivum
  unsure (1)..(516): unsure at all n locations
  Clone ID: PAT_TA_84738
gctgggcctgtcgccgcactcggacgccgccggcctcacgctgctgctccaggtcagcgccgtcccggggctgcagatcaggaggcgcggcgcgtggatcagcgtcgaccccatccccggagcgctggtggccaacgtcggcgacgtcgtcgaggtgctcaccaacggcaggtacaagagcatcgagcaccgggcgctggttagccccacccaccaccgggtgtccgtcgcaccttccacttcgccagntccggcgacacttacgcgccgctttgaggagacattgtcgatngtgatnaaccagcgaggtacagganattggcgtcnaaggactacttccgcctggtgctgtccaagtaantccaaaggaaagacataatggacccatgaaattaatcccgtcnctgaataatgantgaacaacattntttnngaaaaantcnatttgggggngnctttttgaaccncttaaattacaattanacaacggcggnttctcttggcaaaaaaaaaaaa

SEQ ID NO: 84739 - DNA, 489 bp, Triticum aestivum
  unsure (1)..(489): unsure at all n locations
  Clone ID: PAT_TA_84739
tgaacacccctcaaatgtgatccatctgttctttaaccgtacccaaatacgtcgatttcaaccgcacatcggctataggtatctggcatgttaagatcgagtaacatgtctatcagacgaggcgatatcggctcaacagggctctagtcaaccactctgaatattgggcttttgattgaactgaacgaagaaggttgcgatgttcaatactctagtccgtatgaatccaccagcatgacgcctcttctgaccagactgaacgaatgcgatgcactgggccatatgcacattaagcataaccccccggtcatctcgaaagaagcaatcaccatatcncttccnagggcagaactgtttagaggatctatcaaccaatcttaagccaacaaagcaagatccatttaaaattgccacctggatnaagttaagagatcancctcttcnnaaaacactccaatnaangtcaatgncaaacatcnnctgtaaccg

SEQ ID NO: 84740 - DNA, 318 bp, Triticum aestivum
  unsure (1)..(318): unsure at all n locations
  Clone ID: PAT_TA_84740
aaagcatcacaaagcataacgtggcaatatgttgtgccgggagtgacctaacgtatggctacacgatataggtgaagggagaattcaaccgggaatgtattcccggttccgggcctgtgtcagacagataccggagggggaaaagttccatgttcaagcatgctaggggcatgtgacagatgaacggaccgcatattccggntccgttggtttttctggagcaacttcatatagaaaacatttcatcggagttacgtttattttcccaatgattttttaaagtttaaacattcaataaannacccaaggggggggggc

SEQ ID NO: 84741 - DNA, 245 bp, Triticum aestivum
  Clone ID: PAT_TA_84741
ctgctttcactcccaagtgagaagtgttggaacaactctatgattgcaagccttggagaaacattggcaaacctttttaactaagttgtaacgcttaaatggttttaggtgggagtgtttatgttggtgaaagcttgtaaaatggctacttctattgtcatgcatagattgaagattcaatgtacaaatacctatttaaggtttaagatgcatttaatgtaaatcaaggaagtaaaaaaaaaaaa

SEQ ID NO: 84742 - DNA, 593 bp, Triticum aestivum
  unsure (1)..(593): unsure at all n locations
  Clone ID: PAT_TA_84742
cgagaatggaaggttgggaattacaaagaaagagaatggaagattgggatctcatgaccaacttctcactcaaaaatttgctctgactatatctgatgatggcggtggtgattattttgttttggaacaacctcccccatggcaccttgtttttaagcagttgcagctcgaagatatatgctgtctcaaacacacacgatgatatactttccagttgggtgaaaggaaccaagttggtcaagttgtacaaagcctacctctgatccttctcctatggtttttgaagtttnatgacaaattgttgccctgatggcacccttccgtgttttctatccatggataaatccaaatgggtgantngcaagcaccgcacagatgaaccncttgtgccgttcaggaaggttaacccgacaaatatccaagtgggagaaatttggctccttgtccctgaacaggaagtcatttcccgggatagcatatgngggaagatcctcaaaatcccggtgctncanaatcgttccttgttgatcgcaatccgaaaaaggacgtcgcacgtgccttgcctgatncacnctaanggaaatngngttggt

SEQ ID NO: 84743 - DNA, 540 bp, Triticum aestivum
  unsure (1)..(540): unsure at all n locations
  Clone ID: PAT_TA_84743
ccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaggggcggcgtgaagcgcatctccgggctcatctacgaaggagacccgcggcgtgctcaagatctttctccgagaacgtcatccgcgacgcctcacctacacggagcacgcccggcgcaagaccgtcacagcatggacgtctctacgcgctcnaagcgccaaaggccgaccctttaacgntttcngcggtaagggcgctagctaggcatctcgaccggccccatcttcgctctggggtctcaatggtcctttaccctgtncggtcgtcgtngtgctaagtcannatttcnggtncgtaactcncgggtacccttcttgggggtaaatggattcaatctgtgggaatggntncggtcaatgtcaaaaaaaaaaaa

SEQ ID NO: 84744 - DNA, 366 bp, Triticum aestivum
  Clone ID: PAT_TA_84744
agaaccctggcgtcatcaccatcgccagcgccgtcttcggctccaagccgcccatctcggacgacgtcttggccaaggcgttccaggtggagaagaaactcatcgactggctccagtctcagttctgggataccaactactagctgcctagctagctagtaatatacttgcttgcttatttgttgcatgcatgcaccaccaacacaagccttatattaattacgtacgtacatctatgtataatattgaataaatggccggtatgcatgtggaggagttgaaacttattactgtgcgtgattaataatatttaatgtaaacttttcattaatatcctaatataaaaaaaagatacgattcatttgc

SEQ ID NO: 84745 - DNA, 609 bp, Triticum aestivum
  unsure (1)..(609): unsure at all n locations
  Clone ID: PAT_TA_84745
tttttttttttttggaacacaagttttgatttattccaactcatcatccggaacatggtacccaatacaaggatcgatcagtaggagtttatgagatgaaccaaattagttaaatccgacccagcagattcatcgatgcccttgtccgcagcgatcttgagctcgttcatcctcttcctgatgccctccccttcctcgctgccgcccatgagcctgtcgatggcggccttgatctcccctctctccagctggtccccggcgacctccgtgcccaccttccagacgtggncacgtacctcgcgttgccgntacnggtccccgtggcgccgggtggnaattaaggggaagcctccgacacggctccacggtggagttccanccgcatgggtgaaaaanncgcccanggccgggtgcncannaactcccctggggggccaactgacnacannccgcggngngnaccggcctcaagcgttnggaacgcgcccgatccaaacccggtaagttggccgacaaccaacaanggnggcggntnggcancccaagcaatcaanaatctgnggtcanngcccaagcccnaactangtaaaaagggcgcccgngnctaan

SEQ ID NO: 84746 - DNA, 187 bp, Triticum aestivum
  Clone ID: PAT_TA_84746
gctgaccgtaaggagaagcatacatatatggtgagaaattgcatatggttattgatttttttaggacacagtgtatggatgtaaattaacgtgtatttgtatctagtttctctagcatagtatgtactgtgtgaatggcttctggggattcacgaattatacgacagttttgcttaaaaaaaaaaaa

SEQ ID NO: 84747 - DNA, 606 bp, Triticum aestivum
  unsure (1)..(606): unsure at all n locations
  Clone ID: PAT_TA_84747
cagcaagcactgcccactttggtacggatacggcggcgggctaaaattcctggaaaggttttcttatatcaactccatcgtttatccctggacgtccattcctctcctggcttactgtaccttgcctgccatctgcctgctcacggggaaagtttatcacaccaagagcttaccaatgtcgccagtatctgggttcatggcacttttcatctgcatctccgtgaccggcatcctgggaaatgaggtgaagttggngttggccatcgaacaactgggtgggaggaacaacaattctggggcatccgaaggcgtttccggggcancnttcccgggttccaanggcctgctaaagggttcccccggantccaancaanttaacgtaccntccaaaggcgggaacaacaaggattccccggctgtaaanttcaatttggcaacctgctaaacccccaacaactctccngctgattnaacnggtggtggcggattcaaagcgtnanacgggtacaatctggggcccngtcggaaacctctccntcgggtatgcacttaccntccaaggtcgttggaganacagacccacatcncacgcgncaccgcncctc

SEQ ID NO: 84748 - DNA, 586 bp, Triticum aestivum
  unsure (1)..(586): unsure at all n locations
  Clone ID: PAT_TA_84748
ccgtctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaagggaggcatgcaattttccgtgaagaccctgaccggcaagactatcacctcgaggtggatcttcaagacaccatcgacaacgtccaaggcaagttcaangacaaggaaggattcccccaagaccaacancggtcacttnctggnaagcacttgaggacggcgaagcttgccgactacacatccaanaaggganacctccacttgggctccccaagggaagatcantntcntgaaaccttacggnaagattaacccnagtggattaaaacatcacatncaaggcaanntaagacaggnggatcacggcaaaacttgtnttntgaanactgagtgccaccttcgtnaaatn

SEQ ID NO: 84749 - DNA, 374 bp, Triticum aestivum
  unsure (1)..(374): unsure at all n locations
  Clone ID: PAT_TA_84749
cccgaactacctcttcgagatcgtcgggctcttcggggtcgccatgatcgcgcagacggtgtacgcgctcgcctacgccacaggagcggcggcctacctcgccggccggagctgcgccaccaggaggtggtaccaagtccaagttcgacgagttcccagcgaggatcaaggcgttggtgccgtatgtgctgtagccaactcccagctctggctctatgtttgaataaatatattagaaacaattaagagctctttggcagggattttgtacttttctctatnaaaaaagtacaactatatcaaacacttttttaaatgcactaagcatccttaaccgagtgtcacaaacactccggagtttnaaaaaaaaaaaa

SEQ ID NO: 84750 - DNA, 344 bp, Triticum aestivum
  Clone ID: PAT_TA_84750
ttcgtgaaggtgatgatggccaagtgagatgatgtgcctgttttgaagctagttcctctcttgatggtagtagctagtctagtgttggagactgactgcatttggtccgccttgttcctctcgctgcatcaatggacatatccgtttgttttctcccaagggattttaccatgtcggtaatttcgttcaaatttgtttatggttgtattaacatttgtgttatcttggtacaatgatcatgcctttcccttctaaattaggtgttgaattcttgtagaaatacgtggcatgcatgtgcagatatatcccgattttgtttgggtttccccgttaaaaaaaaaaaa

SEQ ID NO: 84751 - DNA, 482 bp, Triticum aestivum
  unsure (1)..(482): unsure at all n locations
  Clone ID: PAT_TA_84751
gcttccccttcctcttcctcgatccccttcctcccccgatcccatccaattccacttccacaccccgggcctcgccgccgacgccgacgccgacgccgccggccatgtccaagtacggcaccattcccacctcctcctccgcgggcggagggcccgtgcccctcggcggcgcctccccgctcgatttcatctcccgcgccaaggctcggggcgcctcggcgctggcgacgcgccggccctgggcgcgagtcgtggacgtccacgccgtcggctgcccccgagcctcggngacgcgtactccgcgtgcgcgccaactcgcccatttcgccatgaatacgcatcgtcgtcctatcgtcgtcttctctccttcttctggaacccgtctccctcatcgtcttcctcgtctgcatgctcgcctggtcgtcctctacttctccgcgaagagccctcgtctcttcggcgcgtctcgccgacggtactcn

SEQ ID NO: 84752 - DNA, 235 bp, Triticum aestivum
  unsure (1)..(235): unsure at all n locations
  Clone ID: PAT_TA_84752
gtccctctcgccttcttccccaccccaccctaccctggcacccacgcgctcttcagatcagatcggcaaggccaatcccgagcagtggtgcgaaacctcgagcgctcgcgccggtgaccataacaaagaggaagccgcggtagcactggtagcggcagcagtaaggggaagatgtcgtcggcgttaagcggcgataanaccgcccctttcttcggtttccttgggncctccggct

SEQ ID NO: 84753 - DNA, 463 bp, Triticum aestivum
  unsure (1)..(463): unsure at all n locations
  Clone ID: PAT_TA_84753
gttacagccgccgtcctacgccaggtcccaggtcttcgtcgggcccttctccggcaacgagcaccaacaagatttttgtgtgtaaagatttgcgagcaccattcactttttcatcaagtgtgaaattaaaacacttcaaggcttcaagcatgagctctcaccgtgtgaagtggaatgaggacaatttgtatgaaattgagtcaaacaaaccggtgaggcagaagataacagagccaaagacaccatatcacccaatgatagatgatgatggatcattgtcgccaacactcctttccgacaaatgtcctggatgagactgtccaagctgaagctatcttaacagccttaaatggngtggttcttcaagcattacattcaaaaggtatggttgggatngtcaanttgatnatcagntcaatnaanaaaagttnccctnaanctnaacanaggtttanttcaaagg

SEQ ID NO: 84754 - DNA, 488 bp, Triticum aestivum
  unsure (1)..(488): unsure at all n locations
  Clone ID: PAT_TA_84754
actacgacgacggggaggtaggggacgaatcgttgcaagcaacgaggtcagaactaaggaggccgatccatcctccagcctccgatcccatccgacgacatggtctgcgtcgcgtgcctgctgccgctcttcctgatcccggtggtcaacgccctcccttacctcatcgacctcatcatcagcaaggtgtatcggctatttggatgggagtaccggagacctgaaagatcccacctgcatgtccatacaagcctgcagtcagaagaacgatgagggtgcgagtgaatcaaaaccctggccgaaccgcacggtgctgggtgctgcggcggcagaagataagaaagtggatgatgcagcaagcgcttaaaatggtggcaacgtctgtgtggttagcttaagaaacaatatgttgtngatggtaatgttcttggtgaanggttgacttttttanaccccggttcttacaatngcattacaacacngcggng

SEQ ID NO: 84755 - DNA, 351 bp, Triticum aestivum
  unsure (1)..(351): unsure at all n locations
  Clone ID: PAT_TA_84755
ctagatcaaatttgtactactcttttgaagttgctggtgcacacatcataatgctangttcanacacagattatgatgatagctcagatcagtatgcttggctaaaggctgatcttgccaaggttgatanaaagaggacaccctggctcattgtgttgttgcacgtaccatggtacantagcaattgggctcatcagggtgaangcgacagtatgatggcttcaatggagcctttgctgtacnctgctcatgtggatatggtaatancaggtcatgtccatgcttatgaacntgcggagcgagtctacaactccaagacctgatccttggggcgctgtccatataactatc

SEQ ID NO: 84756 - DNA, 482 bp, Triticum aestivum
  unsure (1)..(482): unsure at all n locations
  Clone ID: PAT_TA_84756
ccagtctcttatgattcttgagcttggcctgagagaggtgcttgcctgctgctggccttcatggacgagtcattggaaaaaaaactttgcctgccaattgcaaattcaagttcgacataatctttgtgtgtctgtgttcccagacaaaaacttcaaattgtgcatgcctttggaacggtagaagcagcttagtttaagagcataacctgcatgctagagcaggttagaacctgtatattactgggctactacttattttgagtcttgtgaaactcacatcctatccttatgcaagtgaagctgccgtggatgatgaatngaacccggtaattatgctagtgtatgtttanactgcaagaagcagaatacttagggattactggctactactcaagtattggtttcanttcggtgagaccacatcctgtctctacactggatgatgaattgaagcngnatttgtaacaatgctatacnaantg

SEQ ID NO: 84757 - DNA, 354 bp, Triticum aestivum
  unsure (1)..(354): unsure at all n locations
  Clone ID: PAT_TA_84757
gaagactactagctagtgtcagtcatgatgacatcccactcatcagtattagtagcaggactagtgtgtctcagtgcggcggtggtcgtgccaatgccatggctagccgccggggagagtagtattggtggtgcggagtgcaaaagatcatgcggcggcgtggagatcctcagcatctctccggagcaaggtgaagccaaggtgctcctccctatctcttcttactgctacgacctgcgtctcggacgatngtggcgacgagtggactggccttgggcgccaattaccgttctccagcaagggcaacaattnaccgngtanggtgccccggcgcctgggtaaaatcgttcaccc

SEQ ID NO: 84758 - DNA, 459 bp, Triticum aestivum
  unsure (1)..(459): unsure at all n locations
  Clone ID: PAT_TA_84758
ccgccgtctctcgaggcggcgcccgcggaggaccaggcgggagggggagacggtgaggcgcggccatggggggcgccaaggcggaggacaaacccgccgccgccgctgcagaagattggtgctaccaatttggaaacaaggatgcatttgacttgaagcccccnaaaaaatcaccgatcgcgttgagaacggttgtcttcgctatgactatgttatgcgggatatctatttgctcaatgtgcatgaagcaactanggagtgatggctggtcaagagttgtcaagattgaanttgtngaacaacaatttataantcaattgctctccttcggagntcaatttgtncgctatctcaancgataattaaacaaggaaggaatnaanttcaattctttccggtnctttnaattatatnaccnaatcatnttgaattgttgntttaaaaantcttaaaaacann

SEQ ID NO: 84759 - DNA, 460 bp, Triticum aestivum
  unsure (1)..(460): unsure at all n locations
  Clone ID: PAT_TA_84759
ctagagttggagagcaacctcaaaggcaggggcataagtgatcatgggaaagggacaatgcaaggctgctggtggctcaaagacgtacgttctgaagctggacatgcactgccaatgcaatggctgtgtcaagaagatgaaggacgcggtgaaggagatgatgagcctctcgcaaggggtggagagagctgatgtttcagcagaggcagaggcgggagaggtgagggtggaagtgacgggcggaattgacatggacccagcgaagctctgctgcctgctgcaagaggcgacgaanaanaagcgtgtgangatagcccaagaagcgagcgtccatcgcctgggcngcaaaccactctntctggtcanggtcaagcaaaagctctgtggctggcggcaaattgcccggcacctccctacaaccttccgattccaacgcccgcccgggccgngcaaagaagag

SEQ ID NO: 84760 - DNA, 467 bp, Triticum aestivum
  unsure (1)..(467): unsure at all n locations
  Clone ID: PAT_TA_84760
ccgccgccgccgcctgctcccgttggacacgagtttggagtaaagaaaccaaccctgcatctgtattctgtctgtctgtgctgcttcgaataagccttgcatctcgctgacttgggatataactatgccgaaggacaggagctcccgcgtttcctcttatgagagccgccgggctggtgcctccccatacttctcatcgtctcatggacagagcagttcttgtcgccggtccgaggagtcttgtggggcagcagcggcggcagcagcaaagcaagctgcagagtgggaggatgttcggtgcccggtgtgcatggaccacccgcacaacgccgtcctgctggtctgctcctcacacgagaagggctgccgccccttcatgtgcgacacagctcgcggcactcgaactgctatgacagtaccggaaggctccaaggatcaangacagatgcaacantgcaacaacaagt

SEQ ID NO: 84761 - DNA, 471 bp, Triticum aestivum
  unsure (1)..(471): unsure at all n locations
  Clone ID: PAT_TA_84761
cggatgtccctcttattgctgtttactcagacgatgtataagcacggattaaacaggcgtccagctcgcgattcggtcaccgaacaaacaaacaaacaacaaacccctccgcagcactcatgcatcagtccaaaacgatacttccaccccggcaacagtcaagctcactttccgcgagcaggagcgataacttttgataaacatgcagtgcagcagcagcagcaggcggtgaggtcatcggagacggcaggccggcgtcccctcactccttcagcttatggatggtctccatgtccacggcctcgccgagggtgccttcctcgacatggtcccaccaacccatgaggaattgtccaccaccagcctgaaccaggggagatctcaacccatcctcgcaacgtcagccttcngatagtcctngnctcctcncggtcaacgtactnaaatcaacgactnanccgggttcggtgg

SEQ ID NO: 84762 - DNA, 456 bp, Triticum aestivum
  unsure (1)..(456): unsure at all n locations
  Clone ID: PAT_TA_84762
ggactccagcagcgacggatccagcaacggcggcggcggcggcagtcgccaccaaccgaatcgccggaggaggaacagcttcaaccacgggaggcggagggggggccggaggccggccccggcggggtgatagggaggacagcgtgcgccggaccgtctacgtgtccgacattgatcagcatgtgaccgancanaanctcnctgaanngtnctaaangcggtgaggtcatcnganacggnaggccggngtcccctcactccttcagcttatggatggtctccatgtccacggnctcnccgagggtgccttcctcgacatggtcccaacagcccatgangaatttccaccaccagctgaacaggggaaatntnaaccatcctcgcaacgtcagccttcngatnactcctnanctcctcgcggtaagtactnaatcancgantnatcnggttcggtng

SEQ ID NO: 84763 - DNA, 480 bp, Triticum aestivum
  unsure (1)..(480): unsure at all n locations
  Clone ID: PAT_TA_84763
cccagctctgccccagcccgcccacaggagttcccgcatctccctctggtctggtcacaggagttccgagacctctccaatggcggttaagatctacgttgtgtactattccatgtatgggcatgttggcaaactagctnaagagatcaagaaaggtgccttatctgttgaaggtgttgaggctaaaatatggcaggtccctgaaattctctctnaagaagtgcttggaaagatgggcgcgccccctaagcccgacgtgccagtcatcacaccgcaagaacttgcaaangctgacngtatcctccttggggttcccgacaaggtcggaatgattgnaactcaaattaaagggttcttnattcaaccgttggctccggaaggaacaaagcctccctggaancctgccggatgttntnaaaaactggaaaccaaggtggtggcaaaaaantaaacgcttaanggaataaccattttancaca

SEQ ID NO: 84764 - DNA, 484 bp, Triticum aestivum
  unsure (1)..(484): unsure at all n locations
  Clone ID: PAT_TA_84764
cggctccagcatttccaccctcgcgcggcggtcgccggagcgagcagagctgccggaaggcccgtcggatccgccgccgccaagatgaatgacgccgatgtagccaagcagatccagcagatggtgcggttcatccgccaggaggccgacgagaaggccaacgagatctccgtctccgccgaggaggaattcaacattgagaagctgcagcttgttgaagctgagaaaaagaagattagacaagagtatgaacgcaaagagaagcaagttgaagtacggaagaaaattgagtacctatgcaatttaatgctctcgcaacaaaattctcaaagctcaaaggatgatccaattaaacaaaatgaaaagacnatcgattaaggaatccccctngtaagcaaaaacaacaanaatcaagaacttttgaaaantccaatnttnaaggcttgcccgttggaaaaacaacntattgccccttccccaaagg

SEQ ID NO: 84765 - DNA, 463 bp, Triticum aestivum
  unsure (1)..(463): unsure at all n locations
  Clone ID: PAT_TA_84765
attggacccaccgatcaggttgactctggtcaacggaccgttgaccgctgacgtcacctctacgtcatgctgacgtcacgaggcactgttctggataatcctgaattaaaataattaaataaatcctaaaaatgaattaaatcttttaaaatcaatataaaataaaccgtagctcggatggaaaaactttgtacatgaaagttgctcagaacgacgagacgaatccggatacgcggtccgttcgtccgccacacacccctnacctatcgaacccgcaactttccccctccggtctctgcccgaaaacacaaacaccggggaatactttcccgggggnttcccccctttaacnggttcaactacaacgcgttaggganacgaanacgcgtattgccttgtaaatttggtaagcttgttgcccggatcataattctccccctcccccggnnacacanacgagctt

SEQ ID NO: 84766 - DNA, 266 bp, Triticum aestivum
  Clone ID: PAT_TA_84766
ctgtgatgtcaaaagggctctggttgcaacagtaaggcatgattctctgttagcactaggaactgcaaccagaattgtctgtaataccggtagtatcaaatttacctagacacttcgaacgagcaaggcgtctgtaataccggtacttacctgtggtgcctggagcttccaaatctggatagcgtgggtttttcattgagaatgttaagttggctcgggttcctatgaagtcaaacacaggaaagtttgcatctaaaaaaaaaaaa

SEQ ID NO: 84767 - DNA, 303 bp, Triticum aestivum
  unsure (1)..(303): unsure at all n locations
  Clone ID: PAT_TA_84767
ctccgctccagctccaccgccaccaccaccaccgacccacccatcccatccagccatgaagcggctcctgcggcggctgtcccgcacggttgggcngggnnggcgttcaancgaaggacggcggtgccggcggcgcggcccagcagcaaggacgacgggagcaggaggcgcaagaggaagaaagcggggtccgtgccggagggccacgtgcccgtgtgcgtgggcgaagaagggcggcccggttngagcgcttcncgtttncncgccgancttnttggncnaaccgcctttcnncgggcttct

SEQ ID NO: 84768 - DNA, 439 bp, Triticum aestivum
  unsure (1)..(439): unsure at all n locations
  Clone ID: PAT_TA_84768
gggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacngtggcgggcgccgtgatggaggcggtacggcgggtggcggtggaggctacggcggtngcgtggagtaacgggncggcggtgggggatacggttggtgcaaacccgcggnggcggctaacngcaacaacgacgggaactgggaggaactgagcggtggggtccgcttnagcctattancttgttcgcttcctctaccgtgttcacccctatcctagagggtttatcttcctctgtngtcctctcgttncctatnttcctttcntgttccttggtt

SEQ ID NO: 84769 - DNA, 459 bp, Triticum aestivum
  unsure (1)..(459): unsure at all n locations
  Clone ID: PAT_TA_84769
aacatctgaaaaaatgagtgaacttgctgaagatagcagacttcaatgtatggagtttgcatctcccgttctggcaaattttgcgagcaaggaatgtggagaaacaccagaaccacaagttcttaatgagattgttgaagatagcaggcttcaatgtattgaattcaactccccggctcacacaatctcccagataaaacaggcgccgaaaacttgcatccccaantttgatgtgggttgcaaaagatagtaagcctccgtctttgggattcacatcccctgctcatacagttgcacattccaaccgttatgcagacggaatccctaccccaaattcacngctanganaggantttcctgctgtcaatttttanagctgactcaaccaaggtccaaggcctgaacttctcaacagcanccttggcaaaggtcttcccttaaaaccttttgnatnggttt

SEQ ID NO: 84770 - DNA, 170 bp, Triticum aestivum
  unsure (1)..(170): unsure at all n locations
  Clone ID: PAT_TA_84770
ggagaagagggtcaggagagagagagagaganagagaganatagagagagancccttgatcgttngttcancancacanctccgatcnatccgcaaggaaagcaacatctacaatccgcctctcngcccaggacatgntcctaattggaacangtgcananganccacga

SEQ ID NO: 84771 - DNA, 480 bp, Triticum aestivum
  unsure (1)..(480): unsure at all n locations
  Clone ID: PAT_TA_84771
gtcagacaactcttcgtctttctttcttcttcttctcttctccactgcacatcctcctttcttcttctcctcgtcgatcggcaagctaaggaggcaccattgcttgtcgtctgatccccgccgggcgcgtgtcgctgcacaagatgacgacggcaacagccgttggcagcgtcgccgaccgcatcatgccgcacctcctcaacatatatggattcgtctgcgacggcacgggacttccgagattttacgccgccaaatgcgacgttttggaggaccccgctcatgccaagtcaacggggtttnagcagattcaaatcagcgtttctacacgctgccaaagtgttttnggggaatcccaagattaaccggaatacacccgttnnaagagatccccaatggggccnggcaagacgaggtgggtattccaanacaagcanactacaangngctgggcaaccggtggttttgacttcnctaaca

SEQ ID NO: 84772 - DNA, 454 bp, Triticum aestivum
  unsure (1)..(454): unsure at all n locations
  Clone ID: PAT_TA_84772
cccacttccccatcaacgcctccatcaccaacagcaacaccgccatcgagatcagaaacttcctcggcgagaagaaggtcaggaaggtggacatgcttgatggcgtgaccatcctccggtccgagaaggtcaaggatgagctcatccttggacggaaacgacgtccgagctccgtatctccgctccgccgccctcatcaaccaagaaatgccatgtngaagaagaagatatccgaaanttttgggacggtatctatgtnaagcgacaagggcgtcatcgaaagangacaagtnaacgacagagtaacccgaatgccaagagatgatatggtgtccgtttgattcattttggtaaactgatgtaacctttttcccaattcccttaataattnacgcaatgttccggggtttcaaaacaattttancctnattaacgatttgcctattccaatgga

SEQ ID NO: 84773 - DNA, 462 bp, Triticum aestivum
  unsure (1)..(462): unsure at all n locations
  Clone ID: PAT_TA_84773
cgtagcgccacccgccggttcaacacgagctcctcccgaggccagccaccgaccaccgcaccaccaggccacttccccgtgcccagatgctccatcgccgccttgcgctatcctctccgtcctcccgacgtttagcagcgccagcaactccgagcgtggcgcccatccttttgtccccgagcaagccgcaactcaccatagccagcagaggattaaacgccgcccttcccttccttatactctcccttccttgntctctcaattgttttctcctgctttgtcaacaagagttccgccatgggcgcccaagcttttctttgctccatttgnttaagcccgcccgcccnggnanaacttccatagcccaaggccccngggactnaaacgttcatgggtncgccgngcccgccggttcaattcccccaacgggnaaattctcctcctaanaaanagngggagtta

SEQ ID NO: 84774 - DNA, 451 bp, Triticum aestivum
  unsure (1)..(451): unsure at all n locations
  Clone ID: PAT_TA_84774
ggaggtgtatgggagctatgacgccccgtcgcagaagaagaagggcttcgtgctgccgaggcctaagatgtccaacgctgacctgggcaggatcatcaactctgacgaggtgcagtctgtggtgaagccactcaacaaggaagtganccaanggnagaaagaggaaagaacccactcaagaacatggctgctgtgctcaaactcaacccctacctccggcactgcccggaagatggcacccttgctgaggctgctccgtgtgaaggccaagaaggcgaagctcgactccaagaggaccaagcttacccccgggagactgccaaggttaaggctgctgggcaagcatggtacaagaccatgggctccggacagcgactacaccgattttgagantctcaaaatggtccgcgtgactcaatttagcggcaaggtattnatttttnaattactc

SEQ ID NO: 84775 - DNA, 460 bp, Triticum aestivum
  unsure (1)..(460): unsure at all n locations
  Clone ID: PAT_TA_84775
acagaacacagcgcccgcccggacgcaaggggcacgagggagaagcgaggaacggcggcggcggcatcatggcggcgcggaacatccttcgcggtgcggcatgcggccaccgcttcctcgtgcccgtcccctcaggcgctcttgctggttctggaagccggagcatcggcgccgtcgctcagggccttccgtcattacgcagcaagacgaagcaattgggaaacttgggaactgcatgcaccccaaggcaaaacgtccgtcatatatccccaaacgaaaaatgggacaancatgatcttccgctccatattcattacgaaatntactactcaggtctgttgctccaaacagaancatgccaattcaagcaattccaaggttgtttgaggccaaatttacaccaaaaccggtctgattcaaaattccaattggaaaatggcatgnggttttttagtggncn

SEQ ID NO: 84776 - DNA, 448 bp, Triticum aestivum
  unsure (1)..(448): unsure at all n locations
  Clone ID: PAT_TA_84776
nctacaacggcctgcanagcangttcttcaacaccttcgncgcgcccttcaccaagcggnggctgctgctcanggtgctgctgctcggcggcggntcgctgctcgcatanntcagcnccaccgactcccccganctgctccccatcannaaggggccccancngcngcccaccccggnaccactcggcaagatctaaatcncatccttcttcttccnctccgtcncgcctccntncttgatntaccatggnatcacanctgattctganngnttccccnatctaagngttccngttnatacttggattccttgtaatttcggnancaataatttggaaaatgcctgcgtgnatgggtgcangcanttactaattatttgctcttccnatgattgctacantacgngttttggnacccaattcaacnaactacactccgaggggggggc

SEQ ID NO: 84777 - DNA, 434 bp, Triticum aestivum
  unsure (1)..(434): unsure at all n locations
  Clone ID: PAT_TA_84777
aaaaatttccatcggcttgggagccagccgaagctcaagaatggagaaatgtcagccatatgtccagtcgtcagtcacttcccgtgacaagcaaaagttgtttgtccgattctttggtgtgctctacagagtgttcaacaagacgaatttcatgctgctgttggacgacgattgggagccactgatggataattaccggcctttggggaataaaactctgaggtcagcacattttctcttgggaaatatgtcaccaaagatagaagagcaaaaattcaantacaccattcataccattgggaggaagcttaactgcattcatggntttttggccaacttggtgtcatgtgggatacgatgactggggacttcaantcctgggnaaactttccgttactgtggcaaagcaancaantcgacgctccccatcacat

SEQ ID NO: 84778 - DNA, 439 bp, Triticum aestivum
  unsure (1)..(439): unsure at all n locations
  Clone ID: PAT_TA_84778
aaaccctagcttccgtcacccacacagccggcgaggtggcttccatctcgctcgtgggccgatctcactgagcccccgccgttcttctctccacttcctgcgttctccagccgccgtcttcgctgataggctacgccgcccgctggcctgcgcgcgccgcagccttaccctgtgtgcaccctgttcctaaccctgcgtgtggccgccgccgactggttncgttgcgcccgcgcttccggcctaacctgctancttgcgcgcccaaagccaaaatgcccttgancccaacggccggtntctgttgcanccaagttaaacaatcccggtacttnggaagcaatccaantccctgcaactcngttacnggcnatttcctcaagaaanagtgcaanaataacnatancanttcanaatgccaaattcaagnactggtggaaaa

SEQ ID NO: 84779 - DNA, 454 bp, Triticum aestivum
  unsure (1)..(454): unsure at all n locations
  Clone ID: PAT_TA_84779
ccgaggtcgaggagctggagccgggagcacgaaccaatatccggtggtaccggcccagacagccgattgccgctgaggatgagcttcgtcagcgaggtgagcatgccgatgtccgacgggagagtgcctccgatgacgttgtaggagaggtcgaggtactggagagagagcaatcctggaacagtccggtggcattcgccggaaatacgttgtcctgcagtcgacgaacgtngagatcccggcacccagtatctctgctggcagagagccggacaaccggtttcgaacaaagtccaagaagctgangttaccaagcttcccatttccgtccngtatccnccgtgagttggttgcaatcactccggaaccggacaaggacntcaatttccaatcctcccggnggaatccccgacaattnttgtttaataacaattacttggnaacccttggaacc

SEQ ID NO: 84780 - DNA, 453 bp, Triticum aestivum
  unsure (1)..(453): unsure at all n locations
  Clone ID: PAT_TA_84780
tttttttggcaatantgatccacacgtcntacncatantgttcacagtactggtttctgacctgctaatgttcacangaatcataatggaantggcctccanaattgaacgaaacaaaattaaactacaatggcctaangctttgggatatgcagtaacacaaagacaatactaacaacaaactcattttttttctttgagcacacacaaattaagctcactctgtgtatgacnctttanagcgggcagggtgggtacttcaagtgntgtaccggctggatntggccccatccgattagacccaattgctcctcaaacacgacggtccaagagcancttctccccttcggtccgtgcatacangccngttagctgtaccttgcangatttgttcctnaacggngaantaaaccggcnccctgtggaatggattccaagtttaacatnaggtnc

SEQ ID NO: 84781 - DNA, 464 bp, Triticum aestivum
  unsure (1)..(464): unsure at all n locations
  Clone ID: PAT_TA_84781
cgagtacgtgcacgtctcccacaactgccgccacctcctctcccgcatcttcgtccagaacccgtacaagaggatcaccatgagcgagatcaagacccacccctggtacctcaagaacctgccgagggagctcaaggaggaggcgcaggcagcctactactacagccgccaggggagacagcagcagcagcaagcaagcaataatgcgacagcagacccgcctactccgtcgcaaagcgttgaggagttcttgaggtnctgcagggagggccaaaacggtgcccnaaccaacgtccaaggccccgacgaagcaagacaacaggaagaagnaagacgaccatgacgaattacgacnactacgacaaaacgngcgggaaggtgcacncaacggnaatttcnacatgattnttaacaaacccaaatctgacccttaanaacctggccngcaattggaattttgnngt

SEQ ID NO: 84782 - DNA, 328 bp, Triticum aestivum
  unsure (1)..(328): unsure at all n locations
  Clone ID: PAT_TA_84782
aaaaggtggccagtggcctgccagatcggaatttgctgtttactcttttgatctgacgaaatcgaatcagaataaaagaaaactctgcacttcgttcatcgagagcatccatagcaagaggaagcggctgaggttggctccggtgagctaacatggcggagaagctgacgccggagcaggtggacgagtgcaaggaaatctttcgactgttcgacgcnnacgaagacggtcgcatcgcaacggggcgaactccttacggngcttcgctnccctggggcaanaanttggncaagggggaagggggccggggttncctggaagaaccggc

SEQ ID NO: 84783 - DNA, 447 bp, Triticum aestivum
  unsure (1)..(447): unsure at all n locations
  Clone ID: PAT_TA_84783
ccgcgagttcaacatcatcctcgacgacgtcgccatcacccacctctcctatggtatcgagttctcgctggccgttgagaagaagcaggtcgcgcagcaggaggccgagcgctccaagttcctcgtcgccaaggcggagcaggagaggcgggcggccatcgtgcgcgctgagggagagagcgagtccgcgcgcctcatctctgaggccacggcgatggctgggacagggctgatcgagctcaggaggatcgaggcggccaaggagattgccgcaagagctggctcgctcaccgaatgtggcatacattccttctgggggaaaacggaaagatgctgcttgggtctcaaatgctactgggatttgggccggtggattcactgtttttttaatcctgcttgtgctaagtgctgangcaaggactaaaacggaggttcgaacttggaang

SEQ ID NO: 84784 - DNA, 190 bp, Triticum aestivum
  Clone ID: PAT_TA_84784
gtttccagtaaatctgttgtgttgtttcctctctttttttccccctgattctagcggtctggttgtcgatccatgccattgtattgttgttcagttaaatcagcagctcttctggttagtgttgcactgtaatttgacataatctttgcagcgtgattaatgaatttcatttgccttcaaaaaaaaaaaa

SEQ ID NO: 84785 - DNA, 367 bp, Triticum aestivum
  unsure (1)..(367): unsure at all n locations
  Clone ID: PAT_TA_84785
cctcgtcgtcctctgccgccgcgtcctcctcatcctcaagtggcggctcaagcctcagcagcagcggcggcgctgccggtgagggcgaggatggcgccgatgcgggggacggggaggaatacgattcgtccaacctcatagccacaaggagcgccggcgccgccggctatctgggacgaatgagaggagggaatatgagaaccaggttngaaggaggagagagatttgttcggctcaaataacgaaagatactcaagaactccggcgcgcagccactactaatccaattgcttctccaattcggacactaataactcccaaggggggggggcccnggtaccnattcgcctanatgattcntttaccc

SEQ ID NO: 84786 - DNA, 459 bp, Triticum aestivum
  unsure (1)..(459): unsure at all n locations
  Clone ID: PAT_TA_84786
gcatcatctctctttttttcctcctcttagcgaggacgccgaattcgcgattggcttaggcggtgtgtgcggatcaaatcgagtctggaagatcatctgggtgttggagtcatccagaggcacaagctgaggaatggggcaaaaggactccaagccttcacatggatatggctactcttcttatgattacgggagtgcttcatcgggatacacctcgagaaacactgggaattcgtcctccagttatagcgtcaggtacgcgccttcttcggagaacagtgtacagccggagacacatgccaggttgcagaggaagtatccaagatcggtgatgactaccgttcctttggagcaaggtgactgaacttttgggcacaagcaagccttgaacctcaaacctaatggtagnattgatttacaaagagcaatgaagggcaagtaaatttccttcaaaccccg

SEQ ID NO: 84787 - DNA, 393 bp, Triticum aestivum
  unsure (1)..(393): unsure at all n locations
  Clone ID: PAT_TA_84787
cgcgtcctctgctcctctactcccctctccatccatcgcactcacacggtcacactcacacccccgccgtctagccgtttcagctgcagagcctctcgagcggcgcccgcggcaggagctggctacccctcgaccaggtctgggagcggcgccgccgcgcccgcacgagacggcggagctggacgcggaggcggcgctnggcggggagtcggcggaggagcgcaaccgctttctgggtgctgcggctgtacgaggcgcttaacgcccgcgacgcgcgccggggcgcaagagctgctggcgccggactcgagtgggtgggtccatggccttcccgcgcgccaacaatgancgctgtcaacggggctttgacacgcggttctctttcccgcgtct

SEQ ID NO: 84788 - DNA, 476 bp, Triticum aestivum
  unsure (1)..(476): unsure at all n locations
  Clone ID: PAT_TA_84788
ccgccgcgcattcgagcacacgcggaagcgcacctagtgccatggcgaagaagcggaagcgcaccgacgcgcccgcagaggcggccggcgcagagaagcctgacgactccgcgccggcgcgcccggagcgcacgctcttcggcttcaaggacctggtccccgacgccgagcccgcctccgcgggcgccgaggccgcggtggcgccgttccggaacagggagaaggtactcatcacctgctcccgccgaatcacgtatangtatcggcacctgatgcaagacttctgtcgctngtccccgcatgcnaaagaaagncagcaagnccgagtcnaagcaaacaaagggaaacgcgctgaacgantcctttaactcaangagctgctccaactgcttttcttccaatgcaagaaaaaaaaggtnttacctttggatggggaatcncctgggaggaccatcaatnaatttctaantaagctg

SEQ ID NO: 84789 - DNA, 412 bp, Triticum aestivum
  unsure (1)..(412): unsure at all n locations
  Clone ID: PAT_TA_84789
acaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgttaacgccgattttttccccaagtgctgcaacaactgcaggtccttctcgggggtccgacgtctgcgacgacgcccaccccaagtgtccccaangctgctccggcgtncgcgtgngtgtcgaacnagccccgaaatgtggcgctgcgccggatatgaaatccaccgttcnacggnactngcggtggaccctgcnaaaantctggattnngtcnatgccgcatanagttnccctaaaataaataaagtccaaggcagantacaaagttaa

SEQ ID NO: 84790 - DNA, 478 bp, Triticum aestivum
  unsure (1)..(478): unsure at all n locations
  Clone ID: PAT_TA_84790
gccaaatgacttcttcgcagacgccacttcacagatcaatgcttatgtgcaaagtgctaaggtggatggtgtcatcactgatttccctgggactgctcacagatacaaactgaactcctgcacgagcatgggaaagaacatgccactattcatgcagcctccgcaaccaggtgggcctcctttcaaccattctcccaagatgcacagccaccaagcagcagcgccaatgccgctcttggacggacgctgacgtcgcaagaaccagccttcctccgggtcaagcaacaccaccacggctggcatccgcttccgcatgccgcctcaagaatgccgaaccatgtcttggagcatcgccacattggctggagctatgtgcttccctcctcancctggaagatancctgctcaacatcatacgccgcgtggggcattaaagctggagatttcacattggagtggctaatacattctttccanc

SEQ ID NO: 84791 - DNA, 477 bp, Triticum aestivum
  unsure (1)..(477): unsure at all n locations
  Clone ID: PAT_TA_84791
cgccaccaccagcactgccactccgccaccaccgtcccgaagccccctcccagcgccatcgacttcatctcggattgaagcaatgtcgtcggacgatgaggccaagggaaggagaaggagctcgacctctcctccaacgacgttgtcaccaagtacaaggctgccgccgaaatcctcaacaacgctctgaagattgttgtgtctcaagtgcaagccaaaagcaagttgttgacctttgcgagaagggcgatctttcataagaagagcaaactggggaatgttttacaaagaacgcaaagaggaagattgaaaggggattgcttttcccaacctggtgtacccttcaatggacacantttggcacttttcnaacggttggcaaccngatatggctttctnggaanaaaatgacatngggtnaaattgatattggtggccanattgaanggttttattgcggttggtggacaacacatt

SEQ ID NO: 84792 - DNA, 482 bp, Triticum aestivum
  unsure (1)..(482): unsure at all n locations
  Clone ID: PAT_TA_84792
gatggaaagcgcatggatggtccagacagcccggtgggaaccccctgcctttaagcagcccactgtacgggcaaaccggatgcacccttacgaggcatccgaccacaagcccattgacaagaaaaacaaacccttcacgggatatagaactgtccttgacgaactgctcgataaaccctgtcaagatacatacgacatccgagcaccgcaccaacgcacagcttcggggcatgttgggtacccggcaagtggtaagagtggtgaaggttatcctcaccagtactactccaagagaagatccttccggaggatgacgatttcaacgtctttacggccttccgagacttctccttcaaaataatccgcgcaaaaagggcgtccggcaacctcgccgaaatcnaaccaaantaacgcaatgaacttttgggaacgacacgacatactttcgccggcgnacgattaancaanggcaaattaatccn

SEQ ID NO: 84793 - DNA, 295 bp, Triticum aestivum
  unsure (1)..(295): unsure at all n locations
  Clone ID: PAT_TA_84793
gttactcgaaaaattattagctgggaagcatgtaaattccaccgtcttctgcctctcaatggttcattctaggagggtgtgttaatccagaattgtagtgtagcctacatgaatcgtcaccattacacaaacagcgtaaatgtgttcgccgtttcagggttcaggtgatgtgtgtagactgaangggaaaaaggggggaagcctgctgctggaggttcgcggtgtgaaagggaggcctcttgttcaaacagtaatgggtgtctgaatctgttctcctgctgctaaaaaaaaaaaa

SEQ ID NO: 84794 - DNA, 375 bp, Triticum aestivum
  unsure (1)..(375): unsure at all n locations
  Clone ID: PAT_TA_84794
cgaagctcgtctaggatcctatttacaagttctggaaccgacagtggcctagctgccgagcgaaaaaccctatcattcctttgcttccataagtgccagcacactaagatcaccatagtgtcaaaagctttgcgattctccttacgattcgtttttggttattgccccaccattgctccagattgtcatttatcaccaagggctaggataggatggatcctccgtattgggagagggtcatgttccacacttggacgccgaatagacgcactgggaccaggagatgaccaacattgtctnctccctnggccaaagaggtacaatgggaagggncaacttgnaacccatgcggtacccccgatttnggtntcaaaa

SEQ ID NO: 84795 - DNA, 464 bp, Triticum aestivum
  unsure (1)..(464): unsure at all n locations
  Clone ID: PAT_TA_84795
cgagttttttttttttttttttgagtcctaaatcagtttgatgaaatttgataaaaataggacctccgttggaggttgtttttcttccttgagcgctataattcaaaatagaacctcatttaagacccttactcttgttggagatgttcttagtcttggagtcctaaattagtttgatgaaatttgaaaaaaaatagaaactctgttcgaggttgtttttcttccttggagctctataattcaaaataggatcttatttaaagacccttggttgggagatgctctaaaccatcaaaagctgtcgccatcttcaagaagtcaagaatattgtcccaaccaaatccgtctttgacangatgggcttcacgggttcctaaccttcctttaacctttgctcactgtccttcaattggtgacacaacaaaattggcngatacaaacttgtcatcaaaacgattaccaaa

SEQ ID NO: 84796 - DNA, 466 bp, Triticum aestivum
  unsure (1)..(466): unsure at all n locations
  Clone ID: PAT_TA_84796
gccagccggacagcattgcagcccactctgttggcggatcattcagcagtgtgtccttgtcaaagtcatcgactatggaccactctatgcatttcaccagttcccggctctctgatgccataacaggagatggcattgtgaacagaggccaggcattgaatgatgctgacgatgaagagtgcaaggacatgcctttgatcctccgcaacaaggccccaaggtgggcacgagcagttcaatgctgggtgctcaacttccggggccgggtgactggccgctccggtcaaagatttccagtagtccgcggcgacacagctggccgcccgggagcccttgacccatcaacaaggcagcccggcagccagttcgctccttccggccggacaagagaagncatacggattttggaaagnncggaagnattttaccaangatacngtaccgctgttaactttcaagctttcnc

SEQ ID NO: 84797 - DNA, 495 bp, Triticum aestivum
  unsure (1)..(495): unsure at all n locations
  Clone ID: PAT_TA_84797
tttttttttttttttttttttttttaaagcaagcaaaaatgtactatatcatcaattcatcatcatctactagaggctacagactactatacctcatctctcaatatcaatgcctgccggtggtgccgggggtggttaatgccacagcatacaaggggtgagttgagggtagtatggtcgagagttggcgacagaagcaccacaccgacatcataaatatgaccatcattcatttccccgcgaaccacagccaatatataggggtccttccttggatccttattgctacctaagtacagattgtatagtataagaagaaagaaacctctataaacccgttcgtcctcggtcaaccatcacacggtggtaagactgctggatggnccccgatgtccaaaccttctgcttcaacaactgacccatcctccccttcaanggngcnaattntcgcaactcgccatctcggtctccctgcnggctcttccgccangtggn

SEQ ID NO: 84798 - DNA, 460 bp, Triticum aestivum
  unsure (1)..(460): unsure at all n locations
  Clone ID: PAT_TA_84798
gaaccatttcctggtcacggattttctcaagaacaagctcaagtttaggggttttgtgatttccgactgggagggcattgatcggatcactactcctcctcacgccaactactcttactcaattgaggctggtgttggtgctggaattgacatgatcatggttccattcaagatacacaagaattcatcgacgatctgacgacacaagtcaagaacaaggcatccccatgagcaagaatcgacgacgccgtctacaggttcttccgtgtcaagttcaccatgggtctgtttcgagaaccttacccgatctagctcgccggcgagtccgggaagcaagaacaccgggaactggcgcgcgaaccgtcaggaatccttggtccccctgaagaacgnaancctcctaagcccgttgctgccctcccgaagaangcggaaaattctggtcccccggaacaaccca

SEQ ID NO: 84799 - DNA, 483 bp, Triticum aestivum
  unsure (1)..(483): unsure at all n locations
  Clone ID: PAT_TA_84799
ctcgtgccgctcattcattcattcatccatcacccacccctcccggcctcccctgacctctctcgatcactcgtcatctccaccacacacacacacgcgcgagcgaatcaagganagaaagaagaggaggaggatccatggagaagtgcaggtcggtgccgcacgagcactcgtcggcgtactacggctgcggaggcgggtacgactacgaaggacgtcggcggcgggcccgggcaggccggcaanccgtacagttcaacgggccgagcggccgggacgacccggaggcgaagcggcggcgccgccgtggcggcgttnaacgtgttcgccacgcaaggccggttnnaagacaaccgtccgcagcagcgtcaatggtcaanccaantctccgactccgctacgtngctctgaactgatctgataacgtgagctacggcancaagcacctatccctaagacggaacatatagtgtttgacgacaa

SEQ ID NO: 84800 - DNA, 457 bp, Triticum aestivum
  unsure (1)..(457): unsure at all n locations
  Clone ID: PAT_TA_84800
gcgaggtgcacgaagaaaaactttggccgttaccacgtgagcgagccaccagttgagcatttgcgcgatccactgtacaagacagagagggagatcatgaaggttttcttgaccaagcactacagaaacaggcgcgctgatgacccagatttttttcttgattttgaggagatctatgttattgactccgagaacaaggtcaatcacaagagctaaagttatggttaagtgttcctgaaggaaagaaaagagaccggcggaacgacctgctactgatccgtngacgggggtganccttcaagaatcatccgacaagactaaaagggacgacgcaaagcactatcataaaagnagaggagttgggcaagtccnaagacaagacgtgngagaaacattcaaggaactcaagaactttgactacccnaattggntcccaggaaaggttnccaccgcactt

SEQ ID NO: 84801 - DNA, 386 bp, Triticum aestivum
  unsure (1)..(386): unsure at all n locations
  Clone ID: PAT_TA_84801
tcagcatgtccaccaactgcaacaatgtcaactagttcaatatataacccttccgacgtgcatgcaaggacgcgcttgtgtggagcttaatgtctacgttgatggagtgctcatacgatactgagctactaaataataaaatgaagttgcttgcgtgtgttatttcaagtactgtgtcactgtgtgtctgtgtccatgtctgtaccttgcgcacacactgtgtgtgcatatatatttatgccgacatgtatgcatgctccgtttgcgttgagttaactgtcaaccctttgctgtaccctagtgtagccgatgttgtacgttgtgatgtgccctgacctacttgtttcaaggcaatttnatggaatagtaattatttcccctaaaan

SEQ ID NO: 84802 - DNA, 467 bp, Triticum aestivum
  unsure (1)..(467): unsure at all n locations
  Clone ID: PAT_TA_84802
tccacctctgtccatctcacgccaacgcccactggcgtcctcgttcctccctgccggggagcggcggagagcttttcacctcgtcttagggacctctggcttccttccccctgccggcgatcggcggagatccgctgttctaacatcgtctcccgctgctgacttgtgaacaaggcagcagcatggtcaatttggaaacatgtcatcaaagaagatagagttggntcacaaggacatggtccatgattctgctatcgactactatggcaaggcctttccactgctcctcaanatctaaccgtgaagattatcaacatttggcgccggaaatgccccancccaaggcctttgcaagcttaatggccactangcctgtgtggcgtgttgctttggnccatccaaaagtatnggngctaccttgcttcntgcaattatgatggcgtgtcataatttngaaagangatcac

SEQ ID NO: 84803 - DNA, 431 bp, Triticum aestivum
  unsure (1)..(431): unsure at all n locations
  Clone ID: PAT_TA_84803
gttacccccttcgaggtggtaaagattagattgcaacagcaaaaagggctaagcccagacttgcttagatacaaaggtcccatacactgcgcaagaactatagttcgagaggaaggcctctttggtctttggtctggagcactaccaaccgtcatgcgcaacggcacaaaccaagcggcaatgttctcaagccaagaacacgtttgatattgttctgtggaagaagcatgaaaggggacgggaaggtgctcctgccgtggcagtcaatggtctctgggttccttgcaggaacagcaagccctgtctgcaccggacccttccgatgtcgtgaagactaagctgatggtcaaagggagaactggggacgccaagtacaaagcatgggtccatgcgatacgaacaatatatccgaaagangggctgcgagccct

SEQ ID NO: 84804 - DNA, 455 bp, Triticum aestivum
  unsure (1)..(455): unsure at all n locations
  Clone ID: PAT_TA_84804
catcatcatccctgataccaaagctcatcttcttctccttgaaatctttttgggtccacagatttggaggatgtcttgcaactgcggatcaggctgcagctgcggctcagactgcaagtgcgggaagatgtaccctgatctgacggagcaggcaagcgccgccgccgaggtcgccgccgtggtccgtcctcggcgtggcgcctggagaacaaggcgggacattcgaggttggcccgccgggcatccggcgaagggctgcaactgcggcgacaactgcaaatgcaaccctgcaactgttnaactgcatgcacccctacttatacgtgtgatggtgtnaagatatacgtgaataacaacgtccgatctgatggagtccaacagtttncctgtgtgtgtggttaactggcccctcctccttcaaancncngcccttgctgnccngtgtgtaatgtaat

SEQ ID NO: 84805 - DNA, 427 bp, Triticum aestivum
  unsure (1)..(427): unsure at all n locations
  Clone ID: PAT_TA_84805
ctcgcgccacgaccccgtcttcgccatgcgcggcgcgatgcacgccgtgcgcaacgacatgatcctgctcgagaaccagctgccgctcttcgtgctggacctcctgctcggcatccagctcgggaacccggagcagaccggcgccgtcgcggccctcgccgtgcgcttcttcgattcgctcatgcccaccgacgcgccgctgcgccgccgaaggaccggtccaggctggagtcgtccgttcggcgccgaggccacggcggcgttcgaccgctgcggggccgatgctccactgcctcgaagttttcccgccggacctcctgcgcgccancgtgcaccaagccgccgccgccgccgccgggtgcggctgtngcccaagaagttgtccttccnccgggcnttgctnacaagcnggggnacattccttgat

SEQ ID NO: 84806 - DNA, 353 bp, Triticum aestivum
  unsure (1)..(353): unsure at all n locations
  Clone ID: PAT_TA_84806
cgtgagtccgtgaccattcccgtcggccgtcccaaaagaagcggaaatttacaacccagtccaccacgggccacacaatccccaaatctaacccctccgacggcgatggggatctcgagcatgccggagccgcgggacagcctgctggggtacctgggtgtacaacacggtgatctcgattcgcggcgctngcggggctggtgcgggcggcgctggtgttcctgggaccttgcaagccgcgctgccgccccggggaacgaacggcgggggaccgactggcggggttccggcgccccggcctgcgggaccggttcctcaaggctttccgggcngngnttttccaaggncttgcg

SEQ ID NO: 84807 - DNA, 491 bp, Triticum aestivum
  unsure (1)..(491): unsure at all n locations
  Clone ID: PAT_TA_84807
ccgctacaggcccgggaccgtggcgctccgggagatccgcaagtaccagaagagcacggagctgctgatccgcaagctgcctttccagcgcctggtccgcgagatcgcgcaggacttcaagacggacctcaggttccaagagccacgccgtgctggccctccaggaggcggccgaggcgtacctgggtggggctgttccgaaggacaccaacctgtgcgccatccacgccaagcgcgtcaccatcatgcccaaaggacatccagtcngcccgccgcatccgttngcgaaagggctaagctgcccctcccgccgacccgtttagtgagccngatgtgtttgattcctggttgtattttgttccctaattctgttctagtctcctcctgcttttgtgtagaaagaatatggtgtttggtacaacaagacaacttttattgatgatttatttttngtttgcgatnaacaaactttaagnggagggggggcccgg

SEQ ID NO: 84808 - DNA, 390 bp, Triticum aestivum
  unsure (1)..(390): unsure at all n locations
  Clone ID: PAT_TA_84808
attcgggtttgtgaccatgtcttcggtcgaagaggttgaggtggctgttgaccaatttaatggctatgtgcttgatggaagaagtttgagggtgaactctgggccgccaccacccagagatcggtcatcaccgtcaccgcaaagacccaggggtgatgccaacagggtctacgtgggtaacctttcctggggagtttgacaatcagctctccgcaaacctgttcaattgagcaaggtgaggtactgggagcaaggatcatctatgacaggaaagtggaaagtcaaggggtttggtttgtcaccttacgttcccccgaaaaagttttagaatgcatatctaatctcnatgggctgactttgacggnaacanttccgtgttacggnacaaaa

SEQ ID NO: 84809 - DNA, 191 bp, Triticum aestivum
  Clone ID: PAT_TA_84809
ggcggtgcaagcgcatctcccgcagctgaggtcggcgccgtgcaacatgctgaccatggagggcagctgcgagcgggccggcggcaccagggccgccgtcttcttcgtggcgctgtacctggtggcgctcggcgccggctgcgtcatgcccaacatgaccgcgtacggcggcgaatggcccgggggaaaaa

SEQ ID NO: 84810 - DNA, 296 bp, Triticum aestivum
  Clone ID: PAT_TA_84810
ggcctttcaccctccttccatcaagcctccactcagctcactgctgaacagttgttgtagcgagtgagctgcgtccgtgtgtttaggccacgtgtgccaggtgctggcaacgtgcaatatggtgggttagctcgcgtgccattgagcgtgtgctaatggtttttaaatgcttaggcctttttcggttacaagggataaaattctaccatggatttaatccgaccaagaattaagtaaattcatacctcacatccaatcacatggtgggattaaatccattaattaaaaaaaaaaaa

SEQ ID NO: 84811 - DNA, 474 bp, Triticum aestivum
  unsure (1)..(474): unsure at all n locations
  Clone ID: PAT_TA_84811
ctgccttgagcccctgcatctcctatgcacgcggcaacggcgccaacccgcctgcggcctgctgcagcggcgtcaggagtctggccggtgcagcccggagcaccgctgacaagcaagcagcgtgcaagtgcatcaagagcgctgctggtgggctcaacgctggcaaggccgccggcatcccttcaaagtgcggcgtcagcgtcccctacgccatcaagctcatctgtgggactgttctaaagattccgcttgattcgacacttctctcanccgtcgcttcatatacttgagcgatttacgttttnantacgtttttaggtcatacacatacatttacatatatatgataagtgtccncanataactcactgcntttagaacnaaaaggatactaacttccnggcagttnttcaagggcaagcacactgttttattaagtttggtttnctttanccctttnagagntccagattt

SEQ ID NO: 84812 - DNA, 453 bp, Triticum aestivum
  unsure (1)..(453): unsure at all n locations
  Clone ID: PAT_TA_84812
ctaaaatgattttggatttgttctgaaacaatttcagattagtgaatttcatttgcgaaaaacagccaaagcggtaccggcagctccgaaacatttctggtttttatttctaaaaattccaaaaagtttccagaatgattctggcaccctccaaaaattatcaggcatgtgccgaaactattttgacttaatggcataccccgaaacaactttttcggtttcaccaatactcatccggtgacctctctctgcggtacgatcccgctgtccgaaacttttcggtgattttctctcaagacccctgtctaagtattcagcaagatagatgacccttaagcgtgtgaccctataggtttggtgaaagtatagacatgacctgggaaccccttcccgattcaatggatncaacatccgggagcccgtgggacacccatattgacccctatacccaca

SEQ ID NO: 84813 - DNA, 505 bp, Triticum aestivum
  unsure (1)..(505): unsure at all n locations
  Clone ID: PAT_TA_84813
ccccaaactgcaaacagtcaagtaattggaatcatcctcaattcttaagccggcacatgagctcgtcttgaaaatttctgacaaccatcacacttgctaaccaaatcttctgcatcagcatgagccgtcagccaataaaacccatgacgaaaagccttagccatgagagacttagagccagcatgatggccacaatctccttcatgaatctctcgtagaatctcacggccctcctcaggagaaacacaacattgacacgcccctgtgacactgcatccggtgcaatctccattgacaatancattgactttagacagtcgggtatctgtctggctaaagttgcatccttcaagtaactttccccaagtcatatnagcaaatatgggactgtccaaatcnatgaataagatgaaaaagcgccaccaactgtgcctcctgggtcaaggaacaanaagttcttcctccgttaggcatttaaccgaaggattatgcaaatatcaaaaga

SEQ ID NO: 84814 - DNA, 418 bp, Triticum aestivum
  Clone ID: PAT_TA_84814
tcaacaacttggccatgggttcgtccaaggctggaccgtcctccacaacttctggtttccggcgaacaacaagaagattgtcagaaaaacagaaggaggacacagtactgccagcagaaagaggtactcctcttcccttattcgtgcaaatcttacgtctccgctcacaccgtattcatcccacgaaagaaactagttgagcgcttcttactgcatcttcttcgagatactaaatgcacaaggtttcctccattttactatttcacctttgctagaggcagtagcccgcctgggatttcaattcaaggtcaatcgaaaccgcaattaaaagaagcaacaccgcttaagcgcgcggagcaactagtccgcctgttcccggggaagcggcgcatcgtttctatcataagggtgtggggtg

SEQ ID NO: 84815 - DNA, 442 bp, Triticum aestivum
  unsure (1)..(442): unsure at all n locations
  Clone ID: PAT_TA_84815
tatgaaacaggggtcctgtattgctaaggatcccattaaaagtcatattcaataaaaggttacaaatgaaacatcgcgaactacaaattctatggcacaacagaagcaggcaggcatgaagctcctcagttcattccaaccgcacggtatgataacgccccaggaggccaggagccaatgcgaaagttgagctaaattacaccttgcttgccccgctccgttcaatantctgaaattacaaaggatttnggaancatgacatctcctaatgagaaacctaaccgtttcaaatgcattgcacacgaaacaaggggtntgccttattgaaatttccggaattttaccaacntaanntaccgggtgattttggggatnaatttccaaggatttgngaaattccnattaaataggaacccccacaccaaaggggganacntttccc

SEQ ID NO: 84816 - DNA, 406 bp, Triticum aestivum
  unsure (1)..(406): unsure at all n locations
  Clone ID: PAT_TA_84816
ttgcgttgcgtgcgacatggggagagcggcggggctggcgcgcgccggtgtgacggcagcggggcgggcgacgacgacgagggtcatgcgggctgccgtgtccgcgttcttcgccgggtaccaccgcttcacctccgtggcggcgctgctggcgctgccgttctcggcggcggtgctggcgtcggaggcgatggcgccgtcgtcgggggcgctgcgcgctgtggcggcgcggctccgctccgtgttcgcggcgccggggttccggccctccccccttcttcgcgctgctccgangccaagctgtcgcagaccgtcttcacgttcgcggccacctgcgttcgcgctcacttcctgctgctggccaaggcctgcgtcnccgccatgctccgcctccgggacgacaacc

SEQ ID NO: 84817 - DNA, 416 bp, Triticum aestivum
  unsure (1)..(416): unsure at all n locations
  Clone ID: PAT_TA_84817
tataaactgtttactaaatatgagactaagtttggtgcagttagggctcaaagggctgctcagccttctattcatacaggtaaaagaaaacaagcttggggaagaatatttggagattccagttcaggtgttgttggtcctccccctagctctaccccttctgcttcatcttcatctgctatttgtgagctctcagcctacttagacagtgacaatgtcacttcttatgaggatgattttgatatacttctctggtggcgtgaccacaagctaacatatccagttttatccataatgggcaagggatattatgtctgttcctgtatctactgtctcctcggagtctgtttcagtttgacagggaggataatcgaggagcgacgacnacgcttaatgcctgagaagtggagatgcct

SEQ ID NO: 84818 - DNA, 438 bp, Triticum aestivum
  unsure (1)..(438): unsure at all n locations
  Clone ID: PAT_TA_84818
ctggccgccacgatcccgtccaccgatagcgaggacgtgccgccggggaagaagcagtcggcctacgccatcaagtccggtacatcgatggcctgcccgcacgtcgccggcgccgccgccttcgtgaagtcggcgcacccgggctggacgccgtccatgatcagatcagctctcatgaccacagccacgacgacgaacaacctcgggaaaccactggcgagcagcacgggcgcggcggcgacggggcacgacatgggcgccggggaagatgagccccctgcgcgcgctgagcccgggcctggtgttcgacaccaagcacgcangactacctcgactcctctgctactacggctacaaggagcagcaagtccggaaagatntccggcgccgcgcgcttctcctgccccgggggcgcgccctcgncggactcatcgcgtc

SEQ ID NO: 84819 - DNA, 426 bp, Triticum aestivum
  unsure (1)..(426): unsure at all n locations
  Clone ID: PAT_TA_84819
gagattggtgggtgatcgagagttcgagacagtgtacacatacatactctgctcgtctgctgaggatcgatcgcttggtctcgttgttgcgtagataggtactagaggactatagctactagtaggactaggagagatcccgaggggagagagagtaaggccaagatgatgcgcgcgaaccgggagcagagagtggccttctcgtcgacgaaggaggccgccgcggtgcccaaggaggaggtgtgggaggtccggcccggcgggatgctggtgcagaagcggagccccgacgcggacccgccccccggcggcgcgcccgtgcccacatccgcgtcaangtcaagttcaacggcgtctaacacgagatctacatcaaactcccaagcatccttcggcgaactcaaagaaactgctgtcngagaanac

SEQ ID NO: 84820 - DNA, 437 bp, Triticum aestivum
  unsure (1)..(437): unsure at all n locations
  Clone ID: PAT_TA_84820
cgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgccggcaagcaaggttgctgctgggggttacaagccaaaacaattacttacaacagggctgatggcaaaacantnggaacttccttanggacgttcntnaaacaaaggccaagctgctcctggcnggnggtctncctggggcaactntttcgggggaaatgatccntnctggngcctcaacaaagttttcctccctggctggtggcngcaaatntgaaacn

SEQ ID NO: 84821 - DNA, 396 bp, Triticum aestivum
  unsure (1)..(396): unsure at all n locations
  Clone ID: PAT_TA_84821
cacgcgacgctcgccgactcgccgtcacagccgcacctcaaccggagtcgaagcgccattgatgaactccgagcctgccgtggccgcagctagcgatgcacaagctcctcccacgcgccgcctccttcctcgacgcagccgccgccgcggcccccctgctgctctccttcccacgcatgcccacgctgcggctgtctggtagcccattcgtagccatgcgtcctggcggaaaccctagccgtatccgtgcgccgccgtggctgcactgtgacgctgggtggaggcggggactctgttccgccgaggctgccangcgcnggggcgatacagaggagatggagaaggatggcgggggtcgctcggcgccggagaagaagcagagatgtccgaatgatc

SEQ ID NO: 84822 - DNA, 309 bp, Triticum aestivum
  Clone ID: PAT_TA_84822
cggcgtaaagcttctggacgaggccaagttcccggccttgacggcgtgggcggagcgcttcttggcggtggacgccgtgaaggaggtgatgccggacgccggaaggctgttggagcactacaaggggtttctggctaaacggtctccacctgctggttactgaacgctgtaactgtaagcctgtaacagcaagctcagtgttccgtgtacttttccgtgcgttaacgtgtactagagttcaggaaaggctttgatctgtccaagatccagacgaataaacgaatgttttttaatactaaaaaaaaaaaa

SEQ ID NO: 84823 - DNA, 451 bp, Triticum aestivum
  unsure (1)..(451): unsure at all n locations
  Clone ID: PAT_TA_84823
atgggcggcacggcggccgggactacgctgtgcccagcctgttctcagatattttccgtgatccgcttagtgcgccgcacagcattggccgcctgctgaaccttgtggacgacttggcggtggcggcgccaggtcgtgcggtgcgccgtggctggaacgcgaaggaggacgaaggaggcgctgcacctgagggtggacattccagccctggggaaaggagcacgtcaaggtgtntggcggagcaaaacaaccttgtgatcaaaggcgaagggcgagaaggaggtagcgaagacgaagccgccccgcctcccgagtacagccggtcgcatccaactcnccccaanagnttacaaggattgnncaaattcaaggcgggaatnaaaaacggcntctcaaggtggtccctncnaaagtgaangagcancaacgcaaggacttttcccaatcaact

SEQ ID NO: 84824 - DNA, 420 bp, Triticum aestivum
  unsure (1)..(420): unsure at all n locations
  Clone ID: PAT_TA_84824
tttggctagggtttgctcgcgtctcctccttcccttggctgctgtcgtgccggtcggcggcgacagcaagggagggaacatgtcgaagaagaacaatcttgccaagaggaagaagcagtacgagttcgacctccaacggggagaaggaggccaaggagaagcaggccaagaagctgcaagccaagaaatccaagatgaagatagatggtgctgaaaagaaacgtaaaggtggccaatttaaggtccggcaagaaaaaggtgaagacgaaacttcagccttagcaaaancaaagccgcgcaagccatggagtttgacaagtgactgcgggagcacaagcatcatcaccttaagcgtccaaccagattgggaccctgattctgtgcccacatgaatactcccgtccgggtgcaactgcaact

SEQ ID NO: 84825 - DNA, 441 bp, Triticum aestivum
  unsure (1)..(441): unsure at all n locations
  Clone ID: PAT_TA_84825
caggagtgagggagcgcgatggcggagaagaagcagcgcccaggagggtccaggaaggacgaggtggttacccgcgagtacaccatcaacctacacaagcgcctccacggatgcaccttcaagaagaaagcccccaatgctataaaggaaatcaggaagtttgcacagaaggcaatgggcaccactgacatcaggattgatgtgaaactcaacaagcacatctggagcagtgggtatccggagtgtgccgaggcgtgtccgtttcaggatcgcacgcaagaggaacgattaggaaagacgccaaggaagactttactctcttgttaccgtttctgagattcccccagaagcctgaagggctgggtaccaagttgtggaggacgacnagtaattctgcctggggtactgatctgtgtcnactgtcaaatcattttttttggg

SEQ ID NO: 84826 - DNA, 438 bp, Triticum aestivum
  unsure (1)..(438): unsure at all n locations
  Clone ID: PAT_TA_84826
ctccttcagtgcgcctttcttcgtgacaaggttccgggaggctctgttcttctactcggccttgtttgatgcgctggacgcgaccaccccaagagacagcaaccagaggatgctgatcgaggagaacctcttcgggagggctgccctgaatgtcattgcgtgtgagggcacagaccgagtgggagcgccctgagacgtacaaacaatggcaggtgcggaaccaacgagcaggcttgaagcagcagccattgaaccctgattcctgcaagtagtgcggaacaagtcaaggattgctaccacaagacttgtgatcgactccattaccgcttgtcttgcaaggatggaaaagccgcacctctatccgtctcaacatgggttgcaaatgatccccctcttaatctactttctgttnaccacttgtctacaaattttaagtta

SEQ ID NO: 84827 - DNA, 416 bp, Triticum aestivum
  unsure (1)..(416): unsure at all n locations
  Clone ID: PAT_TA_84827
cccgatcacaataatcccgagggatgaattcatcaaagcgccccaggacaagagcacagtccggatgacgatgcattcatcatcctgggaacacacttggaacgagataacctccacagaaggcttatggccactacgagaatctaaagaaccaagaagcaaaggcttaaggctgcacaggaaacgctcaatcgcagatggaataaattgctaagacactgaagaaaantacagcgacgaccgccacacaaagantttccaaaacgttaagctactggccaaattcgatgattaaggctgttcccgccaaaagacatacnggtaggaaggccggncaantanttcgaaaccacattcagcactacggaagccgcaaacatttagccagtcncctggttnaaaaaacgngccggttg

SEQ ID NO: 84828 - DNA, 357 bp, Triticum aestivum
  unsure (1)..(357): unsure at all n locations
  Clone ID: PAT_TA_84828
gttgattgagccctactcaagggtggagattgcacatatagcggagatgattgaattgccgattgaccatgttgagaagaagctgtcgcagatgatcgttgacaagaaattgctgggacactagatcaaggtgctggctgcctcattatctttggaggatctaaagaccgaggaaacctccctgccacctcgaaacattccgaatgtccggaaggttgtngacagctttatgtnaagtccngccaaattcatggttngaaagcactancctaacctgtttgcnccnatttcatttccanccgnccatttccccaaacatttatnccttccatattgacatttaattgttanccgctt

SEQ ID NO: 84829 - DNA, 419 bp, Triticum aestivum
  unsure (1)..(419): unsure at all n locations
  Clone ID: PAT_TA_84829
tacatacgctgttgctgcaaatatgctgctccatggaatggnncatcaangctttacgaccgcagaaggaatttttactgcgggatggtcataataaggatatggntattggttccaaacaccanaaagatggnccacanatgggcattatanatccctcgtatanatgcggcctcttgccatttgggcgatccagtatncagtttctcctcccaaggctattcttgaggcccccacagttaaactaatggaccgaatacatatctcccctcacatggcaccgagcaataacganataagcattagaaaggtancacccgacaatanattttccctagctcgccttccactgtgaatgctgatccgaangtaaacatgcagctgctgancaacttgcaacctttttttggctttttcgg

SEQ ID NO: 84830 - DNA, 513 bp, Triticum aestivum
  unsure (1)..(513): unsure at all n locations
  Clone ID: PAT_TA_84830
gcctcttcggatcgtccctgccggagaccagagagcgcggtgcccgagcaaaccctagcctcccacgatggtgctgcagaacgacatcgacctgctgaacccgccggcggagctcgagaagctcaagcacaagaagaagcgcctcgtccagtctcccaactccttcttcatggacgtcaagtgccagngctgcttcaacatcactactgtgttcaagcaatcacagncggtctggtgttgcccaagctgcaaaacgtgttctggccanccaaagggttgnaaaggcaagtnancnagggttgtcccttccgccgcaaaggngaactaacaaaattctatctttttaaancaacnctnttttaccccaatttttangggggtttggcccgaaattttcaagntctgggaattnancacctttgggaanttggaccaactccgagnaatcccgtttgggtggagttaaacaatatactgcaagnnaatgtgctgatnaatgtgttcaaagggggg

SEQ ID NO: 84831 - DNA, 488 bp, Triticum aestivum
  unsure (1)..(488): unsure at all n locations
  Clone ID: PAT_TA_84831
ggaatacaagcctgaggatcttcctgtctggaactttgatggttcttccaccaaccaggctcctggtgacaactccgatgtctacctccgtccctgcgcagtctaccccgatcccttccgtggctctcccaacattattgttcttgccgagtgctggaatgccgatggaactcccaacaaatacaacttccgtcatgattgcgtgaaggttatggatacctacgccgacgatgagcttgggttgggcctgggaacaggantacaccttctcggtctggacaaccgaccttatggctgggccgccggcggttccctgctccccaaaggcgantatactggtggtgttgggactggaaagncctccaacgcgatatcgtcnaagccaattatnaanctgcttgtatgcccggacaaattcctggactnacctnaggcatgcctgctcaatgggaaacaagccnccctgcanggatnaangggtgacaact

SEQ ID NO: 84832 - DNA, 480 bp, Triticum aestivum
  unsure (1)..(480): unsure at all n locations
  Clone ID: PAT_TA_84832
caagaacgctgtcgtcaccgtcccggcctacttcaacgactcccagcgccaggccaccaaggacgccggcgtcatctccggcctcaacgtcatgcgcatcatcaacgagcccaccgccgcggccatcgcatacgggctcgacaagaagtcgagcagcgacggcgagaagaacgtcctcatcttcgacctcggcggcggtacttttgacgtctccgtcctcacatcgaaggagggatctttgagtcaaaggcaacggcggcgataccacttggaagcgnaagacttncgacaacggtcccttaacactttttccaaggagtttaagagggaagaacaagaaggcatcacttggaaccccaaggngtcccggcggtttaagaccccttgcnaaaaggttaaaagacgtctccttcaaaggcccaaacacacgngattnatcnctctattaagggatcatttntaangacataaccttcccgt

SEQ ID NO: 84833 - DNA, 493 bp, Triticum aestivum
  unsure (1)..(493): unsure at all n locations
  Clone ID: PAT_TA_84833
cggcagtgaagtcgccggcgccgccgcgacaggaggaaggagggagtagcagcggcaggggaggtccggcgatctcggctgctgtggcgcggtaagggaggaagcggagccgcgacaggatgcactcgtttgggcaccgcgccaacgcggtggcaacgtttgcggtcaccatactggccgcgatgtgcttcgccgcctccttctccgacaattttaacaccctgacacccaccgcatccgtcaagatcttgaatataaactgggttccaagaaggaggccaacggcaatgacgaggtcagcatgacgcttaaacattcggctgacttttaannccttttaacgtgggaacacaaaacaagtatttgtttttgtggcaacaaagtatgagaccnacaaaagctttaaatcaattccctttgggatggattatactgcaaaggagatgcaagtttnntcaatacaacaataattcagtttattgacaaggaacan

SEQ ID NO: 84834 - DNA, 502 bp, Triticum aestivum
  unsure (1)..(502): unsure at all n locations
  Clone ID: PAT_TA_84834
ttttttttttttttttggacagtttaaaccttactaaaattatataagttcgaagggagtacacggtacgaacgccagtgatgatcgcatccatccaaatcacaagacagagaatcggaagatgtaattttataaggcacaaggtactgattaggtctctcacaagacttgaaggaactaaagcagacaataataggcgattgaggtgcaagaactgcatttggagcaaaacacactttanantgccgatganttccaantgtanagcctttaacttagggggatttccgactcaacancancgattttcccggtggaagcccttggggccttcccancnaangggcacccacgcttacgcaagccccaagatttccttnaangnccccggcanaccnttggcaangcctgttcccaangccttgggattccanactcccnccaggntgaatttccccctgctgaagttctggactctccgggcccccgggtcctganngcc

SEQ ID NO: 84835 - DNA, 485 bp, Triticum aestivum
  Clone ID: PAT_TA_84835
ctcgtgccgcgtcgttacgtttcgacgccctcgcccgcctgagctgtttctgcagagtcataaatcccagccacccactgtgtgcaccgatcagtcaaccagcgtgaacaaacaggagacgcatccagcctccagcagagggctccagagatccagcaagatgaaggagggcacggcgaactgtgtggacatcctcatcgccatcatcctgcccccactcggcgtcttcctcaagttcggatgcaaggtcgagtctggtctgcctcttgctcacttcctcgcctatcttccggggatcatctacgcgatctacgccatcaccaaaggactagcgcggtccagttggggtgcgagtgcaggtcctcctctcttctcaactgtgaagtactactactagcctactacggattgatgaactgtcgctcgttcgctccttcgttgctctctggtatatggcgtggtctggtataacgattattataaaa

SEQ ID NO: 84836 - DNA, 495 bp, Triticum aestivum
  unsure (1)..(495): unsure at all n locations
  Clone ID: PAT_TA_84836
caaataccagctgcaaagagcagccctccatgggatgaagactggggtccttctaagaaaaccggtgttccatctctctcagttgattctagtgcacagacaaagcaaccctcagtacacccttttgacttcagtactcaaacaaagcaatccacaccactcccctttgatttgagcacccgagcaaagcagccatcattagttctcatgctacagcagctacaatcccacctgcgcaaccacaaccaagtacatctcttggtgccagttcaagactcaaacttctggtcatgtgcccttgttgacattgagtggctnctccgaagaagtccgcatccgacttcaatgaaccttgnccnattaacaaggagaatgatcctggaaggtatctancgaaggncttnacaattgaccctttggcggattggccccaaaactacaaggtactanatttcagcaccganatctccaagcatancaaatatctgggttaac

SEQ ID NO: 84837 - DNA, 209 bp, Triticum aestivum
  Clone ID: PAT_TA_84837
aacgtctgtacggttgttgtaacaggttacagggcgaatctggtgctgtttctgtaagaggatatgatattctgagcagagatggatagcactagataatttgctgttagtgttcatcattcagagaagtgacctgcgtcagtaccttttgttcaggtctatattatatcagctgccttttttggctccattttaccaaaaaaaaaaaa

SEQ ID NO: 84838 - DNA, 200 bp, Triticum aestivum
  Clone ID: PAT_TA_84838
gagaactagtttcgagttttttttttttttttttttttttttacagcaaagcctctacatttgcgtgttcaaaatatcaagaacagttccatctgcacaataacctagagcgccatgcacaggccctttttttttaaagttagaactggcttgtttacaacgaatgggtttattaggcaactgcacagaagcaaaacgtg

SEQ ID NO: 84839 - DNA, 445 bp, Triticum aestivum
  unsure (1)..(445): unsure at all n locations
  Clone ID: PAT_TA_84839
gtgccctgcctcgagttcagcaaggttggcttcgtcttccgtgagcacaacagctcccccgggtactacgacggtcgatactggacaatgtggaagctgcctatgttcgggtgcaccgacgccacacaggtgctcaacgaggtggaggaggtcaagaaggagtaccctgacgcctatgtccgcgtcatcggtttcgacaacctgcgccaggtgcatgcgtcagcttcanccgccttaaggcaccgggttncaaagatcccggnaanggctaaactatgagttttaaacaatggctatcncanataaaattttttggggaanttacttttggccaanactccngttganancctgntttccgaacgggaanctttgtccaaaaaattgggagtnntttggactatcgnggggcngccgnnccaatttcccnnaagagccataaccg

SEQ ID NO: 84840 - DNA, 499 bp, Triticum aestivum
  unsure (1)..(499): unsure at all n locations
  Clone ID: PAT_TA_84840
attgtcatatgatttcttatgctcaactaataatctattcacaatgtcaagtatgaaacagaaacttcattgagaaccaacaaactataatctcagtcattgaagcaattgcaatttatcataacatcagaaagagtctatgtcagagcttttcaagcaagtccacatactcaactatcatttagccttcacaatttgctaacaattcaacgcaatantttgtgggttacaaagttttaatncgggcaacagagaaagantagggnttatanttcccctnccaactttttacctcaagggntantgtgaaccatatgttaaagcnacccacattcaattgttatatntgcangnttttcccaaanaaggggtttgccaaagggnaaagntnaaagggaggngaancccagaacccgggtaagggtgaaaaaaanttaaatatgcttccaaanggaaccaggnccagnctttanggggngccaaactctagcgaaantcc

SEQ ID NO: 84841 - DNA, 455 bp, Triticum aestivum
  unsure (1)..(455): unsure at all n locations
  Clone ID: PAT_TA_84841
cggctangtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgnggnggcggtgtgcnacatnancaacgagcanttcatgtcntgccaacncgcggcggncaatacaantgncncgccggccgcnccgtcncangcgttttgcgactcgctggtggaggcggactcaagtgtctgtgcggctacangaactctccntngatgggcgtctacaacatngaacncatgcgcgcatgnagcttcctcacatgtgtngcctcnctanacgtcccgaactgctncagtgtgcnanccatccaaancaagcacgaaggccccggattcnaactgtacgtgtccgngtnttatctcccaggtgaaga

SEQ ID NO: 84842 - DNA, 490 bp, Triticum aestivum
  unsure (1)..(490): unsure at all n locations
  Clone ID: PAT_TA_84842
ttttctaccaccgaaggcgagggcgagggggccaaagacgagcgctttttcgtgcccgcctgcctgcctgctggtcattgccgctgctcacgagcctcccgccccgtgccgccctgccctctacggctctgccccaacgagccccaggggagccaggaaaaggagcgtcaaaagccgccgccgaggagagcgcgcagtcaggcatggcatcaaccgttactttcaaccagttgagcgcccaaagtgcgctgattcaaaancaaagaactttgggancataantaatgctggttaaaagatgccggatctgttanctcctggtcaaatcctcattcctnggctnggatnatccctttcngnaactttatcccaagattgggcccaagaaaatccggttttcaaaattccaaaagatctacaagnggaattctggtctccgnggancnaaaccttngctgtngtaaattccccgggnnccaactcacgntta

SEQ ID NO: 84843 - DNA, 441 bp, Triticum aestivum
  unsure (1)..(441): unsure at all n locations
  Clone ID: PAT_TA_84843
caccggggaaggggcaatagaataaagtgagggcagccaatgcaggccgccgtcaacaccaccactgtcggcgctcacccgcacccaacaaagtcctcgttcctccgtccgtcccctccttgccgcgtctacttccacgcttctccacgcccgaaccttagggcgatcgccatggccagcaagtcgcagctgcaggaccaactgatcatcactccgccccgacgactggaactccatctttcgcgaagncgtnnctccgagntgtattgcacacaacgccagantttgggaaggcatcatcatgccaacctgaanccccgggnacanaacnggacggcttgattcaggaagaataattaggggcttccccaggatacttccagcctnataacttactcacaaacacacagcaaagnattagtcccagaaatggaattttcg

SEQ ID NO: 84844 - DNA, 504 bp, Triticum aestivum
  unsure (1)..(504): unsure at all n locations
  Clone ID: PAT_TA_84844
tttttttttttttttgtcatcggtgacgaacatcatataaatacataccaatcctggtaaccatctatatatctttgcaacgccgaatttcatagaaaccgggggaaattaaaactcggcgtacctttgctgagctgatgaaaaaaagaaatagatcatctgagacgcaagaaagtgaaaagaaaagaagaactgaaaatggccntgaagacgagcacatgtatgcaaataaaggctttccaatatcnggcaacggattgatcccctgaaacccctcctctctccccntccctngatgcctgcgattcaaaatcaattggtgggtgcatgcaccaanggncgaaaagcatgcatgcatttaacatanccancaactanatcatgatacacccgttccnatgnaaaaaaaggtatgatttggnnacccncattacatacaaaggtttgggcaattcatattttgaaagannaaaatcaagttannttgtgggaaggcaaactcan

SEQ ID NO: 84845 - DNA, 439 bp, Triticum aestivum
  unsure (1)..(439): unsure at all n locations
  Clone ID: PAT_TA_84845
ttgacgcgtctcttcataggccaagctgctgacgagaaaggtggactcaagaccgatgcattcttcgaaacaagtgtagccggggtatacgcgatcggcgacgtggccaccttccctctgaagctctacaacgagcagaggagagttgagcacgtggaccacgcccggaagtccgccgagcaggccgtgagggcaatcaaaggccaaggagtccggcgaacngtggccgaatacgactacttgcctacttctactcccggtccttccacttggcgtggcaanttctaacggngacaacttcgggacaacttctnttcngggaacaacacccggctncggcaacccaantncggaactacgggtntaaggacgnaagncctccgncnntcagggggggggcccntaccaattttcccaaaangancccattaacgcgcca

SEQ ID NO: 84846 - DNA, 327 bp, Triticum aestivum
  unsure (1)..(327): unsure at all n locations
  Clone ID: PAT_TA_84846
atctcctccaaggccatgtccatcatgaactccttcatcaacgacatcttcgagaagctcgccggcgaggccgctaagctggcgaggtacaacaagaagcccaccatcacgtcccgggagatccaagacctccgtccgcctcgtcctccccggcgagctcgccaagcacgccgtctccgagggcaccaaggctgtcaccaantcaactcctcctgatccccgttattanctttttgggtgtgtttgtgggcgtnttatccgtgttnagaatcccatccntatgtttcctggttntccgagaatataccgtgctgctccaatgntcaa

SEQ ID NO: 84847 - DNA, 507 bp, Triticum aestivum
  unsure (1)..(507): unsure at all n locations
  Clone ID: PAT_TA_84847
cgtgggcgtgaccatggcggccgcgggcggcacggtgttcacgttcggcgggcgcgacctggagcacaaggagctgaacgagctctacgccttcgacgcggcgacgcgggcgtggacgctgctgtcgtccggcgccgaanggcccgccgcaccgcagctaccactccatggcggcggacgcggggcgcggggcgggtgtacgtgttcggcgggtgcggcgacgcccggccgcctcaaacgacctgtggggcgtacattttgccggcggggcaatgggaagcagctgcgcccccccggggaaggcntccaaccgccccggcggccccgggttgtcttccccggcggaaagtntggttggtntanggtttccccggggaanaattggcnaacttnactgntacaaccgggaacccggaattggccccgtcaaaaaacggggaaaagccaacccccggactttntgccccccggtttggaagactngtatttcgnggcaagtgggcccaa

SEQ ID NO: 84848 - DNA, 486 bp, Triticum aestivum
  unsure (1)..(486): unsure at all n locations
  Clone ID: PAT_TA_84848
gaactttctctcagagctcaggaagagcgggcagctgctgaaaagctaaataacaaggcagcggaagaaatttttcgccttaggaatagcaataatgacatctggaagatagacatgcatggtcttcatgcatcagaggctgtggcagtattggagaggcatctccacatgatagantccagcaacctgggaatattcaagcccaanctgaaggattaccaatttggatcngcanattccnaatnaaccacaggttnaaacattnactttcccccagaaaggggccttaacccggctaaaagctancttanagtgttncanggggnggnaaccattcnnaagggaggtnaaaacagtgtcnctanggggccccattttgaaanggtnattttttnaacnagggccggnttttngggnncccaaaatcccccnngnacctgggattttnanttntaaagggggggttggggtaaaggccnaattaan

SEQ ID NO: 84849 - DNA, 320 bp, Triticum aestivum
  unsure (1)..(320): unsure at all n locations
  Clone ID: PAT_TA_84849
gaagtgcagtaacatgtcctaatttgaaccggatgtcgcaacacaaggggcggaggcgttgctagcgctggtacccgtagtggtagtaccaccaccagcagcagcagcagcagagttgctctctgtaaccctttcattgcttgattctgtagcagagggaacttcagaagtggatgctgccgggctatcacttgttctgctatttcctctatttccagacgctccatcatcccgtgatacggacgcattccaagcattaactctcttctcactttcaagaaccaagtttcgccacggatgaattacgtngaaacatctct

SEQ ID NO: 84850 - DNA, 512 bp, Triticum aestivum
  unsure (1)..(512): unsure at all n locations
  Clone ID: PAT_TA_84850
aaagagaggtcgcggacggaacccttccaccctcacctcatcccacaaccttcgattccttcacgatcttacctcgcgcgctcgccgattcctcgatcgagtcccgcgcgattcgctttctggtcggattctctcccccgaagcatgcagccggaccagcctgtgatcagcttgcgccccggcggggcgggngggccccgcgcgccggcgcctctctcccccgcctttcgcaactccgtctctgggagacttctccgcccgcacggcgggggcgctccggnatctccaagattnggagatcacatttttgagcacgttagcgtgttcgatacacaagaattaacttctccgagtgcgttaaatgttnatgtngtccgaggaattttnagaatcaagcaagnattatgttnanttcatggngnaaacaaantgggttccaatgatcnacggtnaaggncaanacaagtcanacacaagacanaacnctatctaaacgataccttatggggtga

SEQ ID NO: 84851 - DNA, 183 bp, Triticum aestivum
  unsure (1)..(183): unsure at all n locations
  Clone ID: PAT_TA_84851
gcagcctaaaaaaaccgtatcgtctcgcctgttcagtttccttctcctcttcccgcagcccggtttgccgaccaggttccaccgttccagagtanccaagcgaatcccgtgtctggttcgcgcgatggnggaggagcagtccaacccccagcaccagagctgaangnacagggaggttatgga

SEQ ID NO: 84852 - DNA, 483 bp, Triticum aestivum
  unsure (1)..(483): unsure at all n locations
  Clone ID: PAT_TA_84852
ctgcagtgctgtttccaagcctaaaataaagcatggtttaacgcggaagcatcatcgagcatggacattgagtgaggtcgtgaagctggtggatggtgtggctcggtatggagctggcaagtgggtctgagattagaaaactgtccttcgcctcgtattcctaccgcacttcaagtggatctcaaggataaatggcgtaatctgattaagagcaacccaagacacagttcccggcgcaaaaagatggtgctgtccacggaaagactaaccttctatcataccaatacacaccattttgttgccaagtgaaggactacatnactgcatcccnaggggtngtttaaancccatcaanttccctgggcaagacggaagtctacaaggaaaagccngtttttgngatccggtaagcaaaatactttaactcnggacangtggaaatggtaanatatttatagggtacactttcacaaaatcctaacc

SEQ ID NO: 84853 - DNA, 490 bp, Triticum aestivum
  unsure (1)..(490): unsure at all n locations
  Clone ID: PAT_TA_84853
ctgctgatccgcaagctgccgttccagcgcctggtccgcgagatcgcgcaggacttcaagaccgacctccgcttccagtcccacgccgtgctggccctccaggaggcggccgaggcgtacctcgtcgggctgttcgaggacaccaacctgtgcgccatccacgccaagcgcgtcaccatcatgcccaaggacatccagctcgcccgccgcatccgtggcgaagagggctaagccgtcctccccgtcaacgccttaagtggttcggaaagtggatgtgttgcttcccggtggtagttgttcctaattgccctgctagtcatctcctttggtgtagaagaatatggttgttgggagtaagacaatttgatatgtgatgatttccttcccgggttgcgatgaacaaactattttaatgatgcaaacggcagacattgntgtnaggaananactgctgtcgtcntgtgtgattgtggcnttttcnggantgctt

SEQ ID NO: 84854 - DNA, 522 bp, Triticum aestivum
  unsure (1)..(522): unsure at all n locations
  Clone ID: PAT_TA_84854
ctcttgtgtcccgcctccgttccataattcaccagcgtcgtcctacccatatctcccatcgtcttctccctcgcgccatcagcttccccaagccagcggcgaccatgatctccccggacaccatccgcacggccatcggcgtcatcggcaatggaactgcactcgtgctcttcctctccccaagtgcctacgttcatccgcatctgggaagaaagggcggtggagcagtactccgccgatcccgtacgtggcgacgctgctgaactgcatgatgtgggtgctgttacgggtgccggcggtgcaaccgcacagcatgctggtgatcacatcaaacggcaccggcatggcgattcaactgactaacgtggcgctcttcctcctctatcngtgggggctgcgccgcgcaaggtggtcctgctgctgggccgccgaagtgggttcntccgngcgtnnccgcgcttggtgtcaacctggcganacgcacgacgcaancatggtggtcggatctctgcgtctctttng

SEQ ID NO: 84855 - DNA, 538 bp, Triticum aestivum
  unsure (1)..(538): unsure at all n locations
  Clone ID: PAT_TA_84855
cgcgagacccggcgtcgtggcccgaccggcccgacgagttccggccggagcgcttcgccgggagcgccgtcgacgttcgtgggcagcacttcgagctgctgcctttcggtgccgggcggcggatatgcccggcgtacgggctggcgatgaaggtgataggcgccggcttggccaacctgctgcaaggntcggtngcgctgccggnanggggtcttcgcccggnggacctgagcatggaggagcatgtccggactgtcgacgcgcangaaggtgccactcctcgccgtaccgggacccaaagctgccggcgcatctttacaccgccatgacctgatnaaaaacctgcatgcaaaatcaatttccccgacaatttgtgcaatccaactgaattaactcaaccacttggnggactctctctnaacanacactttccttgttctctnaaaaacctgcgtcccaanaacaatgattccaaatcttttccaacaaaacactgattgtttgttcnaaatgtgtncggttgtcctacataaccctt

SEQ ID NO: 84856 - DNA, 550 bp, Triticum aestivum
  unsure (1)..(550): unsure at all n locations
  Clone ID: PAT_TA_84856
gacggagatagccaagcccctttctcgaaaggcaaaccctctttatcatccaacacaggatctccctatggaataccaccattgtctttctccatctcactcaatagtatatatcggtataaatagctcagctcacgaaatagagcgagcaagagctcgaacttggtaggaaagtcggataagtcgactcgactccttaagtgcagcgtacacttgctggaagcaaaacgaggctcatccatttgttttggatccggaatcacactcctaagaccagtcttcttatagagaaaggaacccacttttgacancataccnaaganggaaaagagaccaaagttgattgagaatagcccatttngaccgggtatcacgaatagcanttttagtagaaaaggcgttngatgattgaaagntttctcctccgaaccactagtnactantcaanttttgcatccngatgatactganccgtnaatattgggatacaataccngtntaacaaatcgatcaacanccagaatggatantatacataggaattgntcaa

SEQ ID NO: 84857 - DNA, 211 bp, Triticum aestivum
  Clone ID: PAT_TA_84857
cccgatccggttcaactaattaagagtggcggatcggaggaataatacatcttcatcaatcaattaacctaataatatgctacatgaataagctgctgcgtgcatgtggccggacttgtggaggagcggtgcaattaacttgtatgcacgtactctatctatatatgatgaataaaaagagatagaatctgatgcattcaaaaaaaaaaaa

SEQ ID NO: 84858 - DNA, 523 bp, Triticum aestivum
  unsure (1)..(523): unsure at all n locations
  Clone ID: PAT_TA_84858
gttttttttttttttttttttttttttttttttttaacggagaagtaattattcatggaggctgaatcaaatgtatctaagctcagtgctcggtatggatgatgcaaaaccagccatcgtagggattgaaagccttaaacactcatccacacttcggtgaaacacctcggacgttgaagagggaaacgccaaacacccagcctccccaaccatccgtacaaatacaatgattattccatatctgagcggaacagtaagggtttgcgtctaaacgagaggctttgagatatagtgaggaagagataaaacaagactactctaagtcctgtggtatgactattggtacatgacgaatggtatatgggtaaggcaagcaagcanacaagcgangcaaaaaggcaattcaaagaaatggnattttgtgagacacgaatgtctccngactaatagctttagagcaaaagatgttgatgggaatttgcaaatggnaggctaagtcataatanggacctanatatancgn

SEQ ID NO: 84859 - DNA, 523 bp, Triticum aestivum
  unsure (1)..(523): unsure at all n locations
  Clone ID: PAT_TA_84859
gttgacccaatgctttcttttgttactaaggtaactgccgtcaaagttgcattgtcctctggtagccagggtcagaaattagattcagttctagcaaaacctttgaagactcaagcttttgcttctcctgataaagttgctgagctagttcaagaaggttgccgctgccattcaacaagatttgcccaaagtaatgaccaagatgaggttgtatttgcaaaaccatctactccggatgatcttattcaaacctatcaaagacaaatatagtttgaggccaatatacagctgcatcccttcctgaagccggantaccctaagtgaaagaaatgcatccatccggatgttgcccgatacctgacctgcatcctcaacttngacaccttttggnatttggcatacacatacaacgggctgctgtatccatgttgacttgcnatgcattctttcaaattaccaagtaagtgtaccacatttcgaactctctacanacgtgtggaacttcatggttaaatggaaaatg

SEQ ID NO: 84860 - DNA, 512 bp, Triticum aestivum
  unsure (1)..(512): unsure at all n locations
  Clone ID: PAT_TA_84860
cgagtttttttttttttttttttaatcttaaacacttgttgagaataatcttaattttaaacttgtttccagacaaaatcttaggggcggatgaaaacaagtagacaactctaagttcacgtcataagcaacctcatgtccagactcagcctagatatagaagtagcaaacaaactactccggcagcagcaactcctgcacagctcatctccctcgacaggctctcaagttcacaccaacacctctttgtagtccccatgaactccatgagttcccaagattcgaattngggggcttggagtactcaccttgccngatgaagacttttggaaggggaagatctggaggtaacttctcatctccttaccaatacttccgggaangacttcngaacaantctttcaaggcacatgtanaacctggtttatcataactcaacatcttacgggggtctgacggtctgggatgcctgaacaagcaggtccttgactggttgggcgctctctgaancc

SEQ ID NO: 84861 - DNA, 535 bp, Triticum aestivum
  unsure (1)..(535): unsure at all n locations
  Clone ID: PAT_TA_84861
agttctttgtagaccaatgggtccgtagtaagtagctagatggcttcctctctttctcgcttgattctcaatacaatggtctcttggggatccatatgatgtaactctttttgcatgtgtttgttgggatctgatgaactttgagtttatgattagttatatctttttatatccatgaaagttatttaagattctttgatctcttatatgcatgattgcttatagcctcgtatttcttctccgatatttgggtttttgtttgggccaacttgatctacttatcttgaagtgggaagaggtgttttgtagtgggtcgatcttacggtgcttggatcccaagtgacagaaggggaaccgacacatatgcaccgttgctagtaaggataaaacgatngggctatttcctacatnaatagattttggtctacacaagtcatcgtcctaatgcatactccgttccccaagaacttaatacactagatgcatgctggaancggttgatgtgtggagtaatanatagatcancaggagcgng

SEQ ID NO: 84862 - DNA, 528 bp, Triticum aestivum
  unsure (1)..(528): unsure at all n locations
  Clone ID: PAT_TA_84862
gcgcaccccagtgttcgaaccttaagggtttgccggaaccccacatccgacaagcatgatcttcccctttttccgccattgctcttgaacaatgaagcaaatgtcttatagtctagtttgaaaaccattcatatcttcatgacatttttcaaccactattcttgtttccgacacaatgtccattagggattgttcttgtgtctaagagcatagatatatcactctgtctaagccggaagntttggttcaattggggcaattngaacgaggttaccttaacaaccaacccaagaattacacgggaaggtgcttttggcactgttaagtgggagagatactggacgcactggtagcaagaggtgacagtgtgcctggtggtacctcctcacttcaaatggttggtggctggtcatcatttggtccaatacttacggaaagtttgactngtagattaagngnccaaataancactaatgagacaanaacaaacaaantagtcaacgttaancataacttanttgggggaac

SEQ ID NO: 84863 - DNA, 241 bp, Triticum aestivum
  unsure (1)..(241): unsure at all n locations
  Clone ID: PAT_TA_84863
cagccaggtatcaagtcatccttccgccgccgcgtactgcgcctatcttgcttctccggcggacgggcgtacccatcgtcctcgatcatcccccggactggatcggaacggagatccagccggacctgcggtgatcccttccttttctcggatagtatagtgagctagccaatgaagaggtaaatcgtcaggctttgtatcaantaagtaagtcatggtgcctggatgagcagtaagagat

SEQ ID NO: 84864 - DNA, 191 bp, Triticum aestivum
  Clone ID: PAT_TA_84864
ttagatagatacatatcaccaactgtgtgcggcggctacatcattcgcatgtggggttacgggtggtagcggccggagggctttgttgtttgctttctttacatccactatgcaaccgtatgcatatgttagctagcactaaacttcacgggttaggacttaggacatagggcaggacagtctctggaaag

SEQ ID NO: 84865 - DNA, 515 bp, Triticum aestivum
  unsure (1)..(515): unsure at all n locations
  Clone ID: PAT_TA_84865
aagacctgcatgctcatctgctacaccagcaacaagttccccactgattacatacccactgtcttcgataacttcagtgcaaacgtggtagtcgacggtaccacggtgaatttgggcctttgggatactgcagggcaggaagattacaacagactgaggccactgagctaccgcggagcagatgtgttcgtgctcgccttctcgcttgtcagccgagctagctacgaagaatgttatgaagaagtggctaccggagcttcagcattatgcaccgggtgtccccatagtgttggncggaactaaattgggccgaaggctcggtgtgcaaggagtccagcaccaagcacctttccaaacctttaggataaatggatgaagcatatccagtgggtccctgtacgaatcaaacttgtgatacatgtgtattgaaattanaatttaattatgcaanatcacactaacttaaagtttnccgggcacaaggatcccgtcctgnattgaaaaaaaggggggcn

SEQ ID NO: 84866 - DNA, 511 bp, Triticum aestivum
  unsure (1)..(511): unsure at all n locations
  Clone ID: PAT_TA_84866
gccgcctgccgcctgccgccgagaccctcgcgctcgtcgatcgccgtggaaatgcatctcgacagcgaccaccccgccggcgttcgtcccacgatacgggccccagggcctgcgccgccgcaccggcccggtcacgctcaacttctcgagcccccgcagcgacgnccgngggaccggaggcgatttccgggaaggacgtcggtcacgccgccgccgagacgtacctccgtaacgggactcgccttcacccggtcgggatacctcnggggctggttatcggtggatatgaggatatcacatcttaatgcatccgtgtatatctgttttactcaatgcccggtttcaatagaaagtcaaggttattaaaaagtgtaatactgttntccaatggagaacaacnaagaaatgggtcaagctnattttaaagaaancacctgctanataactcctcnaacactntaacagtnattcacagaaattagtgtgtttgaatttncatgcccaaaaataa

SEQ ID NO: 84867 - DNA, 372 bp, Triticum aestivum
  unsure (1)..(372): unsure at all n locations
  Clone ID: PAT_TA_84867
ctcgtgccgtttttctgcttcgtaagttcgtggtcgatccagcgagcgagcgagcagaccggcggctaaccgcggagggagagatggcgcaggggacgctggaggtgcttctcgtcggagccaggggcctcgagaacaccgattacctgagcaacatggacccctacgcgcttctgcaatgtcgctcccacgagcagaagagcagcgtcgcatctggtatacatctcttatctctgttcaactgctgcggttgttgcttgcttttgcatattaagatactttgatttgggttggcngaatatcctttttacaactacttttccttaatngtactaatatcaatattcctngctgtcctgcaaaaaaaaaaaa

SEQ ID NO: 84868 - DNA, 517 bp, Triticum aestivum
  unsure (1)..(517): unsure at all n locations
  Clone ID: PAT_TA_84868
gccagatatataccaatcacctctgctattcccaaatatcaggaatgatgatgttccagattctgtaaagaatttgaatgagaaggtgtccccaaagtttaaggtcgatgatgtccaggattctgtaaagagtttgaatgagaaactttctgctgcccttttgactatcaatgataaagatgacttgggtaaagcagcacactagagtgcagaagaggctgttgcangttgggaacaagctgaagctgaagttgctcctcctggaagcaactacttngaaactgcatcaaagaagaatactctccggaggatnaagtcaaccacctagattacgcctttaaaagaatgtgttaanggaacnttcncccaagcaangtttggagaacaaagagantaaatcccatgagacantgctnagaanccnaaagaattggancccgagaattttgactcccacaccatattgccggactcnattagcaattncaancaccnaactnnaactactacgggctgt

SEQ ID NO: 84869 - DNA, 512 bp, Triticum aestivum
  unsure (1)..(512): unsure at all n locations
  Clone ID: PAT_TA_84869
ccacgccttcggcggcgtcccgcgggagagctggaactccgggatcctctcctgcctcggccgcaacgacgagttctgcagcagcgacgtcgaagtgtgtcttcttggaacggtagcaccatgtgtgctctatggtagcaatgttgagaggcttgctgctggacaaggcacatttgcaaacagctgtttgccttacactgggctgtatttgcttgggaactctctctttgggtgggaactgccttgccccatgggtctctcatcccactccgtactgctattccgacaacgctacancttgagggtagtttngaggtttcaacaagcaatgtggggtgctgcggcgatttggtccgaaggacgaaggagaagcgttnanaacctaagaagccgcctggtgactttcaaccaactacttctgccaaccctgcgccctctggcaagaggnccccaactgcccgcaagttcccaacctggatcaacaaagggganccctcttgtcaagatccccc

SEQ ID NO: 84870 - DNA, 502 bp, Triticum aestivum
  unsure (1)..(502): unsure at all n locations
  Clone ID: PAT_TA_84870
ctttcctgactcacctcactcgatcatcctccagtcttgtcgtcgcctgctagcttgaatattacgccagcatctcgccaggaaaatggcgggcactactccgcgccgcttgctcctggtcatcgtccccctcgtcgccgtcgtgccggcgtccgcaaaagactacatggtcggcgactcgtccgggtggaagtccggagtggactacgctgcctgggccaagggcaagccgttcgccatcggcgacacgtctcgttccaattacagtcggcgcatcnngtgctggangtgagcgaagcggacacggcgcgtgtccggcgaacaaaccgctgcggtctcancaanggccaagagcaacaacatcccggtcaaccaaagggcgggaaccgctacttcatctggggggcccccggcantgcgctcnggatnaagncgcancacgtctccgcggngcngcggngnaacataacgccaaaacacggatcctcggtcctcctncggg

SEQ ID NO: 84871 - DNA, 503 bp, Triticum aestivum
  unsure (1)..(503): unsure at all n locations
  Clone ID: PAT_TA_84871
tgggttcgcggagctggtggcgcgcggcgaccgcggctttatcatccggggctgggcgccgcagatgctcatcttgacccacccggcggtgggcgggttcgtcacgcactgcgggtggaactccacgctggaggccgtgagcgccggcgtgcctatggtgacgtggccgcggtacgccgaccattctacaacgaagaagtgggtagtggagctgctcaaggcggtgtcgccgttgggattcacggactacgcgtccatgctgggagaccccggcgcccgttattggtgtnagtgattcgcaaaagcatccgggagagtgatgggcacgtgaaggacgccggangnaatacgggagattgccaagngcctccngggaaaaaggccaagcgcccgttngcaacgtggtcanccttacgatgatgtccgaccttaattgacaacttatgtcctaagaattcgcaaanccgatncaanagttctctcncnttcanatatnactggga

SEQ ID NO: 84872 - DNA, 188 bp, Triticum aestivum
  unsure (1)..(188): unsure at all n locations
  Clone ID: PAT_TA_84872
gttcgaggagcngccggactacntgngcgacaacgagntcatccangcgcactancgctgctagtggtccgtccgcgacgcgctgcgcaaagccttcgtctggcacaacnngacgctcaacgtctggngccatctcngangcttcttcctgttccngtacctcgncntcgcctngncaacagggacgg

SEQ ID NO: 84873 - DNA, 331 bp, Triticum aestivum
  unsure (1)..(331): unsure at all n locations
  Clone ID: PAT_TA_84873
ctgcctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaagtttgaggctactggcccgcgtcttcgccaagtcctggagaagaggagcgtccnatgactcacctttccgtcggttctggtggagttggtgctcccagctgctgctgctgctgccccgntgctgttgggctntgcgcgnaanagnaagaaa

SEQ ID NO: 84874 - DNA, 511 bp, Triticum aestivum
  unsure (1)..(511): unsure at all n locations
  Clone ID: PAT_TA_84874
gaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccanaggccgaggccgccggcgccaccctcctcgtctccgccaccgccacccacaaangcgagctccggcggatggatggncnggcgggagaacggnggctgcggctgcaccagtgcaagtgcngcaccagctgcggtgctcctgctgcagctgctaattcgattatccgaccatatgcatgcacctgcctncgtgcatcatcccattcatatcgattctaactactaccataccaatgttaaccgcaactgatntnaaggcctttanccaatcacctgaactgcatcnacattcaagtgccatgcatgatnttaaaaagcccccctaaataaatttccccggattaaaaaanggggggcccggtaccaattcnccnn

SEQ ID NO: 84875 - DNA, 514 bp, Triticum aestivum
  unsure (1)..(514): unsure at all n locations
  Clone ID: PAT_TA_84875
tgagcccagatatccgttatttggtgggtggcactgcacgttcaccattggctatggtcttccattgcaagattttgtctttgagtcagttgatggccggcgctacatcaaccttacttttggttgccctctattggatactgtggttgacgatcttacagttaaagtgtgcttcctgaaggatcaaaaaaccaagagcatgtattccttttgtgacagagaaacatcttggagactaantatcatacctgacgttgttgggaangacgacggttgtactgaagaagaaaatgttgtaagggagacaacntcctttcaagtgtacnatgaatcanccgatctcaanccgggcgggacatttgatggctnatanctgcatgtttgctgttttcccnntgcctcaatggctacctccaanngtttttccanccangaaacaccatagctgttgatnctnccacaaatntttttgaggaangtccgcaacnggattagnantanacctgtcnaaccn

SEQ ID NO: 84876 - DNA, 183 bp, Triticum aestivum
  Clone ID: PAT_TA_84876
tttgtaccatattttccctcttgaataaaggcatgtgttacgctgaacacctgtggcacatgacaactcttcttggtgtgtaaccaccgtttggcttggggccttccgagttccaactgagacgtgtgctgtggccgccgtgcctatatcaccgatcttgaagtgttaaagaaaaaaaaaaaa

SEQ ID NO: 84877 - DNA, 512 bp, Triticum aestivum
  unsure (1)..(512): unsure at all n locations
  Clone ID: PAT_TA_84877
ctcccactcccccctccgccgctccacttctcctccgtcgcgaaaaccctagaaactaccgaccccctcggcccgccgtcatgtcgtccccgccgccggctgtcgcgtcgcctgcctctgagcaagccaaatcgaagaagaagaagcataaatcgaagaacgacaccgttgccgctgacccgccgtcgcttgctgaggccgaggagaaaactgatggtacctcatcaagcgcatcccttgtaccttccctccgacacctccacctgggccgtcctcctcaaagaactacgaccgctcaacgtccgcaccggcactaaccccgctacctcccggcantcgccgcttnaagcgccccttcgccgganatctcccgttacggngtcatcaactcngacaagcgtcnaaccgtcctcccaanaagtggnccnctggattnaagcgatctccgcgccnagaaaccgtcaaaagnggacctcgacccaaggcaaaagnattcatcgtcgcatnacggg

SEQ ID NO: 84878 - DNA, 419 bp, Triticum aestivum
  unsure (1)..(419): unsure at all n locations
  Clone ID: PAT_TA_84878
gtggtggcggcggcggcggcggtgggacgagcggtcgttgccccgtggacgcgctgaagctgggcgtgtgcgccaacttgctgaacgggctgatcaacgcgaccctggggacgccgcccaggacgccgtgctgcacgctgatccaggggctggcggacctggaggcggcggtgtgcctctgcaccgtcctcagggccaacgtcctgggcatcaacctcaacctgcccatcaacctcagctcctcgtcaactactgcggcaggcgcgtcccatcgggcttccaaatgcttcctgatatatatggtgtagtatatatatttccatgcatgcaatgcatctcctcgtcccatcacatgttgttgttgttgtgtgtgttttcccatgattcctgtcccngtnataaatatcattattatttnc

SEQ ID NO: 84879 - DNA, 435 bp, Triticum aestivum
  unsure (1)..(435): unsure at all n locations
  Clone ID: PAT_TA_84879
ccgtgacggttcttgttcttcttcccacccagcgtgcgctccctcttcctcttccccttctctctcggcgacgactgggtggccgtagctgcctccatacgcctggtgccctggtcttcttcgggccattcgccggccgcgagcaccaccaagtacgcccacctcttgaagggagagcttcccaggtagagaaacagtttctccgtactctagcagatggcaaggataaagcctaagcaattgctaatccaaagcaaaacaaagaaggctccatctcgaatcagctactctactatcatcacatggaacttgattgtcatattggttgtgctatctctctatgctacctacangcattggcatcaaangtctacccaagacttcgaaatggagcttcatgaaagctgagcttgctgtgagaccggaggatcaaaa

SEQ ID NO: 84880 - DNA, 452 bp, Triticum aestivum
  unsure (1)..(452): unsure at all n locations
  Clone ID: PAT_TA_84880
tttttttttaaagagaaagtaccggtacattaatgaaggattcaaagaacaataataatatagtcacaaatccaaggtaccacagggcatattacagctagataaagctatgtcaattccaaacatgctagtgtaaattacaacattaacaccagtaaactagcttgacataattcatcccctcaagactaccaaactaactttcagctttctgaatctgaatctataactgacaggagattcaaggcagacgaaccgatatggattcctctaaccacaccgccatacccaacgtttatttggngacataaaagtagaatggcatcccacagagctgttcttccctgaagagaaaattgctgcttcttgtccaagtatagagcaaaattggaggatctgcttgctcaaagcaanataagagcccctggtgaatattgctggaacaccggatn

SEQ ID NO: 84881 - DNA, 436 bp, Triticum aestivum
  unsure (1)..(436): unsure at all n locations
  Clone ID: PAT_TA_84881
cgcagcacgcacggacgccatcgaggaaccctaaccagagcacagcacacggagcgacggcggcgcgccaccggcgactggcggctggtgccccctctcggtccccactccccagcacggcgacggcctgctgcatcagatggtaaattatttttcagactcagagtgcaaaaaagttggttcgtccagggaagaggaatagaggttatgcttttgtgtgagcggcggcggcggtgctggcattcttgctacctcagctctgccaggaaataaatcgcagcagcgcggaatttgtgtggagattcatgtttacgaatgcgcagcgccaggtcgagcgcaccggccgttctggcactccgcgagaccagtacttcaggatctcgtgaccagttcagaacgccacggatgaagaatctaaggagaagatagttgctan

SEQ ID NO: 84882 - DNA, 432 bp, Triticum aestivum
  unsure (1)..(432): unsure at all n locations
  Clone ID: PAT_TA_84882
cgctcatcgaccacctcggcgccgcctcccggcccgacgccgcgctactcgtcttccgcgccgtcccagccttctgctcgcactccaacgccacgttccacgccctcctccactcccttgtctgcaacggccgtgtggacgccgcgcgggacatgctcccggaggctcctaagctaggcgtccggaccaacgcggtctcctacaacatcatcctcaagggtgtttgccaccgggacgggttctcgggcgcccgtgtggtgctcgacgaaatgctcgcccgcggcgtgcgccccacggtggtgacgttcaacacgctggtggggtcggcgtgcccgggaaaggggagctggncgcggcggaacggctcgtggacgagatgacgcgccggggtgtggcaacgaacgccgtgactacgccctgttaatgcaaggg

SEQ ID NO: 84883 - DNA, 453 bp, Triticum aestivum
  unsure (1)..(453): unsure at all n locations
  Clone ID: PAT_TA_84883
cttcaccgtagccggcctccgcgtcgaggccattgaacccggccgcctcctctgctccttcatggtccctcctcgcctcacgtcgagcgccagcaaccgtatgcacggaggcgcggtggcgtcgctggtggacctggtggggtctgcagtgatcttcgccggcggctcgccggtgacgggggtctcgctggatatcaccgtctcctacctgggcgccgcccgtgcaaacgaggagatcgaggtagaggctcgggtcctcggcatcggcgacaagacggggtgcgtgaccgtggaggtgangaagnaaggacaccggncaagtgctcgcgcacgggcgccacacaaagtatctcgccaacgtctcaagtaaactctgaggtctccctatcatggaaggcacagtgtncaccataaaacggtgtcttgcnacaaatatatgtgataaaaaggtat

SEQ ID NO: 84884 - DNA, 442 bp, Triticum aestivum
  unsure (1)..(442): unsure at all n locations
  Clone ID: PAT_TA_84884
ctcgccccgtcgcgacttcgcgagtcgccccgtcccagcctcccagccgtcccggctccccgcgaccccgccctccggcagtccggcgtgggggctcctctccgatccggtgagccgaacgaggatcccaactccccgaagaaagcggccacagccagagccagggtggctcagctctcctctcacagactgcgccgcagcgcctagcgctcggctggcagccgctccggccggtcggccccgcgcccccgcccctgctgcctacatccgcctgcagccagaagatctgcctccagcgaccgccctgcctgccccttgtggcttctgtggttctgcacaccaagcacacgcacttgtccccaaacaacggcggnggngatgagtatctcagaagagttccggcgaaggatctgacgtgaggangagtctcatcaacangagn

SEQ ID NO: 84885 - DNA, 355 bp, Triticum aestivum
  Clone ID: PAT_TA_84885
tactccataaaagtcactgggaccaacaaggcgataaatcattggccttgtccgcgtcaagaatgcacatgcaattcaaataatggtatggtactctgctggagatgtcatgtgatgctctggctagcagtagcacaaactcattagcaccactcaaaactcttttctcatagagcatgatggtgatgatgcatcttgccaaccctggggatgcttccataaaatattacagcaatacaaccggatgtaggtttcaagcattccagttatccggagtcttagcatgtaacatcataaaaacaaagatccctaagttaataggtgggattgcccccgatacccgcttgggaaggaa

SEQ ID NO: 84886 - DNA, 481 bp, Triticum aestivum
  unsure (1)..(481): unsure at all n locations
  Clone ID: PAT_TA_84886
gggaactcagattttacaattccgagatccatagggctgcttttgttctgccaacatttgtaagaagagaactggaagcatataccactcctattagttctgctgaaaacgagaaaccgaaagaatcagtgtcagaaccgcagaagataaagatattgtcaaacaacgccattcttacagcttcctagccctgagccgtactcaatcttgctcggtatagttgtattctcacaagaataaacagtcactggctttgctgacaccgcacgagcagtttaagtatagaatgatgatcgattgaataagaggtgggatattgaactgatgtaagcctctgcccgaaacatatgtctccctanctggttaaggcgtgttgtggngttgtgcacatttnagctgtacttggtaattgtagaccgttgatgtaagtanacctgntttgtgctgagaaaaaaanaaaaaaccnaggggggggcccggg

SEQ ID NO: 84887 - DNA, 278 bp, Triticum aestivum
  unsure (1)..(278): unsure at all n locations
  Clone ID: PAT_TA_84887
cagatcgaagggaaaaccatcaaagctcaaatatgggatactgcggggcaagagaggtaccgtgcaatcacaagtgcttactacagaggagccgtgggtgcacttctagtctatgacatcacgaagaagcagacatttgaaaacatacagaggtggctccgcgagctccgtggaccacgccggactccaacatcgtgatcatgatggtcggcaacaatccgacctgaacacctgangtccggttcaagaggaagatgggcagctanccnggagaaagg

SEQ ID NO: 84888 - DNA, 475 bp, Triticum aestivum
  unsure (1)..(475): unsure at all n locations
  Clone ID: PAT_TA_84888
acttgatagcatcagaaacattctaaaggatattgaagatgaggcagattcggtgaatgtaaatgggactcatccttcagatgggaccttaagttcagagagcaaatttgccatggatcaagatcttaagaatgccatattgaaaattctagactttgtgaagttacttgatcaagaaatctccaagttcaaggccagtcacctgattatgatggactatgtggagaaaacacaacagtctctgcattagtccgataaagtctgtcaaacgttgatgtctaaatgatattgtcatacactgtcggtacctgtcaagaaactagccagattaagtcacattgttgagagacaatanaatgnagcangaaagtattacttaatggggttgataaagtgccnactttaaaataagggcactttaccaataaaagaaatgtcctggnanctgccacggtggctcatcaactctgntctg

SEQ ID NO: 84889 - DNA, 488 bp, Triticum aestivum
  unsure (1)..(488): unsure at all n locations
  Clone ID: PAT_TA_84889
ccttgatggcgcaaccctccttgttatctcgggctactccgggcataggatgggtgggcgagcagaagttgagaaggccatccttggcaacgaagacaagaagtggtggataatatagtgacgttgatgacgtttgcagtgtacaaataaacaaggtagatacatacacataatgttttttttttgaaggaaacccatacatatataataagctaagagcgatttactgagccagatctatgtcgcaagatatccattccggtgtatgccaccttggatcttcttcaagtctggacgaccacatcactccattgtcatcctttcatttgggcaatcactaagagcagtttaaacccagctcaaaatattgggcacaaagaaantctcatccaattncagctgggaagacgaagaccttgccagtagatgctaaccacacatggcattntagggcggtcccccggctgcaagatcnatacaactttcgn

SEQ ID NO: 84890 - DNA, 489 bp, Triticum aestivum
  unsure (1)..(489): unsure at all n locations
  Clone ID: PAT_TA_84890
cgagtccgacgcctacaggagtcccagtcagtcccgtgcgatcctggatattggtcacttgtgttatatacgcttccgccacccacaataagtatcctcgagcctcactccgacgctcgaagagctgttagattcaggagtcatgtcacccacttcgctctgacatatccaccaccgcttttattgtgagttagtagttacgccaccctatccgcctttatgtattatcggtgtgttgtaataaattgttgtgcagtctccgctcaaccttctattatattcaagtactcctgggtttcttctgtgatcaagatttgtctaccaagtaagaagaatcgtctctactgggtccgttaaaagggatcgatttctcaaataaatatttttattgggaaaacgggcatgacaanttgctagtactcgttgcgtgcaangnaactatccgggggtgttccgnaagtaccgtgatcttngatgagagatgactga

SEQ ID NO: 84891 - DNA, 471 bp, Triticum aestivum
  unsure (1)..(471): unsure at all n locations
  Clone ID: PAT_TA_84891
acgaaccccctctgtgccactgcccactgccacctgaaatccccgcgaacctatacttttccttcccccgatccaggcggttctcttcccagaagccagcccagaatggcggcatccgacgcgctgcagtccatcgtttacagccgtgggtcgctccgcctcctcgatcagaggaagctgccgctcgagatggagtacatcgacgtcaagagttccgccgatggctgggaatgcaataagagacatggttgtccgtggtgctccaagcaatagccatagcagcggcactagcattaccgttgaaatttccngatttaanttttattgggacncctgaagaacaattctttggtttcaaaagaattgggaanacttgtntcaagccgacaaatgcantgaactancgaagctgaanaagcccaaatttgggacaaaggaactgaaatgcaaaaatcnattctacttcangtc

SEQ ID NO: 84892 - DNA, 470 bp, Triticum aestivum
  unsure (1)..(470): unsure at all n locations
  Clone ID: PAT_TA_84892
cgccagctcaagccctcccttcaatccaactccacctccacaaaaatcctatccattctccaccaaacgcccccacgacgagagctcatcatcccctgctaaaaatttgcgtcttttatttctaaagattccttaccggagttttctttaataaaaaaatcccccttctgttgtccatttctcgacgcgccaattgtttttttctttctttctgatttggattcgtggatttggaccacgcgcaccaccacaaccaatcctcctccccccttcgagtccccgtcctgccccaacaatcccaatctccggaagaaggggaagcaagcatcaagaaatcctaaatagggggggcgcaccaagaatccaactgagaatccccaatcatttctccggtgcatttggcccgctccacatcaacgaatctcaaagaaaatcatcccgaatcngccccggccccaaatgggctaaag

SEQ ID NO: 84893 - DNA, 471 bp, Triticum aestivum
  unsure (1)..(471): unsure at all n locations
  Clone ID: PAT_TA_84893
ggaagtaccaggggggatccgaggggagcacaatccaactgggggccctggtgggttgtgcccacctcgtccacctctcgcaccgcctctttgttctataaataccccagtattccaaaaaaaaccatagggaagacgacgaaacacaattccagtcgccgcaagttccagaaaccacagatccaatctagaaaccatcatggaggggttcatcatcctcattgggtgctctcctggatgatgcgttagtagtcattgtagacctacgggccatagttagtantagattgcttctctctctctttcaattcctcaatacggctcttgggagatctaattagatgcanctttttgcggtgtgtttattgcgatcccgatgaactaagatttaatgatcaagttctattttaccatgggnantattngantttggnnccttaaaagcagattccggaacatcgtttctccttn

SEQ ID NO: 84894 - DNA, 487 bp, Triticum aestivum
  unsure (1)..(487): unsure at all n locations
  Clone ID: PAT_TA_84894
ctcgcacagcctgccgcagacgccaaacctcaaagcggaacctgagcatcaccaggcctcgggggcagtccccagcgccaccgccgcaaccgcagcaacagccacaagcaccacaacgaccacgagcaccaccagcaacagcacccctcctcctcctccgacgatggctgttaaagaggaggcaataatggtggggtccngaaatgggagaaagtgattagaccaacaatgacgctttctggctgggttgattacggnggatttcaatgcagcnaagatgttcaaaccaagagctactaacaaggcgaatttatancggnaggcgggcggngggttggctccatgcgnnntgacttctttngntgactccccccaacttgganccngttcccaatgacctcanctttncctngaaagtggtgaacttggaaaaggngaacaaganttgggtgccgttcaatttcaacatgctanacggggngcaacn

SEQ ID NO: 84895 - DNA, 487 bp, Triticum aestivum
  unsure (1)..(487): unsure at all n locations
  Clone ID: PAT_TA_84895
ctctggctccgaccgcgccgccgccttccaccactcctcttcggcggaggtcgtgacggggtcgacggcgtggttcgggaggggggctctcctgcgtctgcgcgcagaggagggacagcgatgcgcgcctttccttcgatttgacgcctgtgcaggaagaatgcctacagaggttacaaaaccgtatagaagttcaagtatgatagtgcaaacagagagcatcaggaagcactacagtccctttggtgtgcttctttcctggcaccgactttcgggggctaatatcaaaacaatggaaagagatgggtttggcaanggaaaagacccanctacanatttaaaaggtngaggctcanctcccttgggaancaattgtncttcgctangaatatncaaanctttcaaggatccttcnnaacaaaatggtgaccnttcaanctngganttccaattnccntccctggggttaaantaacttnaaggcnat

SEQ ID NO: 84896 - DNA, 306 bp, Triticum aestivum
  Clone ID: PAT_TA_84896
gcggctcctaccagcaggtcgccgaccaggactacgcctaagtagtgtgctccgttcgtctggattcagctcatccaacgcaggcgcgcgtttcgatcggcgtcgtcatttgctttgctcttcatttcatcacgttatgtaacgtgccaatgatgtgtgtcgtcctgggtctgttccattccgtccttgtattcatttcccttcttttttcggggtaaaatcgatgtaaagatctcatccgatctgccgttttcgatcgccttgggagtgggaaaaaacaggtgatttccgtttaaaaaaaaaaaa

SEQ ID NO: 84897 - DNA, 553 bp, Triticum aestivum
  unsure (1)..(553): unsure at all n locations
  Clone ID: PAT_TA_84897
gagacattgagagcaatctgatgaaaatgaaacaagaaacttatgcgacgatccaatgatacatggtgtcaaactcaatccacgatactgtggaatggccgcatagtcacaagctccaccgtaggcctggttcggttgcatctgaattggaggtgattgaatccccttctattcaattttaactagggagagatttaatcccatccaatcttctctgatccagacgcaaccaacaagcccttgctcaagatgctggtgaatgtattgggctcatgccattttcaagatgctggtggaaagcattctttccggtgggtaccattcataagtagagttctgtcaaatcgttcaacctgtatcatacncttgtatacccgattcccaaccggttcatcttaaaaactggggggcaaatggagaaaaaattgggttaaggcttgtttggtgaaaaaattggttaaggttgtttgggtacaactgnggggggggggggcggnggggggggnggggcggantttccttaancccaaattccntctaccaaaanaatntt

SEQ ID NO: 84898 - DNA, 372 bp, Triticum aestivum
  unsure (1)..(372): unsure at all n locations
  Clone ID: PAT_TA_84898
agaaaggctggctatatctatctgaaattctgcaacacatattgctctgctcatttcattttcgcctttcaacctttgtcagatactaatatcttcgaaagagtacagtgcctgtttggactttggaaggcaggaactgcacagaaaatggcgtaagtcctctgaatttcatgccaaattccangccagcattccaaacaaggccctaagaaagacggggcagctgggaaagtataacacctgtaaaacctattgtattgatgcttaacttcaaactggatggattactgtagctgccctcatcttggagggagacagattccccctcattcattattggtataattggcgtgggtgactaaaaaaaaaaaa

SEQ ID NO: 84899 - DNA, 523 bp, Triticum aestivum
  unsure (1)..(523): unsure at all n locations
  Clone ID: PAT_TA_84899
cacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagattcgaggccactaccgacttcaagaatcacaactcccgctcgcccgcatcaagaagatcatgaaagcgacgaggactccgcatgattcgccgccgaggtcccgttgtgttccgccgggctgcgagatgttcacctccagtcaaccatcgcggctgggcgcaccccnaanagaacaagggcggaagtccanaaatccgaattngccgcttccatcgccgcacgagnatccattcctggggaancttcgcgcgacacggtanaccttatcggnggcgcccaactcc

SEQ ID NO: 84900 - DNA, 292 bp, Triticum aestivum
  Clone ID: PAT_TA_84900
ggaagtcatggcggatgcgattggagatcttgaagcgttgacggcaaggtgtatcagatgcgatgaatgattttctatggatccacgacatcgggggtcatcaaagtgaattcgggagtttttatctcttgatccggtgaatgactttcggtggtgaggtacaaattatggacaatgacttgacgcaaaggaatgttgttggagtggcagcggttaaattgcagctgcttggattgtggaaaagcggcggcgacaacacatgtgtgactttgatggtggtgctgcgagcacc

SEQ ID NO: 84901 - DNA, 270 bp, Triticum aestivum
  Clone ID: PAT_TA_84901
tggatgtgattgcacattgttgtcatctgaacctgactgcacatcatcagaaagaaattcagacacatcagtgtgaccttcaaaatggttaaaatcatcttccatctgcagactacttttcttaagctcatcctttctgtcaatgactgcatccaccaactttgtgaaactttgttgagtgttaatgcaatgttcagcaaaataactatctctattttcatctgcattacatggcttatctgctctgaaaatccgagggggggccggtac

SEQ ID NO: 84902 - DNA, 551 bp, Triticum aestivum
  unsure (1)..(551): unsure at all n locations
  Clone ID: PAT_TA_84902
gccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattggggcactgggacaagtgatcaaaggatgggatnaagggtctcctggggaatgtgcgttggtgaaaagcggaagttgaagattccatcaaagcttggctatgggctcaaagntcgccacctactattcctggtgggagcaacctcatattttacacggacttgtcgctgtcaatgggagaaccaaccaacaatctgacagctttagatcatcaaacaaatgaaccatcactttttactcnggatcagcagatgttatantccaaagaaatgacctcatcccgcaactnaaaantcttcgcggtcanacggacatcta

SEQ ID NO: 84903 - DNA, 502 bp, Triticum aestivum
  Clone ID: PAT_TA_84903
ctaaacttgcatcgatcgctcgctcgtcagttctttctgatcatcggtcgcctctctagctagctagctacctgatcggccatggctgaggagaagaagcaccaccacctgttccaccgccacaaggacggcggcgaggaggaggcgagcgccggcggcgaggtggactacgacaagaaggagaagcaccacaagcacctggggcagctcggcgggctcggcgccatcgccgccggtgcatacgcaattcacgagaagcacaaggcgaagaaggaccccgagaacgcgcacggccacaaggtgaaggaggaggtggcggcggtggcggctctgggcgcggccgggttcgcgttccacgagcaacaccagaagaaggacgccaagaagcaaggccagagctgatcgagcctctctctgtgtgtgtgccgcttaataatgtggcgtttatagatacttactactaataaatcgcctcgtccatgtgcctgccaaaaaaaaaaaa

SEQ ID NO: 84904 - DNA, 496 bp, Triticum aestivum
  unsure (1)..(496): unsure at all n locations
  Clone ID: PAT_TA_84904
cttcgcggtgcggccggcgagcggcggcaagagcagcggcgctggtactggtagcagggcggccgcgggcgggcggtggaagccgtcggggaaggagaagccggtggtgctgccccgcccgtgtggcggagggagcctcctggtgggcgtgaagagggcgatgacgttcgtgccccgccgccggaagaagacggcggcgttgccgtcggcggccctgaagaccggctgggtcatgcacgagtaccgcctcgccgcgccgctgcacaagaacggctgcagcctggctcangcgcaaggagagtggtcgtctgccgcgtcttcaaaaagggcggcaaaagcccgaggaaggaaggcancnagaaccntcgccgccgccntccgctaacagnactgcgtcacggttccttcaactcggacttggacaagtcaacanctaacttaactactncttncaaaaccaacgtacttcccgctggcanacatcatcaanaactac

SEQ ID NO: 84905 - DNA, 530 bp, Triticum aestivum
  unsure (1)..(530): unsure at all n locations
  Clone ID: PAT_TA_84905
aacgaacgacaactccacgcagagcaacaatggcgccgccgatgaaggtgtacgggtgggccgtgtcgccgtggatggcgcgcgcgctggtgtgtctggaggaggccggcgccgactacgagatcgtccccatgagcaggtgtggcggcgaccaccgccggccggagcacctcgccaaaaacccgttcggtgaaatcccagttttagaggacggtgacctcacgctctaccaatcacgcgccatcgcacggtacgtcctccgcaagctcaagccagagctcctccgcgaaggcgacctcgaggggtcggcgatggtggacgcgtggatggaggtggaagcccaacacatggagccggccctgtggcccatcatccgccacagcatcatcggccagtacgtccgccgcgaccgcgacacaagccgtcatcgacgagaactcgacaggctgangaangtgtgccggcgtacgaggcnaggcttccgtccgcaataactggcccgggacttatcaggccnccgactctgcant

SEQ ID NO: 84906 - DNA, 531 bp, Triticum aestivum
  unsure (1)..(531): unsure at all n locations
  Clone ID: PAT_TA_84906
agcgtaatgtattgacgatgtgctattgagcttcctacaagtctaatcgacactcgatgattgctattctaagtaaaagtaaaaaacccaaaccagtctatagtacttctctaaaacaaatccttgtaccaaaaataaaaattaaaaaagagccgaagctcgattgtgcatctactctactcctgcttcttcttgttcttgttcttgggcatgcgaacaagccagtacaggaacagcgctgcgccaatgttgaacacaatgtacaccattccgataccaaagttcctccatcggtcgtcgtaggttgcagtgagagccttgaggaacgtgttggtgtcgctgatggagcagaagttgcagtcagatgtggcgtcngggttgaggacgtagccgccagccttgtcggcgaacttctggagatattctccacangttgtgccgtttagaaggtgcatctttgtgtactcgttggcagcaatgtgaccttgggttggcatacagtcgatagaatggccgaggcaagatacgtaa

SEQ ID NO: 84907 - DNA, 533 bp, Triticum aestivum
  unsure (1)..(533): unsure at all n locations
  Clone ID: PAT_TA_84907
gtttgccaggggtgaagatgaagagtgctgtattaactcgtcgatggatgagactgcagggacagtgttggtaatgtcatttgtgtcacttgttgtcatcatgtcagttcttgcttcttttctgtttgctcgaaactgccgacttctacgccatggagttgataatcacccaccttacgtcaagaaacaagtggtggaaaagtttccctgctcagcgtacagtgctccctgttctagtgaagataatttccaggaagcttgtgcaatttgcttagaagactacaataatggtgatatgcttagacatctccatgcaagcatgaatttcacaagatcngtattgatncttggctcacaaaatggggaacttcngcccnanatgcaagctaaaantaacnttgggcgggtaggcanacttcattacggcaccaattgcnggnantccatngaaaatgtgnatctttgttccaattgcaaggttcaanatccatttaaccattgntcttggaaatgattaattccantccccangg

SEQ ID NO: 84908 - DNA, 542 bp, Triticum aestivum
  unsure (1)..(542): unsure at all n locations
  Clone ID: PAT_TA_84908
cgcgaagccagctccccgatgcgatctggccgagggaagatggcgactccgccgccgccaatccgccccgccgccgcgctcctcctcctcgtcctcgctggcgtcctcgcctccgccgcgagcgccgatctcgtcatctccaaggcagatcggagggttgatctgacctcgcatatcgttcgcgtcctcgcttccctcaaggctgaaaatgttggaccagaccctgtctctcaagttttactgccttttcccaatattcaagccaagaacttggcagctattagagcattcggcagtgaagggaaagtgaagggtcaaagtactgttctgccaattgaagttgttcaaccttctggagctcccccggagctgacattcttttcagcattgttgcccaaacctttgggaaaaaggaaagactctgtacttggatgttctgactgtgttanacactctcttcaaccattccagaagaaatcactcaagccgaagcacacttgttgtctatcaagatatgctcacatctgtcaacttacctgtta

SEQ ID NO: 84909 - DNA, 362 bp, Triticum aestivum
  unsure (1)..(362): unsure at all n locations
  Clone ID: PAT_TA_84909
atgagacgaaaaataatggagcatgttctgcaagcctggaacacatgatgttgagttggttggttgggaagttccctgacgccttaaccatctccagcgagctttgcctgccctttgtctctacgggcctgtttggttggttcatagccacgcgtaagcacactcagccacacatttaagttagttgggctagtttgatcaaagttaggtggttgtttccgttttagccacaccacacctaaggcaatatctttttgtgaagaaatgaacccacatgctacgcacgcaaaaagtgtggcaaaatttagtgtgggctaacaacttaaacacctaaggtaagggttagcaanaaaaaaaaaaaa

SEQ ID NO: 84910 - DNA, 506 bp, Triticum aestivum
  Clone ID: PAT_TA_84910
gcgacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgtgcttgtgttctgcatcccgagttgtagacttggttatgacagatcctcaaagctgttgtcctaacgaatatagagcatttgaacttattctagaacgatgtatgggagcaaccgagttaaagcaacgtttccttccaagtctgcattatatatcaacaatctaaatccctgttccctaaaaaaaaaaaa

SEQ ID NO: 84911 - DNA, 451 bp, Triticum aestivum
  unsure (1)..(451): unsure at all n locations
  Clone ID: PAT_TA_84911
gagaagcagacggtgagactggatggaagaatggtggccgccaggaagatttctgtgagaaaagctgagcaacagccaaatgtgtattcagagtctcaaactgagctgctacagaagcagatgctgggccttctgcggtcggcacactatgaagcatcaaatctttctaacgaaacgatctggtgacgtttttattgtcctcatcaaagcaaggggggcagaggcccaattaaattagttatccacgtcttctcgctgggtcagttgagctgtgcctgtgaccattcaatatttcctctttgatgctggtcctcctctggtgtttgtaacatatttttggtcagtttgtcaagtccctgaaagaacagaactgtgtgcattgcttgttttgttttantgttttctgaagtttgggtgaaaangccgtaatcctgggcgctctcccctttcc

SEQ ID NO: 84912 - DNA, 437 bp, Triticum aestivum
  unsure (1)..(437): unsure at all n locations
  Clone ID: PAT_TA_84912
ggcgcctccatgaaccccgccgtctccttcggcccggccgtcgtcaccggcgtctgggagaaccactgggtgtactgggtcggcccactcgcaggcgcggccatcgcggcgctcgtctacgacatcatcttcatcgggcagcgcccacaccagcagctgccaaccacggcagcagactactgatgaccatcatcatcatgcactgaataattaagaccagaccactcaatatatatacatatgaagaataacatgccaaatctcatctcctagctagcaacttngattctccatatatttcttaaatacaaactaaactcnattgaagtatancttggtatgaaaccacatgtgtgtgatgttaatttgnccttggggnaatttgtacatctctatctcnatcatatttaagcatcaatttcgacaaaaaaaaaaaa

SEQ ID NO: 84913 - DNA, 544 bp, Triticum aestivum
  unsure (1)..(544): unsure at all n locations
  Clone ID: PAT_TA_84913
ctcaggtctcgtccatgacgaatgtgtaaccaaaatgcgcctcatgtctttgcttgatctgagcagccgatgctctggtgaaatcccttattctgcaatcactgttgaactcaggatcaatgatgacgaggtggagcaatggattgtgaaggcaattgcatccaagatattggattgcaaggttgaccagcttaaccagactgtcattgtcagtcggcacacagagaggatctttggggatggaacattggcatgctctgcgcacaaagctcggagcttggaggggaaacattgccaagagctatcaacacaatacaagctaacaaancaccgaaagagggggcacaagggatgcaagcttggcgattcactgattccaaggcagatnaacgggttccctgaatttagattatagcgtggggagattanaaaggaacttttttttgtataanacaactgttatggttattacttanattccctnacatgcctggttatcctgtattgggcaaacacccggcattannaccaattttaccccgan

SEQ ID NO: 84914 - DNA, 431 bp, Triticum aestivum
  unsure (1)..(431): unsure at all n locations
  Clone ID: PAT_TA_84914
aagcagtctactatggtttgaccaaagcagagtggttggctcgtcaatctgcaaatagaaattcggacatgctgtcccagtgatctaacagctacatggatcgatctttagaagataacatagtattccctaatccctagttattgtgatataagtagaaccaaatagtacatgacgcaccaggaaggtaacctctgacaccaagagcatggtagcttggtaaggtactgaggtatattggggatacaatctttgggtttgttgctcaatangggtaatcagcagtaaatactaagataatagatacacggagaatttgggtactggtaaactgggatgggcaagttccatgttatgtcttccgttcagaagtggntacgaggaagaattttaaacacatgacagcgcattagcgccaatgcacacttcaa

SEQ ID NO: 84915 - DNA, 524 bp, Triticum aestivum
  unsure (1)..(524): unsure at all n locations
  Clone ID: PAT_TA_84915
gtttttttttttttttttttctatgtagtccacaagtgacatcccagttgaatacgaccctgtgtatttatttacactggattctcggcgtgaatgtcttcaaacacgttatcagagaactcgttaaaccacaactgcggaaaagaatcaaggtcaaagaacgcattcgagctcgcagccgtgtcatgactcgtctcatccaccccttcaccaaaatcgtatccgaaatccgtataaggaaatgccggtatctgcggggcctgctccggaaaatccgggggttcttgctcaaccgacacagcaccaagtccccttttcaaaatatttatgctacgctgtatgccagggcagctggccgtgatggcgttcagagctctcataaacatcttgaatcgctgggtagtaacaggcctgccgctttcaagtcttgcacgacgacgtggctgcggttagtcaataagcataagtaaagtnaaacctgnaaccgaagtgttacgaggagctgaagaantgtctacgcttgg

SEQ ID NO: 84916 - DNA, 523 bp, Triticum aestivum
  unsure (1)..(523): unsure at all n locations
  Clone ID: PAT_TA_84916
gccatataagcaaaaaattcgtacccttggactgctatcatctgaagcagacttctgtactgtcaacattttgtttctgccaagacgaacaactgacttgacaccttggccacctccttattcgtcaagtgtggctctacagtttccaagctcacgaccaattagagtgatcaccgctgttacaggaaatatatgccatatatctgcggttattggaacagatggatctgaacattttctacgtaacgttgcttggttactgtgtgactacattttctgttcaagcatagctnctgaccaattttgcaaggatactaatgtccaagaaaagggtcgttatgctnaatgcaatagtacagtgcttcgtatgataattatagttcctgaatttttgctcgccgtactgatcaacagtggcaccagttttgcattggattgtggtgaaattcaagcagccttgttngctaatggtgttctatcaaatcgttngtttggcgacatgaaaaacttgcaagcacacata

SEQ ID NO: 84917 - DNA, 480 bp, Triticum aestivum
  unsure (1)..(480): unsure at all n locations
  Clone ID: PAT_TA_84917
ccgtcatcgtgcagaagacgcggaaggtccccgcccacgaggagcccatcatgaagggcagcttcaaggccacggagcccggcaagctggtgctgggcgtgaacaacccggcgtccaggaagaagaagctgctgtgccggttcaaggtgaggagcgccgccgcctgatgagggtcgttggtctgggtcccagcaggtacagcctgccagctgcttgaccaccagcccgacatgtataattcgatcgatcgccaaccaggtccataccgccaccatttgaatgaacatgctgcattgcattacatgataggagaagaagangagagananagagaggacantaaagagtttctgcttcctanctangcccgttccgtgtcctggtcgttcnttgantatttgntggttgctgntctttttttccttngggggaanggncccnttgtangtgnttaatacttantgnaaacnaaagtgngct

SEQ ID NO: 84918 - DNA, 326 bp, Triticum aestivum
  Clone ID: PAT_TA_84918
ataatttacttcatcctcccagcttacaagttaaaaaaccatcaaaagtttcagcagctgcgacagacaagaacgcgcacgtcgcacgctgtggcgtcgcagctgcgggaacacgacaacattcacatgaacttacttcagctactaataatacaaggcgacggtagatatagagagcatcttctgctagtctggttgtaaataaacgatcttgaaacactgtcttgagccgctatacttttgttttttccttctttgtgcggagcaggtgcgtgcagctgagctcagcagagcggcaggggcgcgccgttccactccttgaggca

SEQ ID NO: 84919 - DNA, 462 bp, Triticum aestivum
  unsure (1)..(462): unsure at all n locations
  Clone ID: PAT_TA_84919
tctccttccccatatcgttcctctcctgatacgtggcgaaggaggaactgaacgtctgaatctgaaccctttcgttcctctcctattcgaactcctcgcagccaaatccgatggcggcctcatcatcagcgggaccctcggcggtagacgcggcctctctcgccgcggtggcggaggcggcgccgccggaggagatgacgctggtggtgaagtggcgcgggcaggagcaaacggtgcggatggtgggggacgatacgctcggtgagctcaaactgcgcatctgcgaggtcaccggggtgctcnccaancgtcagacgctactctacaccaagctcatacttatgganatggggcgactcnacnctcctctcctcnatcnctttnaagcccaacggggaagatnntcatgatcngtncaantgnggaagaatatttgtcggcaaaaanatgatccggagttac

SEQ ID NO: 84920 - DNA, 504 bp, Triticum aestivum
  unsure (1)..(504): unsure at all n locations
  Clone ID: PAT_TA_84920
ggaacagggagtctgcgctgcgctccagggcaaggaagagggcctatgtgcaggagctggagaaggaggttcgtcgcctggtgaatgagaacctcaagctcaagaggcagtgcaaacaactgaaactagatatggctgcactggtccagcaaagcagcagcaagagcagctcccacatcagaagaacctcctcatccactcagctctaggctgctaccaataggaatatgtatgtgaatttaaagccatatatgaccaaggaagaatgggaggaagacgaacaaagctagctagactagactgcagcccctctaatccatggccattcgctgattaatacgataatatctcttatttgttggcttcttctagcttgcttcaatttcctagtacaacagtttatgtagtattcctagattgttaacgcaaagctgccttttcaccatggatccactctagtggtgtccaagtatgtcnattcaattttagtatagagncactcaa

SEQ ID NO: 84921 - DNA, 247 bp, Triticum aestivum
  unsure (1)..(247): unsure at all n locations
  Clone ID: PAT_TA_84921
gctccgctgccctgctctccacctcctccagacctccaccatggacgagccgccgctccatccaccgnccctcccccatgccntcaccancgccgagtaanacctcctcgccgccgnncttgcnttgntcgattcgaattnattcttggnaaganaagttcttattcntttgcnttcagccgtactgcnnctgcggaatctctctctggngttctccaccntgttcgtnntggtcnagcangaggtg

SEQ ID NO: 84922 - DNA, 336 bp, Triticum aestivum
  Clone ID: PAT_TA_84922
cacaactccagattttattcaagtcaaggaatatttttaggttcttttcctagatgaaacggaatacctatttataattaattcctaattatacaaaagcattccagatagactgagcaaaaaaagggtttcatttggattcccctattttgaaaatcgcatattaatttccttcatatgagcagaaaaataggatgactcaaagaagttctctaccaggaactttgtaccgcgcacattacttagcacaactaggaaaataagataagataaagataagcaagactaaaaaaatattcgtcggaatagcggaatacaaattagatgaataaatat

SEQ ID NO: 84923 - DNA, 435 bp, Triticum aestivum
  unsure (1)..(435): unsure at all n locations
  Clone ID: PAT_TA_84923
taacgttggagccgtccgagaagtaaaagaagagacagggattgatgcagaatttgttgaagtgctggccttcaggcagagccacaaatccttttttgataaatcagatctatttttcgtgtgcctgctacgacccctttcatacgacattacgaagcaagactcggaaatagaggcatgccagtggatgccagtagaggaatttgcagcacaaccatttgtccagaaacatgagcttgtgaagtacatcctcgaagtcggcctggctaaagttgacaaggaatatgcaggcttttcgccaatctccataaaatcggcatttacagacaaattgtccttattttacatgaaccggagggatctggacaaggcctcaaggtanagtatatatgtaatgacacnggcaattcangataattaaatttcaaaaaaaaa

SEQ ID NO: 84924 - DNA, 525 bp, Triticum aestivum
  unsure (1)..(525): unsure at all n locations
  Clone ID: PAT_TA_84924
tttgattgcataataggcaccgacgtgacatacaatcctgatgctatactccctctcttcaagactgctaggggagtgatttctgagaaagctaacgaggactcggtacctgctctcattctttgctacatccagcgacgagttgatgaggactccatcctttctaatgcaacgtcccagggtttcaggcttgtggacaaatggataaatggagttcacgagagtaacggtaccatcagttcttggttctctggtaatgatgtctgcagtgctttccggcatacagtactttcaagtactgtacttcgagctgtgaatgctgctatgcatgtgcaaggttactgtataacctgaaggattttgtagcaactgtatcaagcaacggcaaaccaactttgaatctttaggccttgtttaatgattcaattttacgtgaatcggactgtacgggaatggattgagataaattttgacncnaaggatttaaattgactaagngcatcaatccatatgggtaacggngaa

SEQ ID NO: 84925 - DNA, 180 bp, Triticum aestivum
  Clone ID: PAT_TA_84925
atcagaggaggtttatggaaaatatcccatgtcgcttgtgtggctgcctttcaggctgacgtgctcccattctgctcctcatttcctttcacatgttcgtcatgtaaatgccaatactaaagtgtcactgcatgggcagaagtgttaccaaagtgttgattgtgctctaaaaaaaaaaaa

SEQ ID NO: 84926 - DNA, 531 bp, Triticum aestivum
  unsure (1)..(531): unsure at all n locations
  Clone ID: PAT_TA_84926
tttatcattgcctctagggcatatttccttcaggccacactgtcaagatccttcacctccattgtcatacacgccatcaccgtcgactctctcatccatcttgttgtaatctctgaaattgttctggattcgtaatattcatatggatatctcgtctatatcttgtgctttattgtctgagttatctccctagttctcggggatatggaaccctacttgttacatgatttgaatgcaataatataattgatttatgtgatatggtcgtgacaatcttcttcataatgttgtgcgaacgttgaatacacaatattttccctgcgagggcgtaaagtatattagtgtcattgcataacggggttagagtacggtggtgacataagcttcctctctctttaacggacctttggtaagggaataatggtgaatcatatcctttatgccacatccatggtaagaccttattaatggntccgccctaacataaacatatatcacaatgatgaaatattacaatcactctcattatan

SEQ ID NO: 84927 - DNA, 515 bp, Triticum aestivum
  unsure (1)..(515): unsure at all n locations
  Clone ID: PAT_TA_84927
aaacccgctaacgcgaaaccccaacacgtcccggcggccgccgcggagaagaacgacggcggcgacggcgacggcgacgccactgatggagtccctggaggcccttgtggcgcacatccaaggcctctccggcagccccgaggagttggcgcacctccacagcctcctcaaacaggcggacggtgaacccctgcgcgcccacgccgctgctctggtccccttcctcgcgcacctcagcccagagacgcactccctcggctacctctacctcctggaggcgtgcgcgacctccagttccaatctgagcgacttcggcggcggggacttcctggtcaccatcggcggcttcctcaccgcgtgctcggcggaccagatacgcctggcgcccgacaaattcctgaatgtgtgtanggtgctgaaggaccaagtgatgcaacttaacatgccatcanagggatntccccgctgcnggcggccgttcctaaaattaatcctcncccgancaactgacccan

SEQ ID NO: 84928 - DNA, 474 bp, Triticum aestivum
  unsure (1)..(474): unsure at all n locations
  Clone ID: PAT_TA_84928
gaagaatctagctaggagcaggccgcctacgccatcggccgtccacagcaacatgtgctccggctcctggttctggagcagcagcggcagcggcaaggagcacccgtctcttgtcgtcgtcaacctcgagcggcagctaaagaagacgctggcgncaggagaaaggaaggaggtttgaggctgaggaggttgcgagacggaggagcagaggccatggagatggtgaacctgaagctgtatctggagaaccggtgcatcatcgcagagaacgagaggtccgggagagggccagcgcgctccgccgcganaacctcgcgctgctccaaaacctgtcgtccaagacggcggcntnccaanagccangagcgggaactgcntgaggttctgcttcatctctgcctgcctgctgctgaacatgaantancaactcncgtcacctcctcnttngtgcttgtccacttttntgganagaaa

SEQ ID NO: 84929 - DNA, 454 bp, Triticum aestivum
  unsure (1)..(454): unsure at all n locations
  Clone ID: PAT_TA_84929
gaaacctccaaacacctacctctctacgaactacctgccgccggaaaaccctagagcgctcggccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttgaactggggactgatttgagaactgagacactgcagcaatatgttgatgggtcctaagtggcgaatctaanaaaaa

SEQ ID NO: 84930 - DNA, 498 bp, Triticum aestivum
  unsure (1)..(498): unsure at all n locations
  Clone ID: PAT_TA_84930
gccgggcggagcgggagcggcagccgacctggaggccgtagtcccgcagcggaggtctgcccgagggccgcggccgcagacgacgccgcctccacagctcgggaagggctcgtcacgcacgtccaccgcggcgtgcatcggcacaggggtgaagcaagatggggcgtggctacagccggcggcctcatctgcggcagtcgccgtcggtggcgcgaacctatccaccagcggaggagggggttgangcgtagtccagggaactggtgcangcncggnggngtccgcntgcaccattggggcgctcgggccggccaccancaagggtcaaacccatgttcaccggcggtgcatgagcagcggcatcnangctgtgtcancggncaagagcctgcggcatatnacaccacgtgcgctctcaacggcttacngccaactnacgntgnttncattcggcaatagcgacanacggaaaganggccttctcttgntnaggcaang

SEQ ID NO: 84931 - DNA, 523 bp, Triticum aestivum
  unsure (1)..(523): unsure at all n locations
  Clone ID: PAT_TA_84931
gcaatgaccagcagcaagcagcaaaggctactgttcaagtatcaaagaggcctacagcttttggagctctgtttggaaaggcagctgctggaagaaggccagatcttttcctaggattttcaaatgttcagggtaagactaaggtggacaagataacgtcttccgtggtacttccttttcatcatttctcaggtggtgcaaaactttcatcagccgcccttccagcgaaagaatcgttgcattctgaaccagacagcatccaacacagtgatccagcttgtcagttggaangaagtgatacagttggacatgggaacaagacgagcaacaaccaccagaaaatggcaacgaggatgatggacactgtgagactgaagacacggagattcaaagtccccttcaagtgacccgtctgttaccgagcaacgattccgattactcancgaagaaagaaacgttaagcagaaccaagaagacactcgagaattcgaanttagtgtcccgtgggggcctttgattatgc

SEQ ID NO: 84932 - DNA, 408 bp, Triticum aestivum
  Clone ID: PAT_TA_84932
gtcgtggtctcatatgtgaaaagcgctggagccccatgatctgagcctttcttttattagatgtaatgtacataaatcattgtcctgaactggcggcgtatgtatgcaccagggcatagaagcttattctcaaggtgtggaatcccctgatcctagaagcacctgtgctgggttcagtatggttgcgctttagccctggaacatgttagcaaaccattgcaccattttacttgtttgccactgtgagaaatcgttttctctaattatctgaactcttgaagccagggtgggttgtttccccccttgggagttggaggataatgaccaagctgggaaccaaatttgttgtaaacagcgttgattgccgaatgatagttatagacatcttgggactggaaaaaaaaaaaa

SEQ ID NO: 84933 - DNA, 466 bp, Triticum aestivum
  unsure (1)..(466): unsure at all n locations
  Clone ID: PAT_TA_84933
cttgccctgccctccattccacctccacctcgccgcccaaatccccccacccaacaatcccccatggggtcgcaggccatcgaggcgcaccgcgcgggcgcggaggtgtaccgcggcgcggcgctgtgcgcggagaagtcgacggagctgctggcagaggcgcacctcccgctgggcctgctgccgctggccgacatggaggaggtcggctacaaccgcgccacgggcttcgtgtggctgcgccagaggaagtcgctcacgcacacgttccgcccgatcgcgcgccaggtctcgtacgccgccgaggtcaccgccttcgtggaggaccggcggatgaggcgcatgaccgggtcaagacaaaggagtcctcatctgggtcaccttctccgantgttcgtcgacanggacaccctccaagatnancttcaagacgccaacnggctcggcaagactacccgnttccnct

SEQ ID NO: 84934 - DNA, 363 bp, Triticum aestivum
  unsure (1)..(363): unsure at all n locations
  Clone ID: PAT_TA_84934
atggattatcaaggtcaagctcagcaattcaggtgacctcaattcgctcatggatgatgataagtactcgaaattctgtgaagaagaagacaaccattgaagaaatcagagtgtcttctaaacaccaggacctgtttttcaagctttatcactggttatggtctggagaccagctgtgacaaattggcaaggttcatcgcaaggaataaatgttaggatttgccaatcctacaagggcatgggaaatccaagtttgtgttgtcaatgacgtgggtcatatttgatatttctttgtagtttgtaatctccgtgaattccttcctttttcctaaaaaaaantacccttttgattccttcctaagc

SEQ ID NO: 84935 - DNA, 487 bp, Triticum aestivum
  unsure (1)..(487): unsure at all n locations
  Clone ID: PAT_TA_84935
tgatccccgcgaccacctatccacggccgcctccgccctccacctcatctcttgccaaactcctcaaggccgcctccatgtaatcccctcgtccacctcctcactgtcgaagtaggttgcgccaccacggcgagattggcggagttgacggcccttctctcttctctcgaccgcggtcaccacatctgttccgttcctcgtccctgcattcctcgcagcctcaatcgttacccgccggagcacaggacggtaggtactgttattttcccctcaaattgtatgttcttcctgatctccaattgaatagcacactacagtagatgctagcagatatcttctatgtattgcatggtatttgtctcttcttcnggattaatagattggtattgatactgcgccaaaaaaaagtctatcctgaatttcatggagtgtaagtgtgcaacctgggtactgtagtagttgacatttagattggnattgcaacaat

SEQ ID NO: 84936 - DNA, 408 bp, Triticum aestivum
  Clone ID: PAT_TA_84936
gcgctgctcacttctggctttagcctcgacgatcccaacacctttggcagccgcatccaccgcatgctcaagctgggcctgagcatcgacgaggacgaggaggctccggaggctgacaccgacatgccccctctggaggatgacgctggcgagagcaagatggaggaggtcgactaagctgggtttattcttatggaggaaagagagagaacatcgggtctgttctgtgggtcttaccacttatgctattatgcaatctgttgttggtatgctagtgctactattgtctctgctgtcttctaagttaattttgttgttgttttgcgtgggtcagtttctcatcgcatcagtggtagaaaacattcacctgtgggactaaaaaaatgtttgggtaattgggacgcaaaa

SEQ ID NO: 84937 - DNA, 311 bp, Triticum aestivum
  Clone ID: PAT_TA_84937
gcacaacttctgcgtcgacaatgccctcaacgtcgcctgcctactcgcgcgctccgggaccgtccagttgccactgctttgatgatgatccatgccggcatctcgcggtgaggacagcccagtgctgaacgtcgagttgagcaagcaaggcggcgccgttcttcggtgattgaatggtccgcgcggacgtgtcctttcttgagcgtcggtttggatgtataaattggatcttgaaatgcttttcgttatctaatgctgtatgtataacatgcagtcctcttgcatggttgggtttgaacaaaaaaaaaaaa

SEQ ID NO: 84938 - DNA, 311 bp, Triticum aestivum
  unsure (1)..(311): unsure at all n locations
  Clone ID: PAT_TA_84938
tcgccgcgtccgccctcgcgggggtcgcgatggccgccgacgcgcccgcgcccagccccacgtctggggccgccgccgtctcgtcctccgtcgtcgccgccgtcctctgccccgccgtggcgctcctcttcggcagcctgcgccactgagtgctccaggccacggcgagtttgtcccgttccnactttgtangtacnagtacnagncctagnatgtttcttcctacgctagctgcatcgcatgtatgaattatgatgatgtatctttaccgattcanatattctatatcggcattcctcaaaaaaaaaaaa

SEQ ID NO: 84939 - DNA, 477 bp, Triticum aestivum
  unsure (1)..(477): unsure at all n locations
  Clone ID: PAT_TA_84939
cttccgggtcctatcgctcctctccgtcnccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcaaggtcatgatatcaggagctccggcgtccggcaagggcacacagtgcgagctcatcaagaccaaatatcaactggcgcacatctccgctggagatttgttgcgggcggaaatcgctgctggctctgagaatgggaagcgggcaaggaattcatggagaagggcagctcgtgcctgatgaattgtcgttaatatggtgaaggaagccttcggaaccaagacctcaa

SEQ ID NO: 84940 - DNA, 475 bp, Triticum aestivum
  unsure (1)..(475): unsure at all n locations
  Clone ID: PAT_TA_84940
gccatgtctagacgcttccagctgccccccatcctctccttcctaatcaccgtgctgatcagcggcacggcgtcggcagacacgccggactgcccatacccgtgcctgccgccgccatccgctgcaggagccatcaacggctacccgccaccgcaaccgtccactggaggcggcggcggcctcggcggcagctatccgccacctccgccagggagcttccagctgaccccgccgggagcgatgcccgcgggcttctccccaccgtacagtggattcccctctgggccagccccgccgccgccgaaccccgtcctcccgtggttcccgtgggtactaccaagcgcaccaacccgatnacgggtcgacgactcggngtcctcaactgcaagggacgcccggtgggacaatcacagtcgcnggtgcttttcatctgcccttgctcgttctcttcgngttctgtanaaaananctggct

SEQ ID NO: 84941 - DNA, 479 bp, Triticum aestivum
  unsure (1)..(479): unsure at all n locations
  Clone ID: PAT_TA_84941
cgacgacctgccgagttccgaggcaagcaagacgcgaggaggctgtaagcctgccatcagcagcggcgatggcgggcgccgaggtgggagaagacaagtaccgctccttcatctacggcgagggcgagagggacaccgtgtggaggtacagcgccccgcccaactacgacgtggtcaacaagcctcnaaggaaggaagaaggactcaggtgtggcccgagggctcgctggaggagaaggtgcagcggctgctcaagagctgggagatggagctggtgcacaaggtgcggcccgaggaccagaagaccgtcaactccgagaaatactctgccagcaccaacgggatgaacgctctgacccgggccnaggtgatgggcatcggcggctacaacaacttcctgcgcaacaaacttcccccggngcacgcatctacaaccggacaacgagacgtngantccgccatggcacttaacacnggct

SEQ ID NO: 84942 - DNA, 401 bp, Triticum aestivum
  Clone ID: PAT_TA_84942
catccgcaagctccccttccagcgcctcgtccgcgagatcgcgcaggacttcaagactgatctgaggttccagtcctccgccgtcgcggcgctgcaggaggccgccgaggcgtacctggtggggctcttcgaggacaccaacctttgcgccatccacgccaagcgcgtcactatcatgcccaaggacatccagctcgcgcggcgcatcaggggcgagagggcttgagcgcccgtcgtgctgctcgtcgttgtagtgttactagaagtagatggtggcattcgtttcgtggcttccttatcctgtaggagtaatgttctagatgtcttggcttcagtgcaatggactgtgattgctcatttctgaaatttatcaatggacttgttcttgcaaaaaaaaaaaa

SEQ ID NO: 84943 - DNA, 498 bp, Triticum aestivum
  unsure (1)..(498): unsure at all n locations
  Clone ID: PAT_TA_84943
cgtggccgtcgtgccccccggcgagatggccatgtcggaggactacacctgcgtcatctcgcgcggccccaacccgaggaccacgcacatcttcgacgactgcatcgttgagagctgcggggatttgctagccgacaagcccgcggccggcggcgcagcagctgctgcctgtggcttcttcagctcttgccatgcatgcaacaagcaacttggacatggcaatgacatcttaatctatcgaggccataaagcgttctgcagcagcgagtgccggtaccaggagacgcttttggacgaagcggtggacggagaatttgcgctagggaatggaggaaaaggaggagggcgttgttagtggaggagaagagaagccatgaggacgattctgaacaaccaaccaacggcaccgagacgagatctctttcttcttcnttctcctctcctcctttcttcctttcnttcntctccttgcgggatcgcntgctgtttcggtcncca

SEQ ID NO: 84944 - DNA, 524 bp, Triticum aestivum
  unsure (1)..(524): unsure at all n locations
  Clone ID: PAT_TA_84944
acgcgacgcaactatcctctagagagagagaggaagcccgtcgttctggaagtttccacgctccgcgcctccgccccctggtctccgctccaatggcgccctcactcctcgccgccatgtccacctcgcccttcctagccagcagcggcagcagccgcaggccgctaggcgctgcccacacccgacgggctggactgcgcgtggccgcgcttaagtacgaccctgccaaggtggcgccgcagaacgaccgggttctcgtccgtcttgagcagatccctgagaaatctgctggcggtgtattgctaccaaaatctgctgttaagtttgagagatatctgatgggtgagattctatcgatcggtgctgaagtcagtgaagttgaggctgggaagaagntctcttctcagacatcaatgcttaagangtggagcttggtactgatgaagagaacatgcttctgccgtgagtcaaacttgttagctgtagttaatgaatttacaagaaaattcgncttactgggaatg

SEQ ID NO: 84945 - DNA, 524 bp, Triticum aestivum
  unsure (1)..(524): unsure at all n locations
  Clone ID: PAT_TA_84945
accccggcccccgccccagcagccggctccggtgggtccccttccttatcgtcctcgtcctcttccgccgcgacctccccttcccagcccaacgacatctcctccatcctcaactccttcctgggactaggcgaacaacccatcagggtcggcggctctgcctcgcgcgccgccgccggcacggccacccccgagaacgagcccgagcccttcgacccggtcatgttcttccagaattacatccatagcctcgttgagggaggcgccaacatccaggtcctcctcgacgacgccagcgtcaccctcggctccggacccggcctcgggcgtatcggcggggcaagctttggggattacttcgtcgggccaggcctcgaacaactcatcgagcaagctcgccgagaacgaccccaaccgctatggcacgccgccggctggcaaatcggtcctctcctcgctccccgacgtcctcgtgactcatgcatggtcgcagctgcnganggcgctgagtgcgccgtctgcaa

SEQ ID NO: 84946 - DNA, 523 bp, Triticum aestivum
  unsure (1)..(523): unsure at all n locations
  Clone ID: PAT_TA_84946
tttttagatcaaacggtaagaccaatgctgaatgggcaagcagattattcttgaaagtaagacgagtggatcgccacaacacctcgcccaaaaggccacaaagttttatctgatttcagtgcaaactccaaaaactgcacatttacaaaccctgcatctacatctgacctatacagtgtagaccgacgtgtcgtatgtcgatactttggtatctatcaatgtaccacatcttgaattattctaaaagaacttcagatttttcaagaatccctccactcctcagggagacgccaccgtttgtgccagtagatggacacccgggaccagagagggaacatgaagctatagtctgcggcttcatcagggactccccctatcgtcagaggcagccagacataccgcgaatctctaagatcggatgggttccaccgatcagccatgaagatgaatgancccggcagccctgggaaccggcaagacaaatgtgctctgggagaagaacttgttgatctgaagacccntc

SEQ ID NO: 84947 - DNA, 519 bp, Triticum aestivum
  unsure (1)..(519): unsure at all n locations
  Clone ID: PAT_TA_84947
ggaaacgatgcttgtacgaagttccagtttactaccctcaccacacacgcacgcacgagtacatatataattctctcttcaacaagtgaagagaaggcctagcaccattgctaaaccttttcttgcttctcgtccacaacaaggggaatcatctccgtctgattccttgcttgcgctgttcctagactccctggggctgcagcctgccgctgcgagatcagatgcctcacgtagccatagaaagtgcaaccaaccagggtgattccacacccgattgcattcattgcagagattggattccggaagatcgaccacgacactaacactgccaccgcgactttaaggttgcctgcaacgttgaacgtcactgctgttgttgaatggatgacgtanaagatggacnaantanggcagaacgcaagcaccccgaacctaggatgatagtcagcgcaggaacgatggaatcatgttgtgtagaaccaattcattacactcctccttcaaagcacatcgctggtg

SEQ ID NO: 84948 - DNA, 535 bp, Triticum aestivum
  Clone ID: PAT_TA_84948
tttcgatgagaaactggccaatcttgcagaagacaagaatcagcgactttcagatgcaaaccagttaagaacagggaggcttggtgaagaactggtcgagaaatatttggccaaacagctaggttccaacaatgttaggtgggtgaacaacagaattgaaaccggactgccttatgatattgttataacacacccagagggtttcacagagtatgtggaggttaaaacaactgtatcttcaagaaaagattggtttgacgtctcagcaagggaatggcagtttgccttggagaaaggggattcatttagcattgctcgtgtcatcttaggtacaaagaaagcaagtatagaaatgttgaaaaacccacacaagctttgtaagcagaaagcattgcggcttgctctcctgatatccagatcggcagcaacctagactaaaatgtcggttttgttgaggctagcaccgatcatccttctgcagattggtatgattactctgactaatatcaacatgaactggagtgagcatcgcatc

SEQ ID NO: 84949 - DNA, 514 bp, Triticum aestivum
  unsure (1)..(514): unsure at all n locations
  Clone ID: PAT_TA_84949
gctgaacacatggggccttgtgctatacaacaaccttgaggctttgatgctattcccactcgagcttctagtaatgggagaatttgatcagatgaaggtcgacagctccaaagtgtcaaactggctttcatttgatgtggtcctccctgttgctctctcatgcctgtttggactatcaatatccttcttcggattctcctgcagacgagctatttctgctactgggttcacagtgcttggcatagtgaacaagctcctaactgttgtgattaatttgcttatctgggacaagcatgcctcttttgtgggtaccattgggctcttgatatgcatgtcaggtggtgtgctctatcagcaatccaccacgaaaccgaaggcacccaaggttgagccgaaggaagagaacgacgaggagcagcagaaatgctgcagatgcaaggagttcaagagagtcataaaccttacaaagaaagncaactacaaagaagcatatggctaatactcggnaagagnn

SEQ ID NO: 84950 - DNA, 238 bp, Triticum aestivum
  Clone ID: PAT_TA_84950
tgaacagaaagtgaaagaatattgtgaaaagtatgctaaaccagaggacgctggcatcaccccggaagacaagtccagtgacgaagagcttagcgatgacgacgacgacgacaacgactccggggacgaagctatacttggcaatcctgatccttagtctgagtaggaaacagcgcagtcagctcatcaatacattgtccaattgcagaaactgcaagtaaacaaaaactgaaaaact

SEQ ID NO: 84951 - DNA, 521 bp, Triticum aestivum
  unsure (1)..(521): unsure at all n locations
  Clone ID: PAT_TA_84951
tcccgctcctcctcacctccgtcctacggctacagcgcgccggcgcccaggggcgggtacacggccgcgccctactactcgccttcgcccttcgtgtccttcggcccggccgtcggcatcggcttcgggggatcgggtttcctcgtgaccctcattggcttcgcggcattcctctatctcgccgggttcctgtccgactcgtcaggcggtaccagtgtgcttacagagacggataagaccaccgtcctcaagctacaggttggcttgctgggcatggcacgatcatttcaagaaggagcttgaccaaatagcttagaaagcagatacatctactccggctggcttgagctatgtgttgacagagacaacattagcattacttcggcatccggattgttgtatctcagcttactcttcggtgggatgtgaaacgtaacgtggatnatggtgagaaacgttcaatcaactttaatttaggagaagggcaagnttgataanagaactttcaactgaacagaaca

SEQ ID NO: 84952 - DNA, 521 bp, Triticum aestivum
  unsure (1)..(521): unsure at all n locations
  Clone ID: PAT_TA_84952
cttccgccctctccgctccccgttgcccccacccagaccaaacccaggcttcccgttccctcgcttttgtccggcggccatggcggaggagcagcagcatcagagatggcaggagggccaccgcctgtgcgccaacaattgcggcttcttcggcagccccgcgacgctggacctctgctccaagtgctaccgcgacctataccagcagcagccagcaggcgcggcggcgggcccctccgctcccaccgcgtcggccttccagcattcctcctcggcagtctccggcgcggcggcggtctctcccgatctcgaacctcccgcgacggcccctgctggcgccaaggcgggcaggtgctccagctgccggaagcgcgtgggcctgacggggttcgcgtgccgctgcggagctaccttctgcggcgtgcaacgctacccggagcggnacgcgtgcgccttcgatttccgggccgccggccgcgacgcatcgcgcgcgcaacccgtctcaaggggataagtcaagg

SEQ ID NO: 84953 - DNA, 250 bp, Triticum aestivum
  unsure (1)..(250): unsure at all n locations
  Clone ID: PAT_TA_84953
tttttttggtataaaatttatggttcgtcgtgaaaaggaagaaaaaaaaacaggtccaatttttgaccaagcgccgggtggagggtggaggggaaggcgctaccgcgctagccgctaggctanaagagcggcagccccaccagctggtgccgctgccccctgcccagcccngtgnncaccncgccccancgnggcaacnaccgcncccccatcnacgcgcnccaacgaaccncaccacccntcancccac

SEQ ID NO: 84954 - DNA, 244 bp, Triticum aestivum
  Clone ID: PAT_TA_84954
tttgcatgaaatattcctttttttggttaattatctgtgtcgtggaagacatgatccgctggtattgatacatgtcttcttatggttaatgcgaaaactatcacatttgtttttttttctttcatgcttagacatgctatagattttttaagcagcccttgatcgtttctgctgcaatgtttctgtgtaagaactattgaatctgattctgtgttttttgttaagccttgtcaaaaaaaaaaaa

SEQ ID NO: 84955 - DNA, 535 bp, Triticum aestivum
  unsure (1)..(535): unsure at all n locations
  Clone ID: PAT_TA_84955
cgaccacctccccctcatcgacgcccagctcgcgcagtccagcggcctcctccactcctacgccgcccaccaccgccccttcctctccccgcacgacaagcacgacctcgactcgttcctcgcgcagtacctgatgctgctgtgctcgttccgggagcagctgcagcagcacgtccgggtgcacgccgtggaggccgtcatggcgtgccgcgagatcgagcagtccctgcaggacctaaccggggcgacacttgaggaagggacgggggcgaccatgtcagaggacgaggacgaggcgccgatgctggaggtgggcctggatatgggctccgacgggcacgacatgatgggcttcggcccgctcatgcccaacgactcggagcgctcgctcatggaganggtcaggcangagctcaagatggagctcaaagcangttaanaaagagactanggagaagaagactgcaattaatgcatgctgtaggntgatgtgaatcctggtccgaattggttgcaagggttcaagtcaaaatan

SEQ ID NO: 84956 - DNA, 540 bp, Triticum aestivum
  unsure (1)..(540): unsure at all n locations
  Clone ID: PAT_TA_84956
cgggctgctgttctgcgcctccacaaggctttggcctctgttgtaagatctgctttatttccaccctactaatgtgtaccaggccttttctaagctggtcacagtggttgcaacttcagatcgatatctaagctgatcactgtgtttgcgacttcagatcgagattctgatcctttagtattgtgtgatttttactggtgtttctaataatcgattcatccggtgtaacagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcctggggtgcttgacaagctcaaggctgagcgtgagagaggtatcancantgatatcnctctgtggaagtttgagacaccaagtactacgcacgtcattgatgccctggacatccgact

SEQ ID NO: 84957 - DNA, 531 bp, Triticum aestivum
  unsure (1)..(531): unsure at all n locations
  Clone ID: PAT_TA_84957
ctccgtcggcgtcatcggcggtccgttctggagcgtgccgacggggaggcgcgacggcaccgtgtccatcaagcaggaggcgctggaccagatccccgcgcccaccatgaacttcacccaactcctccagtccttccagaacaagagcctcaacctcgccgacctcgtctggctctcaggggctcacacgatcggcatctcccaatgcaactccttcagcgagcgcctgtacaacttcacggggcgcggcgggcccgacgacgcggacccgtcgctggacccgctgtacgccgcgaagttgcggctcaagtgcaagacgctgacggacaacacgacgatcgtggagatggacccccggcagcttcggcaccttcgacttgagtactacgcggcgttctcaaccggcggggctgttcaagtccgacgccgcgctcataaccgacgccgctcaaaggcgaatcctcaacgtgttaaccgncgcccaaggnttcttcaagtcttcgcggctcaatgncaaatggcgcatnaagg

SEQ ID NO: 84958 - DNA, 376 bp, Triticum aestivum
  Clone ID: PAT_TA_84958
tgtccggatctgtaagatgatcttcacctaccaccatagagagcatagcacttcataaatctgatctgctagcaatttttgtacggcgtgctcctgcatcatggcccggcccaacacgaaccggtttttcttggcctgcctcgatacgcattgcgaggcggttttactgacacaccttgcgaaagcagagatcgtgctccccttatcgcgggatcttccattaataccggcgcatgcgtccccacgacgtctgttggtatgactctgtgtttttaggtaagtcccgagcggttacgctgaggacgcttgatattcaccccctttataaaggggccgaggcctatccctcttttccaccactcttgcgccttttcgc

SEQ ID NO: 84959 - DNA, 446 bp, Triticum aestivum
  unsure (1)..(446): unsure at all n locations
  Clone ID: PAT_TA_84959
gcatacggcgcgccgccacccatggccgccggcgggtaccctcccccgccgcagcaggactctaagggcggcaacgacggcttcctgaaaggatgcttggccgctctctgctgctgctgcatgctcgacatgtgcttctgagttcgtcgtcaggggctcagggcacggggatggcgcgcctagagtccagaccgatctccatcatgcagtcaggcgaaaaacaatgcatggagctgttctttttttttccttcctttctgaatcatgacgatgatacatctttgtttccgtttccatcctgtatatgctttcccgtgctatgcatggaancttcactagctacccaagaagggataatgttcccgggngttatgcgcctgtgttcttgagctctgaatctganttgaaaaatctgcnatcggntccgtntttttaaaaaaaaaaaa

SEQ ID NO: 84960 - DNA, 535 bp, Triticum aestivum
  unsure (1)..(535): unsure at all n locations
  Clone ID: PAT_TA_84960
ccaatatgttgcactcaagtcaatcttactctctcagaatcgcgatcacatccggttacgagtgcgccaagaccctccaacttgaaattgcagaggagatatcgtcgtcaccaacttcaatgcgccttgatccttgttcttagtcgcagagataccaccctccatccagctcaatcgcgagctcgccagagatataagcacacccagacgccccccattgcacaacacaatgacggcagaatcaccaaagactcaaagtcctacatctgcctctgcctctgcatcgcgccatgactgggatgactctgaagctggaccgttgcttgcccgtttcgttggcgggggtcaacttgcccctgatgccgacaccgaagcctcaactctcatcggcaccgcgtcgcctgctgattacggagctgtgacttcatctggcgatggcacggcggaggaagccggtgttgcgaagccggagggcaaaccgctgccgaaactcaagtgttgctgctctgctacgcgcgntgatggagcgattgcc

SEQ ID NO: 84961 - DNA, 389 bp, Triticum aestivum
  unsure (1)..(389): unsure at all n locations
  Clone ID: PAT_TA_84961
cgaccgcgcagctctgcgccgaccgcaaggacttcgtcttctgggacgcgtaccacacctccgacgccgccaaccagatcatcgccgaccgcctcttcgccgacatggtgggctccggcgccgtggtgccggggaacgggacgtccccgccccgagtcgttaacgcgccgacnacgataccgatccacgccgccccgccacgcaagccgtgattctcccgttcgggcgcgcccttttngtgtggaaacgcgaccagtgttccaaactgtatgcaagtattncgttcaagcttaagcaancaaagttggtnattgaaaatnccttgnaatttattnaacaangggnaatncttanggnccccaatggttggcaacnaattttctntggga

SEQ ID NO: 84962 - DNA, 537 bp, Triticum aestivum
  unsure (1)..(537): unsure at all n locations
  Clone ID: PAT_TA_84962
cagtcgacaacctcccccgccaaaacaaacctcacctctaaaccttcttgccctcgcgtcgcaactctcatccttctcgtcttacttgcaaccacttagttcctataatttcacacatctcgcatcactatgtcgtggcaagcatacatcgactcaagccttgtcggctccggtcatattgacaagggcgccatcatcagtgctgcgggcgacagcgcttgggcttcttctcctgacctccagctcaagcccgaggagatgaaggccatatctgccatcgttggcggtgactcggctgccaaggacaangctttcgctgagggtctctacattgctggcgagcgttacgttatggcccgagccgangaccggagtatctacgcccgatcgggccgcctcggtgttgctgttgcgaagactggccaggccatcgtcatcggccaccatggtgaggccaggtcgctggcaacgccanctctaccgtcnaaggtcttgccgactaactcgtcagtcaggatattgacattcagcgtattg

SEQ ID NO: 84963 - DNA, 260 bp, Triticum aestivum
  Clone ID: PAT_TA_84963
gtagcattgagagtgagagaaaaaaaatggagcggggaaagtaggtcttccatacagttccaatgcttgcatacttgtacatctccatttgattgtattcatttgccatgggggtacaaaggtgggaatagtaggtcgcacaaaggccctgatttcttgatttgtcaggttggggggtataaatatgaaagttgttacgcacagatcatcatgtatattgtgtcccggaaatgtgttacagattctgctcgagggggggg

SEQ ID NO: 84964 - DNA, 361 bp, Triticum aestivum
  unsure (1)..(361): unsure at all n locations
  Clone ID: PAT_TA_84964
ccgctgtgccgagtttatgtggccgatgggaacaagcagccggtggcggcaaagcacaccagccgtgaagcacaggcactcgccgacgaccttgttatctggttctccaccgtgcttgttcccggtttctgatgccaaattccttcgtctgttcgttcgtttgaaaaagcttgattggtgtgtattttttttattgcatgcatgatacatgtacgtactacgtttactngttaattgtccttagaacagtttctagaaaatctgtgtgtatgtagcatcttgttgcatgaactgattggaacttctgtgtttgcagctgattactgaaaataagaagttcgagcaaatataaaaaannaaa

SEQ ID NO: 84965 - DNA, 527 bp, Triticum aestivum
  unsure (1)..(527): unsure at all n locations
  Clone ID: PAT_TA_84965
gcgaagcgggagggaggcgatggcggcggcttgggggcagaaggccctgggggctctgccgcagctggtgaagtcgctgcggagtgatcccgtctccggcagcgcacgacacaggcgccttccgtctctcaggaggaccttctcgttgtacgatcagatcaacctcatcgacagcgtcccggaagacgagctccgattccagtcgtatgatgacactggattcaaaattaacaatgtaaaatatgaaggcagtgtattgattgtagagaacaagataatgacatgggcacccaaaacgttctcaagagataactcctgaaagtttatcaatcttcaaagttgtgcaccctatcccagagatctttattcttggttgcggaagacacgtccagctggtcagtcctgaagctgcggatgttcaatcggtcaactgggaatgaaactagaagcattgattcgaggaatgcagcttcaacatataatanctgaacaaggagggaagccggtggaactgcagtcttcctatg

SEQ ID NO: 84966 - DNA, 407 bp, Triticum aestivum
  Clone ID: PAT_TA_84966
ttcaactccaatttcttgttgcatttcacgtcttcaaattctgtactcgtgttcccccccttctcataatggctgccaaacaaccatcttcaagatggtggttctggaccaaagtcctgatgggtggcgctgctgtcgcagtcggcggaccggcatttacaatgtggttaactcctaccgaggaagagcttcgatcgagatacaaccccgagttgcggaagaagagtttggagaatcgcgaggagcgacaacaagaatttgacgactttgtgactcgactgaaggaatactccaagtcggataaaccaatctggattgtcggaaaagaagaagaggagcgaaagcgcaaagccgccgccgccgctgcgaaagcaactcagaaggacgcagacactcgacgagaagat

SEQ ID NO: 84967 - DNA, 511 bp, Triticum aestivum
  unsure (1)..(511): unsure at all n locations
  Clone ID: PAT_TA_84967
tggcaaaactcctcacaggatatcaagatatggttggttttttgcatgtccacaaggtggcacaacctaacagtcaggtccctgtgatcttagaggcatccacgctctctctaaagctgcgaaagaggaggtccctggtcttagaacggttgaatcaggctccagtcgatgggtcaagtgggccttcgtctgctgcatcaagcagttgctcatcgcaaggttcacagcttgatttctaattggtatggctggatttccttgagaggagctcanaaagtgctgtgtactaagttactcgtggcanaatgcagcttttgggaggtttaggttttagataggagtcagtttgatggttcactgttaaccatcctccctcatgtaaccccactttcaacaagtattagaaccgtcgaaacttgtaaatttttcgggtagtntccaagttgttgaactgccntgaacaggttacaaantgtggggtttcctggtttgtcngtccaaaaaaaaaaaa

SEQ ID NO: 84968 - DNA, 180 bp, Triticum aestivum
  Clone ID: PAT_TA_84968
cgggtatttataatgtgtaaagagtgcttgtggtgtggatggtctgcacggatggcctgcatcctgtggtgcgtgtaattttgatgtgcatgtttgccgtgcagcacagacgacgatttcacgtctgcatggccaacccgttctgtatatgaaaagaaacaggtgcctaaaaaaaaaaaa

SEQ ID NO: 84969 - DNA, 528 bp, Triticum aestivum
  unsure (1)..(528): unsure at all n locations
  Clone ID: PAT_TA_84969
ctcgtgccgcgaccctgcttgaggctcttgaccagatcaccgagcccaagagaccttcggacaagcccctgcgtctccccctgcaggatgtgtacaagattggtggtattggaactgtaccggttggtcgtgtggagactggtgtcatcaagcctggtatggttgtcaccttcggtccaactggcctgactactgaggtgaagtctgttgagatgcaccacgaggctcttcaggaggcccttcctggtgacaatgttggcttcaacgtgaagaacgttgctgtgaaggatctcaagcgtgggttttgtggcctcaaactccaaggatgaccctgccaaggaggctgccagcttcacgtcccaggtcatcatcatgaaccaccctgggccagatcggtaacggntatcccagtgctggactgcatacctcccatattgctgtcaagtttgctgagctgattacaagattnaaggcttctggnaangagttganaaagaccaattctgaaaaacggcatctggtatggng

SEQ ID NO: 84970 - DNA, 415 bp, Triticum aestivum
  unsure (1)..(415): unsure at all n locations
  Clone ID: PAT_TA_84970
ctcgtgccgcgagttttttttttttttttttttttttttttttttttttttttttttcaataaagcaagacggcgcctatactcagactctgccacaaacatgaataatccaatgttaactgcacttacaatcnaattgggaaaaaagattanccccncattcttttgccgtcgctgcttgttaaagggcacgttaactaacaaagccaagnacaggggacgaccaancaggtanaaccgcaccgngggctnattaacccccattgggncnanccaagccacttaaaaagcttcngaaancttttgnataacccaagggttctccaaggngcccctgggccgcccttggnttcncctgnaaancatttagcacctgtcncatgatagggtcggtaanaatgtccgggatcccggg

SEQ ID NO: 84971 - DNA, 529 bp, Triticum aestivum
  unsure (1)..(529): unsure at all n locations
  Clone ID: PAT_TA_84971
actgacgctccttcaagcctagtagcaactgccccactacacacaatccacgttgcgcataccgtagcgaccctcctcgtcggggcttcgccgtagtgcctcgccgaagcaccttgccagccacgccatgcccactgccgtgcgcagggagccgcgccgcgaccgggcgtcgtcgaacgcagaganccccccccncccccccccgctgcttcgcagctcccgtccgtcgcgcgtcattgaacacccgtgtgctggaacttccccaagccaagttggtcacgcgctggagcgggcttcgccatctctcccaacgtgctacgtcgcaagatgtgatctgttcccgagcttcnagggattgacnatcaaattttggcggcaagtgatcaagcttttcaagatctacaagggtnaaaaacctgagnatcntttggtgaangttccnttggngaatcaagctcaaataaaggaaanatntcaaggnggtntctagggttcaagacttcacaantcnaggttagntacgactccc

SEQ ID NO: 84972 - DNA, 471 bp, Triticum aestivum
  unsure (1)..(471): unsure at all n locations
  Clone ID: PAT_TA_84972
acccatcaaaccaatgtatagctatatgatatatatagaaacagatgcacggtcaactaactatagttagtcaacatgtaaacaaaattccacatgattcccatccgtctgtgatcaccgacccaacaacgatttcccaagaacggattttgtctctgaatcaaacaaagaaagattcagatacccttctccagcatcgcccggaccccggtcgggagaccagagcctgatgaccccccctcggcgtcagcctggttatagatttccccgtcatcaaacgaggaagtctcctcccatgcttcccaccaatttcattgagctcagcgaggagacggatgtgggcgacacgtcttatccgttgatgcaaacaggaacacctgcgacgatgccaatcttctgatacctgatcattgcctttctcggggcatccacaagcaanatctgcatcaacttccttggnaacaggggggg

SEQ ID NO: 84973 - DNA, 473 bp, Triticum aestivum
  unsure (1)..(473): unsure at all n locations
  Clone ID: PAT_TA_84973
cccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtacgaacatggctcgagaaagcatgctcgtatgtgaatgctatcggtggtatgtatatgcacggcccatattttntccaatttcccannaaaancttttagggggccccaanaaaaaaaaaaaa

SEQ ID NO: 84974 - DNA, 532 bp, Triticum aestivum
  unsure (1)..(532): unsure at all n locations
  Clone ID: PAT_TA_84974
ggaaacctccgatcgaagcaaagccaaggctctctcgtcctcctcctcaagatgcagatctttgtgaagaccctcactggcaaaaccatcacccttgaggtcgagtcttctgacaccatcgacaatgttnaaggccaagatccaggataaggagggtatccctccggaccagcagcgactcatcttcgccggcaagcagctcgaggatggccgcaccttggctgactacaacatccagaaggagtccaccctccacctggtgctcangctccgtggtgggcatgcanattttcgtcaagaccctcactggcaagacattaccctcgaggtcgagtcttctgacacgatcgacaacgtcaaggcgaagatacaggacaaggagggattcccccggacaagcagcgcctcatcttcgccgggnaagcagtagaagatggccgcaccttgctgactanaaatcanaangggtcaacctccanttggngccaaggttcnngggggaatgaanttttcacaanaaccngacggnana

SEQ ID NO: 84975 - DNA, 528 bp, Triticum aestivum
  unsure (1)..(528): unsure at all n locations
  Clone ID: PAT_TA_84975
ctagtctcgagttttttttttttttttttgtctatgttcagcaactttaggtcagatatatacatacacaaagtagaagcacgaatgtataatcaacttagtccagcacaatgaagaatataaactttgcaacaattgcagatggttgcttcagctagggtggttaatgcgggaaacatatatacagattttgaactgaagtgtccaccataacatggcgcgcagcacgccatccagcccctggccttcacaactcaagctgccttcttgctcttgtatttgccagcacagaggacataaacaatcaggttcagaaaactgatgccagcgatgagcaagaagaagtaatcaagatggccttcgttcaagttgtcaggaatccacccagggttacctcccctcgtagtaaagtacgcaaccattgtcaaaatgaacgtgctgagatagtccaaacgcagtantgagaagattaagcgcgctgcagagntcctcaaggcgtctggtgactggtcatagaanaaccnaggg

SEQ ID NO: 84976 - DNA, 514 bp, Triticum aestivum
  unsure (1)..(514): unsure at all n locations
  Clone ID: PAT_TA_84976
tacacttctcttttcaccaatacagtcacgaagaagtactccagcagcagctgcagcagcagctgtattatagccggctaccaccaccgatccgtcgaccggagatgcagccggcctgctccggcgccgcgcttctcgccgccttcatcgccgtgctggcgtattcggccgcgcgctgccgcggccagctcgccgacaactactacgccggcaagtgcggcaacttcagcgtggaggccatcatccgggacgccgtcaaggcccgcctcgcgtgggacaagcggatggtcgccggcctcctccacctgcagttccacgactgcttcgtcgccgggtgcgacgcgtcatcctgctggacgggcctgacacggagaagacggcggtgcanaacagcggatcttcggtacaattatcaacaactnaaggnggcctcnaaaaaatttgcccgggngtcnnccctgngctanatntatccccgcaanagggacccnttgnattncggggggccaactan

SEQ ID NO: 84977 - DNA, 272 bp, Triticum aestivum
  unsure (1)..(272): unsure at all n locations
  Clone ID: PAT_TA_84977
gcgcgacgctgacggggcgtggacatggagtatagtantccaaagctgccgcgctcgtcctgggtgatgatggcgccgcggttanttaataancaagcagttcggttaanaacaccgggttattagtatcacgctgtctagttcgtggtggtagctagctaatatagctggcactgaacgtaaggtttggtgccatgaagggtgtcgtcgatcgtcctcctgccgtctctnnggngaaaagagcgannaaatccaacagcgtcaaggaccaa

SEQ ID NO: 84978 - DNA, 514 bp, Triticum aestivum
  unsure (1)..(514): unsure at all n locations
  Clone ID: PAT_TA_84978
gtcttgaagagcgaaagagcctctagccgagttggttaggtggtctgagtagcactcgtcctgatttcgaatcccagtgggagcgaatttcagactgaggttaaaaaatgtcactcgctggttcccctagtcgtgtgcacacgagatggactgacctatggggggcggatcctcgtgtaggggctgggagggctcaaagcacgagtaaagatttggcccatagggggcgaaccctcatgttgcacgggaggaccagctttcatgacctttctcggtcggggctctgattgagcttcttcttaatataatactgtgggggcggtctttcccctaacagccaagtaatgtcntgaaagaaatataaatttggggtgcaagagntcgctccttttcccccccttgattcattacggtgcctaaaataaagttgggccgcgtactttgttaagtctaatgcaaccttgcnacaaaggnatgctgaaattctttgggactttngatacaaanctacatt

SEQ ID NO: 84979 - DNA, 309 bp, Triticum aestivum
  Clone ID: PAT_TA_84979
tttggcgctcgtgacaagcaaaccattgtttttgtttttttttctcaagtaatgcaaaacatccgtcctcaagcatgtcaacggttgaaaggggctacaagatattgcagcacaaagtgaaagctgcacgtagactttagagtcggggattgtggcaatggtgtattttcttttgttctctagtaatgtagtggactccctgcgccagtttgtcataccttgtcgctgcgcaaaattttgtcacatgtaaacactgtatcatcacttctgttattgttgagctgatatcttctgtttaaaaaaaaaaaa

SEQ ID NO: 84980 - DNA, 522 bp, Triticum aestivum
  unsure (1)..(522): unsure at all n locations
  Clone ID: PAT_TA_84980
gagtttttttttgttcacagatgcaaacaatgtttccttttgtccaagatgttcttgttttaaaattgtcgattttcggacatttgtttataaatctgaaaaagttcctattttaaatttgttcacaaattcaaaaattgttcgtgtttgtccaaaaataggaattgaaaaaaggttcccactcttcaaaatttgttcacatattcagacattctttccgttttaaaatttggttacaaatctaaaaaatgggatttttttttcaacacttgttcgtgttttttgaaaattgttcagaatttcttttaaaagtattcaagatttttatgtaaatgttcgaaaaaatgggaaaatattttgatatgtcggtatttttaatactaatggatttccgtgatgaatatttgatatgttgctcccgactttgtccctggaggcctggactgttgtaanctgctccctgaagatngtcgatagctgaagcgtgaagaacacagatngtcactattacgnaacctcanc

SEQ ID NO: 84981 - DNA, 515 bp, Triticum aestivum
  unsure (1)..(515): unsure at all n locations
  Clone ID: PAT_TA_84981
gtcgacgcctaccgggcgacagacgaattttttagccttaccgatgatcaaccgatgttgttgctaggcccaccggtggcatcggggactgagaccaacacgcagaccggtgctgagactgagatcagcgctgagactcagaccggcatcgggaccggcgctgagattgagaccggtgttgtctcggggagcggagctggtgtagaaccgaaagcaaagaggcaacgacttcctaacaaactcgggactactaggctgggtgggtcatgggtgggtggatgacgacatttttgagccaaaggcgcccgaggaagcgcgctccgtgctacggcaatcaaataggctgcatccgtacagacaaccgccaccatcaaacgatgagaaactacagaagatagaaaatatgaggagtccctccctaaagatttcaccaagatatcctgttcccgggnccggatgagaaggattatgaagatcagacgaggaccgacaangaanaagataaacaaacacgc

SEQ ID NO: 84982 - DNA, 421 bp, Triticum aestivum
  unsure (1)..(421): unsure at all n locations
  Clone ID: PAT_TA_84982
gagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcntccggggccatgaggngcgcggcggagggcgcgngccgcgggcgaggccanngaggccgggcgcgccgccgccgccnctgccgagggctcgtgggtgcctcnaccccgtcacgggctactnccngcctcgccanccngggcgcnnccgtctaccctgccgancntcgggggcngcttanttcgcccggcacctacgcccngggncttgatcgggnccgggctctcttaaccttgtncngcctggtctc

SEQ ID NO: 84983 - DNA, 503 bp, Triticum aestivum
  Clone ID: PAT_TA_84983
cagacttcggacaagttcagaaacagtgcatgcctttcatcaagctgaagaaagtcgaaacaagcaactttggtcccaatgctctggagctgaagctccctttcagtgaaattgatgttcttgagcaaaatctggagctgatcaaaaggcagttgggccttgagcacgtggaggtgttgtcgacgtctgatgaagccactgttgccaaagctggcagctatgtttctgtgctgaacaagaccccgccttcccctggtgaaccggttgcagtattcatgaccaggcaggcgtttgaagccccccaaaactgagatcaatcaaggtgcatatgcaatgaaggcttgttaatccatccagctccaagatgtgaagatccaccaattattagaagaaatacattgctgttgcagaatcttgcatgcagtttttctttagagggcgaagcagaaggaagatgcaacggtaaccaagaatgaaagctgcaaatttgtgtagacaagcaa

SEQ ID NO: 84984 - DNA, 493 bp, Triticum aestivum
  unsure (1)..(493): unsure at all n locations
  Clone ID: PAT_TA_84984
ccagttcggcgttgcacatgtgacccgggcacccggcccccagcccccagctcccgaccatttctgcacatctacagctcgcgagctcagcaccagaacacgccaggccagcccaacctctccaagaacccaagcagcagcccccgaccgaccggccatgccaagggccatcggcggtggtgcggcctacaagngcggaatcaagggctactggaagcgccgcggctacgaccggatcgacgcggccgcggcgcagcgccgcccgcgcctccctacagcggagcttggcggcggcgaggcgcatcctcagccagcgggtggtcggcgccgccgcgggtggcgcgttcgccggcgagcgggcgtcctcggccggcgcctcctccgcgcgctctccccgcggcggctgctggcgcggctccgcgacgcctacgtgaacgccatgctccgcctcgcgtctcggcgncgtgggcggtacggcggcgccnggnctatn

SEQ ID NO: 84985 - DNA, 491 bp, Triticum aestivum
  unsure (1)..(491): unsure at all n locations
  Clone ID: PAT_TA_84985
gtttgagccatctggactggactggaccctataaaaaacagatcagatctcccccaccctcgcttccccagcctgcaggttgtcgtcgccctcttcctcctccttcgctgttgctgttgctgttgcttccgcttccgccgccgccgccgcggaaatcaaactaatctgatcgagaccacaccgttccagagagatcccccaaacaaaaaaagagcacgggatcgaaatggagctcgacggcaagtacagcaaggaccagagcctcaaatgcgaatgcctcctcttcgacctcgatgacacactatacccgttcaactccggcattgctgccgacataaagaagaacatccaagactatatggtgcacaagctcggcgttgacgangccataagcttggacctatgcgtcctcctctacaagcagtacgggaccaccaatggctggctttganggctgttgggtacagtttgattacnatgactacannant

SEQ ID NO: 84986 - DNA, 500 bp, Triticum aestivum
  unsure (1)..(500): unsure at all n locations
  Clone ID: PAT_TA_84986
gttgtgacgatcaaggccaggcgggcgccagcgggcgcagagtaccagtttcctctttggtgctaaaggggcaagcgtaggcgaggagtcccgaggcatcaggaaaatgtttccatatcggtgcaacgagaccaagaccagcaggacgacaggacggaggtcaccacggagcccactgcggcatcaccaccagagcctttggtaggcgaagaccaccttttgtcaggataagttgtactagttgtctcccttcaaaattggccgttgtgggatctcttcctgcctaacatttgggaagaggaccagggcctctataaataggactaaccaccaccctagctaggggacggatcattcagaccatcctcgcacacacaagctcancgggctcaagaacacctctcctcaagaggccgttcaacccttgtacttgttcatcctctgcctacaaggcaaccaccacaccacactggagtanggtattacaccgcaacggtggn

SEQ ID NO: 84987 - DNA, 494 bp, Triticum aestivum
  Clone ID: PAT_TA_84987
ttttttttttttttttttttttttcaaacatctgatctgttgaactcgcattgctaggtcatggctagctagggttgctggaagccattattagttcctgtctagaactagaagtacaaaaaagggccacaagtaaaactataaaaaaatcaacgtacgcaaagcaaatgaaaatgaaatagcatcttttggcctccagctttgaaaatctgataggaaactcttaaggctgtccttcgccgaatccagatccgtggcctttaccgccaccagtcccaccgtcgcgaccaccgcccatgccaccaccattgccagaagcatctgcgcttgcgtacggtggtgtggccgagggcgggtcgccggagctagcctcactagagccggatccggtgccaccgccggtaccgtagccaccggagccttggttctccgagccctgtcaaccgccgccgccgccacggatgcccccggcaagatagacccgccattaccga

SEQ ID NO: 84988 - DNA, 487 bp, Triticum aestivum
  unsure (1)..(487): unsure at all n locations
  Clone ID: PAT_TA_84988
tttttttttttttttttagcgtcaaactcagattttggaacatgagtgatcaacaacaaagtgttgatgattcacaaataaacaagtccttgcagggttacatgacgcagttacgagcagcgccgacagagaaaccagcaacatataactacaacaaggggaacatcaacacaagagatgcctacaaagggcgagcgtgcaagcctaggaggaggtgaacttggtgacggccttggtgccctcagagacggcgtgcttggcgagctcgccggggagcacgaggcgcacggaggtctggatctcgcgggacgtgatggtgggcttcttgttgtagcgcgcgagcttggcggcctcgccggccaagcttctcgaagatgtcgttgatgaaggagttcatgatggacatggncttggacgagatgccgattccgggtgcanctgcttcagcancttgaagatgtagatcttgtacgtctccacctcntct

SEQ ID NO: 84989 - DNA, 498 bp, Triticum aestivum
  unsure (1)..(498): unsure at all n locations
  Clone ID: PAT_TA_84989
gatgatgctgatgtgtacagtcaggcagcttcaaaccttgtatctggcaacaatctagaacagactatccaacaaattcttgacatgggtggtggtacatgggaacgtgatactgttgttcgtgctctacgtgctgcatacaataaccccgagagagctatagactacctgtattctggaattcctgagaatgtggaggctcagcctgttgcccgagcacctgctgctggccaacaaacaaatcagcaggccgcatcacccgctcagccagcagttgcattgccagtgcagccatcacctgcctctgcagggcctaatgcaaacctttgaacctttttcctcaaggtgttccaagtggtgggtccaaccaggtgttgttccaagtgcaagatctgggtgctcctgatgccttgcgacaacttccacagtttcaaagcacccttcagttagtccaagctaatcctcaaaatcttgcanccaatgcttcaaagagctagg

SEQ ID NO: 84990 - DNA, 248 bp, Triticum aestivum
  unsure (1)..(248): unsure at all n locations
  Clone ID: PAT_TA_84990
ccgccgcgacggcgctgctagctagtctttggtgttgcaggtgttcgattcctgattccaaattccagactccaaactcggttcttcaatcgacagattccgatttacatcccaaagctcttcggattgaaatccagccgcgacccaagagataagagtatttgggattagtagatagggagggtagataggatagtagaatagaagaggagcactttcgctgatgatanggagggaggagaacgaac

SEQ ID NO: 84991 - DNA, 486 bp, Triticum aestivum
  Clone ID: PAT_TA_84991
tcctgctctcgtgccttccggccgtatgggtgcttgccgcggcggcggggcggagtcccggctgcgcgacgaggtgcggcgagatcgacgtcccgtacccgttcggcctggacccgcagtgcgcgatccacgccggcttttggctcaactgcaccaccgtggatggcgccaccaagctgctcgacaagaactcggaggtgaccaagatctccgtggaggatggcaaggcctggttcaagaacttcatctcccggcagtgctacaaccaatcctcgggtgacatgttcgaaaacaacgcgtgggtcgactataccggcgagccctacgttctgtcggcagaggataataagatcatcgtcctcgggtgcaatagtatggcctacatgcagagcgactcttacataatcggctgcatgtcgacatgcgacgaccaactgaagaacggctcatgctccggcaccgctggctgctgcaagcggagctccc

SEQ ID NO: 84992 - DNA, 485 bp, Triticum aestivum
  Clone ID: PAT_TA_84992
gtttctgcttcattatctctgtatcatactagcacttattaggttgcaacttgattgtttaggtactagatttgatctgattgtgaattaccagatggttggtgcaggtaggagaggtggatttggtggacctagattcgatgtgcagagagcgacttggaggtggctgacatcttcaagcactgcatcatgcagttacaactactgttggccatacagggaaatgctgggcctattataccaattgttcaaagcatggaccttgtataattacatgtttttatcatagatagattaatttctgaaatgcccatagattggtatatttgtggaaatttatttgccaactgtaagcccgtcgtgatgcatagaacatttgtggtataagatttttctgttgatgtttgcaggtaatttttccaagcacttgacattcgagtgaaaaatgtcgcaaggacatattctcttgaacataaaggagaaaa

SEQ ID NO: 84993 - DNA, 180 bp, Triticum aestivum
  Clone ID: PAT_TA_84993
gttaaatcaatcaatcaaatgacgacgatgtaaagcaggattgttacaaaaaccttttgctggcttcgcaactgatgtctctgcatccatctgttctagaatcaggagtgcctgtcgattgttaagcccactggtctggatgtagcgaacggttgaagcatccagtgtaaaaaaaaaaaa

SEQ ID NO: 84994 - DNA, 491 bp, Triticum aestivum
  unsure (1)..(491): unsure at all n locations
  Clone ID: PAT_TA_84994
caccctcttcccgccgcgccgccgccgccgccgctgcctccccgccgccgggctagatgggtcgcgtgatccgcgcgcagcgtaagggtgcggggtccgtgttcaagtcccacacccaccaccgcaagggccccgcccggttccgctccctcgacttcggcgagcgcaacgggtacctcaagggcgtagtcaccgacgtgatccacgaccccggacgcggcgccccgctcgccaaggtcactttccgccaacccttcaggtacaagcaccagaagggagtcttcgtcgccgccgaagggcatgtacactggccagttcgtctactgcggncgccgcgccacgctctccatcggcaacgtcctgccgctccgcgggattcccganggtgccgttcgtctgcaacgtcnagcacactccgtgacgcggtgtcttcncaaggctctggggactacgcatctgataagcanaacctgacaanggactcanggggg

SEQ ID NO: 84995 - DNA, 499 bp, Triticum aestivum
  unsure (1)..(499): unsure at all n locations
  Clone ID: PAT_TA_84995
ccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctgttgtgaacgacaaggcctccaatataccatatactcccaaagtctacccgtacgacaacttgagagctgagcttgggtgatagaccatagaaggtttttgtctgtttgacaaggcactttgatgaatatgatctgagatctatatctcctttccatcaagagagaagcagggggaaacttatttaccatggttttttggtgactgccttgttgtaaacaccgttatgtgatttgctgaatattgtgaacatgggtttgncctacataatgcaacaagctctnn

SEQ ID NO: 84996 - DNA, 490 bp, Triticum aestivum
  unsure (1)..(490): unsure at all n locations
  Clone ID: PAT_TA_84996
gtttttttttttttttttttcaacaccaagtattatttttttactctttagacattttacatagttgggaataactaactatacacagaataagccattttgagtttacaggtttgagggggaacaaatgacgctcggagagctgcgtgttgctcaatacacggcattcagacaactcatatcacacaattactgaacacagatatgtagggggaacctacctgcaggcaggcttaattagcgagcttgaagtagagtatgagaaggatggccagaacgagagccgtgataattcccccaatgatccacttgttcctatccatcctctttgacattgcagccaggatcttccttgctcctgccaatgttgtcatcaactcccgtgcaaagtatatgagcatgtagtaatgactgcnctgttggtgaagatcctgaagaattgacacaccaactcctccgtccccaacatagtctccgntcccttaatctt

SEQ ID NO: 84997 - DNA, 490 bp, Triticum aestivum
  unsure (1)..(490): unsure at all n locations
  Clone ID: PAT_TA_84997
ggaatatgaattatgagaagagtcttgttgacatcttgcatgagcataataatccaagatttaggggtcaaaatggttggattccggagggctggcgtagtataactcaaatgttcaatgagaaatttcctctagctcaattttcgaaagcgcaaatccaagagaaagaaaaagagctcaaagcaaattacaagttaataaaggaagcccggaaacaaagtggggctgggatggaatgacagccttggcatgataaatgcattgccaccaatatgggacaagaataattnaaaaccatccaaagatgaagaattccaatcaaaagcatttcctctcctacaaccaattgggnatggctatatcaaggnagctgtgcaaccggagatntaaattttacatcccacgcaacaactacaccggtcancaagtttcaaacctccaagatgatcctttnaatnaantgtaactcnttnaggatgatgactttacn

SEQ ID NO: 84998 - DNA, 302 bp, Triticum aestivum
  Clone ID: PAT_TA_84998
cctggcatcgctgacaggatgagcaaggagattactgccctcgcgccgagcagcatgaagatcaaggtcgtggcgcctcctgagagaaaatacagtgtttggattggtggctcgatccttgcgtcgctcagtacgttccagcagatgtggatatccaaggatgagtacgatgagtctggccctgctatcgtccaccgaaaatgcttctgagctagctatctgccgcgcctttcatagcgtgtcaagctgttgagatctgcgttgttgagttgagtgtctctatggagtatcacatactcgat

SEQ ID NO: 84999 - DNA, 245 bp, Triticum aestivum
  Clone ID: PAT_TA_84999
gaatatctctctctctctctctctctctctctctctctctctgcctgcctgcctcacaggctgaaaggcgtgtacatttctgatcagcaccaccggtcgcccgtcggtgcgcgcgtgcatgtaaagcaggcaccaccagctgcagcccaagtgcgtgcatgagcatgacgagtcatgcaatgtgttgtacgtattttacatgatgataagaataacaaaccgtgtttagctgcaaaaaaaaaaaa

SEQ ID NO: 85000 - DNA, 478 bp, Triticum aestivum
  unsure (1)..(478): unsure at all n locations
  Clone ID: PAT_TA_85000
tcgagttttttttttttttttttttttttttttttttttttttttcagtcattatcgatcttttgttcaaatctagatcattccaaaacttttatttacctctcacggttgtaggtaggagcaggcttgggcttattatcaagaatcttctcaatctcctccaaaaccttatcatcgatcttcttgtaaatctcaagcgccttgaagttatcctcaagctgctcaacctttgtcgcaccgagaatgacagtgctgacgttggggttcttgagggcccaggcaagagagagctgagcgacgtttccgccgagacgctcagcgacttcggacagcttcttgaccttctcgatcttgggccttgccggcttcggtctgaagctcgttgacggtgttcccaaanaaggcttgttgggggcnaacntgagccncgggaatcccgttgtggacttgcaatcaagagaccggaggcgagagggga

SEQ ID NO: 85001 - DNA, 501 bp, Triticum aestivum
  unsure (1)..(501): unsure at all n locations
  Clone ID: PAT_TA_85001
ctggtctgccattccctcgctccttcccgtgaaccacaaacctaacgcggagcggcgcgggccggccgccgggcgaggtgcgcgtagctgccgtcgattgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcccgggagcacgcccgaggccaagcatcccaagacagacgtttaccaatgcttcccccancctnaagaagtgaaaagcctgaactttacaaccattctggttgggcactacgatttgggccaangggcttnccttgtgttnanggtgtcatccgtgttanctcccgtcnancatgctcctgtcctaagttacctacattagaaangatgtggtnccatn

SEQ ID NO: 85002 - DNA, 456 bp, Triticum aestivum
  unsure (1)..(456): unsure at all n locations
  Clone ID: PAT_TA_85002
ggtcaaaatccctgaggatgtggctgttaatgttgccctgtcactgagatatgagatcaacaggggctttgctaccttaagggagattgggcatggccgtgatctgaagaaattcctaattgttattgcaggtctctggcttctttcagttctcgggagctgctgcaacttcctgacactgttctatattgtctttgtggcactgtacactgtaccagttctgtatgagaaatatgaggacaaggttgatgcttttgggtgagaaggctatgactgaactgaagaagtattatgccattttcgatgagaagtgcctatcgaagattcccaaagggcccctttaaggataagaacactagattggtantaaggaattgctatgaatcaacatctacattaatgtccactantgtcactctttccccnnaaggatnggcttggncctggccccaantt

SEQ ID NO: 85003 - DNA, 468 bp, Triticum aestivum
  unsure (1)..(468): unsure at all n locations
  Clone ID: PAT_TA_85003
tctcgctctcgcggctctcggcggatcggcgttcagtgaaagctaaaagcctaaaaccctagttcgaacctctactagccggcgacagcggcggtggagcgcgggatacccggagatgccagcgccgtctgcggttgcgtcggccgtagagaggctacaggcagcggcgcaggacgccgccaagtcctcgtcgcgctcggccggcgccttctccgagcaggcgcagcaggccctcgtgtccaaggaccgccggacggttgtttctcctgtcaacatgtgcaaaggtcaattgccattagctttgcgattggtgttgtggcaaggttcacactccaaagaaaagntgcccaaaattggctgctanacngcttaaaganatttaagggcgacgaccattggctaagngatnttttcccaatggccttggggtttggttaaaaatcaaaacttgggnaacaanttcctaaa

SEQ ID NO: 85004 - DNA, 445 bp, Triticum aestivum
  unsure (1)..(445): unsure at all n locations
  Clone ID: PAT_TA_85004
tcggcgccagccttaggtcggccatcgtcgacaatttctgggactaccttgacgcccccatcatgtgcctgtcatctcaggatgtgcctacgccatatgctgcgactctggaggatgcaaccgttgtgcagcctgcccagatcgtggctgcggtggaacaactatgtgcatagattgtggcctgggacgtttgggagactgttgttgccatgaaaaagccttccgtttgttagtttgtgctgtaacaagcattctttgggagacttaaggtgtaggcttatagtccgttttgttcttgttttaagaagtataatccagttcgtactgcacggctcaatcttcttgttccnaatcggcgctatgcaatgccaatttgatggtccgaaaattcattgttngacaagaataacaattggactcccgatccaagaacctgtanccccaa

SEQ ID NO: 85005 - DNA, 450 bp, Triticum aestivum
  unsure (1)..(450): unsure at all n locations
  Clone ID: PAT_TA_85005
gtacacaccctttccaccgcctcaacagcctagcaagattgatcttgaacttgagaacggtgagtatttcatgagtgacaaaaagaaatcagcaaagaaatggcaagagaagctggacaagcaatctgggagagctgaagaaaataaaagaaaaagagaggctgcatttgttcctccaaagggagaacactgcaggtccatccaaatctgacaagaatgccagtgacaacagtgagatagcccgatatagcgaaagtccattaaagagaaaaggcgaaaggattttagaaaagaacgaggccaaggagagtgtccatagctgaacatatatcgcaaagtnatggattaatttgcggcaaaaaaagaanaagaancaacttagnccaaagttgccctnacctcaatgcataatgacactgggcattttanaaaggttgcntggnccccccc

SEQ ID NO: 85006 - DNA, 403 bp, Triticum aestivum
  unsure (1)..(403): unsure at all n locations
  Clone ID: PAT_TA_85006
accgtcctcaggacaaggcacctcagaagcccttctcgtccgcgccgcctccttgaccccgctggccggcgagctgctcagcgcggcttttttttgcatccacaatgccgcagcttggcacatgttcattgcctggagctgcaatctatggcacttcaactaggagatttggaggtttggagtttcagcaacataaagttaatcacatctcatttggtcggaaagcgtctgttaaagcaacattgaaaactgtgagatgcaatgccactcaaacacaaagcgtccaaaagaaatcttcaagtgcaactattcagcgtgataagaaaggaatgtacaagggccaaaactggatgacggaagcggtggggttccctccattcccgctttggaagggggtggnggg

SEQ ID NO: 85007 - DNA, 286 bp, Triticum aestivum
  Clone ID: PAT_TA_85007
gcttgtcatagttccttggggccttcacaaattgcttaactatatagtgaagaaatacaacaacccagtaatttatgttactgagaatggcatggatgatgaagacgatcagtccgcgacgattgaccaggtcctaaacgacacgaagagagtcggctacttcaaaggatacctcaattcggttgcacaggcgatcaaggacggggctgatgtccgtgggtacttcgcgtggtcattcctggacaacttcgagtggggctatggggctacaccaaggaggttcggg

SEQ ID NO: 85008 - DNA, 508 bp, Triticum aestivum
  unsure (1)..(508): unsure at all n locations
  Clone ID: PAT_TA_85008
cacacgcgcggctgggtgtcgaggccgggagacgcggtgaagctagctgctagcgtagccgcgcgcggcgggcgggctcgagctgcgctgtcgctccatgtcggccaccgccgagagcggtggggatctgtcnggcggcgcgccgccggtgggatctcaccaacaagggggccgagagcaccccaattttgaaagatgctgtggaaatatctacagatgaagaatcagatggtgttgttacatgccatccgaatggtaacactgatggatgcgaaagaaactattaagtggcagtcacgattgatgatagccagnaaggccaagaaactantccattaaaggaccgatgtacaaggtgacacacagggaagacaaactttaaatcaaatcatccaagttnattgatgaaganctgtctcccaaagtcccaacaaaatccgcgactgcaattctaaatntgngaaggctaaactgttgttcccgacaatttcncttccaatcaaagaat

SEQ ID NO: 85009 - DNA, 263 bp, Triticum aestivum
  unsure (1)..(263): unsure at all n locations
  Clone ID: PAT_TA_85009
aaaaaatcccccattttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaantcctcccaagggggggggggc

SEQ ID NO: 85010 - DNA, 512 bp, Triticum aestivum
  unsure (1)..(512): unsure at all n locations
  Clone ID: PAT_TA_85010
ccagtttgcatgcttgcgtgccataaagggtggtagtgcccaagtccggtttcagcctcatgttggacagtttttagccgcagctgctgaaaacgtggtttccatatttgacattgagacacatgggaaaaaatacactctacagggccataacactgatgtgcagtcagtgtgctgggacaacaatggggaatatattgcatctgtcagtcaggacctagttaaggtttggtcaatgtcaactgggggattgcatttatgagcttaagttccaatgggaaacaantccattcttgccgtgttccaccccgagctattccaactcttgggtattgggaggctaccatctctccgaggtttgggaacatggtgaaaaaccagagcctaaccgtacaactcatgaaagtctaattngcggcgctngcgcatcaccatcacaaggatgatacttcctgctaaccatgacacccttcaaggtgtgggaataacagttacaacgattatgatcactn

SEQ ID NO: 85011 - DNA, 405 bp, Triticum aestivum
  unsure (1)..(405): unsure at all n locations
  Clone ID: PAT_TA_85011
gtgagcccagacatcctcctctaagattagcttttagctagcactagctagctagctcgatcatctgtcggtcggtccggcgcgcgcgagaccatggcgtccatcatcgtcatcgccgtcgtgctcgtcctggacgtcctcgccttcgtgctcgccatcggcgccgagcggcgccggagctacgccaacgtgaccgccgccgactccgtccgggcgtgcctactgcgtgtacagtccgaacgcgtccacggcgtacggcgtgagcgcgctngctgctgctgctcgccgcgcaagccgtgggcatggccgccaccgctgcttctgctgcggccgcggtctctcgccgggccgctggcgggcatgtccnggaactgcttaatcatctgctgcgcancgcaaggtgac

SEQ ID NO: 85012 - DNA, 514 bp, Triticum aestivum
  unsure (1)..(514): unsure at all n locations
  Clone ID: PAT_TA_85012
aagaaactcgccatattcacagcccttgcattttctcaaaagctgtcagggcttcctccggagacagtgttccagccattgctcaaggataatctggttgccaaagggatagtactttcattcataactgagtttttcaaggagtacctgaaggaaaacaccttgggatgatttgattgcgcttttgaagaaaggaaaaatggaggacaatctgttggacttttttccatcaagctaagagatcctcctgaggctttatctgagcatttcatncaaagaaggtctgactagccttgttgagtacaatgaaaagaagatgtttgaagttaaacttaaagagataaagtcaacactgaccactatgatcaatgatgaggctgcaatacctgaagtgattgagactgtcaaacagcaagttaaggatgctaaatttcctgatctanagtcatcccagttgtgggatgtgctcatggaggtgtcnatgggccgggaanaacacaacngatctaatcan

SEQ ID NO: 85013 - DNA, 518 bp, Triticum aestivum
  unsure (1)..(518): unsure at all n locations
  Clone ID: PAT_TA_85013
tcaccagtcaccacaatggcgtctgaatccgaggcctgcagctgggagccgcacctgctccaccccaacggcactgagccgctgcaccggatcgccgtggactactgcccggaggcgtgcctccacgagcgccacgcgggggagatccacgtcacctacgacgaccgcggcggcgcgcgctggcgctcctgctgccggttcctgcccggcagcgccgtggccaccacgatnccgcgcgccggcgggggacacgtccggactcaactacaacatctacttgtcctccctgggagggttccgcccgaccaagacgagttcgactcngattcctcggcacgacaagcgcgctgttccagacaaactactacttccggngcaacggcgggcgggagaaattcaagcgtccctttcgatcctctgacggntcaacaatanccatcgcctgggacgcggccgcatccagtgngcgtcaacgggactcntcngngcganaaagggccaggggaaccttggccgaa

SEQ ID NO: 85014 - DNA, 527 bp, Triticum aestivum
  unsure (1)..(527): unsure at all n locations
  Clone ID: PAT_TA_85014
cccagatccacgcgtttcggagttctagctgcgtttattgaccgcccattctctccaaggcatttttcccctcgtcctccctgcgatttcgcgacctccatccaatccctctgcacggagaatcggctaatggcggaggaggggtacaaggtgacgctgaacgtgtacgacctcagcaacggcctcgcgcggcagctgtccacctccttcctcggcaagcccattgaggccatctggcacacgggagtggtggtgtacgggaacgagtactacttcggcggcgggatccagtcgtcccccgcggggacgacgccgttacgggcggccgctgcgggtggtgggagctgggcgtcacgcacatccccgcgggaagtgttccgaggactactccgcgacatcgcgccccggtacacgggcgagactaccgcctgctcaaccacaactgcaacaacttcagccacangtggcgcantcctcgtcggnactggcgccgggntgccgactcatctcaactccccgccgagtan

SEQ ID NO: 85015 - DNA, 513 bp, Triticum aestivum
  unsure (1)..(513): unsure at all n locations
  Clone ID: PAT_TA_85015
ctcgtgccgctttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtccgtatcaacttcctgctcgctcatgcacaccgctgtggatcttgtgaacgagactaagcttgacagcgagattaatcttggcttgcttttgctgcccaaaangttgttgangttgatgcccttgctaaagcattggctgggtcaaaaggatgangcttacttcgcaacaaatgctgctgctcagctccnaagggggggcccggtaccaaatncccnaaaaagnntcctattangcgcgctcactggccgtcttttanaan

SEQ ID NO: 85016 - DNA, 222 bp, Triticum aestivum
  Clone ID: PAT_TA_85016
tcgaccaggggtcgcacttcgtcaaggtgggcgacgacgagttcgagttgagcttcatggcctgagccggccggggttggatcgaacacgataaacctgctggctgctgcttcagcagaggaggatttcgatcatatatatccataagtgtaatcacctaacttatctgaacgagagatggtaaattaaaagcgagatcatccttttttcaaaaaaaaaaaa

SEQ ID NO: 85017 - DNA, 539 bp, Triticum aestivum
  unsure (1)..(539): unsure at all n locations
  Clone ID: PAT_TA_85017
tgcatctccaatccttagcctagcaaaaaacaggcaactatgatattagtttacaaggattcagcaagtatcattcctagtaactagacgcatgtaatccttggtttgcaagcatcattttacttagaccaagtccatataattctgtagttgctctaatccagggaatcaattttttaaaagtcccagcagattattgatggtaacaagcatagaagtatggtcatggcacaatgcacacactaattcagcacatttatgccagatttgtactgtctcatttttttctgcatgatcaagtcaaccactaaccttttgttccatccaaggagctggcggtcatctttccagttaatagccggaggccgcgggagatatctcaccctttctacgctgctccgcggacatcccagtttgagcgcccgtgctacaaaccgccggngccaantccccanacctgcttgccgccatgancccaacaacatagccggtgtcctccgccgccaagaatccaatcacaatgtctgntcaagaaccgt

SEQ ID NO: 85018 - DNA, 540 bp, Triticum aestivum
  unsure (1)..(540): unsure at all n locations
  Clone ID: PAT_TA_85018
caaacatcctgctgacagatagctatcgggccaaggtgtctgactttgggtttgcaagaagtggccctagtgacacggagaagacacacatatcaacgaaagtgaaaggcacagctgggtacctggaccccgaatacttgaggacataccagctaactccaaagagtgatgtcttctcatttggcatattgcttgtagaaattctttctgctcgcagacccgtagagctgaagcgaacccctgaagagaggatcacaatcaagatggactttcaaaaaattcaacgaaggcaacacgagagagatactggacccattgctggaagatcacgtggacgacgaggtgcttgaaaactccttaacctggctttccaaatgcgctgctcccgacacgggacgaccggccgacatgaaggaanttggggagcactgtnggagataaggaaaganacggaaagatgttaggaaggtgtgaantcatgggaaacattccctgttctcaaagattccctggacaaagggacnaaggggtgttgggttn

SEQ ID NO: 85019 - DNA, 540 bp, Triticum aestivum
  unsure (1)..(540): unsure at all n locations
  Clone ID: PAT_TA_85019
cgagtttttttttttttttttttatagagagaaaaatcatactaccaacatgtgtttcttagttttggacaggccttgaccaaaaaggtaagagcatcccttctcaatcagagccgtggaaccatagccaaatttgccaagtgttaaagaagcaaaagaaatacaggaagaaattcactaatcaggtttcatgaagagctagtttctgcagaatgacaaaaggggaaaagtagcgataacaaccattgggagtgaaaacatttattctgtgttgtcgattgggagtgataacaaccatttcttctgctgcaccaagaatcaagtccgattatcacagttccctcctgccacaaacacatattctttattttctgaactgtatgactttgttccaacaaacgctttccgactggcacacttggtgatcnggaccctgctttggngggtttccccaaggagaaacggaaggctgcctcctttantacccctcgctccacaaggggatgatcacangatcatagcaacacaangncaacaagg

SEQ ID NO: 85020 - DNA, 218 bp, Triticum aestivum
  Clone ID: PAT_TA_85020
tatctcttcgcctctttgcaccaagttctctgcagttgcaggaattcgcagaataggccgaaacagtggtccaggcaaattttgcacaattcctttctattttttggagtttgtgaatttggcctgctaaaagtactatttactagtacttgcctgtcttagaccctgttaattactgtattttctgttgaattttaaaattccagaaaaaaaaaaaa

SEQ ID NO: 85021 - DNA, 553 bp, Triticum aestivum
  unsure (1)..(553): unsure at all n locations
  Clone ID: PAT_TA_85021
tttttttgaacttaaatctatctgcccctaatacaatgttggcatcaccgtacccgactcgcaatctcttctatccacatccccattcaaccagaatggtaaaagtcaatttcaaacataaacattaaactaaattaactaaactgttcttgatattgacctaaaataagaagccgaaaaatcaaacttccttatgaacaagagttgttgtacaaaaggtttacctagctaaccatgaatttataagagagtatgaaatcagtcgacaataatcctcaagaagcgcctccaccctgtccttctccctctttccatctgtatcctctttcacccctcttctctcctctctcatccatcctcttccttttcacatccatccgtgctctgcaaccttcntccttgccgttattgtcctatcaagcaaaaccaaggacanaacatttggtccctggatnaaagctacagatngcactcatcccaaagtgacaactaatgacctgtgagatgacaaggaaacaaganggaagacaatctgcaaaacanttattaatcn

SEQ ID NO: 85022 - DNA, 546 bp, Triticum aestivum
  unsure (1)..(546): unsure at all n locations
  Clone ID: PAT_TA_85022
ctagtctcgagtttttttttttttttttttttatataatctctcgtatactttcaaatataaccgaaggtagtaacaaatgcatgagattttccccaaagctgtttttacagcagtaacaacaacacttcatgtccaaagatgatattgatattcaggacaacattatttgggcccagttcaaacataactcagagtccattcagctcggtgatacctgacccaacgccatgcaaacatttcaagtagcttccccacaatgtactcaatagctaggcttgctctttctttgggctcccaaaggctgatacctccgtccagtccctttgtccccggattcaaaagcatgccccttggagtggnagattaagtcctcaacctcaaccggagtaantccngcttgggctcnacaaggtacctagcatcctccgggtcaagcacttaaccccaatgcnaccgtgagttggncaaccnccaagccatcaaggagnactggggagcatggtacgacttcncgnatatcnaccactaagcctcgtacgagngn

SEQ ID NO: 85023 - DNA, 424 bp, Triticum aestivum
  unsure (1)..(424): unsure at all n locations
  Clone ID: PAT_TA_85023
cagacatccggtcctctttccccaagctagctagctcgcccagccaagcctgaagcgcgcggccataggagcagaagccaagcacaaggcaaactaataagttaggtagagatcgacagaaatgggcaacgtgctgccatgcctggtccaacaagcaggcacagcagcaggggctctgccagccatgaaccccaagcggaggctcatctccctcaaactcctcacgaaggccatccacaagatgaagaagaggtcggtcccggcaaggcggccaagatagacagcaaaccgttaccgtctnnggnttggaaggaagggagaangttcgtgttttaagccaagaagcaaggcaaccaagcaacaccaacaaccgcaanggtgccgtgctgaggacgaggtccatggccggagcaatggctgttaa

SEQ ID NO: 85024 - DNA, 401 bp, Triticum aestivum
  unsure (1)..(401): unsure at all n locations
  Clone ID: PAT_TA_85024
ctggagtgaagcatattgtgctggtgggatctatgggaggaacaaatcctaaccatccgctgaacagcatgggtaatggcaatatactggtatggaagcgcaaagcagaacagtatttggcagacagtggaatcccttatacaatcataaggccaggaggtctacaagacaaggacggaggagtgagagagctacttgtggggaaagacgatgaacttctccagactgacacaaagtcgattcctagagccgatgtggctgaggttgtgtccaggctctgcagtacgaaagaggcaattcaagcatttgatttggcctcaaanctgaaggtgtgggcacgccaacaaaagattttaggnactgttccccanatnactgcccgttttnagcnaactgctaaa

SEQ ID NO: 85025 - DNA, 513 bp, Triticum aestivum
  unsure (1)..(513): unsure at all n locations
  Clone ID: PAT_TA_85025
cgaactaacagttgcggagaagaacattcttctagaagttgaacctattaaattacgtgtgagaagcatcttccgtgaagcatgtgacggtgttagacttaatccagaagacgagaagtttatcctggagaaagttcttgagcaccacccggaaaagcaatccaaggtgtctggtgaaatcgactacctaacggtcaacaagcaccagactttccaaggacactcggtgctttttccgtgggtctccacagatggatcccaggcaagtttctcctacctgaagtgcctggagaacttgtgagaaagagctacacggaggacgccgacacattctgcatgaagtactttaaggcccgtcgcaagnaagcacaaccagctgatgtttgggacaanatcaagggccccggatgagttccaccgtcaaccgnantgagacagacaagggatcctccaaccctcaagcagagttcacaaggagactggggtncccgaattcctcngaagggggaaccc

SEQ ID NO: 85026 - DNA, 356 bp, Triticum aestivum
  unsure (1)..(356): unsure at all n locations
  Clone ID: PAT_TA_85026
gtcgagttaggcaagatgcagattttcgtcaagaccctcacggggaagacgatcacccttgaggtggagtcttccgacaccatcgacaacgtcaagtccaagatccaggacaaggagggcatcccccctgaccagcagcgcctcatcttcgctggcaagcagctcgaggatggccgcaccctgagcgactacaacatccaagaaggagtctacgctccacctgggtcctccgcctccgcggtgggtatggccaagaagcgcaagaagaaggtctacaccacccccaagaagttcaagcacaaagcgcaaagaagaccaagctggntgtcctcaaagtactacaangtcgatctgaa

SEQ ID NO: 85027 - DNA, 527 bp, Triticum aestivum
  unsure (1)..(527): unsure at all n locations
  Clone ID: PAT_TA_85027
ttcatttcgaagccttgcaatttcactctttcagttgttgggctactgatcaactatactataccatgaagttattcacactccttttcacctctcatctcctttggagcgcgagggccttccttgcttacgaggaatctgcggtcaagcgattagtggaggagtatgacctacccgaggcctgcgcaaaggtcatgttgacggacatcgactgcgataccaacctcgatgacgcgggaagtaccggatggcaaggctcaattgaagaggatgacgattcaaggatcaccgacagtatctgcgccagaangtgcggcgacccctgaacaaatgggactgcgtcctttggccaaaatacngcgagcaaaaagattaccccaagcaacatggnggganggccnaaagacaaatttncgaaaanggagccaaagaccggaaantactgcaacgcttcaatcgatcattcccngagttggcnatatnaanaattccngcaagtactcctgnnancctgttacnccgacgnc

SEQ ID NO: 85028 - DNA, 525 bp, Triticum aestivum
  unsure (1)..(525): unsure at all n locations
  Clone ID: PAT_TA_85028
gttcgtcgactcctctcgccctaccatggtctgccgcctcaacaggtccctctacggcctcaagcaggccccccgggcgtggcactccagactggctacgtttccggtgacactgggcttcgtggaggccaagtcagacacgtctctgttcatccaccatcatggagcagagactgcctacttgctcctctacgtggntgacattgtcctcaccgcctccagtcagtcacttcttcgccgcctcgtcnacgcacttcagcgggagtttccggtcaaggatctgggtgtgcttcaccatttcctgggggtcactgctgagcctcgcccctcaangactcctactnaacaagggcagtacatcttgaattctggagcgggccaagatgattgactgaaatcctgntctanccaantcnacacgcaaggcaaantctctgaaggcatgggtgaccaattcaaggacccaacgggtaaaggatcttgccggngccttnaatactcatcttaatcgggnggnattccnag

SEQ ID NO: 85029 - DNA, 516 bp, Triticum aestivum
  unsure (1)..(516): unsure at all n locations
  Clone ID: PAT_TA_85029
ggaaaatcagaacttagggaagttggctgaatgtgctcagtatcaagctcaacttcaaaaaaacctcttgtacctggctgcgattgctgatgcccaaccccagcctccgcaaaaccctgcaggtcgccctcagatgatgcagcctgggatagtgccaggtgcggggcattacatgtcacaagtaccaatgttccctccaagaaccccattaaccccacagcagatgcaggagcagcagcaacaacaacagtttcagcagcagcagcagcaagtgcaggctcttacatttcctgggacagatggtcatgagaccaaggcaccatcaacggcatgcagcagcagcagcctatgcangctgaccctgcccggggcagcancggactgcagcangcacactatcccaactgacgggcgaggaacaacaggaaccccggtggggcnactcaaaacttctgcaatgagaccacaagacgcaccggacantacgagcaagtgcacttggcgaaatctantcan

SEQ ID NO: 85030 - DNA, 458 bp, Triticum aestivum
  unsure (1)..(458): unsure at all n locations
  Clone ID: PAT_TA_85030
gtcatttccgttaccagcaaccttgttcccgggctcatgcacagcctcatgtacaaaggcgagaacgccacgctgaacgagaagctgtcgcccctgatgaaatggctgttctgccagccaaatcctattgccctcaacactgctctggctcanctcggcgtggcaaggcctgtcttcagactgccgtacgttccgctccctcttgaaaagagggccnagttcgtccggattgttgaagtcaattggacgggaaaatttcnttggggcaaaaggaggcccaagttctagatgatgacgatttccgtgttgatcaagtaggtactaggaaaatgagtttgccaatcctangtancttggcgaataaactantaanttggtncttgcnttaagcttcnttccgttggtcaacaaatcgtggggtccgccaaccaattaataattgccctaaaaaaaaaaaa

SEQ ID NO: 85031 - DNA, 532 bp, Triticum aestivum
  unsure (1)..(532): unsure at all n locations
  Clone ID: PAT_TA_85031
cccacccccacacgctctacgctctgctctgctcctgcgtgcgtggtctctttcctcccctcttcatccagatccggacccgaccgccgatccatccaaatcacccttccccttccccttctcttccaccaccaccaccaccaggccgccgcctcgtcgtcctcaattctcctttcgaatttagaatccccgtgctgagagttgagtgccgccttgggttgctccgtactggactcgattcctcatcgcagcagaagcatcccgtcccctccgcttctccttgctctgctctgctaacaaacagacaaaaaaatagatcatgtcggaggtgaaggactccaatgtgcctgctgcacttgatgggaatcctcaacctatgggaccaaactggaagacaattctatgccctcaagnacagcaacaggaagangcatcaaagangaatttggggggactaatgccaataagcccaatcaatctcaaaggnnaatgaggggcctanttgatcggctgacggggtcaaggaagaagg

SEQ ID NO: 85032 - DNA, 481 bp, Triticum aestivum
  unsure (1)..(481): unsure at all n locations
  Clone ID: PAT_TA_85032
cacccgcaccacacacgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcgggatggtgctacgctcttgggtttgcgtcatccttgggatggacatgatgaccactctcatggtcatggacacgggcatgaggcatcatcatcgtcatcttcacattaattccttactgggctgcggacgatgcttgggcatgttccaacagctaaagtttgagttaataaatctatcaccctgcatggggaccatgttgtttgcaactgggtttaacacgaactgggcctgttactattgggctaatgtatttgtttcnaaatttcaatttnnaaaaaaaaaaaa

SEQ ID NO: 85033 - DNA, 523 bp, Triticum aestivum
  unsure (1)..(523): unsure at all n locations
  Clone ID: PAT_TA_85033
gcctactctgccaccgagttcgccatcggcctcttcaccggacgcgtaggcttagtttcagatgctttccatctcacctttggatgcggcttgttaactttctcattgtttgctatggctgcatcccgaaccaagcctgataacctctacacctatgggccagtctcctcattccctcccgcctttcaggctctatttctgttcgtctgtgcactaattcacactcacttattgttgtctgctttctttcaggtacaagcgattggaggttctggctgcctttacaaatgctctgtttctattgttcctgtctttctccttggctgttgaagcattacatgcatttatgcaagatgaatcggagcacaagcattatctgattgtttctgctgtcaccaatcttttggntaatttacttggtgtttggttcttccggaactacgctcgtgttaacatagttacaggaatgcagangatatgaattacactcggtctgttgcagtgttggnagatcaatacgngg

SEQ ID NO: 85034 - DNA, 510 bp, Triticum aestivum
  unsure (1)..(510): unsure at all n locations
  Clone ID: PAT_TA_85034
gttgcttgtttcctgacgcggggtgatctgtatcacagaatctactccccaatctcatttggaaagaagtacgatcccaacggagactacatcaggcatttcatcccggtgctaaaagacatgcccaaggagtacatctacgagccttggactgcaccccttagcgtgcaggagaaagccaggtgcatcgtcggcaaggactacccaaaaccagtggttgaccatgaagctgcaagcaaagaatgcaggaggaggatgggggaagcttatgcgtctaatcncctaggcggcaancctgtcaaaggaaattcctcgaattcatcgcgaaggaagttttctgatgggtgggcaaggaatccangatgtcccngactcatccatgtcaagcaaaccgnggtaganaaagctgaccccagagcaagaacagtcttancaaggaatanctgactctttangggaaatgttgtatccgactaaattaangggtctcncaatcttcaaaaaaaanag

SEQ ID NO: 85035 - DNA, 530 bp, Triticum aestivum
  unsure (1)..(530): unsure at all n locations
  Clone ID: PAT_TA_85035
cgtcgagggcgttgaaaagcattggggagcagctgtgcctggtcctaacaattttattgagacgcttcgagaacggatgtttaggccatcgctgtctactattatctctgagaatccaaaagttgtcactgttgcaccatcagacatggtgttgacagcatcaaagaagatgctggaactaaaagtgagttcagcagttgtagcaattgaaaacaaacctggaggaattctgacatctagagatatattgatgcgtgttatcgcccaaaatcttcctcctgagtccaccacggtcgagaaggcatgaccaagagtcctgaatgtgccacaagtgggacaccccaattcttgatgctcttcacacaatgcatgatgggaaatttttacatttgcctgtcctggacanggatgggaatgttgtgactgttgttgatgttctcacataaccatgctgcaattgctacgttgggaaacancgggcanctggttngaggnaacatctgcatgatcaaagtctgggatcaacaatt

SEQ ID NO: 85036 - DNA, 525 bp, Triticum aestivum
  unsure (1)..(525): unsure at all n locations
  Clone ID: PAT_TA_85036
gttatgtgttttgtttcagatcaaccgagaaatgatggagttgattgagtccttgcaacgcaaggctgttgaagaaggcaagatggctgcaggtgatgccgaggaatctggtgatggtgactcggaggaaaatggtggtgctttggtgaagggagaagatgatagcaatttgaacgaggaaggtcaagacggtgtanacgctgatggttctgtgaagattgtggttgaaatggagggtgcaaaagatgataaaaagtcaaagatgggcgcggctgaagtggtggatgtgttagttgaagatgctgctgcgaaacagccgaagaagcgcacggctgatgaagatgctgctgcgaaacagacgaagcacaaggctgatgctgagactggtggcaagagggtgaaagagcaatgctgcagtggaagaggtgatgtgtgcgtcactcctatgaaacggncaagaaantggtgatatgcatgatgacgnaacngcaacccgctgtgaacaacggcncaaggtgaccngac

SEQ ID NO: 85037 - DNA, 402 bp, Triticum aestivum
  unsure (1)..(402): unsure at all n locations
  Clone ID: PAT_TA_85037
aggaagagaagagtccattctttcgactatataagaacacatgtttgaagatagaaacagcagcagagaagatatccacaagtgttgaagcatcatcaacacatccaacaagccaagtgcctagcattgcagagactatgaagatggtgaaagattgtggggttaaagagaaaacagctctaatgcatacaactgcatttttgattgtgaagcctgaatttagagaggtcttctgcatgctggaaacaaatgaagggaggttgacttacttgagagggagcatgcaaaggaaatgatgaggcacatgtagaagattttgaattatttatttatattaatgtgttgtgagaactatttgtttgcttgctatgtaagcaccatttggaaaaanaaagggggggg

SEQ ID NO: 85038 - DNA, 467 bp, Triticum aestivum
  unsure (1)..(467): unsure at all n locations
  Clone ID: PAT_TA_85038
cgatgtttgtctttcagtgaatctgtttagattcaattttcgttcatctgtgcccctatgtttataggttggatccttctgatctatggttttgtccatcggcggcgtgatgctctagtgtgctggttctatggggtcttaagacgacaacttcccgagtgtatactacaacaaggtttgtccggcttcaatgaatgaggagctatgacggcgatgtgccttcaactagtttaagtggttgtgtggatctagacgtatttttttacttctgataccttgacagttgataagaatatcgcaagttttatgaagaagaaaaaagaaggcaccgactaagagcacttagcgggcgcccctaacaagcccctccggcacccctcgctangtgatttttttcaanccaanngccaaaaatcggccaatcccgccccaagaacctgttttaaccggttggttcanacngggcc

SEQ ID NO: 85039 - DNA, 392 bp, Triticum aestivum
  unsure (1)..(392): unsure at all n locations
  Clone ID: PAT_TA_85039
atggncaacaacagagaaagggagaagatttttgtagccagccaggagaaattccatgccaacgcagacaagcagtactggaaatcgatctcggatctcatcccgcatgaaatagccaccattganaancggggaaagaaagacaaggacaagaagccatccgtcacagttattcagggccccaagcctggcaagcccaccgacctctcccggatgcgccatatcttagtgaagctgangcacgctccaccgccacatatgttgcaatctccaccagcacctgctgctaaaganggcgcaaaggatggctccaaagnaaggtggaaaggatngtgggtgcnanangacggtgcggaancccaagcanacgacgccnagcagcctgcancaga

SEQ ID NO: 85040 - DNA, 525 bp, Triticum aestivum
  unsure (1)..(525): unsure at all n locations
  Clone ID: PAT_TA_85040
attatgatttcacagtatccatctcttgttgaggaatggagtaatggcagacttgaaaatgaaatggacatcgtcttggatgctgtgaacaaaataaggtctctgaagccaccaacagattcaaatgaaagacgtcctgcttttgcactttgccgaggccaagagatcgctgccacaatccagtgctatcaatctctaatcgtgtatctttcttccatatcacatctcaagatcctgacagagaatgatgaaactccagccgattgtgcaactgctggttgtcaacaaagacttgtccngtgtactttcaacttcaaaggagcttttaaatncagacgcntaacntngaaaagcttaagaagaaaaaagattagatcaaaagctncaaaatgnantgggcgcaaaaaatgggncgcctccggctatctccnagaaggtcccacanagcgtncaaggaggaggacattaggaaccaaccgcttttttggacaactagaggcacaatgnantgagaagaatntaccg

SEQ ID NO: 85041 - DNA, 510 bp, Triticum aestivum
  unsure (1)..(510): unsure at all n locations
  Clone ID: PAT_TA_85041
gcctttcgccaccgtcctcctgcacggcggcgcgatgagcagggtagctgcggacgctccttattccgctgccgccgtcgccctgcacgcgcactccctgctggaggagtccaggttcgccgggtcaccgctgagctcgcaccgcggcgggcacagacctttcgaccgggcgttcgccggcggcaagatcatcgtggcggggctcgccgcggccatcgtcgtcgccgtcttctgctacatccgcatcacgaggaagaagagcgtggagccaaaagtctgatgatgactatatagaccacctgactctttctctctgcacactctctgaaagactgaaaccctttctgctctacaaactgcagagtgaggatatacggcatacgggaagaaaaagtggaacccccccccctagatttgctgtactatactaatttgtgatgatggatagatgatcagctccttcacagttaagacccaatgttactcnatttaccatatcgctgagnnaat

SEQ ID NO: 85042 - DNA, 531 bp, Triticum aestivum
  unsure (1)..(531): unsure at all n locations
  Clone ID: PAT_TA_85042
cggatatcaaatggatgggtgggactatacggctcctggtgaaggcgaagcttcaccccaccctccgactggaattaaagaaaaatatcgcggggcagtgtcaactctctgctcccattccatcatcgttggattcattcatgggccgacgcaaagcttggattgcaatcaagctcagccgttgagtagtcagagaaacgataaacaattggagattatgccttccgagatggggcgcacggcagctgttcaacgctgccattgacatgagattccggcgcattcctccaagtccagatnacacgcatggcacatccgcgtgtagataggtccnaggaggaaggatgccaggaaggaagtgatgtttccgttttggcaacaaatgggacgacgcaagctgcaaatttaaaggtgacagttacactgacctgtgttaaagcgagtgggcctttgcccttttgccgctctcaataaaccacaaacangggtgctgtccaattgttnacggcaaatggccggttatataataan

SEQ ID NO: 85043 - DNA, 534 bp, Triticum aestivum
  unsure (1)..(534): unsure at all n locations
  Clone ID: PAT_TA_85043
aaacaaaccaagctagagaaaagaagaaggtactacatactagctagctagcttagctatgggcaccatcgtcgacgctgacgtcgggttcgcggtgaagaggacgagcaggtcgctggtgccgcctgcgtcggcgacgccgcgggagacgctgcggctgtcggtgatcgaccgcgtggcggggctgcgccacctgggtgcggtcgctgcacgtgttcgccgcgggcggcgacaagaagcggcagcaggcgacggcgacgccggccaagggtgccggggaggcgcctggggaaaggcgcttgtggactactaccgttcgcggggcgntcgttgtggttgcgccngnagggcggcggggaagacncgggttgcgttcaccggcgaagggcccttgttngttggaggcaacccgcttctcgctcnaaggaggccgcactccacaacccatgctcatccccaangagcaacttctgccggagcctcgcccgactncaaccgcttgacatgccctcatgancaagntacggatttcnt

SEQ ID NO: 85044 - DNA, 530 bp, Triticum aestivum
  unsure (1)..(530): unsure at all n locations
  Clone ID: PAT_TA_85044
cacgggttcgcctgctgcagggcctccgcggctgcggcgccctcctccgtcctggtcttcctcttcttggccctggcctcgctccactcgccgtaggagtaggacgcgaggccccagagcgagagcaccagcgccacgcctttctcgctactgaacctctcgcgcaggaagatgacggccgccacctccgtcaccgggatgaacaccgcgatgaggatgcccgccagcagcgtgtgcacgcagaagatgacgcccaccgcgcccaggaagaagcactgccacagcaccgccgaccacgccagcaccgcgtaagtaacgcgcctccccaagcttgtaccgcctcgcctccccgcgggattncctgcatgcatactttttttcaattaaattcctccagcgttcccttttactggtgtgcacaatgcatttgtgcatcatgcatgcggcatgacttcttatcctttaaaaatantcantcatgcgccatattttcnaatccaaaaaaaagacactgttggcgngaactgcat

SEQ ID NO: 85045 - DNA, 532 bp, Triticum aestivum
  unsure (1)..(532): unsure at all n locations
  Clone ID: PAT_TA_85045
ccacagaccaaaacgaccaccgcacccgcagcagcgaagtgtccaagcggcggcatggcggagagcaaggcgcgtgtcgcgctgttcctggcggcgctcgcggcggcgagcctgctggcgctggccccggccggcgccgcgacgacgtgcgcgccgacgcagctgaccccgtgcgcgcccgccatcgtcgggaacgcggcgcccaccgcggcgtgctgcgccaggctcaaggcgcacccggcgacctgcttctgccagtacaagaggaaccccagcatgcagcgctacgtcaactcccccaacggcaagaaggtcttcgccgcctgtaaggtgtccctgcccangtgctgatctgagtagtcntctgccgccccatcaagtcgatgtccattcatcctgctcgatngattcgatnatgctactacttnaacactttgggcaaagtttaatatgctcnnagaataataaacggagactacatccaagtacttggtaantgtgagttcgatttgctctccncaagaaaacttng

SEQ ID NO: 85046 - DNA, 546 bp, Triticum aestivum
  unsure (1)..(546): unsure at all n locations
  Clone ID: PAT_TA_85046
gttctgccgtttactcttccactttggcctcctctcttgcaagtttaagcttcgcctccagccatgggtaaggagaagtctcacatcaacattgtggttattggccacgtcgactctggcaagtcgacaaccaccggccacctgatctacaagcttggaggcattgacaagcgtgtgatcgagaggtttgagaaggaggccgctgaaatgaacaagcgatccttcaagtatgcttgggtgcttgacaagctcaaggctgagcgtgagaggggtatcaccattgatattgctctgtggaagtttgagaccaccaagtactattgcaccgttattgatgcccctggacaccgtgactttatcaagaacatgatcactgggtacctcccaggctgactgtgctgtccttatcantgactccaccactggtggttttgaggctgggtatctcaaaggatggcagacacgtgagcatgctctcctggcgttnanacttggagtgaacaaatnattgctgctgcaanagatggatnaacacnccaaatatcc

SEQ ID NO: 85047 - DNA, 379 bp, Triticum aestivum
  unsure (1)..(379): unsure at all n locations
  Clone ID: PAT_TA_85047
acacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaggtacctttgggaggaggcagatgcagaaacccttcgaggacccacatatgccctcagggttggtganccaagnanatcgtggncnctgaaagnggggttnaaaccccc

SEQ ID NO: 85048 - DNA, 479 bp, Triticum aestivum
  unsure (1)..(479): unsure at all n locations
  Clone ID: PAT_TA_85048
tcgccacgcccgccgacgccgcgctcatgatgcagctcggatgcgacggcgtcttcgtcggctcgggcatcttcaagagcggcgaccccgcgcgccgcgcccgcgccatcgtccaggcagtcacccactacagcgaccccaccatcctggccgacgtcagcacggggctcggggaggccatggtcggcatcaacctcaacgacccaaaggtggaacgatacgccgccagatccgagtgaaccctttctttccgtagtcgtctccatccatccatctgccttgggattgcatttccgtcgtttcatgtctctcaatcaagtaataatggaatgaatgaaatggtaagaaacaaagctatggtactatgcagaacctctttattttgtgctacggtacnaattacctantcccaacccaaccctgggattaccatgtncccaaatgttggatggatggtatgtcggtcnctgaaaaaaaaa

SEQ ID NO: 85049 - DNA, 464 bp, Triticum aestivum
  unsure (1)..(464): unsure at all n locations
  Clone ID: PAT_TA_85049
aatttagaagcgcccttcctcctctcccccatccgtacccaatctaatcgacacccggccgagatgggccgcaagttcttcgttggtggcaactggaaatgcaatggaaccacagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcaagaactgctgggtgaagaagggaggtgcattcaccgggtgaaattaagtgctgagatgctccgtcaaccttggcgttccctgggtcattccttgggcactcctgaaaggagagctcctgctgggagaatcaaatgatttggttgggagacaaggttgcttttgctccgtctcaagggactaaagncattgcatgtgttggtagactg

SEQ ID NO: 85050 - DNA, 548 bp, Triticum aestivum
  unsure (1)..(548): unsure at all n locations
  Clone ID: PAT_TA_85050
aaacaaacatcaatcaacaatcgccccaattgaatcccatacacttgtaactcataacccaaatcatacacaatggagaaagcaaagcaggccgtttctagcttcctttccaatgatggaaagcacagaaccactgtcgacgaagatgttaagcctcacgtcactcaggagcatgttatgcctcatcagcatgagcaagtgaccactgccctgggataaggaggttcatcaagagcaccatcatacgactgttcagcctatcactcacaaggagactcttcctgagcagcaccaccacaacctcatccctgtcgagcacaagacttccaacatggnaatgagcangacactcgggctacgctccaccgagaagctgctaaatncagagataccagtgagttcacagtancactcactctactgaaactgctcccgttgtcaccggtgaacaattcatcaccatgttcatgagcatgtgcagccgtgattaataaagagacgtcanccgcacgtcgttcanaccacgataccattcacgaaaccacann

SEQ ID NO: 85051 - DNA, 327 bp, Triticum aestivum
  unsure (1)..(327): unsure at all n locations
  Clone ID: PAT_TA_85051
cgcaaacgcagcagcagctaaagtcctattccggcaggaggggcagcacgcacaggcacagctagcagctgtctgctagcgcgcgagagaggagagcagcttggaaccgtacgtacgcggtgcgcccaccccaccggcggatgccatgacgacgtacagggtctgctgcttcctgcggcggttccgggcggcgtcgaacgagccgtcggaagcggtcggcgacgtgttccgggcgtacgccgacggcggcggcggcttgctcggggaaggaggcgctgcggaggttcctgcgggaggtgcagcgngagaccgacgctggcgccgact

SEQ ID NO: 85052 - DNA, 301 bp, Triticum aestivum
  Clone ID: PAT_TA_85052
gtaccacctctacacccctgccgaggtggaagccgtcatcgcgaggctgtgaaacgcttccgagctcttgctatccacgtcatcaatcggtaatagacgacccttgtacgaagcgtgggcaccatggtccttgattatggcttgattatggcaaggacagtcgatgttagtttgattcacagctcagccgggctcacttgtctttttaaatttttatgaattagcgttgagaactttgtactgccaagaaagttcattttttttaccctttcggtttctcaaaaaaaacaaaaaaaaaaaa

SEQ ID NO: 85053 - DNA, 468 bp, Triticum aestivum
  unsure (1)..(468): unsure at all n locations
  Clone ID: PAT_TA_85053
ggcggcgagagttcttggtcggctagatggaaaaggcgggccagaagcggcggccgctgacggtgatggcatcctcatcgtcgcaggtggcagcagcgcggggcatgggcatgaccaacccactggcggagtggaccgaccgcgtcaggtcgctggaggccggcgtgcgggcgtggctagcgaagcagcccacccacgtcgaggccgccgtggtcacggcggtcggcgccgtgcanggcgccgcgctcggcgggctcatggggcaagcttgcgcccgacggcggggccgcgcttcctgtgccgcccgccgccgccggggaacganccaaangtccttggctccttcaaagcaaacgcangctttancgggtggacccctgntgcaaacacgaaacttgcgtcataatggtgccaaatgctggnanacctgtntcnataaaaggataaaaggattgaggatntcaaggg

SEQ ID NO: 85054 - DNA, 524 bp, Triticum aestivum
  unsure (1)..(524): unsure at all n locations
  Clone ID: PAT_TA_85054
tgcccttgcttgctgctcagttctttgccccctgttcctcctcctcctcttttcgcacctcggcgcctgcttcggcatcaactgcgaccgagatggaggcgcaagacgactgcaagtggcgccaagtcccggcgttcggcgactggaacctgtgggacgacatgcccgtcacccagtactttcaggcagggaccttcttcttcgccgcgccgacgacagagaaggacgacgacgaggatctcttcaaggtgccccagttccctgccacgccctacagctacaagaagtgcgttgttcgatgaaagggggagaaaggaactgctgtgcctccgggggaaaggaaagggangaaggaggcgccgcgtgaacgagcaacagaagtggaagcccaagggagctgtggacgangacctctacaagatatccccgcagcttctctgcaaggtgaanaagaagaactcctgangaatctgctgggaaggtgcctgggcctgactgatccatgaccgaaaaagcatcnctaa

SEQ ID NO: 85055 - DNA, 537 bp, Triticum aestivum
  unsure (1)..(537): unsure at all n locations
  Clone ID: PAT_TA_85055
ggaaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattgggctacgcgtggttgctgccaacaaggaccgaaacgtctatgagctccgctacttcaacattgctgagaacgaaggcgaagaagaagattagattgcactacgcttatatttatattgaactcnttcattttgataccgtaccctaatttccaaatgtccaagttatggtg

SEQ ID NO: 85056 - DNA, 537 bp, Triticum aestivum
  unsure (1)..(537): unsure at all n locations
  Clone ID: PAT_TA_85056
tccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagcctggcctacaacttctacaagaacagctgccccagcgtggactccatcgtccgcagcgtcacctgggcgcaggtcgccgccaaccctgccctcccggctcgcctcctccgcctccacttccatgactgcttcgtcaagggctgcgaccgtcgattctgctgggacaccgcgcaaagcgagaagacgcggcgccgaactgtcngtgggcggtacaagtgatcgaccgataaaggccaagtggagaggcgtncc

SEQ ID NO: 85057 - DNA, 268 bp, Triticum aestivum
  unsure (1)..(268): unsure at all n locations
  Clone ID: PAT_TA_85057
gaggcantcagttgccgcgggctcccggngcgtacgccgtcatggcccagccgaagaagcagcagcccagcgccgccccgtcgcgggcggcgtcagcaccgaagaagtcgacgtctacgctccttgacgcgttcgaggtggactgcatcaggcggganctggagagtctcctcctcaancanaacgccggcgagggctcggnatccagcagcagcgacgcnngcggcggaaatacnccggcactcagntcnnccccgtngcnacagaa

SEQ ID NO: 85058 - DNA, 264 bp, Triticum aestivum
  unsure (1)..(264): unsure at all n locations
  Clone ID: PAT_TA_85058
gcagcttgcacgatgtaataggttgaattgctttattctcatgtggcgttgctatagttgtttttagattaccattactatatctcaatatgtatgctaagtaccatatctgcttgaatttatgtttattgacattttccccgaatgttagatctagttatctacttatctgctgcaatgtatgtctgttgacatttgccccaaatgttggatccagttatcgccacctactaatagatctttgtagttccacataaaaaaann

SEQ ID NO: 85059 - DNA, 529 bp, Triticum aestivum
  unsure (1)..(529): unsure at all n locations
  Clone ID: PAT_TA_85059
cgaccgtcggatctggctccccggtggtggtgtgtggcaacaacaagtgggcagcagtggccccggcggtagctgcggggtttgtgcgtcagggcggcggtggcggaggtagcttgcttttgtcccggggccctcgcttggcattgtgttggggttttctttggcaaaagccttgacgacggtgacgcccctgggcgtcgcttcccctggtgagggcgtcgtgcttctcaagcgctgtcttccatgggcgaaagccccgtccatttcggaccgacggcggtggcgtccccgacgtcactcccttcctgaaggcgtcgctactgctgggcgggggcagaacagaggatcaaggtttggaagtctcgctgggtgaaagaatcggantgtctcgaatgggtgtcnccttggttggcccggatgaaccggcggacatttttgcnaacatctgcccttccgcacaagagaaggtgcanatggcaaatcccttgtganactggaataattgttggtttaaggaaattgancttgn

SEQ ID NO: 85060 - DNA, 460 bp, Triticum aestivum
  unsure (1)..(460): unsure at all n locations
  Clone ID: PAT_TA_85060
ggctaaagtggagcgagatcaccatgttcttgagattggctgtggttggggcagcttagcaatccaattggtgaagcaaactggttgcaaatacactgggatcacattatcagtggagcaattgaaatatgcacagagaaaggtgaaagaagctggattagaggaccacataagcttcatgttgtgtgattaccgtcaaataccaactcagcgcaaatacgacaggatcatctcttgcgaaaantgntcnaaggtgttgggcacgaatacatggacgatttcttcggctgctgcgagtcccttttggctcaagacggcatatttgtcctgcagttcatctcaatcccagaagaacggtatgaggaatacaggcgcagctcagacttcatcaaggaatacatcttccctgggggttgcctgccttccgttagcccggatnactctgccaagtctcaacatn

SEQ ID NO: 85061 - DNA, 539 bp, Triticum aestivum
  unsure (1)..(539): unsure at all n locations
  Clone ID: PAT_TA_85061
cacagatgtttattagacgacgacatccatatagaggtacaccagagggcaccagacgacgcagatacccaggtacagcagcagcttaaatgaaccatggcttactgaccaccgcggaggcggagcaccaggtggagagtgctctccttctggatgttgtagtctgctagggtgcggccatcctccagctgcttgccggcgaagatcagacgctgctggtctggggggatgccctctttgtcctggatcttcgccttcacgttgtcgatggtgtcggagctctcaacctccagggttatggtcttgccaagtcaaggtcttcacaaagatctgcataccacctcgcaagcggagcaccaggtggagggtgctctccttctggatgttgtagtcggcgagggtacggcatcctccagctgcttgccaacaaagatcangcgctgctggtccggtggaatgccctccttgtcctggatcttggcttgacattacgattgttcagacgatccactcaaggtgatggnctgcaatcaatgtcn

SEQ ID NO: 85062 - DNA, 475 bp, Triticum aestivum
  unsure (1)..(475): unsure at all n locations
  Clone ID: PAT_TA_85062
caatgttataatccagcatgcactctcaatggttgctttagagagtgttaagatctacactgcaattagcgatggaacaatcaatctagttgacaagttcttcgagatgcaaaggaatgatgctgttagggcacttgatgtatacaaaagagcaactaaccaggctgaacgactttcagaatttcatgaagtgtgtaaaactatacacattgggcgtggtgagaaattcctgaaaatcgagcagcctccagcatcattcctgcagactatggaggactatgttagagatgctccaacaggtcaaaaacaaaagactatactagcgatagaatacaaaaaagagccagaggaggaagaaaaaccggcctcccctcctcctgctccagaacaggaaccggaacaagagcctgagccagaaccgaaccagtgaaagaggaagcaccagaagccgagccggacttgctgggtctgaacn

SEQ ID NO: 85063 - DNA, 455 bp, Triticum aestivum
  unsure (1)..(455): unsure at all n locations
  Clone ID: PAT_TA_85063
tgacggtactatcatgaccatctctaaggacagagttaagccatctccgttgcccgacagttggaagctgaaggagatctttgctacgggcatcgtgcttggaagctaccttgctctgatgactgtcattttcttctgggctatgcacaagaccgacttcttctcggacaaattcggtgtgaggtcgatcagggacagcgagcatgagatgatgtccgccctgtacctccaagtcagtatcgtgagccaggctctgatcttcgtcacccgttcccgtagctggtccttcgtggagcgccctggtctgctcctggtcaccgcgttcctgctcgctcaacttgttgccaccttcctcgctgtctacgccaactggggcttcgccaggatcaagggtatcggctggggctgggcangtgtggtctggctctacagcatcgtcttctacttcccctgga

SEQ ID NO: 85064 - DNA, 295 bp, Triticum aestivum
  Clone ID: PAT_TA_85064
ccgctccatgcattccaagattctgtcctccccctccctccccccatgttgtaggctggtagtggtcaaattagttggccctgggtccatttggactgatgtattgtttactgctattgaagtcattcgttctcgttttgctcttgcagtggatcgctatagccttgtgttttcaatcttttagggcctgtttgggaatgcagtttcaaaatactgtaattttgagataccatagtttataattgtacatgacataaatactacggtattgctttaccacaataaaaaaaaaaaa

SEQ ID NO: 85065 - DNA, 477 bp, Triticum aestivum
  Clone ID: PAT_TA_85065
cgacttggaggcgttcaaggacgcggtggagctcatgttcgagcccgacgccttgcggtggctcgccagggccggcgtgtcacgggcaaccgctgtgctccaggtttgctcctctattgcgttcgacaaaggagtcgaatcatgtttgaagtacatcgaggcagttccatggagcgagagcgaggaagagaagctgaaacacgtttttgccagatgcactttcggcgaatcagttagtaaagatgtgctggcaagattgcagcagcagtgcgcgagcggctcggaggacctggcggtgcagctcgtggaatctatcacgagcggagccaacaacggcgcgaggaaagaaatgcagtctttggtgagcggtctcctaagcagaagctcagtctaccataaggacctgtccggggtgaacaaggggggcctttaccgaatctgccgttcctgcttgagctcacttgtggaactttcatg

SEQ ID NO: 85066 - DNA, 544 bp, Triticum aestivum
  unsure (1)..(544): unsure at all n locations
  Clone ID: PAT_TA_85066
gacgcttccgctcttctctctctgcttccggcagaaatcaaggcagtattaggatggtgacccggcgcctcttcgcgcgactctaccggcattgcgccggcgcagcggctgcgtcatcagccgcggggcggcaccggggggccctggcagcggcggccgtggagcagttcgccggttcctccctgcctgtcggggttccaaatattttgaatcatcatttcagatactcaaccagcatttttcaaaagattggtttctcgtctgtttcaccacaacaaagtgatgatgaggttaatgagctgaaagaccacgaaagggccttagatggatcaagtgaagattgtccatctggaagtattgaaggccttgatctgtcgagagatgatttggtgaagctagttcgtgagaaggatgaattgttgaagtccaaagatggtgaaatcaaaagatatgaaggataanggtttgcgcaactatgcagaaatggnaaatatcaatgctcggacaaaacggaatctgagaacccaaaaatatcagtcagaac

SEQ ID NO: 85067 - DNA, 486 bp, Triticum aestivum
  Clone ID: PAT_TA_85067
ttccacaaccgcctgaagcctgcaaagcttacctggacagcaatgtacaggaagcagcacaagaaggatatccatgctgaagcggtaaagaagaggcgccgcgccaccaagaagccatactccaggtcaattgtgggtgcttccttggaagtaatccagaagaagagagctgagaagccagaggtccgcgatgctgctagagaagctgctcttcgtgagatcaaggagcgcatcaagaagaccaaggatgagaagaaagcgaagaaggcggaggtgagcaagtcccagaagacgcagacaaagggtgcggtccagaagggttccaagggccccaagttgggcggcggtggtgggaagcgctgaaagaacttagtgtcgtttctcgacattgcagtcgttccttagccaaagccactttcgtagaacctgtgttgaatttgcaagacttattcaagcgttgcttgtgcgtgctaaatacatggcaag

SEQ ID NO: 85068 - DNA, 533 bp, Triticum aestivum
  Clone ID: PAT_TA_85068
gatgaattgatcaaagaagcaagtaaaatggtaccagatcctgatgaaccatctcaaaccttgtatgacaccatgatgcgccatcatccaccgatcactagagtggctggtgctggaacagattttgcagcatttgtccagcatataggagtcccgtcactcgacatgtcttatgggctgtttgaagaataccctgtttaccactcgttgtatgatgattatgtttgggtggagaggtttggagaccccttgttccacaggcatgttgcagtggccagcgtttggggtctgattgcactgaaacttgctgacgacgagatcatacccttcaattacgtctcttatgcctccgaactgggaggagtgcacaaaagatatcgtagataaatgtaaaggattcctgtcagtttctctcctttgcagaactccatcaagcagctcgagagtgctgccaccaaaattacaaagagaagaattgctgcaagcagaaaacgggagcctaaagacaattagttacgctgaaatcagggaga

SEQ ID NO: 85069 - DNA, 500 bp, Triticum aestivum
  unsure (1)..(500): unsure at all n locations
  Clone ID: PAT_TA_85069
gtttcatcaataagatatatcacccaaatgtcgacgaaatgtctggttcagtctgtttggatgtcatcaaccagacatggagcccaatgtttgatcttgtcaatgtgttcgaggtcttccttccacaacttctgttatatcctaatccttctgatccattaaatggagatgcagctgcgttgatgatgcgtgatcgccctgcttacgaacaaaaagtgaaagagtactgtgaaaaatacgccaaaccaggggatgctggtgtcaccccagaagagcagtccagtgacgaagagctgagtgaagatgaagacgactcgggtgatgaggagataatgggcaaaccaagacccatagtcaagttggcacctactatacctgtaatctgcacacgatgtttactgcagcaactgcaattaaacacccatgaacatccgcgtgcagtctgagtgccatgtaaataaactgcanttcaccaantggatttccagcataaaaaaaan

SEQ ID NO: 85070 - DNA, 513 bp, Triticum aestivum
  unsure (1)..(513): unsure at all n locations
  Clone ID: PAT_TA_85070
aaggcaatcaacaatatcttctaccggtttatattcgagacggagaagcataatggtatcgcagagctgttagagattctggggagtataattaatggctttgctttgccgctcaaggaagagcacaaattgtttctagtccgagcgctgattccactccacaaaccaaaatgtgttgccatgtaccatcagcaactgtcgtactgcgtcactcagtttgttgagaaagattgcaagcttgctgatactgtcataagggggttactcaagtattggcccatcacaaatagctcaaaggaggtgatgtttttgggtgagttagaggangtgctggaagctacacagccagcagagtttcagaggtgtatggtgccacttttcgtcagattgcccgctgtttaagcagttctcactttcaagtggcaaaaaaggntctctttctatggaacaacgaccatatcgagggtttgttaaacagacaacaaggttatactgccataanctccaagngtt

SEQ ID NO: 85071 - DNA, 536 bp, Triticum aestivum
  unsure (1)..(536): unsure at all n locations
  Clone ID: PAT_TA_85071
gttttttttttttttttttttttcataaaaactttgcgttggagtgtagtttccaatattacaaaaatatcatggtatctanaatgctatgactttgaaaatataggttttatgaatgcaaccaaacaccttatgccataaacactctagtattcctataaaccatgagattgcttanaaactataaaaataatttacttccaaatataccttacgcttagtctttagcttcctctcttcttttttgagtttctacgtgttaagggctggagtcttaagtattcatgcccatataattgttgatataaangtccgnttcatgtctgttatctaaagaaacaagaaatacatctttgcntcgatcccatgangccttcatgcccgtcgatgtcaaaatttcagctgncccttcaacgcttccctanagctttgcgaagagcctcgctgatatccaaggcnacacnggaccggngcancaaactgagctcgtacctaagcccatgaagccancnggngctgaancctgaacgagagng

SEQ ID NO: 85072 - DNA, 286 bp, Triticum aestivum
  unsure (1)..(286): unsure at all n locations
  Clone ID: PAT_TA_85072
nanggcngcctggccgaccttgaggccgccgtgtgcctctgcaccgcgctcaaggccaacgtcctcggcatcggcctcancatccccatcaagctcancctcctcctcaactactgcggcaagaccgcccccaagggcttccagtgcgcttaattcancagcaaatcgtccancactcagcgcatgcatgcatcgtcagtgnatccgttattttcnttgntcattccaaatttgatttcatcanggcaatanntatancggtcggttgttaantagcttttcttgc

SEQ ID NO: 85073 - DNA, 243 bp, Triticum aestivum
  unsure (1)..(243): unsure at all n locations
  Clone ID: PAT_TA_85073
aagaaactcatcgactggctccagtctcagttctgggataccaactactaactgcctagctagctagtaatatacttgcttgcttatttgttgcatgcatgcaccaccancacaagccttatatnaattacgtacgtacatctatgtataagattgnataaatggccggtatgcatgtggaggagtgnaacttattactgtgcgtgattaataanatttantgtnaacttttcantantaccc

SEQ ID NO: 85074 - DNA, 546 bp, Triticum aestivum
  unsure (1)..(546): unsure at all n locations
  Clone ID: PAT_TA_85074
gctgacatcactgtagaagcgaatgatataaagatagctgtagcatcggcaaacaaaagtggtgcaatgagctttcaagagttgaaccagaagaaataccgcacgcccctaattctaggaatgggcctacttgtgttgcagcagctgagtggaataaacggtataatcttttatgcaggtagcatcttcaaagctgcagggctcaagaacagtaacctggacacatgtatacttggagtgattgcggttcttgccactgctgttacgaccaagatcttgggacagggctggacggagaatcctccttatcatttcttcttttggggatgaccctaagccttcttgtggttgctgttgtattttacatcaaggacaatatttcacatgactctgacttggggtaacaccttaagtatggtgtccttgggtggtgtcctgggcttatgtcactgcctactcctttgggnaggggtgccattccatggatcataatggctgagatccttcaagttagcacaaagatgtggcaggaagctttgcnaccna

SEQ ID NO: 85075 - DNA, 233 bp, Triticum aestivum
  Clone ID: PAT_TA_85075
ccgttgcgcatctgacgtattggttggttaggagtggaaatgtacgggaggcattgaggctgtttgatgatatccaaataaagggactggttttagattgtaggatttttgctaatgtgatcaaggcattctgcagaaagggtccaacagaatgctcagagatttcacagttgtgctttgtattggataggatgcttggaattgggtaatcattatgcggcaaaaaaaaaaaa

SEQ ID NO: 85076 - DNA, 525 bp, Triticum aestivum
  unsure (1)..(525): unsure at all n locations
  Clone ID: PAT_TA_85076
cagtgggtctcttcccttgcctggatcgccacgtatttatggcacaagccacgcggtcttcttcttctcctcccgcggccattgcaggtcttgcagcaacgtctctctcctctgggcggtgggcgctcgatgttcttggctccttcacttggacttcgccccgtcggcgtccactgatcaattgatcatctgcaggtagataagctaccagcatctattttgcgtatctgaactccaaaaaggagagctcgaaactacagcaatgggttgctaccctgtgttctggaggaagaagaactcnagaagccaggttgtgcagcttgaccaagacatcccaatcgcgggcaacgtgaaaatctactcgnccaaggagctgaggaaaagccacgggaaatttctgcccggggaagcaaacttggncagggttctttcggccgtgtatacctgggaaaactgaacaatggcgagaaagttgcatcaagggctctctcagantcaaggcanggacaangganttcttgattg

SEQ ID NO: 85077 - DNA, 542 bp, Triticum aestivum
  unsure (1)..(542): unsure at all n locations
  Clone ID: PAT_TA_85077
gtcgctcttatcatactccatgactccatcactagactagagagagaaacccttgtaccctttgttctgtttatcccccatttctccgagtcacccacccatcgccgaacttcgagtccaaggaagcggagccaccggagaaggggatatttgcctttcccgtcgggggtctagggagcaggagagatgcagcggcggcgggggcacacgtgggcgggggtgggaaagacggcccangcggcgtcggcgcacgccgcgctcttctgcttcactctcctcctcgcgctcagggtcgacggacgcaccacatactcctggtgggataatattcattccactatggtctttcatggtattgttgcgccttgnaaggtttcaaatgcctggcccttcaatacctcatgggcgtcattgggcacatgtcatccattgttgcaacgcctttacnaatgcgttcgaactgcttctctgcatanatcttgaaaacnataagatttgaatcaccaacttttgatttgaaatgngttcctccccggtgggct

SEQ ID NO: 85078 - DNA, 536 bp, Triticum aestivum
  unsure (1)..(536): unsure at all n locations
  Clone ID: PAT_TA_85078
gtttttttttttttttttttttgacgaacaaatcagagttcatttttaatggaaatttctattctgaggccatatatcgtgaaacaataaaggaagcatcctttccaatacaatatcgcctaacggttcatggcaggacaaaaatcaggacctgaatttgcaactcaacataaaacacacaatctagtgctgactagtgatgttcgtcttcctctctctctggctttcttttttgcaagtgctcgatttaatgaagtgtacaggcaactggaagctctaaggcataataatactttattangccttgcaaagaatggctttctcacttggtgtaaagtacatcctcccatgggtgacngtagagtggctgcttgagcctcttctggncgaaggtatgcccgatcaggccaantgatcgtgcaagcacaaaggagcccattgagataaccatttcaaaatctcatcgatctcctgtttggggaacnatccacttccagatagaagtcaagaaaagggaccgattgcacatcnacatt

SEQ ID NO: 85079 - DNA, 513 bp, Triticum aestivum
  unsure (1)..(513): unsure at all n locations
  Clone ID: PAT_TA_85079
tttagccgaggaagttctaaaactggccaagaatggattggaaagaagaggatacaaggaggtcggtttccttagagaggttgacgaagtggtgaggacaggagtgacacctgccgagagacttctgcatctgtacgagacgaagtggcaacgcaacgtagaccatgttttcgagcacttgctatactgatgttgtagatgtaccctagtacaaaaatctcatctttgattcattcaacgccttgagtgggagggcacaggaacacagcttttggttaagttgctgaccgggggaacagctacccggtgctgcgtgcggtgcctacaaataacttcgctcgggacggatcactaccctctanggagatggnacaaacactgtttggtaccggccttttggttccgttttcctcaagagatgggagatgccgttantgaaaataatccacctctgtacatggggaacgnccggtttcccccttcttccttcancattggtgggatgtttgcccc

SEQ ID NO: 85080 - DNA, 509 bp, Triticum aestivum
  unsure (1)..(509): unsure at all n locations
  Clone ID: PAT_TA_85080
gaaaaaaaacgaaacattaaatccatcccaagcatgcaacaacagatgcccactgaactagagcagttcaagttccaacattcaccacatgttgtttactgacatctgttttctagttctgaatttattcgttcagggatcatgcaactgtcggctgttatttttatttctcgcaattgaggtgtcagatctgtccttgttccccaattccggaggggggaggtgtcatttctccccttttgtctatagaagaaaaaccctgtgcgtcaattgtacgccacctgacggcaaaaactctatcttcagcttgtcgcttccccaacaaacagcttttgaaccngcccaanttcaggacatnatcncattcaagatccantcctggcaagttnggcaaggaacccttgtaaatgcaaagggcatcatccttaacgtcttcacaaaacaatcnanaggctttgtaggcgagtcaccacaatccgacntaacccacnacnggggaacaaanaacg

SEQ ID NO: 85081 - DNA, 227 bp, Triticum aestivum
  Clone ID: PAT_TA_85081
gatgcctgaaccctgaagacgtcccagaagaagtggtgttagttgctctgctacagggtaccatttgctctactatcagaatttgttgcattgattgctattgtcataaaaattattaagctcacctccaggtgaagtttacctattgtgtgtgtatttttatgtaactgaatttgatctcatgtttcagagttgaaacgttgttttgtcactccaaaaaaaaaaaa

SEQ ID NO: 85082 - DNA, 452 bp, Triticum aestivum
  unsure (1)..(452): unsure at all n locations
  Clone ID: PAT_TA_85082
gtgcaaactagaagaaacccccgtcatcagcgacctctccccaacggcgccgacgatggcgcaacagcagacgcagctaaccactggntcgggcatcctggatgccgtcccgctcttcgtcgtcatcctcctcgcggnccacgtcctggccctcgtgttctggatgtacaagctggcttccgngaagcaaccaccccggaggaagacacagtgacggcgccgatctacgccatcggcgatccttcgctagcctctttatcggttccattttcatgtgaaccagtaccctccananncatttcaaggncgtcaanttattangagatatccatatagcctttcaatttgactttatttatacgtattgcnttttgggnatggtttgcnannaacttagcganattcnntgaatcnctatccgtttgggtgagaaataaatggtnctangnttt

SEQ ID NO: 85083 - DNA, 514 bp, Triticum aestivum
  unsure (1)..(514): unsure at all n locations
  Clone ID: PAT_TA_85083
caagctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccggaaggcggcgtgcaactgcctcaagaacctggcggggtcgggcatcagcatgggtaacgccgccaacatccccggcaaatgcggcgtctccgtctctttccccatcaacaccaaaaccaactgcaacaacttcactaagttatctaccagcatcatcatcacaccaagctagctagccactcggtgtcnactgttgctgctctctgcgtgtgttcgttgttggtttctcatgtgttcgacn

SEQ ID NO: 85084 - DNA, 226 bp, Triticum aestivum
  unsure (1)..(226): unsure at all n locations
  Clone ID: PAT_TA_85084
cttgacgccttctggtcgaacgggaagaagagtagcgcgtccccaaacccagatccacccccccccccccccccccggnctgagtccagtccaacctcgcangcaaagatggcggacgtcacccgcaacggcttcgggggccggaacccgccggggctgctgcagaatgnggccaanaacangcatgcgttcntgnanctgttcctcangacgggnntcctcttgg

SEQ ID NO: 85085 - DNA, 517 bp, Triticum aestivum
  unsure (1)..(517): unsure at all n locations
  Clone ID: PAT_TA_85085
ccaagaaacatctctccttgctcagcagctcaggcctcaagcttactgcaaagttccctccatcgatcctctgctcgtgtcttagtttgcaagaaaaaacaatggcttcttcttccagcgcccgaagcagtcgcgtggccacatgcctcgtgctgcttctcttggtcgtcagcctgcgagaagcctccgcggcgcgtccactccggccggccggcgacgtgtccagcgaggtgaaggaccaggcgatcgtcgacaagtacgcgccgcttctgctagccatgctgccaagggccccggcgccgccgtccgccccgagcggtggcacgaacgaggctgggaactgatgaagcaaccatagggttttccactaggacagagaaatcgctaggcatacgtatgccgagtagttgatggtttggntacaagatggttgtcagaactgtaagagtgagaagcgtaggatactaggatatacccaaaattataccttcattcttcgtttaacccttcaagtatt

SEQ ID NO: 85086 - DNA, 529 bp, Triticum aestivum
  unsure (1)..(529): unsure at all n locations
  Clone ID: PAT_TA_85086
ccggctccgctgccaccgccgcgactccacctctgtcgccaccatggtcaagtccaaggccatcagggtccacgagctgggcggccccgaggtgctgcggtgggaggaggtggaggtcggggagcccggtgaaggggagatccgcatcaggaccaccgccgtcggcgtcaacttcatcgacatctactttcggaagggggtctacgccgcgcccaccatgcccttcaccccaggaatggaagccgttggcgtcgtcaccgctgttgggcctggcctcactggcaggaaggtgggcgatgttgttgcatatgccggcaaccccatgggctcctatgctcaggagcagatccttccagcggctgtcgctgttcctgttccaccttccgttgatcataagcaagcagcttctgtgatgctcaagggcatgaccgcccatgttctgcttcccgggtaatcaaggttgnaagtggcatactatcctggtccaatgctgctgctggtgggtgtcgntcantcccttgtcaatggg

SEQ ID NO: 85087 - DNA, 531 bp, Triticum aestivum
  unsure (1)..(531): unsure at all n locations
  Clone ID: PAT_TA_85087
cgccgctccgaggaaaatccgatttgaattgaaaatcatccggagacagagatcttttcttcctcgaagctatcttctctctcgactcgatccatagctgctcgcgtccctgttcctcgccggctggcaagtggcggcgacgggacgaggtcttcatcgcctcctcgcgagcgacgatcacccactagtttggtcggtctgaggcacatgatgatggccaacgcgaagctccacaagcaggccctgctgccgccgcggagccccttcccgacggcggcgccgtacgccgaccgcggcccaatcgcgcggccgcaggttggcgccacgcaccaccgccacggccaccaccagcgcacgtcgtccgagagcttcatcgangagcagccgccgtcgtggctcgacgacctgctcaacgagccaagagacgcccgcggcgcggcagancggccgggctgggcaccgcaagtctccagtgactcgtttgcgttgtttgacggtggactgctggtgctggtgcttacccaatggttn

SEQ ID NO: 85088 - DNA, 315 bp, Triticum aestivum
  unsure (1)..(315): unsure at all n locations
  Clone ID: PAT_TA_85088
gagcaacgctacattgatgatgatgaatagctgttcagatttgtttgncagtgacctgtattttttttgcaacatgttgtcagtacacatggtcaggactgtggatcccccatgacttagttgttgcctcagcttccacatttcaactgtggccttgtaataaaatgtcgttgcccaatggatctgatggatcacaattgtaagctacaaattatgggctttgaatatgatcgcttactttctctgatgcaaaattactcagttatagtgactgtgcttttgcaatgccaacttttttcttccaganaaaaccaa

SEQ ID NO: 85089 - DNA, 503 bp, Triticum aestivum
  unsure (1)..(503): unsure at all n locations
  Clone ID: PAT_TA_85089
gtcaactggatcctcatgatcctctgcgttgctgtcactgttggtttccgtaacaccaagcacatggggaacgcgtctggcttggccgtgatcacggtgatgctggtgaccacgtgcctcatgcccctggtgatcatgctgtgctgggaccgctccccctggctggccctcgccttcttcctcttcttcggctccatcgaggcgctctacttctcggcgtcgctgatcaagttcctggacggcgcgtgggtgcccatcctcctgggcctcatcctgctcgccgtcatgttcgtgtggcaccacaccaccatcangaagtacgagtacgacatgcacaacaaggtgacctggagtggctgctggcgctgggcgacaagctgggcatggtgcgcctcccgggatcggctcgtctanaccgactaactccggggtgccgcaaatttcccgnttggtaanaactgccgggtcaacgggggtgggnctccncggcanaaacangggng

SEQ ID NO: 85090 - DNA, 355 bp, Triticum aestivum
  unsure (1)..(355): unsure at all n locations
  Clone ID: PAT_TA_85090
gcgccttcctcctccccggcctcagcgccggagacggcgacggcgacggcgacggcgagctcgcctcctcctccttccctttctccttctgaacccacgcgtagtacgtacgtacgtacgcgcgcgtgctccagccgacaagcaaaagtgaaggcgcacggccggcggcgtgcgtagtacgtgtacgtacgtccctgcagcccggcggccgattgggaggcaagagcaagtcaagtagcaaagccacctacctacttactacactacccctgctagctgattaagacacgagccccttngtacggccggccccggtcctgtnaacatccanggntccgattagacaacaagaaca

SEQ ID NO: 85091 - DNA, 442 bp, Triticum aestivum
  unsure (1)..(442): unsure at all n locations
  Clone ID: PAT_TA_85091
cgtcgaccaacctcgtcgatccggttgcgacgcggtgtgctagaataactaccgaccatggtggaggaggagatcaccgagggcttgaagaacctcaccgtcaccggagacgcggcggcttcgggcggagaagggcagaggaggggcggcggcatcagcagcaaccgcatccaggtgtccaacaccaagaagcccctcttcttctacgtaaacctcgccaagaggtatatgcagcagcacggcgatgtggagttgtccgctcttgggaatggccatagcgacagttgtgaccgtggcaagaaatctgaagaataatggatttgctgttgaaaagaagatncaggacatctactgttgacataaacgacgatcacgaaggcgtccatccaaaaggccaagattgagatatccttgggaaagatgacaatcaatgattnatggt

SEQ ID NO: 85092 - DNA, 413 bp, Triticum aestivum
  unsure (1)..(413): unsure at all n locations
  Clone ID: PAT_TA_85092
cttccacatggtgatgtgcgccgcgccggagctcgtcgactgcttctccagggccttctacgtctccaagtccagcgacaaggacggcgacgcgctcagcaagaagatcctcatggcagtcggcggcaacaagttctaccccaagaacatccgctccccccagtcccaataagtcacgacacgaatcccgagactaagccagccacgcatgcaccaaagtatagcagtggccagtgggtgtgcatatgcatagcagtggtgtatttgggtctttctcgtcttcttctctctcgttttttctcctcctttcantggtgatgtgatgttgagtccaatacaatgttgatancggttgttattgcaaagaaaagnggatcctaaaataacgancgttgttgcttaaaaaaaaaaaa

SEQ ID NO: 85093 - DNA, 515 bp, Triticum aestivum
  unsure (1)..(515): unsure at all n locations
  Clone ID: PAT_TA_85093
caaccctcttctcacttgataaaaacactatccgtgttaaagtcgtacaaagaccaccaaaccaacaagatgggctctcttcatattgaaccctcaccctcccctgccttctcttctgtgcgctcagcactggcccagaacaacaacaaaatcatcctctgtgaaactcatgatggcacctcaacagagatcatcagagcaaccgttggcaagaatggccagaagttcgacggcatctggtacagcggtctctgtcagactacctatctaggtattccagacagtgagacgctctcccctcttcagcgggcatcactcctcgctcttgacggggagcttaagcgaaaaacatgcaaccgttccctctgcgcagcttttgacgcagatagtggtggtgatattgcagacatccctgccctggtggcactcatgaaccttgtcggcgtcggcatggntgtcatcaaggacaaggcgttttancccaggcaaaaggtaactcgctncancgtcatcgg

SEQ ID NO: 85094 - DNA, 526 bp, Triticum aestivum
  unsure (1)..(526): unsure at all n locations
  Clone ID: PAT_TA_85094
aagacgatggggaaggggttcgcatcctacctggcgatgaagacggggccggagggcggcgacgcggcggcggcgcagcaggctctgatcgacgcggacctgcgggagctcggcgtcgccgcgcggaagctcgccaaccacgcattcgtcctcggcggcgggctggggttcggcacctccttcctcaaatggctggccttcctcgccgcagtgtatctcttgatattggatcgcacaaattggaagaccaacatgctgacagctctcttggttccttacattttcttcaccctgcctaatgtgctgttttctctgatcagaggagaggtggggaaatggattgcgattattgctgttattctgcgtctattctttccacgacacttcccanattggttagagcttcctgggttcatcatcctgctcacagtgggtcgcccctagcctgttcgcggacagcttcangggagaactcgttngtgtcctcatatgccttgtgatnggatgctactgctccaagaacaat

SEQ ID NO: 85095 - DNA, 392 bp, Triticum aestivum
  Clone ID: PAT_TA_85095
ctaccgcgcccatggcgcggtactaccgctggcgtggcaggagctaacccagacctgtggcaaaggaaccgagggcggtagaaccgctggcacgatactaccgctcccccttgcggtactaccgcaaggcagggttggtctatactgggaaggcacggatatataaaaatacattcgtggctactttcgttgagttccgatctatgcaaagatccgacacggtactaccgcaagcctggagcggtactaccgcgtagggcgcagatgtaaaaaactacattcgcccctacttccgctcatgctgttgtacccgggcagagctcacgatactaccgcgcccatggtgcggtactaccgtgtagggcgcggatgtaaaaatttacatccgcccc

SEQ ID NO: 85096 - DNA, 239 bp, Triticum aestivum
  Clone ID: PAT_TA_85096
tgaagcactactccaaggaggcaaaaataactacatgagctatatatattaattgtatagcttaagtaatatcaaggggtatggtggtatatatgtattactcaaataaaaacgacaacaaccatcctatagttgttgttctcaggcattgtaggaaaatacatatgttgccatctattgtattgtgctatgtttccttcagctaaaataagaatttttttctctttaaaaaaaaaaaa

SEQ ID NO: 85097 - DNA, 512 bp, Triticum aestivum
  unsure (1)..(512): unsure at all n locations
  Clone ID: PAT_TA_85097
cagacgccggccagacgcaaagccggaagccagcgtatatacatgtgaataacgcgggtcaggcggaccgtacggcgtacacggatctcgctcggccatcgggactgtacaaggacgagagggagaagagaacagcggattcatcaccgccaggcgtcaggtcagagtgtgttaagacaagatggtggcgaatggcgacgcacctgctagagggagtgcggcggcagctgcaagcctgcgcaagcgtaaggaccacaagcggtgctgctgctggcggaggtgggtgccaactccgatgctccaatttttacaccgatnaggcttccgggccgcaaaatgtcaccaaacaccttcctgnnaatgacattgggtcaaccgctgttttcccctatctccnattttttngggnaactgtaccnaactccaactagggtttgggacnacattaccaangaaacaaaggcancaanggaggacctnttgancattnaatngntacaaatgactacana

SEQ ID NO: 85098 - DNA, 521 bp, Triticum aestivum
  unsure (1)..(521): unsure at all n locations
  Clone ID: PAT_TA_85098
ctagtctcgagtttttttttttttttttttttttgcggcatatatttccattctttattacgtacgtattgaacattgcacacatgacagcgacatacagagtgatcaggtgcaattaatccatgccactctgtccccagaaactctgccagttacagtcaaaggcaccaaaactgttacaatccctttatttttcatcatttcttctgtgcctcatgtttgtgttcacggaggtgttttgatcagcgaagcagccgtcaatggntcatcccgcaagtattctgcattattctgctcaatgctggacagcacctcacatgcgtgacctcgccgaaccttgctgcgaagctcctgggtgcgctcaatggtacaccactcttagctcgctgttccaaatatgatgatggtttgaagaangggcataaatttaagccacttgcttagcttagaagtatgtaaggtgcccaacagtgtcagcccagnagacaagacaccctgtatttaggaaagccatccaagna

SEQ ID NO: 85099 - DNA, 495 bp, Triticum aestivum
  unsure (1)..(495): unsure at all n locations
  Clone ID: PAT_TA_85099
gagagacagacgacgagatggccgatgcggaggacgccgccgccgcgcgccgacgggccgccataaccgactaccgcaagaagctgctcaactgcagggagctcgagtcgcgcgtcggcaccgtgagagaaagccttaaaaatgcaaagagggattttaccaagactgaagacgacttgaaatctctgcagagcgtggggcaaataattggagaggttctccgacctcttgataatgaacgctttattgtgaaaggccagcagtgggtccccgatatgtggtcggttgccgaantaaagttgacaaggagaatttanatcctgganncntgttgtncttanatgacnacttttanaataatgccancttccaacgggaggnggtncaaggggnataaacaagcttcantgaantnccanggaatncnanttacccggctntaagnggttntccgataaaatttnggaccaagggatccattgnnttacacttatn

SEQ ID NO: 85100 - DNA, 501 bp, Triticum aestivum
  unsure (1)..(501): unsure at all n locations
  Clone ID: PAT_TA_85100
cagaaacttagccagagattcgtccaggataggggctgtatcgtagggagtagtcgttgcggagattgggtcgaagcggactggacaggagccgagcaaactatctgcagaagaggttaaagggttgccgtgcggactccggagctgtgagaatctaccccgaggtaagctcttagagtcgtagtcaaagaggagaagccaggccgggaacaaacagaaaagagaagagcaacaggagtacaggactcaagtgcaccaagaataggaaagagcanagaccataacagttgaacttcaaagatgcttgaagtgaggactgcaagaaagccggtctccgcccgacatctccggtggtggggtctttatgaaggacagttnaacnccaaggagcttgctggtgaagggtgctttnaagcggccggtccggnatttccaacaacttccaagcaacaagganatttncacaaatggganttnaanggcaaacaaagagggnggccc

SEQ ID NO: 85101 - DNA, 431 bp, Triticum aestivum
  unsure (1)..(431): unsure at all n locations
  Clone ID: PAT_TA_85101
gacactctgcatatatcctctgcgcgtgtatctcgtcgaacagagccgaaagctggagcttccaatggcgggaggcaacgacctgaaggtgctcggcgtgtggacgagcccgttcgtgatccgggtccgcatcgtgctcaacctgaagggcctggcgtacgagtacgtggaggaggacctcggcaacaagagcgcgctcctcctgggatccaacccggtgcacaagagcgtgccggtgctcctccacgccggccgcgccataaacgagtcccaggtcatcctgcagtacatcgacgaggtgtgggcgggacggggccccgggncgtgccttccggncgacccctacnagcgcgcggtggcgcggttctggggcgcgtacatcgacgacaaggtggagtccgcgtggctggggatgctgttaagtcgcaacg

SEQ ID NO: 85102 - DNA, 516 bp, Triticum aestivum
  unsure (1)..(516): unsure at all n locations
  Clone ID: PAT_TA_85102
gttatcttcatctggctgtacaaacccagccctctatgctgttgttattgaaagcccatccttacaagtaccgtcctgctgcagagtggtcacatcatctataccgataaagtctcctcaatttgcagtcatgaaaagcgtgaattacttgcccaatgcactcaccaaggtggaaggagaagagaatggtgcatttactgggcatttggctagacgatgagggcttccgttgcagagggttccgaacatgaatgttggcttccgtgacaaagaacaaggagcttctcatgcctccgttttgacaagatcctgagtggggtgcacagcaagacgggttctgacctccgctngacatctaataactcnaagggaaactcaagcaaggtaatatcaaaggaatgttagtgttgaggaaggnaagattggcgatnagatgatctcanccggtaatggatccttggcaaactgttgtcaaatgggatgataaaaattngtcctgggcaagaaggccgatnc

SEQ ID NO: 85103 - DNA, 515 bp, Triticum aestivum
  Clone ID: PAT_TA_85103
cctcctttttccctctttagcctaatcggcctctctgcactcacaggggaggccaagccccctcgaacttgaatcaatggcggtcgcagcagcatcaggaacaaagtgcgcccgacaactcgtcatgtcatggtagtctcatcagtgccccggcgccagattctgattttgatctcttgtgcgacgtttctcctttcttggatcttccccttcttgacttcgactttagctcccaaggtgtataccagggagatgatgcgtcgtggaattttggtcagaacatgggagagggattgtttgatcaagattatgattcctgacatgaacactctgggatacgaatactcaactcgatgtgggagatggcttcctcgtgcaggagcagcctctcatcactgtcaactcttcaacactcgagcaaccttcaacatcaagcactccccaacctcctgctactaccaacaacaaatctccctcctcatctatcccgggaaatcacttctcctcaaccatct

SEQ ID NO: 85104 - DNA, 283 bp, Triticum aestivum
  Clone ID: PAT_TA_85104
aggcggtggaggagcgtcgagctcgtcgccacctcctacaccgttggcttcgtccagcagagtgacagcgcggtcgtcagcttcctgcgggacaggctcctgtcgggagtgctcgctcgaaggcttctgaaaatggcggactacgactgcggcacgctcgaaagctactagcccccttgtactgtttcctgtgtgtacatcagtacactacacgtgttgtgttgtgcctgctgctgggaataatatgcctactgttatgtgttattagtaaaaaaaggggggg

SEQ ID NO: 85105 - DNA, 459 bp, Triticum aestivum
  unsure (1)..(459): unsure at all n locations
  Clone ID: PAT_TA_85105
ggtcgggacggcatggcccttggagctgcgtaccatcactacctgcagctcgccggcgaccatggcaccgccacacacgcactgctcctcggcgtacttatcttcctcgtcatccgcctagtanccgcaaggcgaaccggcacaacctcagccaacatacgtaagcagcaacagcggcttccgctcccgccttcgcccccgggcaagctgcccatcatcngccacctccacctcatcggcgccnagacccacatctcgatcngggacctgtacgccaagcacgggcgcaacagcctgctgctcctccggatcggcgtcgtgnncancctgttcgtgtcctcgcccagcgtccgccgacaccgtcctgcgcagccatgannacatcttcgcgtcacngccgccgttatgggcgccgatattatccgctacggntcntcggncgtcggttcgtgcctacgg

SEQ ID NO: 85106 - DNA, 474 bp, Triticum aestivum
  unsure (1)..(474): unsure at all n locations
  Clone ID: PAT_TA_85106
ccgccgcgcgtctccttccgcgacacgctctcagtctcacgccacagctcgtcgcgttcgtcaacggtcgacccatcgcctatggaaggaaggcgcgagccggaggcggacggcggaaaggccgggggcctcccgccgtcggagccgccgcacctgcagggccagccgccgcaggagtacgggtacggcacgttccagggtcctcgacatcctcccgtcgggttcccgcagcctgccccgcctcccgggctcggcagcggcggctatcacaaccaagcagcagccgttacgcgcctgcgggagactactacgcccaaggggtaccaagccgtacaagctatggtcctgttgctgaaggaagactttngagaatgagcgtccccattttgtggctcgggttaagctggttccgttcaaaaatgggttttccttggctgcatccaanggtcaattggacttccgttctaaangttt

SEQ ID NO: 85107 - DNA, 529 bp, Triticum aestivum
  unsure (1)..(529): unsure at all n locations
  Clone ID: PAT_TA_85107
tttttttttagcaagatatgttgatgtctcatagctatacacaggtcacccttattacatggtttctgggaaacaagttgatggctacaaaagttccagatctcagccacacccatgacccatgcatgagcatcccaagatctcatgcctctccatccaagatcagagacgtggactacataccttgttttttctctctctctcccatccacacccatatctacctagttaaccagccatgcgttcatgttcgtggtgcaagcagcatgctccatagtttacaagacaagctccagttccttttaagtatggttgagcttgagcagttctctgcagatccggccatgctcttgcaagcccagatctgggtctgtgttttatgtgtggccccanggagccaagaacatgactctccttaaggggtctcggcggccgagccgcggagtcggcgccacgntcggttaacgggcgccggtgtggcggaggcggcgccgtnagagcgcggagttctcacggagggctgctnacc

SEQ ID NO: 85108 - DNA, 507 bp, Triticum aestivum
  unsure (1)..(507): unsure at all n locations
  Clone ID: PAT_TA_85108
ggaacacacacactcggggttccgatggcggcggccgcaccaacacacgcgcccgtgtcctcctcagcgtgccgcgcgggattctcctctagcggtgtatccttccccaattttcgctcggcagcggcttcggcccctgggtggcggcgcagggagccgtacccggcagtctccgtagtgtcgagctccccgcagtctgtggcaggagctataaccgtcgacaccgaggttgacacattgctagacagtgtgaagtgggacagcaaagggttggctgttgccattgcacaaaatgtggatactggagccattcttatgcagggttttgctaataaagaagcccttgcaaaaactatatcaaccaggaaagccacattctttagccgttcacggtcttccttgtggacgaaaggggagacatccatgaacttcattaatgtgcatgacatttcctagacngtgaccatgactctataatataccttggnaagcanatggactacctgc

SEQ ID NO: 85109 - DNA, 449 bp, Triticum aestivum
  unsure (1)..(449): unsure at all n locations
  Clone ID: PAT_TA_85109
ggcgcgcgcaccgggacctcaaccacctgcgcaactccgtgctgcggatgaccggcttcatcgaagggtgacggacgaggcggacccgtcatctgtgcatatgtgcgagaaaagtcagtcaccacgcgtcttcccgacggtgttggccggtcaattttgttcggctcatcttccccgtggttgccaatcaaattaattaatttgcatccgttggttgatgcaaatcggccagtagtgagttaggatttttttttgggaatggaatagtatacatttttcctgaataatctacgactgtactactccctccgtccgaaaatacttgttatcaaaaatgaacaaaaaacgatgttatttaagaactaaaatacatttaagatacatcctcttttaatcaattttaaatgaaaantattcccaagacaaagggagtatgagatcctcccagg

SEQ ID NO: 85110 - DNA, 366 bp, Triticum aestivum
  unsure (1)..(366): unsure at all n locations
  Clone ID: PAT_TA_85110
ccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaaagaagccggcggcgcaccctccctacgctgagatgattgtagaggcgtcccnaaaagggganaanggaaaaggggtccnanctcnggttggcaatcaancaattccnncnagggggaaaccatgggggaaagccccccannaanttccg

SEQ ID NO: 85111 - DNA, 532 bp, Triticum aestivum
  Clone ID: PAT_TA_85111
cgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaggaaaggcaaggctcactgagggctgctctttccgcaggaagggagactagagcggatgtggtcttcaagttttgctctatgccaagatactagcgtcatgaactgcctttagctaagattttccataagttgttctcgaagcagctatgtgttgcatgttggctacttcaaaacttatatctggtttgggttgggattgtgatgaactaatggtctttgaatttatattatgatgttgacatattggtgacaaaaaaaaaaaa

SEQ ID NO: 85112 - DNA, 514 bp, Triticum aestivum
  unsure (1)..(514): unsure at all n locations
  Clone ID: PAT_TA_85112
atttccagcgtgaccaaggcgttccaatcggagcgccttatctaccgctcaccagaagataacgataaagataaggaattcttcttcaagcatatcgagaacgaccccgtcgcaaaagccctcgcagacccttccattcttcgtcccaggaacaaaaaaggcgttgaagacttcttaacagagcttcaaaagtcctctctcgccgtggtcctctgtctctcccccgccgaggccaaaaaaacaaaacattgagagcgaagaaccagttcccatcgggtttatatgcatcggctggggcggcaaacccaaaaacatggaacagcatcgcgctacacatatcggcatcgtaatcgcggagccttttaggaacaagggctatggcggggagagtatcaattgggcgctgggactgggcgtttaagtttggggggtatcatcgtgttgggattgggactttgggttaatgagcgggggcagcatttgtacaagaagttggggttgtggagganggaag

SEQ ID NO: 85113 - DNA, 282 bp, Triticum aestivum
  Clone ID: PAT_TA_85113
ctcagatcgcaaccaggaaggcttagagaaggggctctatcttctgtgattggcttagtacaagttttggctgattatttgttgtctcatactgtttacctgagtattgtttgcaagtgctttatcactgtccgaactgtgcatgcaattcactggtctagagtattgttcgtggattgtttcatatttgtgcgtatggctcatgtctgttgctttgctttaatctgtaccgaacattaagtgtagcattaacaatctgaagcgaacatcaaaaaaaaaaaa

SEQ ID NO: 85114 - DNA, 526 bp, Triticum aestivum
  unsure (1)..(526): unsure at all n locations
  Clone ID: PAT_TA_85114
ccaggaaggccttcttccgcatacggatgaactacgtctgggcgctcgggtacaacgtcgtcggcatcccgatcgctgcgggggtgctcttcccgtccaccgggttccgcctgccgccgtgggtcgccggcgctgcgatggcggcctcgtccgtcagcgtcgtctgctggtccctgctgctgaggtactacaaggctccgaagattgccggcacagctaaagaaattggaattactaccctgtaggcaggtatcactggcactgctgctggaacgggaaggttgtggctggctgctaagtgctaacaatcgctgaaacagaagtctaaaaagaatcgctggaacaagcaagctgtacatatgtgttacaagtatatatacggcgatgctaagtgaagtggtgggtgtaacgtaagtactgctactgatctgccatcgttgcatggatgtataccgtttcctttcctccnaaatgaaaatggtcctatgganactactgctatatggggctgaataaaaaaaaaaaa

SEQ ID NO: 85115 - DNA, 440 bp, Triticum aestivum
  unsure (1)..(440): unsure at all n locations
  Clone ID: PAT_TA_85115
ccgcggtgtgctcaagatctttctggagaacgtcatccgtgacgccgtcacctacaccgagcacgcccgccgcaagaccgtcaccgccatggatgtcgtctacgcgctcaagcgacagggccgcaccctctacggcttcggcggctaggtcgcttcctcatctggtggcgaactgcatctgtgtcggcggtggtcgtgttgtgtgcctaatctagtgtagtccgttctctatatcgtcgctgtgttctgtggtgtcttgtatcccatttcctgcaataccaacttgccattatcaatggaaaaccctcgttttcatcctcgacgtgtctagttctgattttgttttgttctcgtttattgttcgtatgagatgtacatanggctgctgttgctttggngtttgantgcanttttatttgcccaaaanananacaaaaaaa

SEQ ID NO: 85116 - DNA, 439 bp, Triticum aestivum
  Clone ID: PAT_TA_85116
gggtggacgagaagaggaactaccacctgagcagcaacacctgcgaccccggcaaggtgtgcggccactacacgcaggtggtgtggcgcaggtccacccgcatcggctgcgcgcgcgtcgtctgcgccgacaaccgcggcgtcttcatcgtctgcagctacgaccccccgggcaacgtcaacggccagcgcccgttcctcactctcgacgcggctgccaagtagaggcagagagcccggctgcatgcagtgtgcgtacgcacgcatctgcgtgtgcatggcgtggctactcgatcgatcacgtactgcgtgtgcgcgcgcaccataataagtattgtgtgtacgtatatatccgcatctgcagtgtttgtgtcatatataaaataatcgtctgcgtgcgctatataatatctatagaacttcaataattttacataaaa

SEQ ID NO: 85117 - DNA, 455 bp, Triticum aestivum
  unsure (1)..(455): unsure at all n locations
  Clone ID: PAT_TA_85117
gcaatctctagcagcagatcctcgtgcgaagcaaagcgctagcccccttcgtactgtcccgatggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctgggtgcgtgagatcgcccaaggacttcaaagaccgacctccgcttccaagagtccgccgtcgccgcgctgcaggaggcgtcccgaggctactcgtcggctcttcgaggacacaaacctctgcgcattcacgccaagcgcgtcacatcatgccaaaggaatcaactcgcccgcctnctgggaa

SEQ ID NO: 85118 - DNA, 336 bp, Triticum aestivum
  unsure (1)..(336): unsure at all n locations
  Clone ID: PAT_TA_85118
ggcaggtcggcgcgtcatccaccgccggcgcggcgtcgtccaagtcccccaacgccgccgcggccgcggccggcgtggccgcgccggtagccctcgtgctcgcgctggtgggattcttggcgacggtatgatgacgcgtccacggtggctggatgggtgggcggtgagcaggggaggaagtattattgcactgttttctttatttttggttcgtttttcaggtttgttttangctgtgaaataataataaaaacngttggctggctgcacttgttgttgagctgctgtttngtangaatatacagtgatttattacggcaaaaaaaaagggggggg

SEQ ID NO: 85119 - DNA, 513 bp, Triticum aestivum
  unsure (1)..(513): unsure at all n locations
  Clone ID: PAT_TA_85119
gccggcgccggcgccggccccggccccgccgccgcggcagcagggacaggggcagacgcggtgggagatgttcgacctgctgtcgtcgctgccgtccacgtcctcggcctcgtcaacgacgaccgtgagctccacggcgtcctccggcgcgccgccgccgagccgcccggactggatgctcttctgacgagggagggacggcggccccgcaccggccggccaccggcgcgaaagcgaaaggcgagtgcttgatgcggtgcgatgcttgtgtgccaaaaattgcaccccaaatctggtagctcgtcgagtgtcctgatgaggccatgattggcaggcggggggctatctagctttggccacacagctgcattgcgttgggctgcatggtaccgtaccaaccaattcgagttcatcaatcatgtgtgtgagagtattttcttctcctaactctccttttcttccttcctttgagttttttcaatctctctctctctcttcaatcttgtcanggag

SEQ ID NO: 85120 - DNA, 493 bp, Triticum aestivum
  unsure (1)..(493): unsure at all n locations
  Clone ID: PAT_TA_85120
gtcagatcagaagccgccgaggggaggcgccgacgccgagtttttgctccatcccgcatccaccgccagaatgtttctcacgaggacggagtacgaccgcggggttaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctgggaaccaagcagtgtggaaaaaatcatggaaattgatgagcacataggctgtgccatgagtgggcttattgctgatgctagaacactagtcgaacatgctcgtgttgaaactcaagatcatagttctcaatacggggagcaatgaccgtanatcttcaacacagcatttgggacttaactctgcnctttggcaaaggtncaaaaagcaaggtcaangcaatttggagcccccttccaaatgccggg

SEQ ID NO: 85121 - DNA, 184 bp, Triticum aestivum
  unsure (1)..(184): unsure at all n locations
  Clone ID: PAT_TA_85121
gatcaaaattttcctcaattgccattaaaggcgccaacagagtacattgttcgtccattcagagatcagttcacacacacgcacagacacagagagaggggggagctttattttgtttcggtctacacngtggtacncanccactgtnncagttcantcacggtnctcagccatgaacgcctca

SEQ ID NO: 85122 - DNA, 509 bp, Triticum aestivum
  unsure (1)..(509): unsure at all n locations
  Clone ID: PAT_TA_85122
aggaaaagaaagaaaacatgacattaaatcaataagatttagacagtaaatcaataagacttacttgatgtgacacgagtgaatccttaccaggaaatcactatgttgaagtactaaacagaagattcatcgtccaactacggacggcatgcaagggccccgcctactccaacaagcaggacagtccaaaggtcgtaacaaatcgtatgaaccgaacatccatgggactggaaatcctggtgggtgcgataaaccctgcaatgcatacagatattgggagtgtaaccataattgataaaccgtcctcacanaaaagatgatctgggatacttcaaaatatacagactgaattgagtggacagacattancatagactgttctcaggactgaccacacaccaaaagtggcagtactaatgaaaatacagggttcacaaacgcaaatcaagtactgaacantagtacttactacagacaagcaaagttgcactaattaaactctgcagact

SEQ ID NO: 85123 - DNA, 531 bp, Triticum aestivum
  unsure (1)..(531): unsure at all n locations
  Clone ID: PAT_TA_85123
agatcatgcaactctaacgaaacttagcatactgatgaatgcagtgatttctggtcaggatcctgagaagctcttttttggtttcttcgacacagatgggaagtatattgaatccttgctgacagtgaacaagaggacagatgctgagggtaagatcactggtgctctttgctttctgcatgtggccagtccagagcttcagcatgctctccaggtgcagaaaatgtcggaacaagctgcgacaaacagctttaaggaattaacttacattccgtcaagaattaaggaacccactccaatggtatgcaatttacttgtaacttattgaagccttcctgaattgacaagaggaacagcggnacttctttcaacctaatgttctctgtcaaggaccagctgaaaaagattttacatgacactgatcttgaaagcattgaacantgctatatggagatgacacagtanagntcaaccttgagnaactctgaatacggtcctgatgcaaagnatcctttgggcaanggaaaacaa

SEQ ID NO: 85124 - DNA, 515 bp, Triticum aestivum
  unsure (1)..(515): unsure at all n locations
  Clone ID: PAT_TA_85124
gcaaagtccaaggaaacgacgggttcacagccgctgcgctcaattgaccctcccctcgccggcgtccggcgatcgccggcatccgagcgatggatcacccatccacgtgatggatccgacagctccttccccggccccccctgcgggcgatggggcacagccatcggaccagaaccggcagcgaccaaggtctgcactccgtggcgccctcggggtggccttccccatcgcggtatcgttcctcttctccttcctcgttgggctcgctgggctcgcgcttgggtggcctctcgtccaccgcatcggtctccatgccctccacctgccgcatcctctccaagtggcgttgaccttaggtcatcaaaagtttgcgagcttgggttattgaactatagagctaagcatgtcttctaccatcngagtaagaggagattccgctgccatgatgactactactgggcttcaattttacaggttgaatacacagaatattttctgggcaattatcttatgca

SEQ ID NO: 85125 - DNA, 351 bp, Triticum aestivum
  Clone ID: PAT_TA_85125
gcagtaccaggatgccactgctgatgaggaggcggaatatgaggacgaggaggccatccaagacgagtaagggtggtttgggccgccacatttgtacccttgtttcctttcattccggggcttgcctatggtttgcttgttgtattcgctcaagttatgcggtatgtagtagtaccttcgtgcgtagcatgctgtatgctaccacaaagactttgtttcacctgcaccgcttgatatgccagccatggcatatgtgacgagtatttcattattttatctgcttgcttgctcctgtgatggttccttcctatgacattgaatgcgaatttgcccattggtcaaagggggggc

SEQ ID NO: 85126 - DNA, 442 bp, Triticum aestivum
  unsure (1)..(442): unsure at all n locations
  Clone ID: PAT_TA_85126
gtggagcgaccattggatcttctgggtcggccccttcatcggcgccgccctggctgccatctaccaccaggtgatcatcagggccatcccgttcaagagcaggtcttaagctgccgcgggtgtgctgagacatgtggggaatgtattgtctgcccacgcctagtttctctgctgaatcttccatctctcttcccttcaagactgctcactgctgcactgctctgttatctgaacccagaacttcgtgtactcctgtaccgagctgtgtgtatgtttttttttcttccatccgtgtttgttgcaagggtcccgtctccttttatgcgttgggatcntggcaagaaagggcaagatatcatgtgggaaacgtgggttaaaactatcagctgggatttttcatccaaagtgggatcnattcaaaatttcctttaaaaaaaaaaaa

SEQ ID NO: 85127 - DNA, 492 bp, Triticum aestivum
  unsure (1)..(492): unsure at all n locations
  Clone ID: PAT_TA_85127
ggcacccttgggtcttattctacactgattgcccgcagaaagctgaattctctaacctatggggtactaacaaaactgcagctcccatgattcatcaggagatagtcaggtttggttactgcgagtcttcatcttcaaaatcctcaagtgacaactctgaagagcgagatgaatgcggtatagttgacgcactggcnacagcaatancacaggtgaggntntcagagcccaanaggagtcggctgttnagcctacccaacgggttgttgccaccaagcaggaacatctccgaacatgaagaggatgaaccgtgtgtggtttcnaacttggacctacctactcccatccccatgcatgtttaaaacgagataaacaactccngtgattttnnagaagggaaatttcaccgngggttaagttttgcaattgcnaccccctganggtgnaccnccgggtaaaanacncgtggcacgttcctanaaaaaaaaaaaa

SEQ ID NO: 85128 - DNA, 344 bp, Triticum aestivum
  unsure (1)..(344): unsure at all n locations
  Clone ID: PAT_TA_85128
cggcggcctgaccagctcgcaggtgcgtgaggcctatcagcgcctgggccagaccgagcagttgcgcgagagcctgcgtcgccaggtggtacagaacacccgcaacctgttccgtgcggtgaataccgacgtggaaaccgtgcaggcccgccgccagtcgatcatttccaaccagagtgccttggaagccaccgagatcggctatcaggtcggtactcgcaacatcgtcnacgtgctcgacgcccagcgccagctgtacagcgcggtgcncanctacaacnacgcgngctacgactacatcctcaaaaacctgcgcctgaagcaagngggnggcacctcaaccg

SEQ ID NO: 85129 - DNA, 486 bp, Triticum aestivum
  unsure (1)..(486): unsure at all n locations
  Clone ID: PAT_TA_85129
ctgaactctcctcggctcctcgcccacctctcgctagccgttcccgctctgcagtctccgtggccggacgccgcggcgacatggcatcgacctgtttccgcgccgccgcccgcgtggcctccgccgccggccgctcggcggcggccacccgatcggctccctccgcggcccgtgccgccgccgccgcccaccgcgcctcgtccttctccaggatgccggtggagctcgggtgctgcgcgggattgtcgctgctgccgctgcacagcgcggtggcggcggccaggctgacgtcgcggctgagcacggcgtcgagctgccgtgctctctctcaggagatgggtctatccgttcgaangtgataaatcnctggaagattgctcatgtcatgctgttggactcaaatcatttctatagattagtcatctaaatgaantctggagactacactnatcacccttccaaaatcgnggtatctaaatttttccc

SEQ ID NO: 85130 - DNA, 314 bp, Triticum aestivum
  unsure (1)..(314): unsure at all n locations
  Clone ID: PAT_TA_85130
cgtcggcggcctcctcctccccatcctcggcgccctccccgacgcgctcctcgtgctcgtatctggcctgtccgggagtaaagaggaggcacagagtcaggtactgatcggaatggggctgcttgctggttccaccgtcttcctcctcaccctgctttgggggacctgtgtcgttgttggcaaatgtgaccttgggccaaaccgtgaggcagttgatgtaacaagacaccaagggcttcagcttgactgggcactggtattacaaccgacgtgcagaccagctatgcancgcggttcatggggctatcggttaa

SEQ ID NO: 85131 - DNA, 431 bp, Triticum aestivum
  unsure (1)..(431): unsure at all n locations
  Clone ID: PAT_TA_85131
ccggactcggtttcgactttcgagctacagagaattcgtcccggaaaagaaaaaaaaatcacccttccatccgccagagagagagagagaggagtgggaggaccggaggaggagttcaggagggagaggtcggtggnggcgnggtagntcgggtagnacngtgnagctcgggncttaggcgcaccatcggtgctggggatccgcgngcccatgnnccggtgangtggtggngntcgcttggngatcnagttggtatggnggtgtctcgtccgatgggaggtgntgggcggtngtccttgcngttncngtgctgntcggnnccggacnggtcgtcnccannaccgaggggnnatgncctgtanagttgcctcagctttnnanggattttaaattgtnttggaactgntgggatccantcntgttatccaagg

SEQ ID NO: 85132 - DNA, 252 bp, Triticum aestivum
  unsure (1)..(252): unsure at all n locations
  Clone ID: PAT_TA_85132
ccaaaccatcccatgcttgatctcgacaggcgtgggngactctcanatgataaaagaatcagcctcccctcctctgcntcanantactantgttggnangtctgctcnggaggnnaacaaanaatcgagctcccnanagacagaanaagagttccacgacgaacgannanaaaccgtgtcagacaannaccggatgnggnggnaagnggaagcaagatnagtcccatgaagggcaaggcgtccgattctcca

SEQ ID NO: 85133 - DNA, 468 bp, Triticum aestivum
  unsure (1)..(468): unsure at all n locations
  Clone ID: PAT_TA_85133
cgaggtcatcctgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccaagaaggacaccaactggccccttgggtggcccatcggtggcttccccggccctcagggtccttactactgtggaatcnggcgccgaaaatcgttcggccgcgacatcgtggacgcccactacaagcctgcttgttatgcgggcatcaacatcaagtggcatcaaacgggaaggtgatgcccaggcatngggatttccaagtcnggccttccgtgggaattcttnnangcgaccaagtctggtcnctccctaatntttaaaggtt

SEQ ID NO: 85134 - DNA, 508 bp, Triticum aestivum
  unsure (1)..(508): unsure at all n locations
  Clone ID: PAT_TA_85134
tggatacaaatatttgaattggagatcgtatggtacatgtagttcatagtgaaatatgattactgctatatgcatgttttctgttatcaagataatatttaaatgatggtataacttgacaaaaatcatattcccataaggaaaattgattcaaatttagtctgtatggtagacgacaatatatatgttcatagggtggagtaaaatgttcatataagatgcaagatcaaaatgtaggactacatccattataaaccgcaaggtcccctaacgatatattcgaattcaacataacgtggattcaaatactgaaattcgagatcctcgcaattttaatcatataaaaagggacatgacctttcttgtggtgggaattgatttgttttttgttgttgttgagggaagtgcgaattgatttggtactgtacagggtaatcctggtccccccgattttttttacttttgctggagtttttcaatggcattatagcaatatagtaaaaggggn

SEQ ID NO: 85135 - DNA, 483 bp, Triticum aestivum
  unsure (1)..(483): unsure at all n locations
  Clone ID: PAT_TA_85135
tttggctccactggcggcatcgagaggtaccctaatgacagttttgatcgctattggcagccatttccagacgacaagcatgctgtcagtagcacccaaaatgttacatcagccgacttctggaatcttccccctcctgatgtgtttaacacagctttcatagcanaacaagatgcaccgcttgtgttacaatggcctccagtgcctctccaaaatgatagctattatgtcgccctctactttgctgatacattgcctgataattcaaaggacctttgacgtgtatatnaatgattacctctttttcaaagatctaaatgtcacatcagctgganttctgtctttggaacacaatggatctctcaaggcttgaagnacaantacaatgaaaccgctccccttctngcttcnncaacttattaangctggcacggttttgggnttttccccgttggnanatggncatttcncgggagtattccc

SEQ ID NO: 85136 - DNA, 458 bp, Triticum aestivum
  unsure (1)..(458): unsure at all n locations
  Clone ID: PAT_TA_85136
caatcttcctcgttccgccgctccctcgcctccggcagcgaggtgaggccaccgatcggaccttccctagcggcggcgcctaccaacctcaaggagcgatggctctgtctgcgacgctacggatttctcttagcgtcgcgttctttggggttctggcgttcgtgcttggtgtcatcgccgaaaacaaaaagcctgcttccgggactcctatcctaggaaaggatgtcgtcatctgcacgtttccaagtgatccgactcttgcgatggggagcctgtccattgtggcacttgtggtaactgccanccgtangcatgttgccatcntctttccaatactccgggcaagtcattccncccntggagcgctgttttcaaaagcacaacttgacantgttcttggtgttgccgngctttctcaaaccttggtcttgaaattccctggggggaaatttcaacgg

SEQ ID NO: 85137 - DNA, 437 bp, Triticum aestivum
  unsure (1)..(437): unsure at all n locations
  Clone ID: PAT_TA_85137
attcaatgaatcaggttgctgaaggcgtgtcaactgctggcgctgtcatcgcattagctcagaagtacaacgtcaaactgccagtcttgacagcggtagcacggataattgataatgaactaactccgaagagggccgttatggagttaatgaatcttccacagtgtcatagtggatgcccgtcatctattcggcggtggcaaggagcgtctgggtttcaagatgacgcctcgcggagtgacgtgggggccaatgtgtattttcctgggatccaatataagctgataaattcaagtcgtgcccacaataaacattggcattattcaatcccccanttttnaactgttttgccgactcctaaaactncanaatccgtnagcttggcatttcatattccaacctaacaaattcgaacgtncaaagacttaccnaaattg

SEQ ID NO: 85138 - DNA, 537 bp, Triticum aestivum
  unsure (1)..(537): unsure at all n locations
  Clone ID: PAT_TA_85138
tttgaggtgggcatcctacaaggagaaccctctctgcccacagtgcaagcatccattcgaattcctcagcgtgcaccgctctctcgacggctgcctacatgactacctgtttgaggagagtgtttgcctccttctgagggcagcttggtttgaacctctgatcgtagaggctcacgaggaggctctggaagaagaagagttctccaccagcagtaccaatacgatgatgacgaagatgatcttgacgaggaatcttattacatgaacaggtccccaagcatccgtattggtaacaggagatgggggtgacaatgggtaatcaaggggaaggcaggaaaagaggcgaggccngtgaatactgatgtngtgcngggccatccaagaanccnnaagaagaaagagaagccgaacnncttcgggtcngnttcatntccggttcgggncaantttgggnccgtnccaaggattcctgaagngggaaaaaggggcanaancaaaactgaaanaaggaatgcaaaaacactgaanactganagt

SEQ ID NO: 85139 - DNA, 276 bp, Triticum aestivum
  Clone ID: PAT_TA_85139
gcctcagttcggagttctgacacccagccgcctgcatgcgcccgcgcaagctgatctgatccaccactgcaccacccaaagtcatccgcagaagcaagcagctagctggtataggtgagcatcgccaggaaaggagcaaaagctaaggcagctggatcgatcgatcgaagagatgatgctcaaggatttggcaagcaattcaagcaccagcagcagcaactgggctgccgacgaaaacatgtctaacctgacctccgcttcaggcgacctgcaggc

SEQ ID NO: 85140 - DNA, 257 bp, Triticum aestivum
  unsure (1)..(257): unsure at all n locations
  Clone ID: PAT_TA_85140
tttttttggtataaaatttatggttcgtcgtgaaaaggaagaaaaaaaaacaggtccaatttttgaccaagcgccgggtggagggtggaggggaaggcgctaccgcgctagccgctaggctagaagagcggcagccccaccagctggtgccgctgcccnttgccccgccccgtgaacaccccgccccatcgaggcaacnacggagaccccagctacccgcggaaggaactagacgaccccttcaaacnangggagag

SEQ ID NO: 85141 - DNA, 345 bp, Triticum aestivum
  unsure (1)..(345): unsure at all n locations
  Clone ID: PAT_TA_85141
gtcagttgctgctccccccaccttctcctcctgctcctgccctcggtttctgatcagcgaacatgggaacccgcggngtcgccctgctgctcctcgcggcggtgctgctcctccaggcgctcctcctcgcgtcgtcggagggcctggtgcgggtcgcgctgaagaagctgcccgtcgaccagaacggccgcgtcgccgcgcgcctctccgccgaggagaggcagcgcctcctcctccgcggcgccaacgccctgggctcaagcggcgacgacgactccgacgtcatcgcgctcaagaactacatgaacgcgcagtactttgggaagatncgggtcggtcgccgca

SEQ ID NO: 85142 - DNA, 410 bp, Triticum aestivum
  unsure (1)..(410): unsure at all n locations
  Clone ID: PAT_TA_85142
acaactttgcgagcaggatggagtgctatagatgcaatgcaccaagggaggcagcaggcaccgggaggtaagaggcgactggggtgataccaggagcgtgagatgtgacgagctggccgagcagtggaaccaactgccgtcacacactcaccatcaggcatccaggaaggatgagtctactacgtacacgactatattgctgattgccgagcgtagtgccgctgctgtggtttgcgtgggtggagaaagtacccaagcgcaacacctgttacgtgtgttgtttgctcctttttgaggttgtgctgatcaattgacagctganttgtacggcctgatgatgtacttgcattgggtattgtcctaaacacatatatattntgttaaaanaatgcttgcttaaaaaaaaaaaa

SEQ ID NO: 85143 - DNA, 440 bp, Triticum aestivum
  unsure (1)..(440): unsure at all n locations
  Clone ID: PAT_TA_85143
tcgagcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagattccagctggcattccaggtagccgggcgaacaactattaccgtgcagatggccagaacacgggcaacttccttacggacgtccntnaaacaaaggtcaagctgctcctgggnggnggtcntccctggggnactnnttggncggaaangtgatttnaagaagggggcccgnttaattaancgaccnaaaatttgccctgtacctctgtnaaccnngtggaaaag

SEQ ID NO: 85144 - DNA, 444 bp, Triticum aestivum
  unsure (1)..(444): unsure at all n locations
  Clone ID: PAT_TA_85144
gttgttccacgtggtcctgttgcacttctaggtttgggtgctgggacagcagcacatatgatgctagaagtttggccctggatacaacttattggatgggagattgatccgacgataattgaattgtcgagggattattttggtatgtccaatttagagaagaccacggnattangtgggtcactttcggtgcgtatangcgatgcactttccccatcaactacagtttaangnaggattgcctggcnntgttgttgaattaatttcctgatgggaaaagtcctaccccanctccaagaaanccggaaactttgggttnaaattgcaaaaaagcccangccaaaatggccnanncaaggcaaatgnggggggggaananaacccccttccccctgcntngtgnaacgggngttccccttgggncanaatccnaaaacaagggcc

SEQ ID NO: 85145 - DNA, 480 bp, Triticum aestivum
  unsure (1)..(480): unsure at all n locations
  Clone ID: PAT_TA_85145
attactgcgcctgcggaggatcggaggaaccagtagcggaggcttcgattttcggcgggcgcaataaatttcccgcatggctcggagggccgcgtcctcgctcgtctcccgctgcctcctggcgagggcccctgccggcgcgccgcccgctgccccctctgcgccgcgcaggacagtgcctgcagatgggatgcacaggctgttgccaggtgtccttcanaggttcagcactgcagcagcagtagaggagccatcacgcgtcagtccatgtgaactacacaaagntcctcattaatgggaacttngttgaatccgcaancngnaagaccttcccaactcctggacctcntanaagggaaggtgattgctcaagttggctgagggtgacgcanaaggacattaaccgtgcaagtaactgcggtcncaaaggcttttgatgaagggcaatggccgaanattactgcctataaaagncccgta

SEQ ID NO: 85146 - DNA, 511 bp, Triticum aestivum
  unsure (1)..(511): unsure at all n locations
  Clone ID: PAT_TA_85146
cgctgacgacttcttcaaggctgcaaaacttgatcagccaagggacaccaccaaaagcaaggtgggatccaacgttactttgatcaatgtcatgcagctgcctggactcaacacgttggggatctcgttggctcgcattgactacgcaccactaggtcagaatcctccacacacacacccacgtgccactgagattctcaccgtgcttgaggggacactttacgtcggatttgtcacctccaaccaagctgacagaagtaacaagctatttgccaaggttctcaacaagggcgatgtgtttgtatcccccaaggactaatccacttccagttcaacccagtacatgacaagccaagcaatcgcgctcgctgctccaaagtanccaaaaccctggagctattactattgccaatgcatctttggattaaagccactatcncgggtgattccnactaaggctttaagggcaaaaaggganattgattggttaaaccaattctggganaaaacn

SEQ ID NO: 85147 - DNA, 412 bp, Triticum aestivum
  unsure (1)..(412): unsure at all n locations
  Clone ID: PAT_TA_85147
gtggcattgggttggcagcacgcccctgcacacggtgacacgggccacggcgcggcgcggcgcggcacggggagcgagcgccgagcgagagcaagcaaccgctgtccgccgggccggccacggcgctgccccctgcttcgcgccttcgccggtgcgctcacgcctcacgcaggtgcatgcatcgacctacggtatcctagtctgggatcagaaaagaacacagcaacaacaaagaagaaaggcgcgagcgatggacggtgacgccggaccagagcaacacgggtgcgtgcactacaggagggggtgcaanataagggcncctttttccggcaaggtttttggttcaaggaactgccaaaacgaaaccaagganncctggaggtancgtccaacaangcaacgtgnttccctt

SEQ ID NO: 85148 - DNA, 411 bp, Triticum aestivum
  unsure (1)..(411): unsure at all n locations
  Clone ID: PAT_TA_85148
cccacctttgctcactcgcttcgctttccatcctgttgcgcggccgcggcgcaggtgcggttggccatcacaggccaaggacccctcttcctcttccctttgacccaccaccgcccccctcttcccttcttcccccactgtcgccgctcctcgtcttccactctctccactttgctgcttcttctcccttattaatgctcgtgggctcctatgatccgccctccgccgcgggtttcttgatcatcccgggccaaaggaagcgggnccccggcgaacactcctgacagattcgccntcggccgctccctcgatccggtcctccccgntcagcggaaggtgtttaggacctctgcagnatagnanctggtccgtccctgganatttcnggngttaagggagnattcgagatta

SEQ ID NO: 85149 - DNA, 489 bp, Triticum aestivum
  unsure (1)..(489): unsure at all n locations
  Clone ID: PAT_TA_85149
cgcggctgaggaaggagatcacgcggttgctcaggggctggggcgtgcatgatgggattttggttgattccgatggagactccggcgaggcttctgtggagcacgagcttcttccgccacaagatcgccgccatgctcgcctcctcctcctgcttcttatagatcccaccccctcgccgtcgtcgtcggcacggcagctagctcgctagcttctgtacataggtcgacgcgccatatagatactaagtctcggattaancgataattaaggcaaggaancnccaagtttgcttcngctcttnnattaaccangnatccgggaanggtcancttcaacgcaccgggctctggcgccgggnanatgccttcctcnantgcgggccaagcggnggtcccggngggggntnttccancnaggnggganaccangcttgcctttaaaaagggccggngtaaaacggccttnttactcccccaanaactcccagg

SEQ ID NO: 85150 - DNA, 377 bp, Triticum aestivum
  unsure (1)..(377): unsure at all n locations
  Clone ID: PAT_TA_85150
ggttgaagcagcagctcactgcgcgttcagtctcctggcaatgtacttgcttcgcgctgctggtatcctgctgccgctgtgcgttgtcatgcgactgattcgcatcgtccagagtggtcaggagcagcagtatgggctgcagctgctggagcaccaaagaagaaatgtatcaactatatgaattatatgcgtgtccaggaggaggaccagcgagtaattaatatcattaagccaatgaatctcaatgcaagcttgcacaaatgtgcattaagtattaccgtgggaaactttcaaacagaacatcatcngtaaacatttaggtaaanatacanttgnngcaggggaaaaccacaccatttnntccnaaaaaaaaaaaa

SEQ ID NO: 85151 - DNA, 229 bp, Triticum aestivum
  Clone ID: PAT_TA_85151
ctccactactcctgctacagcaaggtcgatcaagaggtcagtgaggccgttataggagaggcgttgccatgttggtcttctttctctctcctctagtactctcgcattcttgcctctccgattgaatctggttccgatgatttgatcggctgctgatgaatctgcatagtttacctgtcatcggtttcatctgtaagtttggtcactgcctcatacttcatgcgcccat

SEQ ID NO: 85152 - DNA, 511 bp, Triticum aestivum
  unsure (1)..(511): unsure at all n locations
  Clone ID: PAT_TA_85152
gttgctccgctccggccgtgacacgagcgcaccagccaccgccagcccctcccccgtcgactcgagccacaggacaaggcatcccaaccgccgcccatctcctatcgtcatctgccgatccctcctcggttcctcacagtcacagagcctcacgtcacgtgtactcccccaacccaacccagcccaacccagcccaaaacctagcgggcgaggggccggggaaccgaccgccggacgcggagatggaccacgcggcggaggcgcagcggacggacctgatgacgatcacgcggcacgtgctcaacgagcaagagccgccacccggagtcccgcggcgacttcaccatcctcctctcccacatcgtcctcggctgcaattcgtcgccgccgcggtcaacaagggcggctcgccaagtcatcggcctcgccggagagacaacgtcaaggcgaggagcaaaagaagctggatgtatgtcaacgagtcttcgtgaaggngctcgtcaagagcggn

SEQ ID NO: 85153 - DNA, 544 bp, Triticum aestivum
  unsure (1)..(544): unsure at all n locations
  Clone ID: PAT_TA_85153
aaaggccggtctactatgtatccactgtcctcactccatgcaaatcacggtacccgcattatcaaaaaattgcatacgtggtattcatggcatcccggaagctacgacaccactttcaagagtgttccataatagtagcctcggaagtaccactcaacgatattatcaagaaccgcgatgcaataggccggattgcaaaatgggccatcgagctcctcccgttcgatataacctataagccatggcgacctattaaatcgcaagttttgggccgacttccgtcgcagaatgggacggaggccgagctccctaaagagtacgacacatattcaaactgggattatgcatttcgacggtccaaaatgttggncggactggggggctggcgtcgtcctgacgtcccccacaggagacatatcccaatatgtgctccagatcatgtncatggattccaacaatgcaaccgaatatgaggcctcctacatggnctccgggtaacaatnccagggtaccaacgcctaaaagnacgcggggatcaaactng

SEQ ID NO: 85154 - DNA, 372 bp, Triticum aestivum
  Clone ID: PAT_TA_85154
gcaagaatggagtggaggaagtgcttggtctgggtgagctcaacgacttcgagaagaaggggctggaaagcctcaaggtcgagctcaagtcttccattgacaagggtatcaagttcgcccacgggagctaggcaactcgcccggcttctaacagttgatatcccttgcaaaattttttttttgactgccttttcccccccgccccgttatggttggcgcaacgaggctttgtggtccataataaaacacagcggagtgtagaaaatgtgcaccaggagcagtttacaaacagcggttcttttttgtgctgaaccaccagtagttgagccgtgaaggaatggaaaaactttccacttgctcaaaaaaaaaaaa

SEQ ID NO: 85155 - DNA, 333 bp, Triticum aestivum
  Clone ID: PAT_TA_85155
ggacactacacagcgcgctactgacatgtcgatgctcaccagcatactgggccgcaagcatcagccgccgccgcagcagcagcagcagcagaagggcggcggcgcgcgcactggcaccggcgccggcgccggcacggaggcggcggcagtggagccggtgagcatcgacatcgcggagcaggggccgctagtggacgccatcacgctggcggcgttcgcggcgccggcgctaggcctgccgccgttcgcgacggccagcatggactggaaggagacgccgacggcgcacgtgttcatggcggacctccccgggctgcgccgcgacgaggtgtg

SEQ ID NO: 85156 - DNA, 517 bp, Triticum aestivum
  unsure (1)..(517): unsure at all n locations
  Clone ID: PAT_TA_85156
cctgggcatggttgagctgctcttgcagtacggcgccaatgtaaaccccacagattcaagagggcggacgccgcttcatcacagcatcatgaaagggcgacatgtgtacgccaagctactgctttccaggggcgctgattctcaagccgcggatagagatggtagaacagcgttacagtatgcaatcgacagcggaaccatagaggacgaagagatccttgttttgctaagaggacccaagtagataaatcacgtaggtgtagtaagtccaagtctccgagtcctgcggtggtgcattgtggctgccttttgcaagtcacctgggcacacacaggggccgaggatgccttgctagtattcagtctctgccttttgtggnaagangaagtatagttttcnagnccgtctgcggtttgggcnccttaaggaaaagtggctgtttgtcgtggatgcatttgcaagttgttgggttgcctttggttgcaaatgtcncantgtacacttgggaagtggntgc

SEQ ID NO: 85157 - DNA, 317 bp, Triticum aestivum
  unsure (1)..(317): unsure at all n locations
  Clone ID: PAT_TA_85157
tttttttttttggggatagaaccgagggctttccattgataatagcagtgaaaatattacaccaaatgggctagaaactggaacacctcgaaacgaagatacagaacaaactacagtagaccggccaactagacacacaaccgaccacggccgtcacatcaaagcatcagaaggggaggcggcctagccgccgaagccgtagagcgtgcggccctggcgcttgagcgcgtagacgacatccatggcggtgacggtcttgcggcgggcgtgctcggtgtaggtgacggcgtcgcggatnntctccnaagggggggggg

SEQ ID NO: 85158 - DNA, 499 bp, Triticum aestivum
  unsure (1)..(499): unsure at all n locations
  Clone ID: PAT_TA_85158
ttttggcatctcaaaaaaacctctataatttggcaacaagtaagcctgctcaccgaagccagacatactaggacatctcaacagacgtatattctacaattagtaaccgatatcaccactgctttgccttgccacaaaacaaggaagcatcaatttatgacctgacttttgttcataatcctcacatgaactcgaatcaccacaccactcttttggtcaaccgtgatggtggccacaaaactaaactactaccgactcatagctaccaagaactcactttgccatagcagcggccgctgatggtgcccgggcaccacgtccactgggatgtgccaagagtagtcgacccgctgatagccaacatcacctccgtgtaatgagccaccctgccgccaactcgggctccataatcggatcggtaactgaactcgccccttccgtacctctgctcattgtatgtacacggctctaanccttcactcggaaattacacctctac

SEQ ID NO: 85159 - DNA, 494 bp, Triticum aestivum
  unsure (1)..(494): unsure at all n locations
  Clone ID: PAT_TA_85159
gcaagctcccgccccatctccgccgcctccgctccccgtcgtccggctgcgctgttgctgctcatacggatcaagctcggctacacccgtttctgcgagcagatcagaggacgccatcgtcgggtcggtagggatgggacatgttcactccgatcaaaaggcgaagaaattggcgagtgagtctttctctctctctcctatcccgcgcctctgcttcgtcctcaagccagccttggaagagtggccaagggtggggatcaagcgactccgaagcacttgaagacgagatcaatgggagcagaagggccgaaacgctaactgggatcgctgggaacccaagagggggcggcaaccttctcctgtttggggggagaaatcncatctaaactggggcctaaggatccacatgcttctcggaagcaaaaggggcaactgggatcttcttccgggagacgtacatccagttatttgcgaacaaagagtataattccaaa

SEQ ID NO: 85160 - DNA, 517 bp, Triticum aestivum
  unsure (1)..(517): unsure at all n locations
  Clone ID: PAT_TA_85160
ggcaccgcagggcgcggcgtggccatggacatggacagggacagcgtggagtgcctctccctcccagacgctgccatggacgtggacaacgtcgacggccacccgcaccacggccatctcggtctcccgctccaccccgcccacctcccatcctctggtgccgggcgcgcgttccccaaggtgaatgccgggggcggcggagcgggcccggctgtagcgggagcggcgggcgcagcaggagcaggcggagggccgccggcgaccagcgtgcacgagctgctcgagtgccccgtctgcactaactccatgttcccgcccatccatcagtgtcaaaatggacatacttgtgttcgacatgcaaggccaagggtgcacaaccggtgccctacatgcagacaagacttggtgatatcaagtgcttagcattgggaaaagtagcagagtcactgagcttccatgtnagtactgctccttaagttgccagagatcttcccgtactacagcaagataaagcatg

SEQ ID NO: 85161 - DNA, 536 bp, Triticum aestivum
  Clone ID: PAT_TA_85161
cctcatacgacctcagattgagacgaattatatatgaaaatcgatcggctcgatgagacgaaacatttttgtgttgaagatttttcaattcaaggccgtcttgagggccgaattgctcacgcattgtatcagacacgcatcaacatgtgtctgatgtcaagcgtaatattttggtctctgggctgtccaggccgtattgactgtaacttttgcatatgaattcggattaagatgatttatatatgaaaatcaattgactcgacgagacgaagacagttcctttatagtgctccttcatctgaggtcatattgagagcgtaatcggccgaaaagcactcaagaacactaaattttgtcactcggaggacagcttcgggcactgagatgaggtcgaatggcgatagcctaaacatcaaagttgtttcactcgacgatgtgaaacttctcaagctgaaaccttcacccgtatctggcaaaacaagtgtcaacacagcctccctgtgtttcggcaaaggtgcatgccgaaaaataatatc

SEQ ID NO: 85162 - DNA, 531 bp, Triticum aestivum
  unsure (1)..(531): unsure at all n locations
  Clone ID: PAT_TA_85162
gtagtatctctctctccacccttgggtacgctgagcacaaacaaggggcaattggtaaggagcacaaggcctgggctctgatgggagtggagtgaggcgctgcacgggattctctgcttctgcgtggtagagcaggtacggtgagacagcagagaaatcaagtgacgggtgaaaagattgttgccatcagtcagggatgaacagcaaggagatgtgccaagaaccgtgcgacgagctgtccgagatcagcagccaggaggcgtccaaactcctccggcctggtaagcctcgacctcacgctcaccgtcgccgccgccgccgccgccgagtcgagcataccgacaacaagtaacagcggcggcacgccggccgacgcggcggcggtcgcccgcgagcgttcgcgcgtgttaacgtgcaactacngcaacgcagttcttcaactccaaggcctgggcgggcacaagaaccgcaccgggcgggagcgcanctggccggccacctgcggtcacccgggggccctacggtatanca

SEQ ID NO: 85163 - DNA, 524 bp, Triticum aestivum
  unsure (1)..(524): unsure at all n locations
  Clone ID: PAT_TA_85163
aagagatctagaataacattacaacatagcatgaccatttgtgcatctcaaccttgccaaagatatccatagttcagagcattaacaagatgatcattgatcaagacatcataacaagcaccaaacgatcacatccaatatggcatgtggtacaagtaggaagagctaaggacaaaaggcaagccaggagtcatgaccattcagacatgccctgtggagaatgggggctcctcggcttttcttgcatcatatcatggcctggaatgggaacaatgctctcttggaggcggtgctgagtaagcaacatgcaatagtgactcttcccaatgttcacaacacctaggaacttgccatcaacattgcagcgcaacacatgcttcttattgaacatgaccagcagctcacatttgtttagcacagccacatcgttcaacaatcgcaccgttagaatcaagtgaccttatccttttctttcaaaagaagttgaataaagttgtcttgatgcctccacggntggcanntta

SEQ ID NO: 85164 - DNA, 495 bp, Triticum aestivum
  unsure (1)..(495): unsure at all n locations
  Clone ID: PAT_TA_85164
gaaaattttccgtttccgttccgtgttggacctcttgttgcacgcacattttttttataatgcattgcgcgcacgccccctcctgcgtgttggagaaaatacaccgcacgctctacgttttcttctagccaaacacaatttttaccggtacattacatgcccctataatgacaatattgtcatgcatctaggggtgacaatgagcttttaattttacactatacaatttaaggattaaatcaagattaagattaaaccctatttctatgtaattttgaactaaattttatttagggtcctgacattctgtgaataatcatttgtagcacgatccattaccactgtacatgcatccatctgttctgtctaccataccangaaccaacacattagcatcattttcttccaataagaaaggagccaccccagtcccagctgtgcaaattattgggcagcgtccacaaactgagcagaatcctatatatactgggatca

SEQ ID NO: 85165 - DNA, 524 bp, Triticum aestivum
  unsure (1)..(524): unsure at all n locations
  Clone ID: PAT_TA_85165
ccttcgcatatccccaaagcaagctcgagtgaagaaactcacgaaatctgaagccagctgagagaggcggatggggcagtgcccgtgtttcgggtccgcgaaggcggcggagcaggagcggcgggcggaggcggaccggcgcgagtcgcaggatgctcgcgccaaggccgccgaggccgcgcagaggaggtaagacagcaggactatgagaaatcggcagctggaagggcagccaaagcacaaatgaaagcaatgaaggaatcaaaggcatcaaaccaaggtggagagccggttcttaagtggcagatgggatcatgagtttcgtttctgttgatttgcatccctccgcttacttttgatggccgacagaaaattgattgcgactaattctgataggatcactgtgattgtgtgattatgcaatnaagtgtacatccngtttacaatctctatgctgtacatgctatcccatagacngccaactccaattaaaatcacaatttgtgttgtaattaacaaaaana

SEQ ID NO: 85166 - DNA, 521 bp, Triticum aestivum
  unsure (1)..(521): unsure at all n locations
  Clone ID: PAT_TA_85166
ccgccgccgccccggcccccagcaaccagcagatcgggacctctgttctgcgcaatccatccatggcggaggaatcaggccgtcccttgccaaagtttggtgaatgggatgtcaacgatccggcttccgcagacggatttactgtcatattcaacaaagccagagatgagaagaagggtgggaatggtcaagacacagactcaccttccaaggaccccaggactgagagggttggagtcttatgctgcaaaaccaagcacgaagaaatggttttgttgtgtgacagccagccctacgcaatcctgaggaaggcaattgcatgcgctgggaaatactgcccctttaattttcctatacatactatcccataaagacactgttagaggtacccatggtctcctgggctcccaangatgggtgtctcaataaaaccctggcgtgcatgtagtatgtatggtgtgaagagttgtccggcatacatttgcaaagtgggcttcggcttgtaatccantcctgtcccc

SEQ ID NO: 85167 - DNA, 423 bp, Triticum aestivum
  unsure (1)..(423): unsure at all n locations
  Clone ID: PAT_TA_85167
gttgaagctgaaccgtgaagtagttatactgcttatgcttttctttcttatagtaatatgctccgtctcaaaataagtcaatttctagaatcacttaaagtcaaattatcttaagtttgaccaattttataggaaaggcaccatcgtctatgtctctatgacaccaaatgagtacattatgaaaaatattttatggtgcattagtgacactaattcagtgccatgctctttttatgaatttggtcaaacttaaaaatagtttgatttaagataactctgagaaattgatttattttgggacagagagaatgtttctgggttgtcttgtaaatacaagttcttgtcattaagagtatatgatgactangaccggtttaatccgaattaaaacacacncantggcaaaanccgntngtaaaaaac

SEQ ID NO: 85168 - DNA, 381 bp, Triticum aestivum
  Clone ID: PAT_TA_85168
attttgttgttctactcggtcattttggtgtcctaaacttgtaattttgctggaatattgtacagggcatctgatgcaaggtgcaaagactggtgttaggtctgcggttgctttcaaggaggtgtgtgccggttgcttgcacatctttaactctgggtctgaagagcaaatcagaagtatttatggtttaggaaatatgcacctgctttgctggagaactttgtcctgctatttatttatagacacttctgatctacaggaaggcggccattcctcactacctctctttgcccattgtctacatttatttgttctactagtagattaggggactacagatgtactcctgcagatggttaatttgggtgggctattttcgat

SEQ ID NO: 85169 - DNA, 257 bp, Triticum aestivum
  Clone ID: PAT_TA_85169
ctcgtgccgaaacaaatgcgtacctctgcaggcctagttttctgcaaatcgcttcagggtgcaagagtgtcataaatctttatggccaacatctttcttgtatcatggaatcgtgtgtcatgtatcttccctgcaaataataactaactatatgaggagagcagcagggaaagaattttctttccaactactgagataatcactgtactggaaccattcacatttagttctcacttttcagtgttaaaaaaaaaaaa

SEQ ID NO: 85170 - DNA, 490 bp, Triticum aestivum
  Clone ID: PAT_TA_85170
tggggacatatgttataaacaagcaaactccaaacaaacaaatttggctatcttctcctgtgagtgggccttctaggtttgattgggatgcaacagctaatggttggatatacaagaggactggagtgaaccttgtgcggcttctggagaaggagattggtgagctctgtggtactccagtagaactttagtaacagtactggaaatgccacacagctaggttgtatggagagcagtgctctgaatgtcgaagtgtagtacacaaaactttttttttgttctacacatttgcacatggtttggaataaataacttcccctctctggtagcggggaacagtattattcggaaatggtgggagtatttttcagcttttgtaagtaccgaattccgatcactgtcagcctgtcagactacattagtgtttctggatgcaatatcacattgcaagatgaccagatatcacactatattctgttgtgccaaaaaa

SEQ ID NO: 85171 - DNA, 298 bp, Triticum aestivum
  Clone ID: PAT_TA_85171
tcaagagaccctgaggtcgcgatgaccggaaggctgtagatgaccgcctgccgataaacttccggatcgatgtattgcttgacatcaccgaaatactggtactgcccataacctgccgcttcactgagcgctgcaccccagacagcggattcgtaaccgatgttgatatagcgactgaattcggcattgccagtgagatcgccaacgatacccaagaggttaccgtagttactgatatctcggggatcaccgtattggacttgtcggatcacttcattgccagctgccttgggggggg

SEQ ID NO: 85172 - DNA, 340 bp, Triticum aestivum
  Clone ID: PAT_TA_85172
gatacattgggtttcaaccgctattataaagaagagaaacaataccaagtggacaagtgaaggaagcagctgaagtctgatcctgtggattcagtcggatcgtggccatggcttaatttccaccggacatgctgggcttccaccggacatgatgcagaccaatcgtatttatgttgagttgtaatcgaacgctgcgtagcgcagtatcccgaagaacatatatatggggtcttctcttccgtttctgctctgctgtggtttcaataatcccgaaattgtgattccagtttaatataacaggccagcttgatggggctttcgttatgccaaaaaaaaaaaa

SEQ ID NO: 85173 - DNA, 499 bp, Triticum aestivum
  unsure (1)..(499): unsure at all n locations
  Clone ID: PAT_TA_85173
aaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacactgagcacgctcgccgtaagaccgtcaccgccatggacgtcgtctacgcgcttaagcgccagggccgtaccctctacggcttcggcggctangcctgccgccccgcgcctcgccgtcgctgcggttctggtgttgctgcaattcgcaagttgtttgtgtgggggaaatttgctagatactggtanaactgcagtgcggtatgctcacatggtgtgtttgtccgaagaaatgttgtcattgctggg

SEQ ID NO: 85174 - DNA, 488 bp, Triticum aestivum
  unsure (1)..(488): unsure at all n locations
  Clone ID: PAT_TA_85174
ctccctctgagctaccgggccgccctcgtcagctgtctcctctcgtggctgagcatccgccggcctggcctgcgcagccgcctcaccccttcttcgtcttcacaaaccatgagatgagtgcatcaggagatctccacaggaggcctgcaggggctgttcccagctgggcatggcaggtggcagcagcagctcctcctcctgccgccctgccgtcgtccgctgcagcatcatcaggattctccaacaccgccacgacagctgccaccaccgccccatcggcctcctccctccggtactgcccgccgccgccgccgccgtcgagccatcaccatccccgctgagagaatcaagaagccgcactgtaaatctgccgggaagctagcattttccccccggcccctccccctctccgggcgttgcgactttttcagttttgcgccgccggccggggtggtggtttcntgtaccgatcgattggatcctcgtat

SEQ ID NO: 85175 - DNA, 486 bp, Triticum aestivum
  unsure (1)..(486): unsure at all n locations
  Clone ID: PAT_TA_85175
cgtcgcttcagtcacctctcagtgtcgaggcaggtctcaaagcagtaaaagttgatcatgggtcgtttagatggtaaagtcgctatcgttacaggcgccgcgtctggctttggccaaggtatcgccgagcatttcgctcaagagggcgccaaagtcctcatctgtgacatcaacgaagaagcaggccaaaaagtagctgcgacgtctggctcgttcgagtttcagaccatgaacgtcaccaaagcagcggattggcagagcgctgtcgagaaagccgttcagctttggggacatcttgacattctgggttaacaacgctggtaccagctacgagaacaagagcaccaatctcgtcactgaggaagaattcgacaaggtaatgagcgtcaacgtcaagagcgtcttctcgggaagcaacgccttcacagtcagtcaaaagcaagnacaaaagntccatgatcaacatcgcctccgttggcgccaacg

SEQ ID NO: 85176 - DNA, 509 bp, Triticum aestivum
  unsure (1)..(509): unsure at all n locations
  Clone ID: PAT_TA_85176
cgccgccaccgcccgatccaggtctgcagactgctccctcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccaagcgcctcgtccgcgagattgcgcaaggacttcaagacggacctgcggttcaagtcctcggccgtggcggcgctgcaggaggccgcggaggcgtacctggtggggctcttcgaggacaccaacctctgcgccatccacgccaagagggtcaccatcatgccaaggacatcaactcgccgccgcatcaggggcgaganggcttgagctgtccgctgctgctgttcgtcgttgtaactctgaagtaatt

SEQ ID NO: 85177 - DNA, 502 bp, Triticum aestivum
  unsure (1)..(502): unsure at all n locations
  Clone ID: PAT_TA_85177
ttctgatgaggatgattctgatgattctgatgaaggcgagggattatctcctgacgaaggcgatgatgattcaagtgatgaggatgataccagtgatgatgacgaggaagaaaccccaactcctaaaaagccagaggcaggcaagaagagaggtgctgaaaatgctctgaaaacgcctctttctgataagaaagcaaaggttgccacaccgccagcccagaaaacaggtggcaagaagggtgccacccatgtggcaactccacacccagcaaaaggcaagacccctgcaaacaatgacaaatcaacggagaagtctccaaaatctggtgggtcagtcccttgcaaatcatgcagcaagacattcaatagtgagatggctctgcaggctcactccaaggcgaagcatggggccaaatgagttgcangtccaactgagtccatgaaggagaagcatggtggccaagtgagtcgaagtccattcgagtccatgaaggtgaagcat

SEQ ID NO: 85178 - DNA, 493 bp, Triticum aestivum
  Clone ID: PAT_TA_85178
cgataaataatcaatcatcgctcacaacagttggtgacatgcaaaccatatacatcaaaaataaacagggctcaggcctacctaagtacatcaattttgaattccgttgaagttatttacactctcgaaatggtatttgaaaaacaaaaaaatgttgaaacgaatcgctgctacaaaagcattgttggggactctcaaaacttcggtggagtcatcaggcttatggtcagacatcattgtatgctcatctctccggatgacacagctctctcaccaaatggtcgaaaaacgtcggcgagctcatcgagcctctcctccagaagctttgcgtagagcttgaggagtgactcaagtgcgtcggccctttgctgaactatgttcaaatgatccactttgcaggtgcgttatctgtatgcgccaattttagtgtgctaatgggtgatgattcctttgtataattgtgtcacacaactttggctttgttgcttgataa

SEQ ID NO: 85179 - DNA, 500 bp, Triticum aestivum
  unsure (1)..(500): unsure at all n locations
  Clone ID: PAT_TA_85179
caaaaccaaaatatactttgtgctggaacatgttaaaggtggagagctgttcaacaagattcagcgaggaaggctcaaggaagacgcagcgaggaagtacttccagcagttgatctgtgcggtggacttctgccacagcaggggtgtctatcatcgagatttgaagccagaaaatcttttgctcgatgagaatagcaacctaaaggtatcagattttggtctaagcgcacttgctgaatgccatagacaagacggcctgctccacacgacttgtggcacgcctgcttatgttgccccagaggtgattaacagaaagggttatgatggtgcaaaggctgacatatggtcttgtggggtcatcctgtttgtgctattggctgggttatcttccgttccatgataagaacttgatggacatgttaggaaagattgagaaaagctgacttcaaatgtccaagttgggtttccnaccgatgttcgganggctttgcaaaggattc

SEQ ID NO: 85180 - DNA, 487 bp, Triticum aestivum
  unsure (1)..(487): unsure at all n locations
  Clone ID: PAT_TA_85180
cccgtctaagcactcggatcctctgccgccgcgatgagctactacggccagcagcagccgcccgtcagcgcgccgccggcgcaaggttatcccgggaaggacgcgtacccgccgccgggctacccgcccgcgggatatcctccgccggcgcagggctaccccccgcagggctacccgccgcagggctaccctccgcagcaggggtatccgcagcagggatacccgccgcagtactcgcagccgccgccgccgccccgccagcagcagagcagcgggccctctttcatggagggatgcttggccgccctttgttgctgctgcctattggaagcctgcttctgagatctaagctgcgcacaacttgttctacaaaacaccacttcaatttgcacgggtgatataactggggattggcttgttncgaagaancgaagatacatgggttcttatcaaatcacaagtctcctagttctttcnatcgttctga

SEQ ID NO: 85181 - DNA, 213 bp, Triticum aestivum
  unsure (1)..(213): unsure at all n locations
  Clone ID: PAT_TA_85181
aggccgggggcaagnanctgaagcatagcagtcaantggntaccatcagagccgccgcggagatcaccgtcgtcgcccgtgcngcnatcnccaggccncaggccctatgtctgccccagctgangacnaggagctagaggntgaggtgcanctactcgancgnagccaangaggtgacnccggctgcngccgtccgcggggtccgtgcgcttc

SEQ ID NO: 85182 - DNA, 496 bp, Triticum aestivum
  unsure (1)..(496): unsure at all n locations
  Clone ID: PAT_TA_85182
atcgaattcatcaagaagtacctccacgcgctccactgggaagcagtagcggctgcagatgccgagcccagctcggaatcagaggagaacgagatgatcttggtgatccggaagaagttgtggctaccagaagcaggctcgcacacgtgattcccttcccggcgtctgcagctcagaagcgaggcgccagctgcaccagccatgatttatttctagccctactgcacacatggagatagatttattatttacgaggatacggaaaatatgtggcaggcctggattaaaaaaaggctatttttttctcattctcgacagatatgggacttgatgtttgttctctaagtttgggttaggaaataaacattctttttcgtcttaatgttgaggctcatttangtgtttgatgtccatcaatggaagtctgatgtagtctgtagctagtgtatttagtgtttacttgaaagaactactgtacgcggatacgtggtttgca

SEQ ID NO: 85183 - DNA, 484 bp, Triticum aestivum
  unsure (1)..(484): unsure at all n locations
  Clone ID: PAT_TA_85183
agacaacaggttgatggaggctaagatgggacgcttcttcgagtccgtgagcaatttcttcaccggaggcgaccacatcccctggtgcgaccgcgacctcatcgccggctgtgaaggagagcttgtcaatgctgtaaatgaggaacaaaggaatgaaagccttatgaggttgtcatgggcccttgtgcactccaggcagacagacgatgtaaaccgtggaatcagcatgcttcaagcttctttggataattctgccagtcctctgcagactagggaaaagctgtacttgttggctgttggattctacaggattggcgactactcaaaaagcaggcaacttgcagatcgttgtttggagattcaagcggattggcggcaagccatatcgctgaagaaggaatagaagataaaattgccaaagatggtctgattggataagaattgcgacaactgcgtcggacttctggttggtggaatgcanctg

SEQ ID NO: 85184 - DNA, 492 bp, Triticum aestivum
  unsure (1)..(492): unsure at all n locations
  Clone ID: PAT_TA_85184
ggttgctctaactgtagaaaaaagtgttgcgtctcagaggggcaattatcttcctgctgaccagtacttgaatcatgctgagaagtcagacatgactattgtggaagctttcaaaaggatgcaggttgttcagcatgaggaacctgaagatgtggctgaggaaaatggagaacttgatcaacaggcatttgaagagactgaaatgcagaatacagatgatgatgctgatgaacctgaagagacagttttagtaaatgggaacaagggtgaggaacatcagggtacggacaatgaaggagctttatctgcctagaattcttgggcaaatatgggaaccccaagttttgcctacgtgctaactcaacatgaatangggctgaaagaagcacagctcaatgggctgcaaatttttttctganggtaacaaatgtgggcccctgtttactctgaaacaccggaactggggatgctngaccgcctgatgcttgtaaa

SEQ ID NO: 85185 - DNA, 521 bp, Triticum aestivum
  unsure (1)..(521): unsure at all n locations
  Clone ID: PAT_TA_85185
gtttaatataaactctctttttaatagatgctgacatgtgggccccactggtcaggtttgacctggtaagtgcggctgttgactgctgacatcatcctctagtcatgctgacgtcataattctatttctgctaatttagatnattccataatatacataattttttgaaaattcatagataattaaccgtagctcagatgaaaatgttttgtatatgaaagttgctcaaaacaacgagacgaatccgaatacgcggtccattcatccgccacacgtccctatcatagcaaacgttgaacctttcccctccggtcatctgtctgacagacgtccgggaaccgggaaaactttccggatgttttcccccttccgccagtatcgcctaacactgcgttagaacacccctagctctgcctgttgacttgtcatgctaagtttgctccgtaattacngttcctccccctcttcctttccggtagacccgagacgccgctgatgtactgtgatcgacatgtcacgac

SEQ ID NO: 85186 - DNA, 513 bp, Triticum aestivum
  Clone ID: PAT_TA_85186
gtctcgagttttttttttttttttttaaaagcgcgccttctttttttcacataaaattcgaatgcgaatcctgaacaaccaaggaagtagaagaaaaaaaattacaaacaaacagttactacgctcagcacggctattggcagagcagcaccaagattagtaataagtattgtccgccgctaaacaccgttacaaaatttggctcggctcccggcactccacgtcaccaccaccatctacaaccatctacagctcgtcgtggtcgtcgtcaacaccgccgtcagcgtcaccgccaggggcgccgcccgaccgctggtacacggccgacacgatggggttgcacacggcctccacctccttgagcttctcctcgtagtcctccttctcggccgactggttgtcgtccagtaacaagaatttgctgctctgtacttgctcgacgaaggctggggcttcacgatgaatagggaggaatggttgttgtatatctcccttctcatcaatagctcacat

SEQ ID NO: 85187 - DNA, 514 bp, Triticum aestivum
  unsure (1)..(514): unsure at all n locations
  Clone ID: PAT_TA_85187
taaagacggagggagggtgtgggacctcgagagcagtgcatgtgctatctttgaggcatcctgctggcatggtggtattttgagtaccagggctactgatagtgaacgcacaccatattcgctagtggagagtggagattgcagagaagctgaccagacttttgcattggttgatgatttctgttttacgtgtcggtagtttatgtacaatggcatggagcatagctagtagatcaaatttccggatcctctgttgtactgtccctttgtggacaagttgtggacctgttggatccttgcaaacgcattgtgatccaggacctagaggacaaaatcaaactgtccagcgattgttacttggaccttccaacattgactgcatactaagtaccagcgattcgtagctgctactgcctttctcatggttaccggcgaacgttcaancantgtttatttgcatctaacangaattgtaagggagttatcgcnaatatatacncgtttgaagtggctc

SEQ ID NO: 85188 - DNA, 520 bp, Triticum aestivum
  Clone ID: PAT_TA_85188
gcccgcagctggagccgctggcggaggcgcagcgcatgctcgtgggcggcctccagcacacgtcaacgcaggcggaggacgcgctgtcgcagggcatggagaagctacagcagaacctcgccgagatcctgaccgccgaggctgaccccttcggggcccccgacgcctacatgctgcagatggccactgcggtggagaagctgaaagagctcgtcaacttcgtcacccaggcggaccatctccggctgatgacgctgcaacagatgcacaagatcctgacgacgcggcaggcggccaggggcctgctggcgctcggcgactacttccagcgcctccgcacgctgagctcgctgtgggcggcgcgcccgcgggaggcggcgattagctagatgcccgcggtgtgggtgtggccaaccaaaggccaccaagagaacacgacgacgacgaatagtacaattcgctgtatactttccaagctgtaaatcaatggaggacgaaaaaacgactacaatcactgggg

SEQ ID NO: 85189 - DNA, 506 bp, Triticum aestivum
  unsure (1)..(506): unsure at all n locations
  Clone ID: PAT_TA_85189
cagatagctgccagtagagcttcttcttcttcttcttcttccgcttcctcttgccgagcgcagtgctacgtaggaaggagttcacgccctcgcgcacgcgtcgtagctcgtcggtcgatcgccggaaatgtcgaccaactcgagggccaactccagggccaacttcaacaacgagatccacgacatcggcacggcggtgcacaactccagcagcctgccccccgcgtactacgaccggtcgctagcggacatgttccctccccacctcctcaagaaggtggtctcggaggtggtgtccacgttcctgctggtgttcgtgacgtgcggggcggcggggatctacggcagcgacaaggaccgcatctcgcagctggggcagtcggtcgccggcggctcatcgtcaccgtgatgatctacgccgtcggcacatctccggngcgcacatgaacccgccgtcacgctcgccttcgccgtgttcgcaattccctggatcaagtcccgttcta

SEQ ID NO: 85190 - DNA, 506 bp, Triticum aestivum
  unsure (1)..(506): unsure at all n locations
  Clone ID: PAT_TA_85190
agccgccgccgtggtcccagtgggcaccgtcgggtcaacccgtaggcgtaccaccacccacagagcaccccggtggcgtctggccgccgcacacgccaacggctcccggcacaccaggatcagcgtacccgccgggcacaccaggatcgccgtccacaccgacgactccgggcacgccaggttcgacattcccgccgacgacccccggcgcaccagggtcgttgccatccacgccgacgactccgggcacgccaggttcgacgttcccgccgacgaaccccgggcgcaccagggtcgttgccacccacgccgacgactccaggatcgacgttcccgccgacgactcccggtgcgccaaggtcgttgccaaccacgcccggctacaacctccgtccccaagcgaccacggcagcagccaggagcacacccgccatcggcactggcacaacgggggngtctacgttccgcccgtgcacgggtggctatcgtcgccgctcgccgccgtc

SEQ ID NO: 85191 - DNA, 518 bp, Triticum aestivum
  unsure (1)..(518): unsure at all n locations
  Clone ID: PAT_TA_85191
gcaagcaaggcactgattgggagggtggtcatttcccattgaccttgcattttgatgaggactacccaagtcggcctccccactgcaagtttccagcaggtttcttccatgtcaatgtctacaacactggttctgtatgcttgtcgatccttggcgacgcatggaagccttctatcacagtgcggcagactctaatcggcatccaggaccttctagataatccaaatccagcctccccagcgcagaatttgtcctacgtgctctttacacagaatatgccggagtatgcgagtcgtgttccgtcaacaggccaagcgttacccttcgcttgtgtaacgttggatcatctagcaaaccagctcctcacttcgtcggacactgtcacgattcgtggttatattatccatccgtttcaataggcttgttgggactgttaaaatgcattcaatggcttggcgttcataaacaagcttcgttctgtatgagatgtttcctaattcaaaantggtgtcaaggat

SEQ ID NO: 85192 - DNA, 500 bp, Triticum aestivum
  unsure (1)..(500): unsure at all n locations
  Clone ID: PAT_TA_85192
cacactgcaccatcattgcattagcaagcagtgaagcacaaagcacaaacaaagcaagccgatcgaattaataggtgcagcatagtgctcgatagcttgctcagcagcaagcaagcaagctaggtagccgtgtgaggttggtcgatcgacgagatgaagaagggagcaatggcctcattggtccctctggttgttgcgctcctcttgtgcccgtcgtcgtcgctggcaatggcatccggcgccggccctgcgcagtgggggaagaagctggacccgcacttctacgaccagtcgtgccctcacgcgcagcacatcgtggcgtccatcgtggggaangcgcaccaacaaggaccccgcatggccgcctccctcctccgcctcaacttcacaactgcttctcaanggctgcgacgcttgctgctgctggacaacaacgggtcatcgtgagcgaaaacgtccaacccaaacgggatccccaagggcttcaagtcatcacaaat

SEQ ID NO: 85193 - DNA, 598 bp, Triticum aestivum
  unsure (1)..(598): unsure at all n locations
  Clone ID: PAT_TA_85193
gtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaaggtgcagtgcgtcagcttcatcgccttcaagccaccgngctgcgangatccggcaagggctaaacagctcactcacacgggccacatataaagtgcaantgcnggtttgtcaactctgacattccttggtttccntcncaattacttcttgtntgtccaagatattgntgtcaagttatgtncaacatgctcagaaacatccgtattnatg

SEQ ID NO: 85194 - DNA, 605 bp, Triticum aestivum
  unsure (1)..(605): unsure at all n locations
  Clone ID: PAT_TA_85194
attttccctcgtcctctccttcttcacggccaatcaatcctcctgttctcgtccactcaacgagcaatcagaatcgcctaaggcctctcgaaacatttgatttgattgacctgtgtcgctacctttattctctggccattcacaattcacaagcacttcttcccttgattggatcatacacgcgcgcaagcccagcaatcgctcccgcccgcgaaccacagacagacagccagcccagtaaacgctctgtgctcgcaagcccagtcaaattctgctattcgctcagcgcccgccttatcaccccaaagggcaacacataacacggcagagcattagtcgaagatcagttcttaccatcgcatctattcgctctgtcttctcttgcaaagatcttgttgcaacgccacttgataacgcgtcaagtactgaacaattcttcaatgatctttacgcgggtaacgaataataacgcgacgaggactattcctcgacacttagtgataagactggattccaagtggagaatggactacagcaatacaanaaggcaaaataacatccgggtaccgaactcgcacgncaataaaacgctnacaacgatacat

SEQ ID NO: 85195 - DNA, 599 bp, Triticum aestivum
  unsure (1)..(599): unsure at all n locations
  Clone ID: PAT_TA_85195
cgaaccggcgaggcgggggcgcggggcaacgcaaagcagcgcagcgcagcgcagtgcagcaaaagcttcgatctttatccgccggattcctctcctcccctttcctctctctccgtctccccgcttgctttgtgcttcgttgttgagaggaggggagaggagaggagacccacatccacttgcctttctcctctctcctctcgcagccccccttccaactcctcctggtccctggaaaaaaaggagaccttttggtgcaagattcgatctgctgtggctgcctcggccttgctgcgtgcgcggagatttggtttcttggctggcggctggcgcgcgcgggcagttggagctctttgattcaacaggttcagattgcagcggcgagcgactgctctgcggtcgangctgctgctcgccgggtgattccgtgcccgctcttggtggcggcgggcggtgtcctcgtctgatccgtttcntcgggaagntttggtgatgtgctgggttcctcggagctaantcccaantcgcaatttgatgaggagctctccantgtaaaactacgcgctcctccctgtgcactccctgctccaaacaaaann

SEQ ID NO: 85196 - DNA, 554 bp, Triticum aestivum
  unsure (1)..(554): unsure at all n locations
  Clone ID: PAT_TA_85196
cgccgtcggccatgggtcaagcctggggtaatctccaagataggctccaagggcggcggtggaaggagcaccaggtgaggaagatcaccgacaaggtgttcgaccgcctcacggaggacgcccagaagcgcgacaaggaggccctcagattcgaggaggtctacatcgccgtcctctgcgtctacaatgacatcaataagtacttgccggggccgcaccacgaccccccgtccaaggagaagctcagggccatgatggaggagtacgacgtgaacctgnacgggctcctggaccgcgaggagttcgcggngttcatccggaagctgaccgcggactcgctgtgctcgatcagcgtgaagctgctgatcacgctggtggcggcgccggcgctggcgatggcgaccaatcgggcgacggaagggcgtcccggcgttggcaangtggtaccaaggtgccaacgcgctctacncctccgcataacctgggcgttgtgctgttcanagataaccanggcgtcagtgaccccgctgtgaaatgnatgtctcggtgtgtga

SEQ ID NO: 85197 - DNA, 601 bp, Triticum aestivum
  unsure (1)..(601): unsure at all n locations
  Clone ID: PAT_TA_85197
ttttttttttgacaaaaggctaataagatttgccatcagcagacttaaatatttcccacatcggtgtcctcacaggatcacaagagaaacggaaacactggggatcctttttacatgcatcacgcccaaaaacccaactgctgaacaaagtctgtaagtcttaatggcatcacatggttttcgggtgtaaccacctagtgggacttgggacttcacatggaccacaagaggccagccacaagaaagtcctttaccaaagcgcgatcactggcaccacggactgctgcttgctagttcttcgggaagtgagcgttcaagtagcctgttgatctccagcatcccaaccttgtccctcccgccaaacaagcttttgagcgtggcgtcgcaattgatctccgttttcctggctgggttctggaaggcgtgggccttgatgtgggccagatgagcttgatggctcggagcgtgcgactccggcgcgccgccggcgaactgcggaaccatcggagacggcatcgcttctgatcccgtcggaatctcggttcgaatggcgcctcggcctctggcaacgccgcgccgccgcgccggccgcntcttgtng

SEQ ID NO: 85198 - DNA, 609 bp, Triticum aestivum
  unsure (1)..(609): unsure at all n locations
  Clone ID: PAT_TA_85198
gagagcccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgcgcgctccagaatgggttccagaagatggacaagatcaaggactccagcaggcagtccaagcagctggaggatctcacggccaagatgagagagtgcaagcgcttgatcaaagagtttgaccgtatactcaaggatgaggagaaaaagaacaccctgatgtcaacaagcaagctcaatgacaagaagcattcatgatcaaagaactcaactcctatgtgaccttaaggaaaacgtaccagagcagccttggtaataagaggatcgaactantcgatacgggtaatgacaagtggctgagggaactcaattaaatggatcaagaaatgnaaatcaagaactcataacaacggaaggaacaatggncaaactgataactatgacgctcaaaatggtgtanacaatgntaa

SEQ ID NO: 85199 - DNA, 575 bp, Triticum aestivum
  unsure (1)..(575): unsure at all n locations
  Clone ID: PAT_TA_85199
gccaccacagcccgccgttgtgagagctagcgttggaggtggcgatggcggcattgcaagagcagcaggaggaggaccgcgacgagggcgagggcgggaaagacgacgacgaggagtcagaggatgatggggtagggtgggggcaactgatctgatcttctcttgacgcttgtcccgaggcgtcctgtccgcttgtggcggtgtagcagtaagatattggcgcaataggctcaatcacctttttccccctctctgtctcttcattttctttcctgcttctacgttgctgtgcttgattttttaaccacttttgttcctataaatcgatgagtctaattcatcactactcccccgtgaaaattcgttccatgtcgatgttctgttcttgggtgatttgcccggtttgggaattactagaacggaaggacaacggaaactcatcgtctccgtctcccctgctctggttaaatcccgtgcacttgctgtcgatngcccatgatgggcgttcaagccctctgtctgactctgaccctgtcattgccatggcaaatcaaactcaagccaggagangggga

SEQ ID NO: 85200 - DNA, 539 bp, Triticum aestivum
  Clone ID: PAT_TA_85200
agcagggaggcgattttgaagcgaaagtcacgaagcttgtggagctcggttttgacagggcgtcggtgacacaagcgctcaagttgttcaacgggaatgaggagcaagctgctgcgttcttgtttggtggttagactggtgggagcagccgttcctggctttgtgttcgctcaaccctttccagggttgagtacttgaatatttgatacgaaagtgattaaagtatttggatactgtttgtccagtgaaaggacttacttttagaggttttatgttttctcttgtttctgagaacaaacatttgttttctgtacctgatacatagactgatagacaccagaattgagacagaactgtgaagattttttttttattaagagtgtttatttgagccagcgaaagggagacaactgagtttgttaagtggtctgagtaatactttcaattcctgggtttgtttaattgagctatatttttaaagttaatgtgaactgtggctaaaaaaagtgctaagatgtgatagatcgaaaaaaaaaaaa

SEQ ID NO: 85201 - DNA, 526 bp, Triticum aestivum
  unsure (1)..(526): unsure at all n locations
  Clone ID: PAT_TA_85201
gcgggcccgacctcggcgcgcagccgctcgggcgcgcgcagggcgtgtacgtggcgagctccgccgatgggtcgtcgcagatgatggcgttcacggccatgatggagggcggcgagtacggcgacacgatcaacttcttcggggtgtacaaggtgggcaccccgctgtgccggctgtccatcaccggaggcaccggcaagttcaagggtgcctgcgggttcgccgaggtacgcccgctcatcgcttccggccagcacgtcaccgatggcgcagagacgctgctgaggatcaccgtccatcttgcttaagttgtgaccgtaaagtaagccagcgcttgtcggctgtcgtggctgcagtgaagcctgggctgtgttgtttcggacgtgtcgangtcgtcgcctcgtcggtggatgcatgcatgcatgcaatttcaatgtagtgttgcatgggtcaaaaattgtatccgctcntctgcaaggtgtacacaattgtaanttaagcatacatgatgtctgtggtatatcaa

SEQ ID NO: 85202 - DNA, 230 bp, Triticum aestivum
  Clone ID: PAT_TA_85202
cagcatggtgggcaaggtcgccatttccattcagagctatcgtgagcgcactggcgagaagagcggcccgctgggcgacgccaccgccgtattgcggcataaaccacatggggtggtcgcggtgttcgggccctacaacttccccggtcacctgcccaatgggcatatcgtgccggcgctgttggccggtaactgcgtactgttcaagcccagcgagctgacgccgaagg

SEQ ID NO: 85203 - DNA, 595 bp, Triticum aestivum
  unsure (1)..(595): unsure at all n locations
  Clone ID: PAT_TA_85203
aactcgccgtgcgtggagtatttcaaggtgaaggcgatccggatcgagccgggcctgcgcgtgggcagcagcaccaagggcggtatcatcgactcggacggggaggtgctcgcgaggggcgacgggtcccactcccgcgccggcgacgagccggggcacctgatggcgtacggcccgcccatccagctgacggtggaccaggggctggccaccatcttctccccgagatgacgattcttctatctgttctccatcgcctgcgaggactttgcttcgttagccctgccattttctcgagtagaatcatgtgactctatatgtaaatattactcacacggtcacaccccactccagtggatgagcgatgagccaaaacacaagagggacagtcctggatctccgtcaagagattgttttcgtttcacgggcacaagccacatggncgccgcttttagtgttagcgtgagaaaatgacaagtgggaactcctaatccttttcaacttgtgtgtgttgttgantgcctttacaaacagtggactgtttctgnaacntggggttaatnacttaaagcntnacttcatcaaaaaaaaaaaa

SEQ ID NO: 85204 - DNA, 579 bp, Triticum aestivum
  unsure (1)..(579): unsure at all n locations
  Clone ID: PAT_TA_85204
gttttttttttttgaaccggaaatttttaacccggatactgagagcttcaaagctttgtgggagatagctttcccttgagccggattttaaaccgaaatccttctttttaagccagaaattttctgacgccctgatatgtcatgccagaaattatccaccgcggaattgatgatcacgacggtgaagctgacatcaatcacgggcgggtcgaccgtggaagcagacagatgagacggccgcgtcattgtaaaccggtgcggacgagcaagttgtcttccgtgctgtaggccggcgcggacacatgaaccggccgcgagggtggatgggcgagtcgtccatgacgttgtaaggcggtgccgacgggcgagccggccggcgcattgatataaactggactgcgacacgcgtgtccgtgaagccgcgtggcagccgaacgtgcatccacggtacaacacanccttttcctgtagtaatcctcctgcgtaaaaatatacaagcagatgatcgttccggatgaagtaatatctcgaaaataccgaggaaagatacactggggcctttcggcgaaatgattgcca

SEQ ID NO: 85205 - DNA, 599 bp, Triticum aestivum
  unsure (1)..(599): unsure at all n locations
  Clone ID: PAT_TA_85205
gttgaggtcgaggtcgaggtcgaggtcgccgtggaggtgcctcgcatggggttggagcagcctgatgtcgcaccaagtttatccacggacatgatacagcagtttgtgcccaacatccgttctggtagcttcgccgacattgggcctcggaggtatatggaggacgagcacatccgaatagatgatctttccgcccatctcggctcgatgttggtctgccctctgcctagcgccttctacggggtctttgacggccatggcggcccggacgccgcagcctacatgaagaggcatgcgatgaggttcttgtttgaggaaagcgagttcccacaggcgtcgcaagtggatgaggtgtacctccaagtccgtggaagagctgtgtccgcaaagccttcctgcaagcggaccttgccctggctgatgatctggacatcaaccggtcctctgggaacacggngctcactgcataagtgtttggaaggaactggtggtcgcgaacacgggggantgccgcgcgtgttgtcccgnaaggagtggcgatggagattcccgcgacaacgcgcgaacagtggagganccaagaggtgnccgtcggcggg

SEQ ID NO: 85206 - DNA, 589 bp, Triticum aestivum
  unsure (1)..(589): unsure at all n locations
  Clone ID: PAT_TA_85206
caaaaaacgaactagaaacgaccgcgaagccacaggtcgaaggcggcggcggcgatggggagcgacacggagacggagaagaaggcctcggtggcgctgatgtccatcgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaatatttctcctattgatgtgattacacatgttccgatactatgtgaggaagctaatgttccttacgtatatgttccatcaaaagaggatcttgcgaccgcangaaccactaagaggccgacttgttgcgtcttgggttctgaccaaaccaaacaagggggagctcagtggagaagtgaaggataaactgaagtcggactatgacaagttgtaacggnagtcgctgagctacatctcaatgttctgaggacacattatctgagaatccggcaattcctgtgcactcttcttggngtananctgccaacttcgtaancgaaccaatatgtttgac

SEQ ID NO: 85207 - DNA, 584 bp, Triticum aestivum
  unsure (1)..(584): unsure at all n locations
  Clone ID: PAT_TA_85207
gatgagctgaccagcctcaaggactacgtgaccaggatgaaggagggacagaatgacatatactatatcactggtgagagcaagaaggcagtggagaactcccccttccttgagaagctgaagaagaggggctatgaggttctgtacatggttgatgccattgacgagtatgctgttggtcagctcaaggagtttgagggcaagcatgcgatgcgacacttagtcgacctcctccatcttgctttcaccagcgtcgtcctcaagctgaggcatctcagcctctgcctcaacaggctcgtcctcatcgatgctcagaccgagtttgagcatgcggtggatccggttgccgaaggtgttggggtcatccaagctgaagccggaggtcaggagagcagtctcgaacagcaacatcacganatccttgactgacttgtcattcttgtcaacctcggaacgctgcggagctatcaatgatagggttctctgggttgatctcaattgtcntttgctcacatgtacccgccatgctcangggggnccggtaccaattgcccaaantgagtctantaccgcgctantggcct

SEQ ID NO: 85208 - DNA, 279 bp, Triticum aestivum
  unsure (1)..(279): unsure at all n locations
  Clone ID: PAT_TA_85208
gctttcanagccactaccactgcttaanacctctctcccgctgcagctgcaagtactcccagcagggagtagtacaaagcagttatgaacatggtgtagccccangctaaagctcttcggcttccacgtctccaaggaggagcacnagctgtgtccggagactacgacggaggcggaaacaaccgagccagaggaggcgccggngtgcggtaacaacggcggagggtccgactcntcntcntcgtcnaccaccaccancancacngccacggaggccgg

SEQ ID NO: 85209 - DNA, 323 bp, Triticum aestivum
  Clone ID: PAT_TA_85209
agaactagcactgctgcttcatcttatattctgtgaatcctcgaatatatgatctgaggacagcaccacgaagtgataagaaacaataaaacttcccaggtccccttttacaaagagtgcagaaatcatgacaaggggagtgaattaagcagcgtcagtgaagagtgaataaagcacctaaaacccaatcattctctccattctaccattctatacaaaggtttggacaaggactatagctacataatgagcagaatgcttaaatacacaagaaattatcatgcatttcataagcacgctaactctcagttttgccctaattg

SEQ ID NO: 85210 - DNA, 318 bp, Triticum aestivum
  Clone ID: PAT_TA_85210
gcaaatcccttcttcccgttcccaatgtttcttcgggccagtttaaccacactaatcggtgagttgaggtactccgttgccttgacatatatgttggagctattattatgacactaggtgtcttagggagtcatctagtaatctagcaatgctatgtgttcccggtgtgatgattctggccaccattcttgaaagcattctatgatgccatttagttagtaggtattctattcctgggttcttgaacccgagattcaccctacttacctcatgttgatagtgttgctagttcctttaggatattagtaaccttttcat

SEQ ID NO: 85211 - DNA, 577 bp, Triticum aestivum
  unsure (1)..(577): unsure at all n locations
  Clone ID: PAT_TA_85211
ccgaggaagagtcgaggaggcctcgccagtccactgagggatcagtctgctaccgctcacgaccgccctaacaccagctgaacacccccgtacgttcaagcttcactctactatatatacttttcaataaagtatcgtctttctctagtccacggacttaaatccctctctcaacttcccaacgaacccccgcaactgtttgggatatggttatggcaacggctgtcctcgacacctacaatcataatgtcaatcaccctcatatcgcattaaagaaacccctgcttcaggaatctcttgagcaatatggcgtgattactccaaagcaactcatcggccaggcactccaccagcgtgtgggaggcattgaccatgagatgtgtgagcctggcgacgaagatactttcttcgttgctgactcggagangtctacgccagcatcttcgctgggaagaagatctcctcgggtccggccttctatgccgtcaagtgcaacccgatctagatataanctcttctaactcggaacggctcgatgtgctcaagacgagttgacagtctgtcgaggactanccga

SEQ ID NO: 85212 - DNA, 467 bp, Triticum aestivum
  unsure (1)..(467): unsure at all n locations
  Clone ID: PAT_TA_85212
gccgcttcttcgccttcctggagcttcccgcatccacacatacctctaaagaaccanacaaataaccgacacagaaccgtcggagtcgtcttctactactgtcnccattatatgggtttgttgtgcacaggtgcgcgtagataggtagaaccgtagaaggcagattatcgctcgaggnancagcttggntgctggggcacgcgatcgnactccaggcaagaagattattgcaggaaggcgcngcaggnatggancgatctgtacagcatccacccggggatntcacgcgccgggggcgccgccactgnggacancgangtgtccggtgtcgcnggcngnccaggctcgccccctcccncgccgttcaagaccctccgccgncgccggctnatctgancggcctggtcaangngcatatcgncnggcaccgcnctaccttcctcctctccgactaancnagtgcccaa

SEQ ID NO: 85213 - DNA, 603 bp, Triticum aestivum
  unsure (1)..(603): unsure at all n locations
  Clone ID: PAT_TA_85213
ggctcaaggcgtctgctacgacattggatttccctgggtgatagtgtagcttcatgtcataatccttgataagctccaaccatctcctctgtcgaaggttcagttccttctgggtgaaaatgtacttcaaactcttatggtccgtgtacacatcacaatggtttccaataaggtaatgtctccaggtcttcaatgcatgtactacggctgctagctccaaatcatgtgtggcatagtttaactcatgaggtttcagttgtcgtgaggcatacgaaacaactctcctgtcctgcataagcacacatccaagtcctaagcgtgaggcatcgcagtacacttggaactccttatgtatatctggcagtgttagcactggcgctgtagtcaagcgtttcttcaattccttgaaacttgcctcgcaatcttctgtccatttaaacttagtatccttcttcaacagttcagtcattgggctttgcaatcctggnaaaattctcgatgaatcccggtagtanctgcgagtccaagaaaactgcggatctcgctaactgaagtgggtgcaacatcagtgactgacgaatttgctggggccanngcanactc

SEQ ID NO: 85214 - DNA, 455 bp, Triticum aestivum
  Clone ID: PAT_TA_85214
tctcatcggctgggcgtggtctacactgcacgcacacttaccaccagccaccgcaagtgaatcactagccggaagacaggccaaccccactgctagtgctaggaatctaggagcgagaacgagagaccatgtcctcagaggccagcagcgtcgtcgtcgccgacgagaatggagcggcggagacggtcggcgtcgggcggtacgtggaaatggagaaggaccaagagtcgagcgcagccaagtcgcggctctccggcctgctctggcacggcggctccgcctacgacgcttggttcagctgcgcgtccaaccaggtggctcaggtgctcctgaccctgccctactcgttctcgcaactggggatgctgagcggcatactgttccagctcctgtacgggctgatgggcagctggacggcgtactcatcagcgttctctacgtggagtacggcaaga

SEQ ID NO: 85215 - DNA, 576 bp, Triticum aestivum
  unsure (1)..(576): unsure at all n locations
  Clone ID: PAT_TA_85215
gcttccgagcggcatggcacagtgccacaagttctcctctccctcatcacctccacctccatggctggtccccggatgtgcgtctgcgagctacaacaactgttgaagttcatttgatgttttactgaagctcactaaaatttgttttgtagttcactatggaaaaaatgcgccatgtttcctggagttggctcaattcctctcccccgacgaggatcccgtgctcccctacccgaaccacgcatccaggagctcctcccggcccacggcgatctcctgtgcgcggcaccaccactcttccttcgaatcaaggcataaagtttggagcatgtgaacaagcagtgcanatggtgcattttttgtttgagaattttgtgtataaaaattacagggactcattttgtgtttgggatgagactattcanataatgtatttgaagtatgtgcacatgcagtgcaatccgggcttttgtgcttggggatttacgtaagcatanaattgcagtgaccatttgaatgcagttccgggggaaaatgggctantgagacttncatcaanannaaaaaaaaacncgg

SEQ ID NO: 85216 - DNA, 393 bp, Triticum aestivum
  Clone ID: PAT_TA_85216
ggaacactggccgcgtgggtgttatcaagaacagggagaagcacaagggcagctttgagaccattcacgtggaggactccctgggccaccagttcgccacccgtatgggcaacgtgttcaccatcggcaagggtaataagccgtgggtgagcctgcccaagggcaagggaatcaagctgagcatcatagaagagcaaaggaagcgggatgccgctgcccaggctgctgccaacgcataaatcctctgaatgtgctgtgttgagagttttttctaagttgctctgcaaggatatagaacaatgttctaagactaccatgtttttaagtctgcctgatgcttataattcatgaacgatttttgcagctagctgtaatgtgactaaaaaaaaaaaa

SEQ ID NO: 85217 - DNA, 581 bp, Triticum aestivum
  unsure (1)..(581): unsure at all n locations
  Clone ID: PAT_TA_85217
cgccactgcaatgcgatggggaccgttgacaagtacgtaggcgtagcagggcctgagagcggtggtgtcgatgtggagtggtcgcaccacatcggacgatcatggatgccccagaaggccaaggaggtggtgccacagagccttcaggaggtgaacaagggggtcgatcaggcacagtggcgcatacctctgtgggggagtttcgggatggagatatctcgagtgcttggtggtggtattgttcctggctccttgattttagtcggtggggatccaggtgttggcaaaagttcattgatgttacagcttgcttcgaatatattggagggtttcaaggccaaggagtcttctcctgttgtatatgtgtctggtgaggagagtattgagcaaattggaaacagggctgaccggatgagtatcacgtccagcaacttgtacctctactctggtacggatattgaggatatcttggacaaaatcaaccctctctccaagggctcttatatcgatcgatcaaacagttatgtcagatatttctggaatgctggtaatttgcacagtcaaagaatgtactcncctng

SEQ ID NO: 85218 - DNA, 290 bp, Triticum aestivum
  Clone ID: PAT_TA_85218
tggcaaccgtggccgccgccgccaccgtagccgccgccaccgccgtagccgccaccgccatcacggcgcccgccaccgccgtagccgccgcctccacggccaccaccgtacccaccgccgccgcctccacggccgccgcgggactgggcctcgttgacggtgatgttgcggccgtccagctccttgccgttcatgccctcgatggcgttccgcatcgcctcctccgtggagaaggtgacgaagccgaagccgcgggacctctgcgtctcccgatcgaggatgatcttgga

SEQ ID NO: 85219 - DNA, 606 bp, Triticum aestivum
  unsure (1)..(606): unsure at all n locations
  Clone ID: PAT_TA_85219
cctcctctaagatgtctcgttatggtatcatggaaattgttttccttgctactctgaaacctcatccaattgtttcttccgtcctttccaaggtgtgttttgcctcccaactcaagagatgtttctacgtctcattctgtgagatgatcttgtgatcattaagatgatccatcattgtagagttgtctctgaactcgtgtttgatgaagatctcgaaagcagagttgtcaagaccaagaggatgcaaggaatcgatgttcctatgatgtgcaagttggatcatggagatcatgctagtttcgagtcccttgtgtcttcttacctcgcgttttgaatctcgggacgagattcttgtttagtgcgggtgagttgtcacagccctaccttagcccttgcctgactctgcataagtagccatgcatcatgtttaaatttctgaaacttgaattgaggttagttgaaacctcaaaaatcagttcaaaaattaatcaacatttaaatccatcaaatgagtcaagaaaatgtcctctgtcnccgaaaatatggaagagataanatcanacaatattttggngcncggaatattattggggattgagtaaacca

SEQ ID NO: 85220 - DNA, 579 bp, Triticum aestivum
  unsure (1)..(579): unsure at all n locations
  Clone ID: PAT_TA_85220
gtacggtccaaatgctgaacggattaataaagggagaataatggagccagttccaaggcccaggggccgttccagaagccgcagtccaagacggaggtaccgtgatgattatcgagatgactaccaggatagagattatagaaggcgaagccgtagccagagtagagatagatacgcccgtgacaggtacagagatagggattaccgccatcgtagcctgagtcgcagtttgtctcctgcacgaagaagccctagtcatagccgcagccgcagttacactcctgatgattacaagaggcgtggcaaagacagcgcatcacctgcaagtaggagccctagtcgctcccctcctcgcaagacgccaccttctcctaagagatctcctgtcaggcacaatgatgaccggtctccacgctcacggagcccttcaacataagcacaattcacttgcaaagcatcttgaacagctcaagatgaatggacttgctctgatctatgtgtgtgtggtatgctgtgctcaatggtgggcacttcagttaaagtttgtatgctgtcgtcaattctgcctcaaacttggan

SEQ ID NO: 85221 - DNA, 604 bp, Triticum aestivum
  unsure (1)..(604): unsure at all n locations
  Clone ID: PAT_TA_85221
gccaactatccatgggatggaactagagacacaaggtctgttggcatctatcattttgcaaatttgcaccagcaacagaacatgtacatggcgaagacaaatcattaggtggcgacttttttctcaccacggtaacactgaatttcattatggcagcaacaaagttacaatattcaggtttcattaggtggtgttttttactaatatttgaagagtttgagttgggcgacaggggggtattgccagcaactggttaatgaactgttatggctgaagtgaaccattaatatagagtttgagttattctgtgttgtcacagacaaccgtatttacacacacagtatctcgcccgctcctccaagtctccctctctcaatataagcctatttctgaattctatttgtggtcgctttctttgatttgctgattgtcacaactgggtttttagggctcaatatgacttgttcacattgtaacatcctcaacaatgattttacttcntacaacaaacactactacggatgtcctgatgataagacatcaacacatggnactgtgtatagcggcccactatacatgncttggcaagaattgaggnggatan

SEQ ID NO: 85222 - DNA, 518 bp, Triticum aestivum
  unsure (1)..(518): unsure at all n locations
  Clone ID: PAT_TA_85222
ctggcggtggcggtggcggaggcggtggcgtgggcaatcctaagatggtgatgccgcanccgacgccgcagcagctccagcagctgcagcagcagctgcagatgaaggggctgaagcttccgccgcacctcttgggcggnaatatgccggcgttccccgcggctgcgccgatgaaggaccccaagtccgtcaagtttgccctcccggaggacaacttcgacgactacggcagcgagttcgacnatgacttcgacgacggcttcgacgacgacgangacgactacgacgacgacggcctggacgacgacgtctacggcgaccccaannatgatgatgaagcccatggctgtgccgccgncggccggcgggggcgacaagaacggcggtggcggcannaanggtggtggtgnngggaacgagatcctgngcanntcaanggaaacanccaccgtnggtgccgtgggagncgnacaatcaaagggaggctcccgggangctgggcccacctgggcaangga

SEQ ID NO: 85223 - DNA, 413 bp, Triticum aestivum
  Clone ID: PAT_TA_85223
gtgctcaagaagctcggcctgcccgaggctcggaacctggccactgtgcaggagatgatctgcaacgtcgaccgcaactgcgacggccgcgtcgacttcggcgagttcaagaacatgatgcaggggatcaccgtgtggggcgcttagctgccgcgcacctgcgttgtcacaccccctctactgcgtggtgtcatgtatgtatccaggcaccgtaggatgcgcttttctacccggcgcttcttcctcctcttgatggcgcagtggattcttcctgttcttggctttgctatctgactctgcttgtagtcttgagaatctggcggcacacagacatagttttctttagtttcttgtgtttgatttactccgtgtttaattgcacagtttatttacatgtaaaaaaaaaggggggg

SEQ ID NO: 85224 - DNA, 581 bp, Triticum aestivum
  unsure (1)..(581): unsure at all n locations
  Clone ID: PAT_TA_85224
cgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagtcgctgctgangccgccaagctcgcgcgctataacaagaagcctacatcacctcccgtgagatcagacctccgtgcgcctcgtccttccggggagctcgccaancacgccgtctccganggcacaanggcgtcacaagttaactcggctagctgcgcggccgccgcttgaggatctctcctgtgtcagtctcttgctgtagtaagtctgctgctgctggctcattang

SEQ ID NO: 85225 - DNA, 401 bp, Triticum aestivum
  unsure (1)..(401): unsure at all n locations
  Clone ID: PAT_TA_85225
gttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgaatgccggattcttcgtcttacggcttgaatcgagctgggaggctgtggatctgagcacgggaggtacaacaaatccgcgtgtatgacganttggatcggcaccgtttanctctgaccgcaanttttgttgtgtgttgggctgatctgcgcgntgtttgctcaagttctaaagctagcgaaacccaaggtataaggtcctttccgagcctctgaacgatgatgntgaatccgnggngnatcgga

SEQ ID NO: 85226 - DNA, 361 bp, Triticum aestivum
  Clone ID: PAT_TA_85226
gaatcactgtacaagggaaactggtgaccaaccaaggcaggctgtggaactgggcaggcatggcgccctagagcgttgcggctccatctcgtcgctgctggagagcagctggctagctgttagcgttttccctagtctctctctctgttccccgtttcagtttgcttatagcccgaagacttttctgctgtagtattggaatgccagagacctttggccggacaagaggaatttgcgaaggccgtctggctgggtgtgttgcgtcgtcattggggtcgagtatggccggttgtgttcgtcgttatattgagtggatccgaatgaatgtgggttagattgggagctttccaaaaaaaaaaaa

SEQ ID NO: 85227 - DNA, 587 bp, Triticum aestivum
  unsure (1)..(587): unsure at all n locations
  Clone ID: PAT_TA_85227
tttttttttttttttttatcgctctgtggagacagaaagcggctaattgagtcgattcagatactggattcactttcagaaatctctccacatacaaacagagagcatacaacttgagacatgtacggtaaggttcgcttattatccttgtaacaacatcctacagccaagcaaggccaacatcaaagctttatttctctcaagttttgctcattatgcattgggactgtatatatcctctaaccggaagacatgactacagctccaactctatcgcnagggatgagacgcactccgancatgtttcaagaaacacgttgcctgcactttgctgggggttgatgccaatccanccgttggtggatnatggactggtccnggggcggaccttgatcctccgccggngantttacacnccggtnaaggcncccnccgggacgctnacattnagggggggggcccggtaccaattcgcctatatgatctatacgccgcnacgggcgtgnttanacgctgacgggaaaacctgngttaccactaacgcctgagaaacccctttccnnggggtatacaaagcccacgttccc

SEQ ID NO: 85228 - DNA, 430 bp, Triticum aestivum
  unsure (1)..(430): unsure at all n locations
  Clone ID: PAT_TA_85228
acccggagagctanccttcgatcatagtggcctangtttgtaggtccaccttatcactttgtgtcagagctctgttgccccatagacggntcaagctagcagcgtaaaatctgatatanggctcagtccaacattttccattgaaagtgcgatcatatctagcataccaaagagtgacagcagaggccgcaaaggcantgttccatttccacttgaagcanagttggtcagcagccttgcagacaaaatgtttgatatatggagatgtgcatgctagaggggccatcaatagtctatcccaaattgcgttaactagtcggcaacggngcaccagatgagaaccgtttcaagagcccgagcagagtcacacccagaagaaggacaacantgacagccttctcggcatgagtttcgagtggcagacggccca

SEQ ID NO: 85229 - DNA, 163 bp, Triticum aestivum
  Clone ID: PAT_TA_85229
atccatcactcctagctactcctactctggtcgctgcctattgattgatccatcaatcctgttaattttcagaagagtttcagaagagtcttaatactcctagtcttaatagtcctagctatgcaaatatgcagtgttaatttgcggcagtaaaaaaaaaaaa

SEQ ID NO: 85230 - DNA, 591 bp, Triticum aestivum
  unsure (1)..(591): unsure at all n locations
  Clone ID: PAT_TA_85230
atgaagcctagcaagcttgttgcagcagctgctaaatcaaataaaagcatgtttgtttctggtgatgatgaccttccgaagagagataatatcggagaaagacggagaaaacatgagcttcgcgtcctatcaagagtaggggctaactcagcagaggatcatgagctgccagatggtgacgcttctgaagaggaggaccaccatgagttgccagaaggtggtgatgaatctgaagacgacatccatcgggatgtcaaaagaaagaggactgaaaagctatcaaccaagaatgctctgtactcgccaactccgggcgtttgaacatctgggaggaagaaacagaaggcgatggcaagaggacatttcgtacaaatcttgaagacaggggttgacccttccangaataagaagaagaagacccgcggaagaactacanggattagcacaagaacaactgtcaagcggaaaggcaatgccttatatcaagaacatctggccctttggagtgaactctggatnaaccgaattnacgcatgtcggtaagagtnanttntcaanagaaanttggttgcatgaggattttncgcctac

SEQ ID NO: 85231 - DNA, 591 bp, Triticum aestivum
  unsure (1)..(591): unsure at all n locations
  Clone ID: PAT_TA_85231
ccaacatcctgctggacgacaagctggtggccaaggtttccgacttcgggctgtccaagacgggtcccaacaacgtcgacaacacccacgtgagcacggtcgtgaagggcagcttcgggtacctcgacccggagtacttccggcggcagcagctgacggagaagtcggacgtctactcgttcggggtcgtgctgttggaggtcctgtgcgcgcggcccgccctgagcccctcgctccccaaggagcaggtgagcctggccgactgggcgctgcactgccagaggaagggcgtgctcgggcagtnatcgacccgcacctgcaggggcagtctccccgcagtgcttcctcaaagtcccggagaccgcggagaatgcgtggcggaccgcagcgtcgacaggcgtcaatggcgacnnctctgggaactcgattcgcctgcaactgcaagggacgcggaggaaacggcacgtcgnctcgtaacgacgaacactctcgtctcgaacaagtcgtcgccgcttatgtctcgggctnatcggacaaccgccacggcanncacacacacacactctcacacacttacatatggacggcccc

SEQ ID NO: 85232 - DNA, 584 bp, Triticum aestivum
  unsure (1)..(584): unsure at all n locations
  Clone ID: PAT_TA_85232
ccttgcaaccgattgcctatccccctcccaacccaagaccgatggcgcccaaggccgagaagaagcccgcggcgaagaagccggcggaggaggagcccgcggcggagaagacgaccgccgggaagaagcccaaggcggagaagcgggtccccgcgggcaagtccgccggcaaggagggcggcgagggcaagcgtggcaagaagaagggcaagaagagcgtggagacgtacaagatctacatcttcaaggtgctgaagcaggtgcacccggacatcggcatctcgtccaaggccatgtccatcatgaactccttcatcaaacgacatcttcgagaagctggccggcgaggccgccaagtcgcgcgctacaacaagaacccacatcacgtcccgcgaagntcaaactccgtgcgctcgtgctccccggngantcgccaagcacgccgtctctganggaacaaggcgtcacaattaactcctcctaagctggacgctcgcctttgtaggatccctgngttattccccttggtgtagtaatgttctggntcccttcgggctctctaactgcgcatgtacctgaaggct

SEQ ID NO: 85233 - DNA, 592 bp, Triticum aestivum
  unsure (1)..(592): unsure at all n locations
  Clone ID: PAT_TA_85233
gaactgcttatcactgaacttatgttcaatggtacatttaatgatcttgaccatcatcaagttgcctcccttgctagctgctttgtaccttgtgataaatcaagtgagcagatacgcctaagaaatgaactttctaggccgatgatgcagcttcaggaggctgcaagaaaaatagctgaggtacaacgagaatgcaaactggaagtaaatgtggaggaatatgttgaatcaacctgcagaccctaccttatggatgtcatatactgttggtcaaggggagccacctttgcggaggtgatggaaatgaccgacatatttgaaggaagtgtcataagacttgctagaaggctggatgaattctgaatcagttgagaactgctgctgaagccgtgggggaagttaaccttgagaagaagtcaagaatgcaagtganaatttgctccgggtancatgttctcaactcactgtatcgtaataacactttacagcaatantaccatatgttaccgacaaatctaacggcggtttgcctgaacaaatatcnttgtcgtagaaaggattgcanatncccngtaacttgtnncantccaaa

SEQ ID NO: 85234 - DNA, 492 bp, Triticum aestivum
  unsure (1)..(492): unsure at all n locations
  Clone ID: PAT_TA_85234
acgccgcccctcaggttcccgggacgccgcccctcagttttcctggacgccgaccctccctcgaggttctccgtgtagatccgccacctctcccttgcacgaactcgcgcccctccgtcgaggtcccctggacgccgcgcccacccctagcgcctatcttgccaaacaccatcaaaactcccagaggagttgccccaccagggagtttggagcagagcagtctaggtggagcaagagtatgccaaacacgcttntccaaacaagnactngagacgaaccttttggctcngtcccctccttgtagtgtgtaaccccggttnnggaaatccaatggcgggnccgagaaaatgccggcggcgganaaattncccgggctttctcngggaaaaagacaaaccgnttaaaatggcgtnatcaaccggttttcngancgggggggctaaaaatnatttccangccgttgcanttctgccaagattaagagtnaagtct

SEQ ID NO: 85235 - DNA, 289 bp, Triticum aestivum
  Clone ID: PAT_TA_85235
aggtacaaccacaatacgaacaagttctgttggaaagaaggcaaggaagtagtcgatgacaacacaaattaccgaggggcaaggatggtaatccccattaggaattcgactgttatcctagaagagctcaaaatgctgatgatgatcacgacacatttgtcgagagatctcatgaagatgtaatcggtcggcgatgccatcaagtcaaatgatgatgaagcaaaaggttatgggaaccaagggtatgacataaactccaaaccaagccttgttgttcaaaggcgaaatg

SEQ ID NO: 85236 - DNA, 284 bp, Triticum aestivum
  Clone ID: PAT_TA_85236
ccgccggaagcttgttgtagctcgctagctaaacggtcagagccgagctggctccgtacccacgcagccacgcttactccgatcctccaaaatcgcggcgccactaatctaaagccctaaacccatgacgcagccgccgcaccacctccctctccatcgccagtaccccagcctcgcctccgtcgcctatggggcgacagcctaagccgcccgcgtccccatccccaccgccgtgcccgccctccggactccggacccggacccaggcagcggcttcgacccct

SEQ ID NO: 85237 - DNA, 296 bp, Triticum aestivum
  Clone ID: PAT_TA_85237
gcgaaatgaaccagtgcatctgggcagtctatgtattgatttgtcattccagtctctctggttgctctcagcattttgaagattgcccatttgctgcttaaatcagtatttatccggtgcaagtgtttttatgtagctggaatggtacacccttcaagtatatcaccaagctatgaattccatccatttgggtcctagatttcaatattttcaaagcagcagtaagcttattagcagcaagattgtagcgccaagtttcctgaggttgaatgggatggcattcctttttttaagac

SEQ ID NO: 85238 - DNA, 298 bp, Triticum aestivum
  Clone ID: PAT_TA_85238
tttttttgggcaaataaaaatcgtatagaaagtaacagagatgttttccaaccgtttacgtccgatcccttgttacaagccatgaacgttggtcacacaatgacggccaggcaagcctagaatacaatcccgattcagaaaatggagagcaaaggtacatcgtaaaaactaagagagccagcaagctagcattttatttaagtaaaatcgttcacccgccggtacccaatcttctcagttttacacagttgccgtcttggaggctgttgcccttctcctgtaggctccacgagtaggc

SEQ ID NO: 85239 - DNA, 297 bp, Triticum aestivum
  unsure (1)..(297): unsure at all n locations
  Clone ID: PAT_TA_85239
ctcaagctaaatctgcttgggtccatcctttctggcctcgccattgccaccacctgtgttggccaaattctcacaaatacaatacagaagaggttgaaggtctcctcaacgcagcttctgtaccaatctgcgccttaccaggcggcaattctgtttgcatctgggccttttgtagatcaactccttactaaccggagtgtctttgcacacaaatactctgctacagttctgggtttcattgtcctcctcttgccttgatgcggtgtcctgttgaacttccatacattttcntggggt

SEQ ID NO: 85240 - DNA, 305 bp, Triticum aestivum
  unsure (1)..(305): unsure at all n locations
  Clone ID: PAT_TA_85240
caccgcacagctaccgtccaaatcgccgcatataatgtagcctggccatggatactttccctcctcgcctccccctcttcgtcagccccgcatctggcccggattagccgcctccggctccctcccggatcgccccaccaacagccagcctcgccagctgatctaagccaggcgcaactgtgaaacaatggcgacatccaagaagggttcccccaattcctagcaagangganggngttaaccaaccttaaagttgttcaaacagttagtcnctcccggggnacggggtataggggcnaggnggg

SEQ ID NO: 85241 - DNA, 290 bp, Triticum aestivum
  Clone ID: PAT_TA_85241
ccgccgccgtcgacgccgccctgctcgccttcctttccgccttcaacctcttcaggctctacggcgccaaggcctagcgcccagcccaccaccacgacgtagctttgttgcattaattagcacagcagaggtgccttccatctgaccatcctctcttgcaaacaccgtaacaccgcgtagtagagtagagattatggagagacaattaataaggtgcgttcaagctttattaacatatataaacgcattactcatccaataaattctacacgcatgttaaaaaaaaaaaa

SEQ ID NO: 85242 - DNA, 300 bp, Triticum aestivum
  unsure (1)..(300): unsure at all n locations
  Clone ID: PAT_TA_85242
ctggaatgagactcaagccatgtacggagacgaaatgaccccggtcttctcgggtggcgtcgtgtacgagtatactgaggaggacaacaactatggcctcgtcaagattactggagacaagcttcgcattctcggagatttcaaccgccttaagaaccagtttgctagaatcaactgggaaggaggtccaatctaagcctgctagcaagagctctccgaagggctccggcctgtaagggctgggatcatcgaggaaancggttttcganaanaaatttcccctttcaantatnccccnga

SEQ ID NO: 85243 - DNA, 293 bp, Triticum aestivum
  unsure (1)..(293): unsure at all n locations
  Clone ID: PAT_TA_85243
cgtatcgacatggtggaaaacaggctggtcggcatgaagtcacgtggggtctatgagacccccggtggcaccatcatggcagccgcggtacgcgagttggagtccctgaccctggacagggagaccatgcagtggaaggacatcattgccctcaagtacgccgagctggtctatgctggccgctggtttgacccgctccggcagtccttttgatgccttcatggagaaggttaccgcgacgacaactggttcaattgacccctgaanctgtanaaggttccgttaaacttcct

SEQ ID NO: 85244 - DNA, 287 bp, Triticum aestivum
  Clone ID: PAT_TA_85244
tcgggatgcagcccaccgtttcgtcgccgcgctcctcgccgcccaacggcctcgacatgggcgccatgctcaacccggcctggccctcctccccggccagcaggctcaagaccgcgctcgccgccggccgggagctggacttggacctcgagctgctcgcgctcgaccagtaccagcagaagctgttcgacaaggtgtcgtcgccgagggccggctggggaggcgggatgggctcgccgctgcccgccgcggcgcccagcaccagggccgttgccggactacgcgga

SEQ ID NO: 85245 - DNA, 292 bp, Triticum aestivum
  unsure (1)..(292): unsure at all n locations
  Clone ID: PAT_TA_85245
caccggccggtgaccctacattacttgctaatctttcttgagggcagatggccgtttcttttgcaaatgtcaacgccgaggcagggctgaaaaagcttgatgagtaccttctcactcgcagctacatcactggctaccaagcttccaaggatgacctggctgtctactcttcatttttggctgatccctcatccaagtatatcaatgtagcaaggtggtttaatcacatttgatgcactccctgaggctgagttggagttaccgcagagggcctangtgttaaggtttagcc

SEQ ID NO: 85246 - DNA, 286 bp, Triticum aestivum
  Clone ID: PAT_TA_85246
ctcgtgccgattcggcacgaggcgacggccgcgctctcgacggttcggccagcatcagtgctcaccccacggttcttggcctcaaggtttacctcctctgccctccctcaccttatcttcttcggtatgcacttgtgttgtgttgtgttgcagggccagagcagcaactgggtggtccgtcgagttcaggcatccgaacccctccaacgacgactggggtccggcgtcttctctccctcgggtttcaggtactccgacggactatggatgtttaggctctgcataa

SEQ ID NO: 85247 - DNA, 299 bp, Triticum aestivum
  unsure (1)..(299): unsure at all n locations
  Clone ID: PAT_TA_85247
cagcaactccctcccaagttctcaaccaccttctccttcggtccttccacaccaccccgatttacccacggcccacgtcttctccctctcatctccccgctcactcccgtccccatcccacgcgatggccttccgcctcgccgtcgccgtctccgtcgcagcgcctgcgtcgtggccttccccggtcgccaccgtcgccccgccccgccttcgccttccgccganggcttccgncgangtttgngcgcantttngcgcncttccgggtttcccgttggccctntncgtgggttgcaagn

SEQ ID NO: 85248 - DNA, 575 bp, Triticum aestivum
  unsure (1)..(575): unsure at all n locations
  Clone ID: PAT_TA_85248
ctcttccggtgctcgtgctcgtgctcgtgctctccgccctccccctccgccacttcgcgcggaacggaacccaggccgccgccgacccagccaccgctaggcgtctaggcgaccgcgcggcatggtggcgcttttacactacctatgctagtttgcctgatgctacatttccacgatggttaagctgactatgatagcgcgtgtcactgatggccttccattgtcggagggattagatgatagtcgggatctcaaagatgctgacttctacaagcagcaagcaaaactgttgttcaagaacttgtccagagggcagcatgaggcgtcaaggatgtcaattgagacaggaccgtaccttttccactacatcattgaaggccgtgtttgctatttgactttgtgtgaccgttcttatcccaagaaacttgcattccagtatctcgaagatctcaaaaatgaatttgagaaatcaatggcagcaaattgaaactgctgcaaggcatatgcattaataaattgatgcatcatacagaagacaagaaacgtattggtacagaacacagaggaacttctng

SEQ ID NO: 85249 - DNA, 575 bp, Triticum aestivum
  unsure (1)..(575): unsure at all n locations
  Clone ID: PAT_TA_85249
cttgccttgtggccgtcaattctaattctgtaaatagtagtttcaacatcgagtgtggagatgctacagatgccaactttgagaaatacaatctcagtagaggctccgtagctggcattcttacacttgatacagtggcagactatcttccgagaaggggacccctgaagcagagaaggacaggtattgcgtatatagcaaacgtcgcggtgcggaaggaggagcgacggaaagggatcgcgaagatgttggtccaagaagcagaggctcgggcaaggagctggggatgccggtcgatggcactgcactgcgacgtaaacaacgtggccgcgctacgcctgtacagaaaccaaggcttcaagtgcatacgagtgccggaaggagctaaatggcccgaacccaagatagctaaaggagcggagtacaacttcatgatgaagctagtgcccaaggcttgagtcntgaaccttataagatctgactanggaaaaaaaggaaaggttggccgtgtagtctcacggatcacaattgctccaatcagtgtcacattggtgtaagtggagctacttgtaatg

SEQ ID NO: 85250 - DNA, 575 bp, Triticum aestivum
  unsure (1)..(575): unsure at all n locations
  Clone ID: PAT_TA_85250
ctcaccagcagccttttctctcatagcttacttttcctttccaaccatggagactgcaccccctcagtacaatgctgaagatgcgcctccgtcctatgaagatgtcgttaaaaagttcaccgccgctcttggcaacggcaaagatcctgagaagatacttgacgcaatggcctcactcaacctggcagattgcaaagttgtttgtgacaagaatggcagcaaacttgggcctattgttggggagaaggacatggagaaattccaactgggcgcagaacaagctgcttctttacccgttgctcaagagcacctcaagaaagtggcaaacactgctacgcgcgctgtcaaggacattgagatggtgttcaaccgtctactcctaaaaatcatggagatcgacaaaatcacgaatcggggttcgtgcaaaagcttagacacatcaagagacattctctgacctgatacgggaaancgccttctggcaagagaatcagcaacacgtcaagaattgagaactaacagtagatttgcccgacaaacatttcgtcnaaaacgntaaccgaattgnggctcag

SEQ ID NO: 85251 - DNA, 356 bp, Triticum aestivum
  Clone ID: PAT_TA_85251
cgactatgccgtttacgccgccgcgctgtgtgacgcctggtgcggcgggcggcacaggaaggccgagtcggacggcgacgatgatgatgacgactatgactgcgcgcctgctgcctgaagtgcacgttcgtatctggaacctgcccgccaagagctagcatgaatgtatcccccctaatatatgaggcagtgaggtgtgctttttgtaaccgggaagtagctagttcgcgccgcttaattaacccacttgtatagatattgaaagtaggcttgcgcttttcatcgactagcttgttactgcaataaaactgatatcttgatcagtacatcactaccttactgtcaaaaaaaaaaaa

SEQ ID NO: 85252 - DNA, 546 bp, Triticum aestivum
  unsure (1)..(546): unsure at all n locations
  Clone ID: PAT_TA_85252
ctggcttggacctctctggtttatttgaagaatctaacaagaagagagaatccaaattcacatctaccaacacaagctcgacaatcatatcgaagatcgaagatattgcaaagaatttgcggttgaatttgacaaagaaggatggtggtttgttaaagatggaagcttcaaagcccggaaggaaaggggtaatgggtatcgatgccgaagtatttgaggttagccctaactttcatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttaaaaacttatgagctagtgcaatacatcttttagccaatttccaatctttcgtgtattgtgtagttttactctttaatatcaatttgtttcccgtgtaatgcaacataaacttgtgtaatttcgaggacaaattattcaaagatgtgttacncgttaaaaaaaaaaaa

SEQ ID NO: 85253 - DNA, 569 bp, Triticum aestivum
  unsure (1)..(569): unsure at all n locations
  Clone ID: PAT_TA_85253
gttccctttccccgcccctacctggggcatctgcctctgaatcgcggcggctcccgaggcgccgcctggcgagcggctaggcgccggtctacggcgacgatggaggtgtgatttggacgggagagagcgtggtggtgaggtctcggttttctcgatataggagatggcggcggcaaagggccngggaggggagttccccgtgggcatgaaggtgctggttgtggacgacgacccgacgtgcctcgttgtgctcaagaggatgctccttgagtgccgatatgacgtgacaacatgtcctcaggctacaagagcactaactatgttgcgagagaataggcgtggttttgatgttataataagtgatgtccacatgccggatatggacggattcangctacttgaacttgtaggccttgagatggaccttcaattatcatgatgtctgctgaatcaaagaacggatattgtaatgaacggattaagcatggacattgacaattaataaaactgtcagaatggaggagctgaaaaacatctggcaacatgtataggaaaaaattatgaaacag

SEQ ID NO: 85254 - DNA, 432 bp, Triticum aestivum
  Clone ID: PAT_TA_85254
ccaaggccctggagctgtacgcgagggacgccgggctgggcgcgcaggaggtggtggccgcggtcgagtgccacctgcccgagggcctccgggacgccgtgcgccggagccagcagcaggccggccgggcgcgcgccgtggagtggaagccccacaacctggcgttccggtacctgctggccaaggagctggtcggcgggtcccccgcgtgcagccggccgctggagccggtcagtgcgccgctgcgggctggtccgtgatccgtcatcagatcgccgtggggcccgtggccgtgccgagccgagcacgagttgagatgtgcggcggcggcacactgcgttcgggccttgggggcgttgtatgtacagagagtcaagagagatggacggcgaaacagacatctgatttactcgtaccagtaaaaaaaaaaaa

SEQ ID NO: 85255 - DNA, 562 bp, Triticum aestivum
  unsure (1)..(562): unsure at all n locations
  Clone ID: PAT_TA_85255
ccgacactcatctgatcacccactagctagctagcagcttaaggaacttccagctagcgatcgatggctcgtctcaacagcaaggctgtggtgtccgccgtggtcctggcggcggtggtgctaatgatggccggcagggaggcgacggcactgtcgtgcgggcaggtggactccaagctcgcgccgtgcgtgtcgtacgtgacggggaaggcgccctcgatcagcaaggagtgctgctccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttcccatcagcatgtcaacaactgcaacaatgtcaactagttaatatataacccttccgacgtgcatcaaggacnccntgtgtggagctaatgtcnacttatggagtgctcatacatactgagctacaaatataaataaattgctgcgtgttaattcagtacgtgtacgtgttcg

SEQ ID NO: 85256 - DNA, 561 bp, Triticum aestivum
  unsure (1)..(561): unsure at all n locations
  Clone ID: PAT_TA_85256
cacctcagcaaccttatggtagctatcccccaacatctggtggctatcagactgggtgggatcagtctcaaaaccagcaatctcatacaactccccctggtactgggtatgattattatagccagcagcagcaacctcaacaacaacaatctgcccctgggactgctgcttctactgatgccactagctacaattatggccagccttcaacatatgcttcacaaggatatgattctacctatactcagcatagtggtgggcagcaagcatatggacatgatggctactctggttaccagacccaaggccagcagcagggctactctcagcagactggttatgaccagcagggatatggtgcatctgcttatggatcagctgcgaactcganccaggatgggtccagctatggtggtcctggtggggcaccaagcatctccggggaacaaactnaaccccaactgctggaagcaacctggctatccaatcaacgcctactantgctgcacaagcttcaattcagggtaactccatctggatatggnctcacanccaanctgg

SEQ ID NO: 85257 - DNA, 571 bp, Triticum aestivum
  unsure (1)..(571): unsure at all n locations
  Clone ID: PAT_TA_85257
attgtggcccacatactgattaaggctctcatggcaatgccagcccctgacttcagtttgtgcttattcttaatccctgaacatgtgcaaatggaggagcaattcaaggtattgatagttctttctcactacctagagactgctaggttcagtcaattttgggatgaagcagcaaagaaccgccacatatcggaagcagtgccaggtttcgaacaagcaatccaatcctatgcgattcatgtactttccttgacataccagaaagttccaaggcctattcttgtagaggcaatcaacatcgaaggtctcgcnttgggacaatttcttgagtaccatgccgcgaactcaggttgggtgattgagaagggtgggcaatctcaatgattgttcttccgcgtaatgantcaatcaccagagctcaaagaagaacacagccgatacctccgtttgaacacgtaacaccatatccctgtcctggctgatcaagcgtgctgagantctatcaaaatcagcgatgaagctcctantcaatgcacctcagttgtggtacctatgagatanccggnaacat

SEQ ID NO: 85258 - DNA, 516 bp, Triticum aestivum
  unsure (1)..(516): unsure at all n locations
  Clone ID: PAT_TA_85258
cccaaccttcccctacaccagaaaaatccccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccaanggccgcacctctacgcttcggaggtaagctaagcgctcctcntaatccgggactgggttaggggaattcnctgtgtgatgctttcnaagnaatattgctcaatanctgtgtatccatcgcttctgcaatgaaacgcttgaacatctactatttgtgnaaaaaaaaaaaa

SEQ ID NO: 85259 - DNA, 592 bp, Triticum aestivum
  unsure (1)..(592): unsure at all n locations
  Clone ID: PAT_TA_85259
gaagcgacaacgaggaaaaacgggacgtggtgaaggacaactcccctaacaaacaaccaaaacggcgacgcaagcgccgcccgaagaccggcctcgataaaaacggcacccatacggacccggacctagagcagggcgaagcagtggacgatgaacatgccaccaagcaaccatccgaacatgatgaactggacaagcaacccatccccggtgaagacgatctcacatcaccaagagcatacgaaccttcataaaagntcgtcgccactgcaagaanttgaagaagcaaaagcggaagtcaaaacagcggaggacgcactcaagaatgagatggagcaaantactcaacaacgcaagataaatatggcgctancaccaagacaaagagtaaccgaaacacaantcttgccccgaattttacgangaggcttaagaccccgcggtcaaaaaagaaagaaccccctggccgggatagacgacaagngacaggcaagactacaangggcncgggcacaaccgganacgatctcgaaaaaggtgaccggcagtcatcttgggcaaaaagaagatcaggaanacataacagccgaca

SEQ ID NO: 85260 - DNA, 447 bp, Triticum aestivum
  Clone ID: PAT_TA_85260
tcgagttttttttttttttttttttttttttttttgccaaataccagaagacaggtcgatctctgaacaatgtttatcttgagtgtactctcaagtgctgtgagatactattattcaatggaccacggtaaaaccgtacgacagacccattaggaacacatccatttcctaagcaaaaccgtacggtatactcaccaggaacacatctgtaatgaagatttttggtaaacgttatttgtgtatacatggggcgaatgcacattaggcaaaagaaacataaagtatcaaaactgctgggtccagatatgcatctttctctgacttgttcccacctaggtaccctgccaaactctcaagaaacgtccgtgacccaggagacgctgcgagtcagccaagctttaggagtcgatgacatttctgggggtctctgccgcaatgcgcctttgt

SEQ ID NO: 85261 - DNA, 337 bp, Triticum aestivum
  Clone ID: PAT_TA_85261
tccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccaagaagagcacggagctgctcatccgcaagtgcccttccagcgcctgggtccgcgaagattcgcgcaaggattccaagaccgactccgcttcaatcctccgccgtcgcc

SEQ ID NO: 85262 - DNA, 474 bp, Triticum aestivum
  unsure (1)..(474): unsure at all n locations
  Clone ID: PAT_TA_85262
gccagctagagccaaccagaagagcttgcagttactgagagtgtgtgagagagagaggatgatgggtggcagcggnagggctgctctgctgctggccctggtggccgtgagcctggccgtggagatccaggccgacgccgggtacgggtacaccccnacnccgacgccggccaccccgaccccgaanccgganaagccccccaccaaggggcccaagccgganaanccgccaaaggancacaagccgcccaaggagcacnggcncaagccggagaagccgcccaangagcacaagccgacgccgnccacgtncacccggngccccaaacccacgccgncgantanaactcccacccgaacgccccccaagccgacgccacccanatacactcccgcccctangncccacaaaccactcccactcctcngacgtcanccctcccccagcctccgnnctaagccgaacncgccgac

SEQ ID NO: 85263 - DNA, 572 bp, Triticum aestivum
  unsure (1)..(572): unsure at all n locations
  Clone ID: PAT_TA_85263
catctgaggaggacgaaggtgcctttggctctggtggttaccggaagccaaaaccctatgacgaggagacacagggttcatacggttatggagaggagcagcccaagtatcagagtggcgggtatgagaggccgagcttggtngggggagaggggtactntggccgcaagaaagatgatgacgactcggatgatgagaagaagcggcgtcattctaagcaccaccaccatggccaccactacgattactaancaccantgccttctgctgggcgttgccctggttcaccgctactgctactatatccattcgcttgcataaataaagacggctgtgtaccttctgggacactggaccaccgttgcnacgtttcctctgcattgttacatcccagccgtgagtgtgctgttnattatctatgttcaaatcnttntgatgaacaccgtccacgcctgttatcctaannanaaaaaanancnagggggggcccggtaccaatcgcctatangatctattagctcgctcatggcntcntttacaagtcttaacgggaaacctgcgtttccaactat

SEQ ID NO: 85264 - DNA, 577 bp, Triticum aestivum
  unsure (1)..(577): unsure at all n locations
  Clone ID: PAT_TA_85264
tttttttaatttctgaacttcctaaagtgctctggtgtaatactaaaaagtctagactctaaagataggaccctgtcaaacaagcggattgtcgaatcacacaagcagaaccgatagcttcgttcatgacccctcttctgcaggccacgccgcccaaccaaacatgacagtaatcttgagtacagcggctacccacagcgcaccagaagttcccagctcgctctttgcaatgagtcctccaattatagcgccgatgaggaggagcatcggtgctgcgacacgcctgtttctctccgcattgacgaaaatgctctcaaacantccgcatcggagaacaancgcagtagatgcttgtgagaacaacactatcaaagcgttgaacttgagcgcacgacccgcaacagttgcccgcagtttggaacgccacgagagctattggtacgatgacgtacaaggtgtacatctgggcctgcgcctttanggccaagtaacgatacaagcagtgcaacgatgaagangtttgaatgcaaaagacaacaaacaccaattcccaagtgttgggtaaacacctgtgana

SEQ ID NO: 85265 - DNA, 392 bp, Triticum aestivum
  Clone ID: PAT_TA_85265
ccacagcccaccgcgcgagcaacgatgttcaggtgccccagcaatggctacggccaaccgcaccccaccgcgaactaccaccgcacccactccggcgaacacgtcaccaccaaggtcgcccagaaaccctgccatgccggcggcgccgtgcagcagcaccacgttgtccacaaggagtcgtcgttcaaggagctggacgggggtaaccgccgctgcttcgacaactatcccatgaacgctgctaacaacgcgaaccaccaccgctacgaggcctacgaggaaacctacgaggaaaccaactgcgaggaggagacgtacgcgtacggcgccggccgccaccatggtcacggcagcggcggcggcgggcgccgcttccaataccaagaccacga

SEQ ID NO: 85266 - DNA, 584 bp, Triticum aestivum
  unsure (1)..(584): unsure at all n locations
  Clone ID: PAT_TA_85266
cgagaacggctggaagaaccgagagcgctccggaaatgtcggcgggtgagctgcggttggagctggacgagctgcggcggctggagagcctcgccaagcacccccgcgtccagatcctcctcgccaacgaaatccgcaacgttgaagcgaagttggcgaaggcaaccgaaccatcgcctgagccactggcggcggcttctgcgccagcgcccgcgcccgctgcgcgtcctgttttaagctacgtcactcttgggtcgttcagctgggagcaggacaacgagaagattaggatatatgtttcccttgagggagttgagcaagagaaggtggagactactttcaagccaacatcagtggatataaagttcaatgatgtcaaaggcaagaatacggtgtgctataccaaagctgaacaaggaaatgttcctgagaatgtnaggttgtggtgaaacaacaaggttgttgttaccctttcaagggtctaaagnaactgggtnagactgcactcaaggaagacaattaagcaaacatggacaagggaaaagtcgattangaatatgactatganaacattacaagaggca

SEQ ID NO: 85267 - DNA, 567 bp, Triticum aestivum
  unsure (1)..(567): unsure at all n locations
  Clone ID: PAT_TA_85267
cgaaggccctgaagaaatggcacaaggccgtggtgaagaagaaacaccacaaggattcctcacacaattcttccgagactcctagcactgacacaacaggacctgcaggggaagcgggtgagtggcancggctgcacgaggtgccggtccggcacctccaccggtacaagaccatcgcgcacgtcggcggcgtgaggagcccgttgtcggacccggactacagcgacacggacgacaccgagccgctttcgttgcagactaggcacctgataccgccggcgaagcagcggagctcgacaccgagcgcgcngaggtgcgcgttaactcnttanagacagcggcggcgccnagcaacttctcccaagacagttctcgttccaaaggntgctcctcctcgccatgtgccggacaagttaagtngcaacattctgcttaatactacaaacgtcctatatngagatatanaatagtanttcaagttataatcnattgggtagtttacaacttggtattattaattaagntattcatatacaaaagttaaactagaaaatcaaatgttntatt

SEQ ID NO: 85268 - DNA, 374 bp, Triticum aestivum
  Clone ID: PAT_TA_85268
cttccacttacagcacgatggcagtatgatcataaaccggaagaaggaaccgaggaatggaaacttctggaagcctgcataaacccgaaggattggatctgattagccgttattcttgagatcttttgttagagttttcccttctgtagggctaagaccacgtgcagtttcattatatattttgcatctgtagaatcgtgaataaatatgatgtagtgatgttgtagctgtttgtatctatctgctgtttttcccccatgtgaatgagagaaccattgggcttctgtatttacgaaggattcaggtttctgaacactatcatttgctactactatggggaaataccaccgatgcaggcagataggctgtctaag

SEQ ID NO: 85269 - DNA, 339 bp, Triticum aestivum
  Clone ID: PAT_TA_85269
attttatgccatcaacagaagggggcaggttttacatgccacagttaatgatgcaactgttgtaccttttgtcagtggccaattaaacaaccttgagcttgctgtgaatctggccaagagagctaacctccctggtgctgagaacttggttgtgcaaagattccaggaattgtttgcacagacaaaatacaaggaagcagctgagcttgctgcagaatctccccagggtctcctgaggacgcctgagaccgtggcaaaatttcagagtgttcctgtgcaagctgggcaaacacccccactcttgcagtactttgggcacattgctaacccgaggggggg

SEQ ID NO: 85270 - DNA, 568 bp, Triticum aestivum
  unsure (1)..(568): unsure at all n locations
  Clone ID: PAT_TA_85270
ttagggtggaatgctatagcttaatgccctaatctttatatgcctcttcttatatctgcacttccatgggcaccgggcgacactaaattcacaagataccccctccacctcaagatattagatcccttgattatcatgaaagatgctggcattattcattgtgatctaaatccaggaaaaaaattcttatagctccaacatgagttaattcttctcaatgccaatgttggcattgcagcatcacagtaaaacattgtatttctacagacacttccagtaactgaactctattttttagttgttcccataatagtcagccacctgggtatactgttattgtcttcaagatttcaagacagcaacccttgcagctatctgaaaccagtgtttggccggggcgagggagatgggaaggagtggaggagagcgtgctcccaacaccgcttgagagtttcaattttttctaaatcacgttcctaggagctcgtgttgttgcatgtgttgatgtaattaaggaatatatctttgtgtcggctcnacaatctgaacagtatttggttctaattag

SEQ ID NO: 85271 - DNA, 591 bp, Triticum aestivum
  unsure (1)..(591): unsure at all n locations
  Clone ID: PAT_TA_85271
ctgacccgggccacactccgctgctccgccatggcgatccgctccaaggcctggatctcgctgttgctcgcgctggccgtcgcgctctccgcccgggcggaggaggagcccgccgccgccgcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacganatccaagggttcccaaccatcaagatttcagggaccaaggggaagaacattcaggaatacaagggcctagggaggctgatggattgtggattacttgaagaacaagttggcctgcgtcaaaggatatnaantcacaaaagatgcgacggccttatcgatnacaagaatatcacattggtggtacctcgctaantaagggcacnaattanaaantatggnggncaaaaaactgngtctann

SEQ ID NO: 85272 - DNA, 388 bp, Triticum aestivum
  Clone ID: PAT_TA_85272
aataatcttcctagcggctttggcctatcaaccttttcagattctgtatcttgcgaaagacggtctcgtgtactctctatagtttaggtgtcaaggaattgaggaacagacaattttgagctgtataattttgcgagatcagatgagtgttgattgttattgtttcggccaagaaggaaagaaagaagccatgaattttggtcttgggcgaccaacttaatttgcaggagtcctagatgaacaaggctaaatatgttgttactatgtccacctaaaatgttgttagttattttcctgtgactacacatttttgtaacgttgtactatgatttgggaatgttttattgggtacaatatattgtgttatttaggagtcaaaaaaaaaaaa

SEQ ID NO: 85273 - DNA, 581 bp, Triticum aestivum
  unsure (1)..(581): unsure at all n locations
  Clone ID: PAT_TA_85273
cgcatctacaacggatccaccccgatcgttgactctggcctgagcgccgggtacgccacactgctgcgcgcgctgtgcccgtccaacgccaactcgtccacgcccacgaccacggtgatcgaccccagcacgccggcggtgctggacaacaactactacaagctgctgccgctcaacctgggcctcttcttctccgacaaccagctgcgcgtcaactccacgctcaacgcctccgtcaacagcttcgccgccaacgagacgctctggaaggagaattcgtcgccgccatggtcaagatgggaaacatccaggtgctcacggggaccagggccagttaagntcaactgcagcatcgtcaacaacggtcgtcgtcngtggggattcaacagatgacagtgccaactcctactctggcgccacgcgtccttgatgatnagttgccacgagtgatctaaatnggcgcggtgtgatgtgatattgatatttgcattgtgtgtcatctttaggcaataattatacttgctccggtagcgcnaaatgcgtagttgnggtantaaatcgcgtaacaganttcatacacn

SEQ ID NO: 85274 - DNA, 489 bp, Triticum aestivum
  Clone ID: PAT_TA_85274
cgccgccgcatcccagcctccatcaccgtttccgtctcgttgccatgggtaaggtgcacggatcgttggcgcgcgccgggaaggtccgcgggcagacccccaaggtggcgaagcaggacaagaagaagaagccccgcggccgcgcgcacaagaggatgcagtacaaccgccgcttcgtcaccgccgtcgtcggcttcggcaagaagcgcgggcccaactcctccgagaagtaggcgccgctcggctcgtaccggttcctcatccttcctgctctccgtatgcttatgctcttgatggtactaagtttcgttgttcgcaagcagaggaagaaccttctgtagattcggttttgttgtccatgtgctcaagatgggaacttgagattgtatgaatttgagatatggtgatatgagctgatgattttaatatgcttaatgttgctcctctgagctgttaattttgaacgctatccaaataaatttgaaacaa

SEQ ID NO: 85275 - DNA, 286 bp, Triticum aestivum
  Clone ID: PAT_TA_85275
cttttgaccaaccacttaacatcactcactcacaatgggttacggcactctcgacaacggcgactggctcatggtcggcatgagcatcttcagcaaagatcgctccgtcgagctccgcatgcaagacgatggcaagctcgccatctactacaacaaccgctgcgcctggcagagcaccgaccagcagatcagcaacgcaaagggcgccatcatgcaaggcgacggtaacttctgcatctatgacaagaatggcaaggccacttggcacaccaacactgctgccccc

SEQ ID NO: 85276 - DNA, 229 bp, Triticum aestivum
  Clone ID: PAT_TA_85276
ttggagctggttgcttgacttgaccgaccctgtatcatgtaatttgtatgccactcatttgtggtgcttggattgctgctatcttagaaaaagaagtggtaaactggttatgtatggttgtcttgtaacgaacaaaacaaatcaaagagttaggtgccgtttgttttacatatttgtaacgtgatgggtaactgtgatgggtaactgataacgttacaaaaaaaaaaaa

SEQ ID NO: 85277 - DNA, 294 bp, Triticum aestivum
  Clone ID: PAT_TA_85277
ggtgcaacgcgccacgggactccggtagcgctgccacgacgacctacgaaaactacttgcactgaggtgtaggtagagcaaagtttacagctatagcgcgcgtcgacgaagcaggagcagcagcagcagcatgaattgaagaggagtcctcatcatcacatcataagggagcagcagtagatttaattgcaaaattaaagacacccgcgatgcatgccctatcactagttttgttccaccggtacccctaccgcgcgtttcttttaagatttggttccccatttatctggggac

SEQ ID NO: 85278 - DNA, 294 bp, Triticum aestivum
  Clone ID: PAT_TA_85278
gttgcaacgcacggacatccagctagtacactagaagcatgatattttacatttgtagtgattgtatattccgagaactttgataggatatcaacgttctcacgctcacagaaaggatctcacagagattaaaccacatcctgatatccataatcaaatgtaaggatcgctgctgcataaacgaccaggatcattagcttcttcctaaatcccaccggccaccgtgttcacctctctactacttggagagcgccttgcggttgcggaccctgggagcccaccctggtcttccct

SEQ ID NO: 85279 - DNA, 283 bp, Triticum aestivum
  Clone ID: PAT_TA_85279
ggggcaccaggcgcagcacggcacggacgacaccgaggagctgcttgcagcccaccggcagctgtggtgccatgccctgggctacgtcaagtccatggcgctcaagtgcgccctggacctgcgcatccccgacaccatcgaccgctgcggcgggagcgccaccctgggcgagctgctcgccgcaagcgagatcccggcgtccaaccacgactacctccgacgggtcatgcgcacgctgacagccatgcgcatcttcgcggtcagccacgacgaccccgccaag

SEQ ID NO: 85280 - DNA, 325 bp, Triticum aestivum
  unsure (1)..(325): unsure at all n locations
  Clone ID: PAT_TA_85280
aacttcatgtcaatcacgntgcttggttccttggcgtggacaatgatgcaatctggtggtactcggntggtctgggaaacggtcancgaacaacgccggcccggtgnggcgaacgggcgcagcaccggcggtcgaagagtgcctccaatctcctcgaggctcctccccttgggtctcaggcaggcacgcgtagacgaacacccacgccgccgcggggacatcgccgcggaagatgtagaaggtcccggccatgcccaccggcctcggtacatcgggaatgaaaggtcatccccacgaatggcgctcatcacccgggttgaccgcc

SEQ ID NO: 85281 - DNA, 286 bp, Triticum aestivum
  Clone ID: PAT_TA_85281
gcttggaagtggtgcaacgtcacgccacagaatacgtcagcagattgatcttgtgtaacattattctctctacggtagtacgtggaatttatttttgtagagtcggacactatcctggtgttcacaatcttctataatttattcggaggaggaacccgccttgcaatgccgaagacaatatgcgcgccggactcgtcgtcattgaagcctggttcaggggctaatgagggagttccggactagggggtgtccagatagccgaactatcatgatcggtcggactcca

SEQ ID NO: 85282 - DNA, 285 bp, Triticum aestivum
  Clone ID: PAT_TA_85282
ccagcttccccggcatcaccagctgcggcggcagcagctgcagccgccgcggcagcacagcaggcggcagccaaagctaagggagtggctggtatgggatcttagcacatggagcgccccaccggatgtatatttaaccaaacaagcaaagctgttccagcgattgacagttgatgaaggtcatcggatgtattgtatgctaaactgctgcagcaatagaacacactgattgcgtggaagttactcttccatgtgcctcgagtgcaaagcagagacaaaaaaact

SEQ ID NO: 85283 - DNA, 579 bp, Triticum aestivum
  unsure (1)..(579): unsure at all n locations
  Clone ID: PAT_TA_85283
tatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacaanggccggtactgggacaatgtggaagctgcctatgttcggatgcaccgacgccaccangtgattaacgagtggaggagtcaagaaaggagtacctgacgcctaagtccgcatcatcggattcacaacatcgtcagtgcantgcgtcagctcatcgcctnaagcacgggctcaagatccgcaaggctaaacagtactcacacaggcatttaatgcantnagtttgcacnctacn

SEQ ID NO: 85284 - DNA, 586 bp, Triticum aestivum
  unsure (1)..(586): unsure at all n locations
  Clone ID: PAT_TA_85284
cttttgcatgcttcaggctgtgaagatacaccaaatatactttgcaatgttgacccagttgtatatgagacccagaagtgtgtattggaagaaaatctttccaggagagctgaacactacttttttgaaatgaagcgggttacaaagggcagggatgcatgggctcatgggaacctacaagaacttggacagctgatctctgaatctggtcgcagctccatactcaactacgaatgtgggagcaaagagatgatccagctgtacgagatcctgctgaaggcccccggcgccctccggcgcccgggttcagcggcgccggcttcaagggctgctgcctggccatcgtggagagcgaccgcgcggaggatgcggctgcatacgtccgtgccgagtacgaaaaggccaacccgagctggtctccaagattcccgcgggtngccgtgttctggtctgcnaacccggggacccgcgcgcgtcanaatgcctgatctcacctgagctcctgatgcantcgtggnccgacanacggatgatgacncacantcaatcctgcgttggatcnntttagtaacccctttgacaacgg

SEQ ID NO: 85285 - DNA, 584 bp, Triticum aestivum
  unsure (1)..(584): unsure at all n locations
  Clone ID: PAT_TA_85285
tgaacacctacgacggccgcaccatccgctaccccgacccgctcatcaaggccaacgacaccatcaagatcgatctggagaccaacaagatcatggacttcatcaagtttgacgtcggcaacgtggtcatggtgaccggcgggaggaacaccgggcgtgtaggtgtgatcaagaacagggagaagcacaagggcggcttcgataccatccacgtcgaggactccatgggccaccagttcgccacccgcatgggcaacgtgttcaccatcggcaagggcaacaagccgtgggtgagcctgcccaagggcaagggtatcaagctcaagcatcatcgaggagcagaggaggcgcgactttgctgcccaagctgctgccaaggcataagttctctgaatgtgctgcttggagcttttgctagtcnagttaaattttatctgcaangntatagactacctcccaaagacttatcatcatgttttgntgctttgggtcttgaaancgttgcaactaactgtaagcntaaatcacttcaaatantgtgaacgtgtgtcacacatacagcttgtttgctcaaaaaaaaaaaa

SEQ ID NO: 85286 - DNA, 575 bp, Triticum aestivum
  unsure (1)..(575): unsure at all n locations
  Clone ID: PAT_TA_85286
cgcgtcttggtcttcgtcttcgtcctcgtcttctcccccaccccacggtccacgcctacctccttattgcttggttggtatacataccaccatcggcacctcgctcttctgctcagctctccccctctagcctcacctaccctatacacagccactactgttgatcgattgagtttgaacccaccaggatcaggcttaggattacagcatgtcggcgtccccggagttgtacaggcccgcggaagcgccggccttctcgccgtcctgcgccacgcagccgccgctcccgctcgtgttcgccggcgacgactactgctgcaggacgccgacgggcagcgggatctgctacctgagggagcccaacacgtgcccgcccgcgccccggaagccgccgccgccgccgccatgtgcangaagcgcctcttcaaagcggcggataacaagttgctgangcggggccgtcctgttataacatccgcctcgacagctggacgcctctccgccctgtcgcgccgacacaacacaacgacaacgagccctcggtcggccanccaaatcgcacaaanagnntaagt

SEQ ID NO: 85287 - DNA, 531 bp, Triticum aestivum
  unsure (1)..(531): unsure at all n locations
  Clone ID: PAT_TA_85287
cggcgacgggcgccgcctcctcaggctcctcctcgcggtttaccacccgcgcaaccggtacgtgctccacctctccgccgacgcgccagacgacgagcgcctgagcctcgccaccggggtcgtcgccgcggcgcccgccgtgggagcattcgagaacgtggttattattggcaatcccaccgccgggacgcccgtggggtcctccggactcgccggcacgctccgcgctgcggccgtgctgctccggctccacgctgactgggactggttcctcaccctcaatgccgccgactaccccctcgtcacacaggatgacctgattcatgtcctttcttctgtccaagggatcttaacttcattgaccacaccgggtgacgttggatnaaaagaactgagaaattcaacaaattatatcgatgctggaattactgtcanggaggacaactctttcgaggaacacagaaacagcanctcctgaggcttaagttcttanaggtctcaanggtcatattaaccggcaattntagatac

SEQ ID NO: 85288 - DNA, 567 bp, Triticum aestivum
  unsure (1)..(567): unsure at all n locations
  Clone ID: PAT_TA_85288
gccattgccgcctcccggctcgcgactcgcgagtcacaggcgcagccgagcgttccttggggacgaggctacatcgcgatgtggtggagggcggtgaggcgccggtgggtcgcgacggcgcggcccgcgtcctccgcggcggcgggggcggagaagagctgccgcgccgtggtggtgccgcgtttcggtgggccggaggtgctcgaggtcaggcagggcatgcctgtgcccgatctgaagccgcaggaggtgctcgtgcgcgcacgcgctgtctctatcaaccccctggacctccgaatgcgatgtggctatgggcgctccatattcgaaccactcctacctctgatcattggtccggacattaacggtgaattgcggcaacggaacttgnatctctttcnantggcaanaagtgttggntcgttgcatcaaangctctcaaaaggaatatctgaatatgcatcctgtcactggacaacttatctcaaacatctaaccagnattggaggcaatgcaatccctttgcgcttactnatgggcgcttaatgtacgntctattctaagana

SEQ ID NO: 85289 - DNA, 567 bp, Triticum aestivum
  unsure (1)..(567): unsure at all n locations
  Clone ID: PAT_TA_85289
acgggtttgaagcgaaaattcgcccaaaccaggccggcgacggacgcctcctcgttctccacgccgccgccgccgccgccgcgttggctaggttgacctgatcgatcttgacttctctaggctcttgcatccccgacgacggaaatagcctccgagtttccgacagggtggctccggtcgaccacgaagcctcgatctgcatgacgaggctactcgtcatcctgttcgccggggcgaccctagtagtcgccaccaccgcgcacgagcaccatggtgaggcgcccacctgcgccggaggcagcgagcacgtgcttgcggagttccgccccggtgaggtgaccgtggacgggcaaacgaaggactgggaaancgttngaggctcggagttcgcgctgctgccggtctaattaagacgatgataagggctatccggcggcaagatcgcctaaagctgtcatgatgggtcaactctctcttgctcaagtnaangggctacctaacaaagggaaagtacaatgcctcgttcncgangtcaagttgngaaaacaanttaatatggaggtnaan

SEQ ID NO: 85290 - DNA, 493 bp, Triticum aestivum
  unsure (1)..(493): unsure at all n locations
  Clone ID: PAT_TA_85290
gaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaaccgctacctgatcaagggccttatctatgcacctgacctgcatcaacaatcangtgccatgccatgcntgttgtaaacaggccccctaaataaaatctccctggnttaactataaaaaaaaaaaa

SEQ ID NO: 85291 - DNA, 585 bp, Triticum aestivum
  unsure (1)..(585): unsure at all n locations
  Clone ID: PAT_TA_85291
gttcccgcggctgcacttcttcatggtggggttcgccccgctgacgtcccgcggctcgcagcagtaccgcgcgctgacggtgccggagctgacgcagcagatgtgggatgccaagaacatgatgtgcgcggcggacccgcgccacgggcggtacctgacagcgtccgccatgttccggggcaagatgagcaccaaggaggtggacgagcagatgatcaacgtgcagaacaagaactcctcctacttcgtggagtggatccccaacaacgtcaagtccagcgtgtgcgacatcccgcccgtcgggctgcccatggcctccaacttcgtgggcaactccaactccatccaagagatttccgccgcgtggagcgaacaattcacggcatgttccggcgcaaggcttcttgcactgggtacacaacganggcatggacaaatggagtcacagaggcnanagcaacatgaacgactcgttgccgagtacaacagtacaagacgcaacgccgaggatacaagagganacacacgggaagaggacaccctgattggcgcaatancgtgaaacgttcattcaccncnatgaaa

SEQ ID NO: 85292 - DNA, 496 bp, Triticum aestivum
  unsure (1)..(496): unsure at all n locations
  Clone ID: PAT_TA_85292
cattcgttaagacaagaattccacttcagactttcgctttgagattcatctcgattactttacattactaattctaatatcaacaatctcgaaatctatcaacatgcgtttcacctccatcttcgttgccggcgctttcgccaccatggccgctgcccagagcaagactgcttctgtctctcccgctcaacagtctcagcttgactgccttgacgcctgtgatgctggtgatgttaagtgccagtcttactgcatcactgtcccctctcccgatgagaagaacatcaacgccaccaccgagtgtgttgccgcctgtcccaagggcaagggtctgcctccgacaccgagaagtactctgtctgtctccaagattgtatccccaacaactactgggaagacagtctccggtactccccgtnaagaccggcgatgctggtccaaaggacgagcttcctccgctgccgggtctgctgcttcaaaggcaccgcacgcctcn

SEQ ID NO: 85293 - DNA, 518 bp, Triticum aestivum
  unsure (1)..(518): unsure at all n locations
  Clone ID: PAT_TA_85293
cacacgttccctgccgctgcctctacccctctccgggctctccctccccctctccaccgtctctacaccgccgccgctcacaccccaattcctctcgccccattgccggccgcctccctccgtcctctcgcctcgcttgctgcaggttcaatcgccgccgccatttctgcagtttttaattcccacgtcctgttccggcccggccgtgcactccaaattcttccaagaaggccagcccacgccacccggccgggatcccagaaaagttgcgctcggccttcgcgcgttacgtctcccacccagccttcgatcccgtgatttcaagaggcgcccctgtaccgaaagcctagtcccaatcttccttgggattcgtcttttttttggattcttggggactgcactggcacacagtttgcctctcctaactttttttgggttcttggtggtgccgagccgacaagcaatggggaggaattactaatgcacgccgtgggcgcgctggcgtcgtgttcgcnggg

SEQ ID NO: 85294 - DNA, 513 bp, Triticum aestivum
  unsure (1)..(513): unsure at all n locations
  Clone ID: PAT_TA_85294
ggagcccctcggtgtggtgctcatcatctcagcctggaactaccctttcatactctcgatcgacccagtcattggagcaatcgcagctggaaatgctgttgttctgaagccgtcagaaatagcgccagctacctcgtcattgctagcgaagctgctgcccgagtacgttgataactcctgtattaaagtcgtggagggaggcgttgcagaaacaacctcactcctgggaacagagatgggataagatcttctacacaggtaatggaaccgtaggacgcatcgtgatggcagcagccgcaaagcatctaactccggtggctctgggagcttggtgggaaacccctgttgttgtggactcaaatgttgaccttcatgttccgtcaagagnttnttgttggcaaatggggatgcaacaacggccaagcatgcattgccccagactacatcataacgacaaaatcatttgcccaaagctgggtggctccttgaaaagggtttggaaagttttacggg

SEQ ID NO: 85295 - DNA, 299 bp, Triticum aestivum
  Clone ID: PAT_TA_85295
cagaaacccaaaagactccacctagagtagaaactgctcaagcaaggaacaacagactgcaaacgactcaccgtcattgggtgaagaatggttcaaccatgagtgtattgcagaggtcgcggtagagagaggaacatcgtggctgagatgtctgatcctatttacattcactcctccatggaatgactgtattgcagagggaagcctaggtcctaatgatgaaaaagtcagaccagctcctcccccaacgctcatgcacactccgttgaaaataatagctgattttctccgaggggggg

SEQ ID NO: 85296 - DNA, 311 bp, Triticum aestivum
  Clone ID: PAT_TA_85296
gcacaacccgcacaagcctgagaccaaggccctgccgtaaacagactatgccaccacgcccctcccacgcccgcctacggaggtgggcacccctagccagtgtctcgactccgatctaccaccctcccgcccagcattgaaatctccatgatttcgtgctatcactcttgctatttatgatttcaagtgtctgcagaactcagcagagttcaagaataacacggttatgagaaggacagacggatctgtgtgtttcacaagtgtatcctttttaccaatgtttgtaatatcagtgtgatttttgggggggg

SEQ ID NO: 85297 - DNA, 526 bp, Triticum aestivum
  unsure (1)..(526): unsure at all n locations
  Clone ID: PAT_TA_85297
ggagacctggactggaggaggaggacctacctacccggcctccagctctctcgtctcttcctcctcctcctcgaagctccgatccgatcccccaatgtctgacagcagtccagctcccggcgcctactactccggccctcccgccgcgccgccgcccgagtctaagcccgttgacggcggccaggtcaacgccgatgttcctggctactactcctccgtccctgctgcgaaatctggcgccggcggccagggcagctccgctgctcctaaggaatcgggcttcttcgccagctgttgtgggtgcttctctggcggcgaaaccgcgagatagatagantcagtgttggaccgangaccatggctggatggatggnacatgcatgcccactgattgtttgcgccgatgaaattaatttgtccggattatttccctgaaatatanangttttttttccatcggtgagcggtatcntggcaatttgtcannatcattattgnanccaatgnncttaatttgcctgaanna

SEQ ID NO: 85298 - DNA, 472 bp, Triticum aestivum
  unsure (1)..(472): unsure at all n locations
  Clone ID: PAT_TA_85298
gataaatggctccttacatgcatttgttggtggagaccaatctcatccatgttcacgtgacatatatcatgaacttgataatatcatggtagacattaagaaactaggctaccaggccgacactagttttgttttgcaagatctggaggaagaggaaaaggaaaaggcacttctttatcatagtgaaaagctagcgatagcttttgggtgtcctcagtcttaatgaggataagaccatctttgttacgaagaatctccgtgtatgtggagactgccatactgccatcaaatacatgaccttagttaggaacaggactatcattgttaagagataccaatagatttcatcacttccaagaatggggcaatgcagttgtggaaatttccnggngactggccaaaactaaatgccatttcatganttgttgagaacttgaatatctgaggaatngtgttatgggactttgtcctt

SEQ ID NO: 85299 - DNA, 521 bp, Triticum aestivum
  Clone ID: PAT_TA_85299
ggtgatgttgtgctcgatctgcctcgacacagtggtcgccggaggcgaggagaggtccaccgcgaggctgcagtgcggtcacgaatttcacctcgattgcattggttcagcatttaatgccaaaggaatcatgcaatgccccaattgtcgcacgattgagatggggaactggctttatgcgaatggttctcgatcatcacaggacgtaaacaatgatgaatggggttatgatgacctatatgatcatggtcactcagagctggcaacctttgtgcctcttcgcattcaagtgggtgtcctattgggcgcctagaactccatccttatttgaagaaggagatccccaactccagctactttaatgattcacgggacaatcaaccctgacccatggtaccggtacctgcacactcatcctgggcccttactaacttatttcaacctgccccgacaccggtacacaactccctgtcgctgagaaacaatggatggtgctcatacatgatacgggacatctggtg

SEQ ID NO: 85300 - DNA, 526 bp, Triticum aestivum
  unsure (1)..(526): unsure at all n locations
  Clone ID: PAT_TA_85300
agacgatccgctagcgtgtgcgtggcgacgagatgtggcggaggcgagtgggcgccctcctccgatctccacgaacttcttcctcggcctcctcggcctgccagagccgccgccaccatcttctccccagcgaggaacctcttgctctcaaccgtcttgccaggctcttcacgtcccaggctggaagtgatggtggcgatacccagaagccctttattgcttttgtcttaggtggtcctgggagtggcaaaggaacacagtgcactaagattgcttcggatttggatttgcccatctgagcgctggtgatattctccgacatgaaatagcatctggcagtgagaaaggggagtttgatcctagaaatcataaaggaagggaagattgttccgtctggagataactgtgggaccatcaagaaaangatgggaatgaacaatgctaaaagggttcttattgatggctcccaaggtgttaaggaaaacaaaaccccttcnaaaggattttggaacaaaaccagcatttn

SEQ ID NO: 85301 - DNA, 531 bp, Triticum aestivum
  unsure (1)..(531): unsure at all n locations
  Clone ID: PAT_TA_85301
gtgacaattccacaacagttggcgcccaccgtggggcctgcgcacggtggtgttgagttcttggagggatctttcacacagatcaagaggttcacaattttctggatcaacaagagctactacggaaggatctgcatcaattctagcttcatcaattaagatcaaagaagtattattgtcacacagccatggatctctacaattttttgattcagtgtgtgtgggcgtcaagcaacacgctaagatccagtctacgtgtgagtatctaacgaaggaaactagaatcgtcaggtacgacgagtcaaacaaacaagcggtcagtcgactactgcaattcgatctaatctacagtgaagacaaattgggaaaaaaanggntcagnccaacaacaggactcggagaaagacttaaaccccgtcgaacccctcctctggtttctgctggtcaatggncgctcacccgattcgagttatgaccgcgacctgtctcaaccgcctcgcctggttcactttggaacccctccccnggntc

SEQ ID NO: 85302 - DNA, 521 bp, Triticum aestivum
  unsure (1)..(521): unsure at all n locations
  Clone ID: PAT_TA_85302
gtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtgatccatcaaatcaggacaaggagatggcatggcatggatggacctaatgaaggagcactagtagtagttatgcatggtgtgtgctttgtgttctctttttaattgccgccgagaataagacaaatttatcgtatcctacctaccgtatccagctattcatggcccttgtggctgtacgtgttgtgtcaaaagccgcgtactcctgtgtcntgaccccctttcctacgttctaaccctccctgcttccgtttaactacatatattngacaacaataattggnttn

SEQ ID NO: 85303 - DNA, 533 bp, Triticum aestivum
  unsure (1)..(533): unsure at all n locations
  Clone ID: PAT_TA_85303
gcaaggcagctcagcagcttttgtagcgagcttcttggagccttgaaatgagtagtagtggtagcctagccaccaccagtagcaagtaggcactataagcactaggaagtagctaaagcagtcataaccatgggttcgctgccgccggtggacgggcagagacgccccccacacgttgtgatgatcccgtacccggcgcagggccacatcacgccgatgctgcagtttgccaagctcctccatactcgcggcttccacgtcaccttcgtcaacaacgagttcaatcatcgacgccacctgcgtgcgcgagggcccaacgcgctcgacggcacggatgggtttcgcttcaccgccatcgacgacggtctcccgctctttgaagcggacgccacccaggacatccccgcgctctgccatccaccttgacaacctgcctgccccggtttaaggnntcatcgccaggattaacgccgaggcngagccgaaggacaaccaccgtgacatgctcgtcggcgacacacatgactcgcgcc

SEQ ID NO: 85304 - DNA, 526 bp, Triticum aestivum
  unsure (1)..(526): unsure at all n locations
  Clone ID: PAT_TA_85304
cgcggttttaaaaggagggaccgcaaccaaccacctcgccatcgacctcctcgatccagacagcaggcagcagccatgtccaaggtcttcaccctcgacgcggtcgccaagcacaactccaaggaggattgctggctcatcatcggcggcaaggtgtatgatgtgacgaagtttttggtagaccacccaggaggtgatgatgttctgttgtcctcaactgggcaaggatgcgactgatgatttcgaggatgtcggtcacagcaacactgcccgcgcgatgatggatgagtacttggtgggtgaaatccgacgcgtcgacgattccttccaaggacgaagtatgtcccccccgaaacaaccgcactacaaccaaggacaagactcccgatttgtcatcaaattctccaatttttgggtcccctggnaatcctgggcttggctgttgccgttaggatgtncaccaanccggatcctgcttaacttgttgccactgcccttgccccctcgcgattgtacaatcgaattt

SEQ ID NO: 85305 - DNA, 330 bp, Triticum aestivum
  Clone ID: PAT_TA_85305
gtcagtcctgagtttgaggttgcactctacacgttgtgcttttttgttggaggggaagacaaccgcgtcgatattggcccgtatagtgtgaacgtcaagtgctaccgattggggaacaacaaaattggatcagcctttcccattgtagagaactgattatctggtgctatgcttctgcaggtttccaaatattcactttcttcgtttcataatcaattacgtgaagttaacaatgtactattttacttgtgcatgaaaaggtaccatactgttcaatttgttgctgccatctgcaatagtattgctacttgcactgctaaaaaaaaaaaa

SEQ ID NO: 85306 - DNA, 485 bp, Triticum aestivum
  unsure (1)..(485): unsure at all n locations
  Clone ID: PAT_TA_85306
gatcagggaggacgacctgagcagcctgccgtacctaaaggcgtccatgaaggaagcgctgcggctgcacccaccggggcccctgctgctgccgcactactccaccgccgactgccagatcgacgggtaccacatccccgccaacacgcgcgtcctcgtgaacggctgggccatcggcagagacccggcggtctgggagaagcccgaggagttcatgccggagaggttcatgcgggacggctgggacaagtccaacagctacagcggccaggacttcaggtacctgccgttcgggtctgggcgccggatctgccccggggccaacttcgcgctcgcgaccatggagatnatgctcgccaacctcatgtaccatttcgactggggaagtcccaatgagaaggaagacggttgcnggaaggtnagcatggacgacactttgggctgatnctcgcaagaacaaccgctctacttgttctanggccgtc

SEQ ID NO: 85307 - DNA, 564 bp, Triticum aestivum
  unsure (1)..(564): unsure at all n locations
  Clone ID: PAT_TA_85307
catctctgtaggcacgcaaacgcaacccaccgccgcgccggcgccgccgccggccctacttccttacccttccctggccgtctcccgaagttcgctgtctccgctttaaccatccgtggtcccgttcttctgcagtaagcgggtgtttctgtgcccacgcactggcgtcacgcggaccccactgtttgtagggttacaaggacgataccccaggccatcacagtcgcattattcaggaacaggaaagatgtctacacgttaccagcacacatgtaaagcatgttaactgcatttcagtttcaagagaaagtctaccccaagacaaccaccatgttacaaaggaacgaaatggagtgctgttccgaaaacgaaagtgacactcatttcangaagaaaagagaataaagcgacaccagacaatctccaggttgaaacggcgccnggctgaagccttctgttttacatcccaagcacgattaaacagtattggggaaggacgctcaaccacaaatatgcggaattggaggacgtcgatcnggngtggaattttaggaaaaganangg

SEQ ID NO: 85308 - DNA, 200 bp, Triticum aestivum
  Clone ID: PAT_TA_85308
ctcgacttttttttttttaagggatatcttgtgtgtgtgttgaagaaaggtgatatcttcattgattgatcctcgcgatcaattgttggacctatcgtcctaaccaaaactctgatttgagtatgggctatcctcaaatcaagtcagaaccaacgatgttcgtaatgttgtcttactcgtggtttttcccgaaggggggg

SEQ ID NO: 85309 - DNA, 555 bp, Triticum aestivum
  unsure (1)..(555): unsure at all n locations
  Clone ID: PAT_TA_85309
gtcaaaagcagcacaaatgcttagtgggattgacttggattcaggaatcaggatgcttgatgacaccaacaaattatccaagtgtgttcaaattgcacgactctatttagaggatgatgatgcagtgaatgctgaggcttttataaacaaggcttcatttttggtcaccaacagccatcaggaggttctaaacttacagtacaaggtctgttatgcaaggattttggatctgaaaagaagatttctggaagctgcacttcgatattatgacatttctcaaattgaacaacgcaagattggagacgaagagattgatgaaaatgcactaagaacaactcttaatgctgctggtgacatgcacaatattgggctgggtgctgggcccacaacgctcccgtgttccttgctaccctgtacaaggatgaaagatgctccaaattgaaaatatacccaatactgcagaagtttaccttngaaagattttggaggaaaccagaattgatcatttgcanaggactgaggcgcacaaaaacttattacagataatccacgtgc

SEQ ID NO: 85310 - DNA, 462 bp, Triticum aestivum
  unsure (1)..(462): unsure at all n locations
  Clone ID: PAT_TA_85310
ctgactcaaccatctgtaacaccatcaactggacagagcaaaaagaggaagttgattactggcgactaccttccggcagagccccctgaagccgccgtcaagaaagtccccaagatcaacaccaagagcgctgaggagcggtctgctccggcaaaccctgggccttgttccgtttgagcagaggctcccgacaagttttgctccggcaaacttcccggggaacgtcctgctccggcaagccccaggctttgttccgttcgagcagaactcccggcaagttctgccccggtgaacttgccggggaacgtcaactccnggcagaacgttcagttcccgccgttggaagccggcgttccccgcaacaccaaatatgccttantccttggttgtccagccacaggtcccggcatggcaaaacgnttntcaattcctttcaaacanganaattcccnaaacagaagg

SEQ ID NO: 85311 - DNA, 485 bp, Triticum aestivum
  unsure (1)..(485): unsure at all n locations
  Clone ID: PAT_TA_85311
gcgaaacgccgaaaccgcgtcaagttccccttcttcgatcccccaatcgccgtaaccctagactcgccaccgccgccgcgatgctccgctcgccgggcaattcgccccgcctcctctcaccgtcgcccacacccgcgccctccacccctcgcccggcctccccgcccccctccaacgccccctcctcgaagcgccgccggtcggaggtgctcgacgaggacacctacgtcgccgccatcgagcgcatcatcgagcgcgactactttcccgacctgccccgcctccgggaccgcctcgactggctgcaggccgtgcggtcccacgacccgctcatcctacgggacgcgcagctcaagatcctagaccgccgccgccgcgcccagcgccacgcggcggggcccgtccccacgccgacgccgggcacctcaacgcgctccgctccccgtcctttctnacaaccccgccggatcgtcgccggcggcgtt

SEQ ID NO: 85312 - DNA, 530 bp, Triticum aestivum
  unsure (1)..(530): unsure at all n locations
  Clone ID: PAT_TA_85312
ctctcccgaccccacctctgccgtccgtgcgtccgtccggcaaccgcgacgcaacaatggcggccgggcgagagctggtggtgagtttcggcgagatgctgatagacttcgtgccgaccgtggcgggggtctcgctggccgaggcgccggccttcctcaaggcggccgggggcgcgcccgccaacgtcgccatcgcggtctcgcgcctcggtggcggggccgccttcgttggcaagctcggcgacgacgagttcggccgcatgctcgccgccatcctccgcgacaacggcgtcgacggcggcggcgtcgtcttcgacgccgggcgcgcgcaccgcgcttgccttcgtcaccctgcgcgccgacggcnacgcnattcatttctaccgcaaccccaacgccgaatctcctcactgccgacnactcaantccggctcatccggangggctgcgtctttcactacggntnaataagcttgattgctgaccttgccggaaacaatctccgtgcaatggnaattgcaaagaggnng

SEQ ID NO: 85313 - DNA, 277 bp, Triticum aestivum
  Clone ID: PAT_TA_85313
gcgtctccgttcggttttccatcggaaccgtccaaagcaaaaagtaatacatacatcaaacagcagcagcagtcacggcctcccaggagacaacaaaacactaccaagagttgatagtagcacacactgtagattgcaaaatgtattccttggtttctgcttccctcccacctttacattacattgtgccagaccacactggatcggatcagatcagatcaaatctgtgaaaaaacaagcatttcatccagcgtatgctggttacatcatgtaatgc

SEQ ID NO: 85314 - DNA, 495 bp, Triticum aestivum
  unsure (1)..(495): unsure at all n locations
  Clone ID: PAT_TA_85314
cgagttttttttttttttttttttttttttttttttttttttaaatccagaaaatgtgagcatccattcatgtggtgagacgggtaatacaactctgggaaaggtttatttctcgactgacaagtgacaactggaactggtaggttgatcaatcattttaaccattcagtttcgaaaggggtanaggcatccagcagttccagatccttgttcggtgcttcaactacccattcccccttcttcagataaacaaatgccaatagtagcagtagatcatgcatccatcgtcagaatgctgcccatccagctcctgtgctctttgtttgtccgggttcagcagatgaaggtagattttgcnttatagcagaangatctgaaaaaaggatcgttaattcccctgggtgggttcttttggagccccgaatcccngcagtaagttcaaaaatcaaccctggaagctgcanggtncnttaaggtggtggtggnaattgaaan

SEQ ID NO: 85315 - DNA, 436 bp, Triticum aestivum
  Clone ID: PAT_TA_85315
ccaagcccaagcccggcgtccgcggcagcctcaagaagtaagcttgctgggcttggttggctcgcccgcctgcatggggcgcaattcccttcggtttcaatcccatccgccgacccgatctataatcaatcaaaccgccgccctccggcctggcggctgccgcagtcggcctgcggtgtactgttagtctgctgctgatttccgttgttatactgctggtacatgtgtcgtgtgatagatgtgtcaactatatatcaatctcgtcgccggcagctctggcatgtttgagtatgtgttgcttctctgtggtgccggcgacgattgctgctagtactgttaatgtgatcgggtctccttgaacaatggcataaatatgttcttgtttactttttcctctaatggcaagtaaagttcatgatttgcgaaaaaaaaaaaa

SEQ ID NO: 85316 - DNA, 495 bp, Triticum aestivum
  unsure (1)..(495): unsure at all n locations
  Clone ID: PAT_TA_85316
cttaactaccctgccttcgccgccgtcttctcctcctaccaagactcggtcacctaccgccgggtggtgcgcaacgtcggcagcaactccagcgcggtgtaccagccgacgatcgccagcccgtacggcgtggatgtcacggtgaccccgagcaagctcgcgttcgacgggaagcagcagagcctgggatacgaaatcaccatcgcagtgtcaggcaacccggtgatcgtggattccagctactcgttcggatccatcacctggagcgacggcgcgcacgacgtcacgagccccattgccgtgacctggccgtccaacggtggagcagcagccatgtagtagactgatgctgttgctactgtctaccgctgtgggaagaaggacagggccatgagcccatgagattcgaaatctccacgcctcctgcctgccatangaataanttcctcgactgaaccacgcaataatcaactgcccctatcgtgggtgtggggg

SEQ ID NO: 85317 - DNA, 556 bp, Triticum aestivum
  unsure (1)..(556): unsure at all n locations
  Clone ID: PAT_TA_85317
cttgaagcagatgaggaattggactaaggaggagtttgttcacatactccgacgtcaaagcactgggtttgccagggggagctcaaagtaccgcggtgtgacactacacaagtgtggtcggtgggaagctcggatgggtcagcttctcggaaagaagtacatctaccttggtctatttgacagtgaaatcgaagcagcaagagcgtatgatagggcagccattcgcttcaatggaccggatgctgttacgaactttgattctgtttcctatgatggagatgtcccacttccacctgcaattgagaaagatgtggtttatgggagacaccttgatctgaatttngaggatttcacaacctaacgtgcatgatctcaagaagtgatggtaccctgactggttttgggattaagttgtattccncctggaacttcaactccatttttctcaagccaaatgggccccagtggctgtcatcctcaacagcantngatgcggcccagcatcanatctgtatcactccttgtcaagctcttgtaactcaaggagggcctaatg

SEQ ID NO: 85318 - DNA, 527 bp, Triticum aestivum
  unsure (1)..(527): unsure at all n locations
  Clone ID: PAT_TA_85318
ccaccaacccaggcgactccccctcaacccaacccaacccaacctgccattgctcttctttccctccccgtcgccagctggccagagccgccccgcccggagcccaaaggcgccgcctttcctgaaccccgtccgcggcagattgatcgattggttgttcggttccttggtcgggaatcagaggaggcagcaagagaagagatgtgcccgctgcgggtgatcctcatcttcctctccgccaccgttgccggcttcttcctcatcaggggcctcaacgctgagcccgaccagttcgacgccgacgccgacgactcgggatcccccagggcacccctgccccttcattccaaggttggtncggccgtgaaagcanggttctggacgatggtgggacatggcgagcgggcggtactctggcgcacctcgctgccaagccaaccttcaaatcggcgcggtgaaatgaaatgaaacatctctcctgncgatcantgganatggtnagtcgtcatgttgttgnatgcgttang

SEQ ID NO: 85319 - DNA, 487 bp, Triticum aestivum
  unsure (1)..(487): unsure at all n locations
  Clone ID: PAT_TA_85319
aaacaatcaagctcatctcatctcttcaagtccaactcttccaactcaaccttcatcatgaagttcactctcttcctcgctgccgccagccttgccctcgctgctcctggcacaaagctcactccccgtgacacttctccccttgtccctcgctccgcccgccgtgccaagtacagctctcaccccaaccagcgcctcacatctctctctgaggttcgcaccaagaacgaccagtactctggcaactgggctggcgccgttcagatcggcagcggatacaacaaagtccagggcaccatcaccgtccccgaggtcagtggtgccgacggcgctgctgcttccgcttgggtcggtatcgatggcgatacctgccagactgctattcttcagactgggtatctccttctacgctgatggatctttcgatgctnggtaagagtggattcccgactacgcctacagcttcagcaactttgacgtttctgtc

SEQ ID NO: 85320 - DNA, 375 bp, Triticum aestivum
  Clone ID: PAT_TA_85320
cgaggacggcatcgtcgtgcccatgtgcctgcccggccccgccatggagacgttcgtcaaggagatggacaagctgctgagcgcgcccgcagacgcagaggcagagcagcagaaggatgcgttccccgtcatcaggtccgcgctctgaagtgagctctctgctgaggcagccgcgcgcacggcgccgatcgaaccatcgttttcgcttcgtgctacagcaagcatataggtaatcatcagcgggtcctgagcagctgagcttgtgtaacgtagtgggtgtgggtgtgggttgaaccatagtacgttgacgtgcgtgggagctacgttgatgtatacgtatgtaatgcgcgcatttggccggctaaaaaaaaaaaa

SEQ ID NO: 85321 - DNA, 561 bp, Triticum aestivum
  unsure (1)..(561): unsure at all n locations
  Clone ID: PAT_TA_85321
ctcgtgccgctacgccgggaagccgcccaagggcgtcaagaccaactggatcatgcacgagtaccgcctcgcggacgtcgaccgctcggccgccgcacgcaagaagaccaacaacgcgctcagggctctagagacatgtaaagcgcgggcggcgtggcgtcacggctcacgcacgccgcgatagagacaagcgcggcaaccatggtccatggccggcgcagagccgccgcctgatcttatcgcccgcgcacaaattaccacatgcgcggcgcgcaccggattncgacgtcacgtcgacctcatctccaagcctcttccaaacactcccaatgcctggatgactgggttgctgttcccggttttacaacaagaanggtgtttatcgagcngtacgacacanttggacgacgacgacgngaacggngcctnggccgaagacgtcaacccgttgccngcgcccgnngggttcaaagaacccgcgtgccaatgcccgccttaggggcanaacngcgngccgataaagtgggactccccnagtacggnggnggtacangaatacaa

SEQ ID NO: 85322 - DNA, 534 bp, Triticum aestivum
  unsure (1)..(534): unsure at all n locations
  Clone ID: PAT_TA_85322
tctgggtcctgatgttgatgctatgaaagctgtggccgatgcctactccaaaaggtctctgaagtacttcgaaactgctctccgtgattacaaagctcagctggaagaagatcctattgtccacaggcacctttcctcgctgtatgacactctcttggagcagaacctctgcaggctgattgagccctactcaagggtggagattgctcacatagcanagattattgagctgccaatgaaccatgtttagaagaagctgtcccagatgatcctccgacaagaaattcgcagggacacttgatcaaggcgctngctgcctcatcatcttccgaggacagcaagactgaggagattttccctgccacacttgaaacgattaacgaatgtttgcaaggttgtggacagcctgtacatgagatngggcaagatnatggcctgaaagatgcagtgggagcctaagttcgtcagcttctttcctnggccnattgtcattnagtttaccaactttactttccaagaacactatggnggttt

SEQ ID NO: 85323 - DNA, 337 bp, Triticum aestivum
  Clone ID: PAT_TA_85323
gttctacaaggacttcatgtcccgctgacccgcttaaaatggttagtgtggaatatccaagtctgtcctgtcagatccaagaatcctttgcaacctcagttgtttgacttcagcggtagtgttgggtaagtcaaaatccgaaccatcagcacataccaggtctattcactggtgagatcaagtgcacggacatcctatcatgaaaagtaccttcccgctagtatccctgtcaggccagtctcaagatgtatgtttgaggtatgatacacctataagcccatacaccgttatattgctcatgacagaaggcagtcaaatctttggtacatgtcgcatg

SEQ ID NO: 85324 - DNA, 396 bp, Triticum aestivum
  Clone ID: PAT_TA_85324
gtgcccagtgcgttctccatcaagtccttggtgccgacggcgtggcaccgcccggccgctccaggatgccagcgtgggagagcagcgcccacaactgcgtcatgaactcgccgccggcgccgagcggcgtggatgtccacgttgtccgacggagggaggaacactatgaattctgcccaaaactccgccagcaccttccaccgccgcccttcgtctggcacggacacccagatctgcccgccgagcagcgcagccttctcgacaatgctgggtgctgccggctctctcgtacaggctgccgccctccaggtggctcctcatgatttttccgtgggtatctgagtctgtctgaatgtgtttttccgaggaactctctgaatttcatgtatgttaccc

SEQ ID NO: 85325 - DNA, 548 bp, Triticum aestivum
  unsure (1)..(548): unsure at all n locations
  Clone ID: PAT_TA_85325
gtttcgagttttttttttttttttttttttttttttttttttttgttatcaacttgtcatcggccttgaatagttttgagcgagctggaatctacagagtaataacactgactgttttcggacacttcacgaaacattgaacgcttcaccgacctttcgggctgtccccatgaaaaacaaacagcagacaaactgaagagctaactgcatggcctttgaatgtcgtttattgatgttgttcaagtctatcatctatactacatgagcaaaggaacaaaggagtgcgggaagagggccgagtaaacaagcaattcttctgaatccatgtggtcatcatgcggacaccttacaaccgagctttgcctgaattgaaggatgatgaaggaaatcgaaagcaaacaggccatagccttctgggtctgcgttcccccatgatcatctgatcatccaagtgcattaantcactgaatcactgttgctgctcanctctttggggctacanctgcaatgcgatagaataaaagcctgcactactccactgaggagan

SEQ ID NO: 85326 - DNA, 582 bp, Triticum aestivum
  unsure (1)..(582): unsure at all n locations
  Clone ID: PAT_TA_85326
cgagcgctctctttctctatcgactggcgacgactccgccaccgccgccgctctagcgagacgcccaggtcttcgccaacgacgagcatccgggttagagaggaagaaattgcaaccgaaacaatggcggcagattccggcgctcgcagacaaccaagcttcaccaaggtcgaccagctgcgccctggaacccacggccacaacctcatcctcaaggttgttgactccaagatggtcgtccaagagaggccgcgagggagggccccagggaagacagatgaggattgcggagtgcttgggttgggtgatgaaaccggcatcattgtcctcactgcaagaaacgattaaagtggatgtaattaagcctgggaacaactgttgaactgangaacgcaaagttcgacatgttcaagggtccatgcggttgcaatggaaatggggaattnttgaaactgctgaaactcaactgantggncattcaaggaggacaacaactgtccttaatngatttnaactgggtgacntnacggattgaaacgccatgctaagatatgttggtgccgtgtgtnaacnaacacatcc

SEQ ID NO: 85327 - DNA, 555 bp, Triticum aestivum
  unsure (1)..(555): unsure at all n locations
  Clone ID: PAT_TA_85327
cgcgcctccgccgcctccaggtcctgatcgaggactccggcgcgctcgccgacatcgacgcggcggagatcggggagggccagaccaacgacttcctccgcgacatccaggcgatgcgtgctaaagctgcgactgtcacgaagcccaaggcggccggcgcggaggccgagcgtggggagggcgacagcgtatcgatagatgtgccgttcgaggagctctgcgacgaggacaagatcactgcgttcttcaggagactgttggacgagtggacccaggaggtggacggtatgcctgaggcggaacggaggacggcaaaagggaaggccgcgatagccacctgcaagcagtgcacgcgatacctcgaccctctgttcaagcagtgcaagaagaagattcttacagcatcaagtaatccattttnggaatacnaccaatacngcgaaagacaacagagatatggtgtatcgtttcnaaccganggcatcatcctaaaatgcacaaacacancatcgacgatnagattacaactgtgttcaaactctcctctgangtcgn

SEQ ID NO: 85328 - DNA, 160 bp, Triticum aestivum
  unsure (1)..(160): unsure at all n locations
  Clone ID: PAT_TA_85328
cttaacatccttgttgcaagcggcgccagcttgctcgcgctctctcgcagctgctacgctaaagcaagtctagtctctagaggaggaggcggngggggaggccangnncaaggacgntgtnntctatancgntgntggtcngctgggagttcnnctctaa

SEQ ID NO: 85329 - DNA, 543 bp, Triticum aestivum
  unsure (1)..(543): unsure at all n locations
  Clone ID: PAT_TA_85329
gcattgccacctaattaatttagggggagaaatgaagtaggcttgctgaattgcaaaacaccattaggtatttacttgcatgattgcatctttaataacaacccataatctttctgttttccggtaaaaaggtagcccataatttcgacaaagtgcaaacaaagccaaaaaaaatactagtggccatgtaatagaagtcaatgttactcatcacataagggccagcagcttgtgacttcaataggaatcagcaaatcactgtattttcgtgcatcctgcagacattcatatcactaaagtatctcttcagtccatgtatattgtataccccttcagtccatataattttaatatcatagacttgtagtttagagatcagtaatctggtaagttatagaggattccctggtcctgatttataaaccctgttgaaaaattaaggtccccttcaaccgtgggactggtaacacattaangttttaagttaanacaaatgggccaagaatgtgtgccagctgatatncagtgtaccncaaccngccc

SEQ ID NO: 85330 - DNA, 165 bp, Triticum aestivum
  Clone ID: PAT_TA_85330
catttggaatataccaatggccagacatggttttccaaatacgagatcatgaagtgtaaatatcaatggagacgataccagcctaggatgtatcacggcgacttttttcttgtctttatatttatttagacctaatatatataactatataccaaaaaaaaaaaa

SEQ ID NO: 85331 - DNA, 577 bp, Triticum aestivum
  unsure (1)..(577): unsure at all n locations
  Clone ID: PAT_TA_85331
gttgacgacgcgttcactttttggtttggatcggccggtgtgccgaacagtggcagacccatttttctttgcatataaaaaccacacggcccaaatgaacatatttaaacattaaatgaccggtcaaccatcggtctcagtccacttagacaacattaaatgaccggtcaaccatcggctgcagttcacttagacattaataaaacttaaaaaactaaaaaaatgcttgtgtggtcagcgcactaccctaggcatcgtcatcgtcctcctcctccccggagccggtaagatcgatgaacgccggccagcccaagggaaantgggctcctactccgcacgcgccgcctcctccgtccgtttgcctcgtcngcggctgcactgcagctgcgcgggcgtgctcctcctcctcccactctaggggtcctcctccgcctcctgtggcaaagcgacatccaactccaccgttgctccgccatcgccgcgctcgtccggccaacgcgcangccctcaattgttggaggactggctcctgcccngtgtaacccgaacacatggcggngcgctgaccantcacgng

SEQ ID NO: 85332 - DNA, 389 bp, Triticum aestivum
  Clone ID: PAT_TA_85332
caggggcctcttccactccgacgcccagctgctcgccgacccttccacccgcgcctacgtgctccgccacgccacgggcgcccacagggacgagttcttcgccgacttcgccgcgtccatggtcaagatgggctccgtcggcgtgctcaccggcggccagggcgaggtcaggaagaagtgcaacgtcgtcaactaacttattatatggcctcctgaggagtcatgtctttctcttcttcattttttccgttcactgcattattgattgattgatttttttttgttcctctgtcgccatgtatgtaatgtaaactctgcccctcatcttcagttgtcatcaggatctcatgataatgcatgcaataaacattttttgatttaaaaaaaaa

SEQ ID NO: 85333 - DNA, 604 bp, Triticum aestivum
  unsure (1)..(604): unsure at all n locations
  Clone ID: PAT_TA_85333
cgcaggcgctcctcgacgcgctcggcaccgcgcgccgcgtgcacgtcgtcgacttggacgtcggcttcggcggccggtgggcgccgctcatgcaggagctcgcgctccagtggcgccgagcacccgtctcgccgctgccgccgccgtgcttgaaggtgacggccttggtctcgccagggtcatcagcgcaccccttggagctccacctcacgcaccagggcctgacgcgcttcgccgccgacctcggcatctcgttcgagttcaacgccgtcgcgttcgaccccttgggacccgttgccccccacggggctgtccgtcgcgcccggcgatccgtcgccgttcactctccgttcggtccgggtcccgtccgnagctatctccgcgtccttgaacaactccgccctgccgtcntggtgtgccttcnacaacggatgcaacgcgggactgccgctgtcgcacaacgcgctagcgtcntgcgtcaaacgcggctttctcnatcnctggagccggcggggccccggcggagcgtggcaagntggaggatantctgcctccaaggtggaacnctgtgcaagcacangatcctcaagggggacaagctgnc

SEQ ID NO: 85334 - DNA, 605 bp, Triticum aestivum
  unsure (1)..(605): unsure at all n locations
  Clone ID: PAT_TA_85334
tactgctggacaagagcgcttcaggacaatcactagcagctactaccgcggagctcacggaatcattattgtatatgacgtgacagaccaagaaagcttcaataatgtgaagcaatggttaaacgagattgaccgttatgcaagtgacaatgttaacaagctccttgttgggaacaagagcgatctaactgctaacaaagttgtggcaaccgagacagcaaaggcgtttgctgatgagatgggcatcccattcatggagacgagtgccaaaaacgccatcaatgtggagcaagcttcatggctatggctgcatccatcaaaggacaggatggccagccaaccagctgcggctaacgcaangccaacgaccgtgcaaattccgcgggcaacccgtcnaaccagaaactccttgctgcncaaccctaaggttgcccgattttttttnggncttgggggtaacnccaacacacactacactttggngtcnctgcatgtatttgcattatttcaaaaaacctgctatacactatcatggtcggncataaggcaactgtcnaatcaatttcaagggattcaatttcaaganaaatattttattttctaaa

SEQ ID NO: 85335 - DNA, 583 bp, Triticum aestivum
  unsure (1)..(583): unsure at all n locations
  Clone ID: PAT_TA_85335
cgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagattaaacaagcagttaatggccgcatcatcangaacggttcatgtccgcgtgggagcatgtgcaccctccccgtttcacggaggatttccgcttgangaaaccaagaatgacaactcaaaggcggagccaaaggccgcggtgagtgatnaacaacaaagaggaacctgtgggacccaaactggcttcatggttnaggggctacatccagnancatcctatccttatgagtggncaacatntcaangggggttacaaaagagattttgtactcaacaatnaaacanctggaaantacta

SEQ ID NO: 85336 - DNA, 418 bp, Triticum aestivum
  unsure (1)..(418): unsure at all n locations
  Clone ID: PAT_TA_85336
gcattgggatcccatggccaagctcgccgtcctcctcctcctcctcgccgtggccgcgtccgccacagtgccggcgcacggccgcgataccccgactgagatcaagctcatcaaaggcacggacgcctccggcgtgggcgacgacagcatggagtgcgtgtacacggtgttcatccggacggggtcgatcttgaaggccgggacggacgcgaacgtcacgctggagctggccgccgcggacggcaacgggtgggggatttcgaaacctgcccgcctgggggcnggctcatggggnaggctnnccnatttctancccaacaaccttgacaatcttaaccgggcnncggcctngaatgcgaaaaggccctttctgattccgnttgggancnaaggaacgggaaanaanggngactggaca

SEQ ID NO: 85337 - DNA, 507 bp, Triticum aestivum
  unsure (1)..(507): unsure at all n locations
  Clone ID: PAT_TA_85337
ctgttatctctgtcctctcctcgtgtttgttcttcctaccagcggagcgcgagctacgcgctgtgcctcgtgcctagacgaacggcataggcaccggacggtggcgtcatgtgcgtggaggagccgaaggacgccgaacggtttggttttggagacccaggggtcgaggagcccgctaagtttcccttggctcaagatggagagagttgtgaaaatacaacttctgctgatttcaggcagaagttaagcaatttgtcccaagtaatccgattcgggggattgggtctgatattggaggtcgccaatacatggaagacacccacgtgtgcattccagaccttgctaagaacttggnttcccatcattaagattatgaattgtttcattccaatggggcctttngatggtcaccgtgggaaaagatgctgcccattctttggtgataatttacaaggatgattgtggganatcaaattccctcctcaacttgnaaaantttgagaangc

SEQ ID NO: 85338 - DNA, 593 bp, Triticum aestivum
  unsure (1)..(593): unsure at all n locations
  Clone ID: PAT_TA_85338
atccgctcggctcccacccgtccgtcgtcgcctcgccgtcgagccaccgccctccttgtcaacctcgctgacgacgggcccgtgtgattctgctgcggtgcagtgttgctgctcgggccgggcgggaggagaaaagatgggggtgtacctcagcacgcccaagacggacaagctctcagctgatggagagaacagccgcgtccggttcggcctctcctccatgcaggggtggcggaccaccatggaggacgcgcatgctgccttgccagacttggatgaatgcacacctttttgggtgtttaatgatggcatggtggaaaagtgtttcaaaattttgtgccaagcatttgcatnaacaantgctttataaatgagcaattcanccnggngatttgcaactctctncnataantttccttaagaaggataatatnaaggaaaagggttggnaanactaacnactgggaataaggaaacaatcccaggttgattnacacataatatgccccaaggnggngatcacattngataaggaanttggatacnagganggcaaatcnaatttctgacaaatcngaacaaaantgtttgnn

SEQ ID NO: 85339 - DNA, 523 bp, Triticum aestivum
  unsure (1)..(523): unsure at all n locations
  Clone ID: PAT_TA_85339
ttgccttttctcgaactgcaagaaagaataagcccttaatcattaccgttcaggaaaatgagacggtgcttgatgacacccctgataaattcagtatagatgcgctcaatgtccagaactactgggaagctattggagttattgctgctcacaaggcaggcatcaatccaaatgctctaagaagacaaggagttgatcatcttaagagccatcaacgattgtattctgcccgatcttctggtcgccggccatatgcctcttctccaatgcaagataaagtatatgtacaccagttagtttgacaatttaagtacaggagagatcagttttaacaaataagagcgtgcaaattttgaancccaaggtacatattccacaacaatccgtagcatacatatattaaattatctccgtcacacccgtngacatacacgcacacacacgcaatggatgcaagtgtacccnaaccatttcaagaacaaatatttttcatttccaaaaaaaaggggggcccggtaccaat

SEQ ID NO: 85340 - DNA, 460 bp, Triticum aestivum
  unsure (1)..(460): unsure at all n locations
  Clone ID: PAT_TA_85340
ctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggnttgcttgctcgctcctccccatgctcctgcccatggtgtccttgtgtgtaagttgtgtgttcaagtttccctgtaatgcttcaanctaccccaactatggatggagttgatgataattttagattgaaagatttacctaattaacttaanaaaaaaaaaaaa

SEQ ID NO: 85341 - DNA, 407 bp, Triticum aestivum
  unsure (1)..(407): unsure at all n locations
  Clone ID: PAT_TA_85341
gagccacagaggcagggganangaggancancgtggctacgcccatntccancgacctgatcgangcccctcgcccctactcgctgaatcccaatccgancccgccaattgggcgcccccccccgcccacgcaaagatcaatcgggctctaatggcgtatgtgcantagattactgatganggatnctactgaaattgatgaacttgttacgggcgttctggcgaccgtcatctaaccngcattcccnaacangctcatatnttaccggtacgcaggntggacttctatggtacaangacgccnggcaacatntcantggggacgttctccntggctgttgttnacncaaattcttactgatgaccantgtcacatcnantcgggcccactgagttttcaanattct

SEQ ID NO: 85342 - DNA, 499 bp, Triticum aestivum
  unsure (1)..(499): unsure at all n locations
  Clone ID: PAT_TA_85342
tataacttaatagtatggccaattgttgacataagcaagtgccatgtcatctatagccaacatgtataacaatcgattaaacctgggcaaacgtcgggccgggccgggtttcgggtcgggcttgtaaaagcccgaccttcatttcttaagcccgagcccagcccgaagcccgaaatactccatattttcaagcccgagcccggcccgaaatcaagcccgaagcccgaaagcccggcccgaatgctattttttaagtacgcgcacgtgaaaacccggcccgaaatacgaaaaaattgaagcctgagcctggcccgaactatctttcgggctgcaaaacaaagccgagcccggccagtttttcgggccgggttcgaaccggtcttcnggcnggctgcccatgccaaggtttacaatcgatactccgaaaacnattctaaagatatttcttggtnaagcacaataanctaattctcacaantttggatcangtggacatttt

SEQ ID NO: 85343 - DNA, 564 bp, Triticum aestivum
  unsure (1)..(564): unsure at all n locations
  Clone ID: PAT_TA_85343
ttttttttttttttttttttttttagagtaccacaatgtgcaaaactctttcaaatttataagtcagttggaacataatccatatgataggaaaaaaaactacaagaaaacagcacaatataacagctaatcctttttctcttctaagcacaagaggtaggcaacaatgccaacaactgggataaaccttgctacattcacaaactctctagcttttggtttcacgttctgaagattgtctccaatcaaccatggctggaatatcgagtatagcaatatgtcccacagaaatgcataagcaagccgctcggtcaagacataatcctgcgcatattgccaccggtccaagacgcctccaaaatcagcatctgcacggccgaagaaagccaaacaatgggataaaatgcaagaccaggcaccagttatgcctacacctgatgcactctcaccatggagtgaactcagttttgatgtccngcggtgggaggnggttcttgtcgacatcgtttaacccggatgccatgttaggaacaagaaanatttgtgaggaaatctgacagcccn

SEQ ID NO: 85344 - DNA, 588 bp, Triticum aestivum
  unsure (1)..(588): unsure at all n locations
  Clone ID: PAT_TA_85344
gttccctaacaatttgtttgcggaacaaatgatcatcaatatattaccaaacaaactgcagatcaggtgatgcgagattaaccacaggtccacagccagtgacagcataattcttcctacagagggttcacaaaacactacttcattcccttgcccttccttttaccctttgcagcaccccgcttcttgtcaccccttttcgctctagccttgctcttgaacgttctcttcggtggcttcctcttcacacctaaactgctgttcttcttgggcaaaagagctaggattcttgctgggtgaggctccgtcgccacggggccgacagtttccgggacaatgtcatcttcttcaggagtaattcactgggtggtgactacantctgggcccatcatcttccgtagttttggattcagacaaaggttggcatttccatatcctcaacatcatcgcccgattcttccgtttctaaccaanacatcattttaacccgattcantatccaacatacagacaactccttctctcttcctcctctgcggctggattctctccctctccctgnaaactcnggcctccttctctctttc

SEQ ID NO: 85345 - DNA, 360 bp, Triticum aestivum
  Clone ID: PAT_TA_85345
gatcagtccatgtacaaggagctcaagcgcatcattcctactgccgccgcctttggcggtgcctgcattggtgcgctctccgtcaccagtgaccttttgggcgctcttggttccggtaccggtactctccttgctgtcactatcatctacggttacttcgaaatcgccgccaaggagggtgacatggccggtatgaagggcatgattatgggctaaacagccatctccgaacacaaggcacgattgatcagccttccgttgtgggccgctaagacgggcgtttgtgtatcaacagtaaagaggaagaaaagatgaaatatcaacatgtttttgtttcctttttggctcaaaaaaaaaaaa

SEQ ID NO: 85346 - DNA, 586 bp, Triticum aestivum
  unsure (1)..(586): unsure at all n locations
  Clone ID: PAT_TA_85346
cgcgcacccgcgcggggtgcggatgaaggatccgcctggggcaccagggacacctgcggggcttggtctacgccttgcgcaggccttcttcgcagccgctgcgctcgccgtcatggcgtccaccaacgacttcccgtccgtctctgccttcagctaccttgtcgcagcagccattttgcagtgcttgtggagccttttgctagcctttgtcgacatttatgcacttcttgtcaagcgatcgttgagaaatgcccgagctgtatgtatatttactatcggagatggggtacaataaccttggggcgcggcatgtgcttcaagcaaggaacactgttctcatccggtaatgatctccaacataagtgcaagagaacactggtgcaanttccgagaccgccacacattggcttttaataactggnttgccnctgggccatcctgtacctggatttccgggccnatggctccaagatataaatataggagttttaaaacatatattttgaatggttccggacaggccctgcttagggnacaacaaacaccggtgccttaaactaatgtaaaccanaattgttgaatggtg

SEQ ID NO: 85347 - DNA, 505 bp, Triticum aestivum
  unsure (1)..(505): unsure at all n locations
  Clone ID: PAT_TA_85347
accgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggcctacctcgtggggctctttgaggacactaacctgtgcgccatccacgccaagcgcgtcaccatcatgcccaaggacatccaagctcgccccatcaggggggaaagaagaaggggcctgagcgaggcgagctcctctcaccgcaagcggcgtcgttgttgcttcgggcctgcttgtaggacttgtgcttctcttggtttcctttctggtggcaatggatcttcgtaccattgtgcttttcttaaaaccttaaggatagagagtgttcaattnctgggtaacctgattgtttatctgcattcctgcctccgtnatgggtgtcggcgtctaaaggaaatatattctt

SEQ ID NO: 85348 - DNA, 518 bp, Triticum aestivum
  Clone ID: PAT_TA_85348
cagctctatcagtcagaagcgcatctaagccattttatgatgcagcaagttccgaacagcatgcccatgcctgaacaacaacctaatagcatgcttgcaacgcaacaaggtttgggttccttcaacatgggttttgatcaggaagctcctctcggatacccccaggcaaacacctcaccttcctacggctccgttggtggtggtagtaatccatttggctgaaagaagtgtggaaatacctgatcgttcatcactagacgaagggtctgcagcactcagggggacagacatgcatccgaagccctggagagattgtgtttcatacaacaaggtgggtgtatcttgtcggccgtaatcctgttgtacaactgtttccaaaggcttaatgatcgaatataacccgttttgggagggcctaactgattcaacctcatccaagtacattgtgtccggcgttctgctgggattgcacataagtaatgtgttcctcctgttgtcaaggacatgtcaccccgttt

SEQ ID NO: 85349 - DNA, 493 bp, Triticum aestivum
  unsure (1)..(493): unsure at all n locations
  Clone ID: PAT_TA_85349
caacctcactcgctacaaacaagaaacaacaagcgaaagttttctctcgagagaggaggagaagaccaacaccgggaggagatggcagcagcagcagcgacgaaggcgtcgtcgtggatggtggccatgagcgtgggcgccgtggaagcgctcaaggaccagggaggcctctgccgctggaactacgcgctgcggtccgtctaccggaccgccaaggccaacgtgcgcagcggcagcagaagcttcgccgcgcagcgggacaaggacctgggccccggcggcggagaaggggccggcaggacaaggccgcgcggaggagggtttaggaccgtcatgttcctcagctgctggggaccaattaactacctttcgtatcctaactggccttggcttcctcagcgaccgcgaactcgccagctgattattgtnaatatacgacgatgatcggagatgatgatgatgaaaattctccacttccgttaaaaaaaaaaaa

SEQ ID NO: 85350 - DNA, 490 bp, Triticum aestivum
  unsure (1)..(490): unsure at all n locations
  Clone ID: PAT_TA_85350
ccgggccacgcgcacaccacgaggtcgccgatcacctcggccgtcgaagagaagaggcagcagcctcctgccatagaggagaagccacccaagccagaggttgcaccggaggagaagcctccgaaggaagagaagccgccacgcgttgatgttgaagggccccatgctgaaacagatgaggaccagaagaagcctgtccctgacgatgatggtaggagcagtggtatcaagcggcggcgaatggcgtcgccacggagagtgctccggccaagaagccggcgtgcgacatccaaggcccgtntggcgtccgacgtgtgcgacatcgacggcaacgtgcggttcacgggtcccgcgggaccgtgctgatngcccccttccatcgaaagcggcggcaacccgaaccgcangagtggngcgtccgccctatcccgggaacacaaggcggttnaaggagttacgtggccagctggctcaacgcnnaccccccgct

SEQ ID NO: 85351 - DNA, 375 bp, Triticum aestivum
  unsure (1)..(375): unsure at all n locations
  Clone ID: PAT_TA_85351
gcagtactacagctatgtgctggagaccccactggcactgacgggctctcacaatctggccaaggccacggccaaggggagcacggtggtgctcttcgtcgcgagcgccagcgacaagcagtggcagtcgtcggaaaagattctgaaggctatggtagattcattccaaatatgattgcagcaagtgcaggcttggcctccaaacctggacgcgcgggtttgcttgcttactgcttccacgaaagaaaatggtacctgtttttgangcttggaacanttgttatgagtacttnatcgactaangtgactattacttgtacactactttttatanaaggtattccaatgtncacactgataaaaaagggggggggg

SEQ ID NO: 85352 - DNA, 362 bp, Triticum aestivum
  unsure (1)..(362): unsure at all n locations
  Clone ID: PAT_TA_85352
ccagggaggagcccgccgaggcctctgtctacgctatccaggccgccagtgggagcaatggctccaaggcaagggtcaggccagcgggcgcggcgccggtggtggggtggccgccggtgcggtcgttccggaggaacctggccgcctcctcctccaggccgtcgtcggggaaacacacccgccaggagggcagcgccaaggacggcctgttcgtgaagatcaacatggacggcgtgccgatcgggcgcaaggtggacctcacggcgtacggcggctacgccgacctctccgccgccgtcggcaagctcttccgcggcctgcttgccgctcagagggaccgagcggccacggcgtggnnaagg

SEQ ID NO: 85353 - DNA, 485 bp, Triticum aestivum
  unsure (1)..(485): unsure at all n locations
  Clone ID: PAT_TA_85353
cgccgatccgatgattcatgataacttgacggatcgcacggccttcgtgccggcgacgcatcattcaaatttctgccctatcaactttcgatggtaggataggggcctaccatggtggtgacgggtgacggagaattagggttcgattccggagagggagcctgagaaacggctaccacatccaaggaaggcagcaggcgcgcaaattacccaatcctgacacggggaggtagtgacaataaataacaataccgggcgcgttagtgtctggtaattggaatgagtacaatctaaatcccttaacgaggatccattggagggcaagtctggtgccaagcagccgcggtaattccagctccaaggccnccgcccccgcgcccgaggnccntgcccccgngcccaangccnangccccgacccccnagatanctcccnccnanccacgganggccncgcccnacnccctcgncgagggtgntcctgnn

SEQ ID NO: 85354 - DNA, 490 bp, Triticum aestivum
  unsure (1)..(490): unsure at all n locations
  Clone ID: PAT_TA_85354
gccacatctattacataccaccatagtagacgaccaaatccatttatagagtatgaacgcaacatcacttccaacacaaacatgcaggaatcaacaaaccaagtagctaaaaccagacaaagggaagtacatgttgtttatttggcggcaagtgtaactgtttcgactccatctcctttagtagagcgcccaactgacagttggcaaacaaatcagaaacatagcagcaatcttgagggctaatagttgcagttgcatccaaatggaaaaccttttatttagaatgtgctcaatcttttgccaattcggatcatcaattgttaaacaatagcacatgaggaatgtgcatatctgaaggaaaatattaacaaatatatcaaagataaaattgccattcagtttaaatttctactaagcagaagtaagatgaaaatgaattgacatgcatgagagagcaaagtcacaatactaataccaccntgtcaacagt

SEQ ID NO: 85355 - DNA, 485 bp, Triticum aestivum
  unsure (1)..(485): unsure at all n locations
  Clone ID: PAT_TA_85355
gccgagaacaaggtgctagatccgaagaaggcgcagaacattgccatcttgctgcgcgcgctgaatgttaccaaggaagaggtcagcgacgcgctctgtgaaggtaacacggagaactttggagcggatttactggagaccttgctgaagatggctcccaccaaggaagaggagattaaactgagagaattcaaagaggagtcttctccagttaagcttaacccagctgagaagttcctcaaggcagtgctcgatgtgccttttgccttcaagagagtggatgcgatgctttacatagcgaacttcgatgcagaggtcaattacctcaagaagtcgttcgagaccttgaggctgcttgtgatgagctgagaagcagcangctatttcttaagctactgggaagcggttctgaagaccggcaacangatgaatgttggcacaaaccgtggggaccacaccgttcaagctcgacactctgctcaaac

SEQ ID NO: 85356 - DNA, 478 bp, Triticum aestivum
  unsure (1)..(478): unsure at all n locations
  Clone ID: PAT_TA_85356
ccccaagaagggctcgctcggcaccatcgcgcccatcgccatcggcttcatcgtcggcgccaacatcctcgccgcggggcccttcagcggcggctccatgaaccccgcccgctccttcggccccgccgtcgccgcgggcgacttcgccggaaactgggtctactgggtcggcccgctcgtcggcggcggcctcgctggcctcgtctacggcgacgtcttcattggcggctcctaccaagcaggtcgcggaccaggactacgcctaatttattcaccactccatctccgctctgggatgaatgggattcaaaaccgtcgtcgtttgcttttgctcctcgccacgttcaattaatggttgtgtatgcatgtatgtgccaatatgattgccttgccctggtcaatcattcccttcctttttcggggtgaaatanatgtaaagattcctctgcctgccgtatcncgccgtgttgggaaaaat

SEQ ID NO: 85357 - DNA, 485 bp, Triticum aestivum
  unsure (1)..(485): unsure at all n locations
  Clone ID: PAT_TA_85357
cagtgtcccagctcagcttagcaatccgtctctctatctacaggcgggggaattaatagatggagggcaaggaggaggacgttcgcctgggcgccaaccgctactcggagcgccagccaatcggcacggcggcgcagggcacggaggagaaggactacaaggagcctccgccggcgccgctgttcgaggcggaggagctgacgtcgtggtccttctaccgggccgggatcgccgagttcgtggccaccttcctgttcctgtacatcagcatcctgactgtgatgggcgtgagcaagtcgtccaacaagtgcgccaccgttggcatccaaggcatccgtggtcccttcggcggcaatattctcnccctgggttactgcacggcgggcatctccggcgggcacatcaacccggcgttaacntncggctcttcttgcgccggaactttctcaacccgcgctccttcaaaangccatnattgccgggnn

SEQ ID NO: 85358 - DNA, 326 bp, Triticum aestivum
  unsure (1)..(326): unsure at all n locations
  Clone ID: PAT_TA_85358
cgaggcccagtcccgcggcggccgtggaggcggcggtggcggatacggtggcgggcgccgtgatggaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctaganggggtttatcttcgtctgtggtcgtctcgtgtccgtatgtttcgtttcgtgttcaaaaaaaaaaaa

SEQ ID NO: 85359 - DNA, 612 bp, Triticum aestivum
  unsure (1)..(612): unsure at all n locations
  Clone ID: PAT_TA_85359
ccctggccgccactttcttctctccctgtcttcttctccatcgcgcagcaggcatcccacggcagcagcagcagggagccgtgctcctctccatggcgccctcctccccttcttcttcctcaagccagcaggcacctccctctactccctgcgcgcagcagcagccatggcgctgcctctcttctccatggcgagcagcagctcatccacctctctctcccatggcgtgctgctccagtcggtctccttcctccctctgtcccttgccgcaggagcaagcagctcctcctcccatggtcggcctcccttctccccctcggctccttcctccaggccgagctcctatgccaggaacggctgctccacttgaccgctgctccatttttttccctcgctctgctctctcggctgctggcagcaanggcgcgacgcctctgctccttctctctacccacaaaacagcaacgcgcaagagcttctctcaatggagccaagaattcaagnaggagccccttctcgctgttctctggtgccgccgctgttcggaaaatgcgcacaagcangcacncanaactcntcctncctgcntgttcacttgcannnaattcaaaa

SEQ ID NO: 85360 - DNA, 619 bp, Triticum aestivum
  unsure (1)..(619): unsure at all n locations
  Clone ID: PAT_TA_85360
attttgttattacaaaatctttgcgcacaatgcttagatccacattatcactttatatatgtcaaaagcacttgttctgtacttctgttaagattgttggttcgacaacctaagtggtaatttccatgtgggttttctctttctgcaactttactgggcctgtctctgaaaaattatccttgcctcttaactgtgtaatgcttcttgtgctaacatctaaatctctgctgtttcatgttattttagtcgatactcagtagtctaaagagttactgaaatcacatggtaccttctctgtttgaaaaatctagacaacataactactatttttggttatattattccaaactgtctggtggttttgttcataccagcgttcttcangtttttaagggaaaatcttcccccataattactttacttcanaaagggtaactaatgggtcaattttgagcangggaagaanttagcaaccatagggaaacactngagggttcnatcctgaaaatatctaactgatgacatgagttggcaacctggaagacatgntaataacagctcatggttaanangcaaccaaggtcagggatggattgcacncaataggggnttcaaanna

SEQ ID NO: 85361 - DNA, 319 bp, Triticum aestivum
  Clone ID: PAT_TA_85361
cagcgaaacagcaatggatgatcccaccccctcccccccctagattttactggcggctgcagcgagtcgaggcattcgagagcgatatgtttgtttcatttccctccttcccgccttgtgattatctggtgtgtgtgactgacgaggtcgtggcaatttaggtaactcgcttagaaggtatttcccccgtgtttgagcccccacccccaccaaaaaaaagaaggtatcatgctatctctgttccataagtagacatgatgtaatcgtactaagtgtttatttttattttttttacttatttcacttcaaaaaaaaaaaa

SEQ ID NO: 85362 - DNA, 463 bp, Triticum aestivum
  Clone ID: PAT_TA_85362
gccacaccccgccgaaccctgaacctgaagcaccatccatttcgttcttgcgagaacgaatcaaaaatgttattcgctcatgccagcgtatacgaaaataaaaaatcctaaaaaggattaacgaagatcttcaccttgaaacggcgagcgccgagaagcgggtaaaaatcgcccaggtcctcgataacatgaactggaaaagggttttcttttatacctatacgggggaacctaagataaagcccatatcgacttaacggtccacgattgggatcgcgcacgaaaaggctaaacacagcctttttcttgtcctcgggacagcgggctagtcccgtgcctgtttttttgagttggggtacacaatcttccttgtgactgccaaaccagatttccgtttttaagggagaaggtgtatccttttgaacggtggtatcgtcaagaagaacgaggcccgcccattggg

SEQ ID NO: 85363 - DNA, 366 bp, Triticum aestivum
  unsure (1)..(366): unsure at all n locations
  Clone ID: PAT_TA_85363
atcgaacgtaactaccgtcctctgtctcggcgtcggcgagcaacagaacagacagaggaggggaggcgaggcgaggcggaaatggggctccgcgtccgcgcttcctcgcttctgctatccctcgccatcgagctcgcggccgtgctcgtctcagtgtcggcgcagcanaagttcgggatcaactacgggcagatcgcgaacaatctcccggacccgacgcangtggcgaccctcctccgatcgatgaacgtgaacaangtgaagctctangacncggacccccgggtgctgacggcgttcgcgaacacnggcgtggagttcatcatcgcctgggcaacgagaactgcanaccatggcggcancccc

SEQ ID NO: 85364 - DNA, 420 bp, Triticum aestivum
  unsure (1)..(420): unsure at all n locations
  Clone ID: PAT_TA_85364
gccgtctcgtcgccatgggtctgcaggaggagttcgaggagcacgccgagaaggccaagaccctgcctgccaccacgacgaacgagagcaagctcgtcctctacggcctctacaagcaggccaccgtcggcgacgtcagcaccggtcgtcctggcatcttcagcctgaaagagagagccaaatgggatgcttggaaggctgttgaagggaaatccaaggacgaagcaatggccgactacatcaccaaggtgaagcagctgctggaggccgccgccgcatccaacctctaaggtactcaagggaaaacaanaaccaatgattcggaagtcgaatatacgtatacaatgntggtcaatgtattacggtcgncaattaaatcctaannattggtggaacngcttggaanggcttccggagcca

SEQ ID NO: 85365 - DNA, 352 bp, Triticum aestivum
  unsure (1)..(352): unsure at all n locations
  Clone ID: PAT_TA_85365
cacggcgcgctctgccccgtcgccgagttcccggccatcaaggccgtcgggctcaacaaccactgggtcgacgcctgcgtcatggcgctcatgctcgtcggctaccgcgtcgtcgcgtacattgcgcttgaccgcctcaagcccaggtgaaacaagataagagaagagaagagaagggatcaattagtttagtgctctatgcataatacaaccagangggatgaaatgaatacgatacanacctgcagcagcttgagctctctgttttactccattcacaaagggtttcaagaactccgtaaggctttccttcggctccaannaanaaagaanaaaaacccgaggggggggn

SEQ ID NO: 85366 - DNA, 602 bp, Triticum aestivum
  unsure (1)..(602): unsure at all n locations
  Clone ID: PAT_TA_85366
gcgatgcgctcgagaagcccttcgacgaggctgttacatcacaaagccaggagtctgtggattgcatgcagcccatgggttggaccagcgagaatgtcagcaaggactttggcgtcactcgcgatgtcatggacaagtatgcggctgagagtttccaaaaggctgaggcggcgcaaaaggctggtttgttcgccgatgagatcgtccccatcaccaccaaggtcaagggccccgatggtcaggagaaggaggttactcttacccaggatgagggtatccgaccaggcactaccgctgagagcctcggcaagattcgatctgctttccctcaatggggtgggagctacaactggaggcaatgccagccagctcactgacggagctgccgctgtgttgctgatgaagcgatctacagctatcaagctgggcaagcctatcatgggcaagtacgtcggttctactgtggctggcctcgcgcctcgcatcatgggcattggnccaacattgcatccccaacttcttgccaaganaaatcncctcgatgatattgcatgtngaattaacangctttctccatggccnttatgcaancaaactggttg

SEQ ID NO: 85367 - DNA, 386 bp, Triticum aestivum
  unsure (1)..(386): unsure at all n locations
  Clone ID: PAT_TA_85367
gttgattatgatcaacggcctgatatctttaggggaacaattagatatgcgagtgtccatgctcatttggggcgcactggtagtaggagggatgatttagagtcactggcatacacccttattttcctgattagaggaagattgccttggcaaggctaccanggagataccaagagtttccttgtttgcaagaaganaatggctacntctccagagatgcnttgttgtttctgtccagctccattcanacaggtttcttgagantgtcacacntatganatttgatgaaggagcancattatgcaagcttatctcaatttttgatggtttgantgaacaacctgcgtcnaagacnatccagcattgatgggggcccnaaaggttgg

SEQ ID NO: 85368 - DNA, 320 bp, Triticum aestivum
  unsure (1)..(320): unsure at all n locations
  Clone ID: PAT_TA_85368
ctcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggntgcagttccccgtcggncggatcgggcgctacctcaagaanggccggtacgcgcaagcgcgtgggcactggcgccccgtctacctcgccgccgtcctgnaatactcgccggccgagggttctggagtnggaagggaancgcggcgaa

SEQ ID NO: 85369 - DNA, 208 bp, Triticum aestivum
  unsure (1)..(208): unsure at all n locations
  Clone ID: PAT_TA_85369
acaaaacgaacagggcttaagggagagcacttgtacattattatcaatattcacttagggttcttgataaaaccgagtcgctgttcatatggagttgtcacacccgaagataagaagattgtaatctagcatgacctcagatttaaatctgtgtagtggagcattttatatcaattaattgttgtatatcaaaaaaacnnaaaaaaaa

SEQ ID NO: 85370 - DNA, 499 bp, Triticum aestivum
  unsure (1)..(499): unsure at all n locations
  Clone ID: PAT_TA_85370
agtgcatctacgtcgagcccgaggaccgcaagggcgtcttctggtacaacaagaagttctagccgccgccgctcgcagagctgagaggacgctaccataggaatgggagcaggaaccaggaggaggagacggtactcgccccaaagtctccgtcaacctatctaatcgttagtcgtcagtcttttagacgggaagagagatcatttgggcacagagacgaaggcttactgcagtgccatcgctagagctgccatcaagtacaagtaggcaaattcgtcaacttagtgtgtcccatgttgtttttcttagtccgtccgctgctgtaggctttccggcggcggtcgtttgtgtggttggatccgtggcatgcctgtgcgtgcgtggccgcgcttgtcgtgtgctctgtctcncgttggngtcngctcttcgngtccccgtgtgttgttgtaaacaagaagatgntttctggggnctttggcggaatananntctccgancg

SEQ ID NO: 85371 - DNA, 293 bp, Triticum aestivum
  unsure (1)..(293): unsure at all n locations
  Clone ID: PAT_TA_85371
cggggttcggnttcgtgggtgcagcggtctcgagatggcggcgtcggatgttgagtaccgctgcttcctcggnggcctcgcctggnncacggacgaccactccctccanancgacttcagcanctacggcgnggtcctcgagtcnangatcatcctcgatcntggngacgcatnngtcccgcngcttcggnttcgncaccttctccactcngcgacgcgangnnaaacggcnatcgaggggcntgancngccanggacctggacggtcgnacnatcaccgttatcgngggtca

SEQ ID NO: 85372 - DNA, 590 bp, Triticum aestivum
  unsure (1)..(590): unsure at all n locations
  Clone ID: PAT_TA_85372
tgacaacccacgccacgacgacacaacaaagcacaagcaccgcagctaaacccatggccggggtcgttgtggtgttcgacttcgacaagacgatcatcgacgtcgacagcgacaactgggtcgtggacagcctcggcttcaccgagccgttcgagcgcctcctgcccaccatgccctggaacacgctcatggacaccatgatgggggagctgcacgcgcacggcaggaccctggacgacgtcgccgaggcgctccgtgcggcgcccgtcgtcgcgggcgtcccgccgccatcaaggccgcctacgcgctcggctgcgacctgcgcgtcctcagcgacgccaacgccttcttcatcgacaccgtcctggcgcacaacggcctgctgggctgctttccaagattaacacaaaccccagcaccccgganncgaacgcngacggccgctcgcatcgggcctacacgactgcaaggtgcggcgtcggaactggccgccaanattncaagggcaagtgntggncgatctccnnagggtcntcntngccgccgnaagaacctnctgtacctggnnacgccgnggnatatngccgggg

SEQ ID NO: 85373 - DNA, 546 bp, Triticum aestivum
  unsure (1)..(546): unsure at all n locations
  Clone ID: PAT_TA_85373
ccacccactccagaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgctggtacaaacttatatgaattgaaactagatctgaatgacaaagtaaacgttgaggctagcaaaataagtgtgggtgtcaggtccatattctgtattgtagaaaaagctgaggccaaaatggtgggaagaaacttgttcgagatgatcaaagggcacctcactttgtgaaagttgattgggacaaatgggttgacgaagatgatgatgggctgatgtcaacttggntgggatgggcttctcnaattttgggggnaggtggnatggtggatgggtganatggtgnntgggtggccttggnggaatggtggatggaatgntttttgaggtg

SEQ ID NO: 85374 - DNA, 574 bp, Triticum aestivum
  unsure (1)..(574): unsure at all n locations
  Clone ID: PAT_TA_85374
cgccgcccttccttctcaacgagagcagcgaggagggtcggtgcagctgggcggcgttcggcggcgggtcgccgccggcgcgcgcgggcaacccgctggtgcacgaccccagcttcctgctgagccagcgccaccccgcggcggacccgccgctggagctcggcttcttcgaccacctgatccgcaccagcagctacgttcaccggccgacgccgacgacgtcgtataccagcaccagcagcagcggcagtagcagcaagagtagttttggcccgtcgtcgttcgcgcccgccgtgaggatccaggggttcgacgtcnccgcgtgccggagctcccacagcggcggcgngctccgggcngccgcgttctgtccgccgcccngcgcgtnagctancggtccagctccatgtgtngacgggcanggaatcaaagaggaggangangaacttgtgtaagattatctgtctatagnntttcgtgtcccttacaaatgtaacacacangttcanacatacattaganncatataaagaaactnggtcggtcngacgnnacctcggtctgtacatcagct

SEQ ID NO: 85375 - DNA, 572 bp, Triticum aestivum
  unsure (1)..(572): unsure at all n locations
  Clone ID: PAT_TA_85375
atttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactccgtgtacgacgtcatccgttgancccctgggcatcggnaancgcccaagacccggcactgggccgtccgcccgtcgtctccttccaangcgcgtcaacgncattcatcatcgaagatctcctccgggtcagttcctcccttggcggnattgnatatcctcctcaactcgccgttgaccgcacaagcccnganctcgctctctttggaacnccggcatcgcgtttnacgcctagcaaggcagtctctcgcanaantccggtactcngnangtgaaaactccgtaacaacaatcgtncaaatcgcgcanaaaactggtn

SEQ ID NO: 85376 - DNA, 595 bp, Triticum aestivum
  unsure (1)..(595): unsure at all n locations
  Clone ID: PAT_TA_85376
ccgacgtgctcaccgacgacgtcgcggaccttgccgtgggactcgccatcgccgctctccgcaggatcccgcacgccgacagctacgtccgcgccgggctgtggaaggccaatgatggccactacggtctcaccactcggttcagtggcaaaagggtcggcatcattgggctgggcaggatagggtttccattgccaagcgagtggaaggttcggttgcccggtctgctactaccaagagaacaagcangatgcgtaccccaatacatctactccccgacggtgctccagctcgcaacaaacacgatttcctcgttgtggcctgctccgctggaacgagcagacccgcngatcctgaccgcnaagtgatnnaaggctccgcccaacggcgtgctcctcaacgtttggcgccgcgcgcactnnaacaaccccactctcnccggctcgccgatgccgcctccggcgnnccgggctgacttttccaaagccnaccngattcncaagcctaatgggctcnaaactntctggcacgcacatggcaacnggaccatanacncaagcatgcgactgtgccncatctgagncncccctanatc

SEQ ID NO: 85377 - DNA, 538 bp, Triticum aestivum
  unsure (1)..(538): unsure at all n locations
  Clone ID: PAT_TA_85377
gtgcccaaggggctgccaggctgggacgatgccgagaaggagcacttgggcgaggagctcgccgacgtgctcctctatctggtgcgcctgtcggacatgtgcggcgtcgacctcggcaaggctgccctgcgcaagatggagatcaacgcccgcaaatacccagttggacagtgcaagggttcatccaagaagcacactccactacggctccactaacaatgtttggcgacagcgacaaagctaatgcccgccgaacaaggagcagcatactgtggtgtcctaaaatgacccggactccccttgaatggnaattttggatggtccngcatgattctagttacgtntngctgatgaaacaggatctcctatttttggtgggaaaggacaattnccttgntcaattccccctatatattaaatggtnatgaccagtgttnaccacaacttcctagcttactcccctaantcnaagtgtacnggggattccgatcctcnggtcattatcaactcatatgatcnaaancanaaaaaaaaaaaa

SEQ ID NO: 85378 - DNA, 599 bp, Triticum aestivum
  unsure (1)..(599): unsure at all n locations
  Clone ID: PAT_TA_85378
gaagttcatgattttgcaagcctgcgacatgcagttcttgaacaggtagataaaccactgcaagatgctgaagtgaattattcaaacatttcaaaaaaatattgtatgtgctgttttgagtatcattgctctgtaacttgagtgcaatcatcttatgtcaatagggggcagacattttacattttgcagataattgaagctgatagtccgacacacattctgtttaacattgacttttaattgctttgggtancacaaatctcactctcagttcaataatgttcaccccttttccgttataaaaaatggttctacttcctgaaaacagtgatattccgttgcgacatagtaacattatgaattacaggaaaactagagttgactaatgtttcctgggtaaatagaacagttaacgtgttgctcacttttttttcattacgattatgatcaccttcaatgtatataanattagacaatataaatactgcatggtgatntgtaacgcaattttggctgatttggangtcacatggnactgatttataanaaccttacttcatggaanagtgtcctaatgnncaaanttttggtcctacgcn

SEQ ID NO: 85379 - DNA, 332 bp, Triticum aestivum
  unsure (1)..(332): unsure at all n locations
  Clone ID: PAT_TA_85379
gtcgcttcctccgtctctcggcgtcgaatctcctccaaccaccgcgcacactctactcgacgcccggtggaaggagttctccgggatttgagctgtttctgccctcacctccgctaggccggcgtcaantgganatccaatcggaaatcnaactgacttcatcttcngttgcatccccntcaggataacccatgccaggagtgttcacaaattcgcggttanatccangggtnatttggatggcccggtttcaatcgtttaaggttcaaactacnanggtttcaaggttaaatccggtttnnccctcggggaaaaaactccccaagggttcc

SEQ ID NO: 85380 - DNA, 356 bp, Triticum aestivum
  unsure (1)..(356): unsure at all n locations
  Clone ID: PAT_TA_85380
ccaccacccgcctcctctcgagttcgatctgtttgctcccccagacatgtcgggccgcggcaagggaggcaagggcctgggtaagggcggcgcgaaacgccaccgcaaggtgctccgcgacaacatccagggcatcacgaagccggccatccggaggctggctcgcaagggcggcgtgaagcgcatctccgggctcatctacaaggagacccgcnggcgtgctcaaatctttctcnaaaacntcatccgcaanccntaactaaaacnggacaancccggngcaaaaacntnaaaacaatggnntcttcaaancccctaaagnccaanggcnaaccctttaagggttcngggggtna

SEQ ID NO: 85381 - DNA, 216 bp, Triticum aestivum
  Clone ID: PAT_TA_85381
ccagtttagggggtgtttggagcaaagtatttttagagttttgaggtaaaaccatgatattgaagaatactatagtatttctcattgttttgctaagaggtgtttggttacattgtaaaaaactctgttttgaataccatggttttgcagataccatggtatttttgaacatttgaaactctactccaacctaaatttttatctaaaaaaaaaaaa

SEQ ID NO: 85382 - DNA, 570 bp, Triticum aestivum
  unsure (1)..(570): unsure at all n locations
  Clone ID: PAT_TA_85382
ggagcattggatggaggcctggatattcctcacagcgagaagaggtttgctggattcaagaaggacgacaagcagttggatgctgatacccaccgcaggtacatctatggtggccatgttgctgactacatgaagaaccttgctgaagaggagccagaaaagtaccagaccacttcagtgcgtacattangaagganttnaaggctgatgaataaaaccnctgtacaagaaggccatgctgcaaccgtgccnttcttccattgttaattcaaccaaccaaccaccaaagggaccataagaggtaaaccccaaaaaactgacatntngcccaaaggaaggcaaccccatntaaagntcaacaaactaaancccccgggggggcctnattaccacnattnggccaccnttaanttaattcccacccaattatgcttccaaaccaaggattacaattgttactgtcctaatcngggactttntacgccaaaaggattttnttaaattttccangggnaaaaangnttcgttantncacttngcccaagttancctaaannaaaccncccttgg

SEQ ID NO: 85383 - DNA, 595 bp, Triticum aestivum
  unsure (1)..(595): unsure at all n locations
  Clone ID: PAT_TA_85383
caacgtcgtcgttcaagccagcggtagtagagactacgaccgaggctagctaagctaagagatggcggatcaccagtactcggcgtggacgacttccgctgctcgtcatcgggtcttctcctgtgcgctcatggctcttgttagttttgtggctgcaggacgacccatggtgctcgccgacgccatcgtctttcacgtnggcgaacaggtgcccgttcccggtgttggccggcgtccgccctaacaccggcacccatnctcccccggcggcggtttctactcccgcaaggcaattcgagcgcgtcntcgcgcccggcaaactggacgggcgctttctgggccgcaccggtttcaactttaaccgcgaacgcatgggccttaccggctnctcaacggcgactgccaaggccgtcccctgtacggtccgtttgcgcccgcccgcaagctatccaggttacctgcacaagncccccnaaangacccctacannttacctggtgacggtaaaccccctttcctttcngcaanccccaanggcgggcggaccaanaatncncatgcggtgccaaaantaancgnttccncgactcagtan

SEQ ID NO: 85384 - DNA, 524 bp, Triticum aestivum
  unsure (1)..(524): unsure at all n locations
  Clone ID: PAT_TA_85384
ggcacagcaaggctagcaaccccttcgttaacttgaagaaggaatacaagggcatcttctggcaggaggacatcatccccttcttccagaacgtgaccatccccaaggactgcgacaccgtccaaaagtgctacatctacctctctggacaagtgaaggagaagctgggcacgattgacccctactttgtcaagctcggtgacgccatggtcacctggatcgaggcctgggatgagctgaacccgtcgacccctgccgccgcaaatggcaaggccaagtagatgtgccatcacttcggcactggagtgaaaaagaaatatgattgggtcctgcctaagccccatagatatagctcttttttgagaaggaagagagattaattcancagcagcttttataaatccttgttgtcatgaacaagtgggtcttttgtagttnatgaaagggatttgtcntccctatcgttacataatnaagacaatanttttatatgtgtactctgaaaacaaacatgttgtgtatac

SEQ ID NO: 85385 - DNA, 280 bp, Triticum aestivum
  Clone ID: PAT_TA_85385
caacgatgtcattcagacagcaatgcaacagacattgcacccaaatgtgcgttataccgtagcattccagacattcaagtccccctatatatcgaaaccatcactctagcaaatcccacaaacagaagttaaaaggtacccagctatgcctgggtagcattttttatgttgcagcaaaaaaggatacattccccgcttgcgaggtcgattcagcttcctatttcccagctcggcgacagcaaaaccagagatcactcccatgctttaagggcaggggggg

SEQ ID NO: 85386 - DNA, 559 bp, Triticum aestivum
  unsure (1)..(559): unsure at all n locations
  Clone ID: PAT_TA_85386
ctctcttccttcaacctctcggagacaattaccctcttctccgttggtcaaactcccgctcacatttagctttaactgccgagtcacgcacgaggtctcacctcggattgcagtcatgtttgacctttttcctatgctcttatcttctgtcgcctgttatctgtttcctatctttgcatcttacaaagcgctcaagacacatgatcccacccagctgacgccatggctgatgtactgggtcgtgctcagttgctgtcttctcgctgagtcttgggtttgggtttattgtgtcatggattccgctttacggttatttccgtttactattcctcctctaccttatcctcccacagacacagggcgctcgacgcctatacgaagaatatgtccatccttatcttgaaaagaacgagaccagattgacgactcatcgcaagcgcacatgagcgcttgactgctgccggatactaactcaaagctcgctatcgaacaattnaagncaaggtcctgggcctcaacaaccgaaccgagtcgctctccgagctgcgcaaggtatana

SEQ ID NO: 85387 - DNA, 555 bp, Triticum aestivum
  unsure (1)..(555): unsure at all n locations
  Clone ID: PAT_TA_85387
gccgccgaagctggctgagggctacttcgagatcgaggccatccgccgccgccgcctccgcaagggccagctccagtacctcgtcaagtggcgtgggtggccagagagtgctaacacatgggaaccccttgaaaacctgaaggcctgttctgacattgttgatgctttcaataagcggtcaaggtcgcccagatcctgtggaaagcgaaagcgcaagactccaacaactccaacatccgatcctaacccttctcgtggcaaacgtggtcgaccacctcggtcggaggcccggagcatgcatagcatacatgcctcagaagtgaagaaactgccctgcaggacaagtagtangagagcaaataataatagtaacaagacctcacctgggggccttggcgcagcaatgaatttgcttggggcaaagaatagtacaggagggtagtctggtgtggctcaattgggtttcatctcaagangtcccttatctgttaacttgactgatcaacaagatgccaacacctgctatggtcaatgaagatgncaataaatacnagn

SEQ ID NO: 85388 - DNA, 546 bp, Triticum aestivum
  unsure (1)..(546): unsure at all n locations
  Clone ID: PAT_TA_85388
cggaagcttgttcactgaaagacagatatgggctgcatagttatatgcgtgccccagttgctgttaatggattatcagctacaactcaagaatgttctctcgcactatctactccgccaggagcacaagtgccctctctctaccctggtaatgttgttaaccgaactgtggttccacaacttggactggcaaggaagtttggtggtggaggtacaaatggccagcagtctggcccatttgataggccgagggaactttgggaccaaggccacagcatgaaacacctgaccaaatgaacttggttcagtttggagactagaagacttcaatgcctgtagatgctgctaacttgggctggntggaggggaaggttcgcaaaactaactgcagacttttggttctccctngactgaaaaatcttgccagcaaatgatgatgactcnaggaatnaactataaacggatgcaaaaccacggagctggactgttcnggtanaacgccaacacgatgcgctctcaactcgtgtgctgcgccccttgggaagtg

SEQ ID NO: 85389 - DNA, 544 bp, Triticum aestivum
  unsure (1)..(544): unsure at all n locations
  Clone ID: PAT_TA_85389
gccggcttctcatcaggcggatcgtacccggttggtgccactgagcattggtgcagatgaatggatgtttataattttttggcacgttccggatcgagaaagctagaaacgcggcaatgttccggtcacgtctgcatcggcatgactgcacccagtacaaccatttccattatggggatggtttgtggttatacgtactacgctcatgttcgcagcttgcacacactgggccagtgtgttgtagtagcgacagcatcctcaagaggcccacctagattcaccattttggncacgagcagatttaaatctccggatcatcaagcaaaacctgtgactaacttggntttcggtgatncccgtttgagcaaggagtaagaatcccgacttcgcgctgcacnacgccngntaccancgggttggacnagcaagacatnggtgccncaaatntcnccaagctggnagnggaaaaattccggcttcggtgcaatcccacnggggaattaattccccggactcgtgtatgcatggtcccattaaaagctgg

SEQ ID NO: 85390 - DNA, 297 bp, Triticum aestivum
  unsure (1)..(297): unsure at all n locations
  Clone ID: PAT_TA_85390
gtctccatccccactcctccaacggccgcgtcgttctcgttcgcccgccggcatcccattcgctcgtctcctcccctccgccggtcgctgtcaccccgcgtcgtcacgcgcccccggccgccgccatcactgtcatcgttccccctcctaaagccacccgtacgccagccgcaatggatttttgcaccgcatctgcatcctctcgccatggcgccgccgcccgcgtcgcctgctgactcggcccctgatccaaggccgaccgccancgcgcccgtttncaanaangtgccnaccccc

SEQ ID NO: 85391 - DNA, 205 bp, Triticum aestivum
  unsure (1)..(205): unsure at all n locations
  Clone ID: PAT_TA_85391
ctctctgtctgctgctcctctcaaaagagtcgcagttcactttgttgtactagagcgctgagcagatctttccttgtttctccattccggtacgaaggggtggggtccaagtgaagggaaagggaagggaagggaagagaaggcctgctgcgagcgatgggcatcgtcnangtcgtctccganttctgctccttgccgangactc

SEQ ID NO: 85392 - DNA, 503 bp, Triticum aestivum
  unsure (1)..(503): unsure at all n locations
  Clone ID: PAT_TA_85392
gttcacgccgcgatccgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtggttcagcagcggcactaagcactcaagaaaacctgaattttctgttgctaaccatatcanggtggtgggatttgcattctgcttctgcaattaattatgtgtcaacgatnagaanggtgcccctttcaagccgtaaggacactaantgggtgattactcaaaagtccagacatggtgcaatgccaagattctaagtgttcaagcttcnatcgtggatan

SEQ ID NO: 85393 - DNA, 515 bp, Triticum aestivum
  unsure (1)..(515): unsure at all n locations
  Clone ID: PAT_TA_85393
ttttttttaaaagaactgaaggtaaaaatctgtataaaatatggtccaattccattcaatgacataactaggcagtatccccctctccttatggctacatcccagccaacaaaagcatgccctctctctctctctctctctctctctctctctctctctctctctctctctcctcgcctgcacgacgagagcccgagaccaatccagccgccgcctccgccttcgcctcgcctagtattccctccgattcagaggccgatggagtgcatcgccgagatgccccgcgcgccgctggacagcaagctgcgcaagcgtcagcgtctcggctgggacgtcggccctgccgagatgtataanggcgtncggccgccgcacgggtgggaagtcggcccgccgagatgtatcagttagaacttgtgggacaacaaattgtgaatgccatcaantgctgcagccttgggccttcgtccggctgtgtttcttccaaagtcaaacaaagaacagcctcatgatgg

SEQ ID NO: 85394 - DNA, 488 bp, Triticum aestivum
  unsure (1)..(488): unsure at all n locations
  Clone ID: PAT_TA_85394
gctccacgagttccagcggcgcgtcgccggcaggggcatgatcgtcagctggtgttcccagcaacaggtcctggcgcaccgtgcggtggcgtgcttcgtgtcgcactgcgggtggaactcgaccatggagggtctgaggaacggcgtgccgttcctgtgctggccctacttctgcgaccagtacctgaaccggagctacatcgtcaacgtgtggaggaccgggctggcggtgacgcccgacgcggacggaatcntaggcnggaaggacttaggancaagggtggaccaggtcgtcggcgacnccnacatcaaggacagggcgcgggtgctcaaggacgaagcccaccggtgcgtccccnaaggagggtcctcgaacgacaacttcaaaaagctcgtgaatctctcagtgaatgatgagaaccgggagactgggaacatcgtgtcaatgtcctggcgtttnaatttngtgcacttanggcttgtttggt

SEQ ID NO: 85395 - DNA, 412 bp, Triticum aestivum
  Clone ID: PAT_TA_85395
cgacgcgtcgtcgagggtagagtccttcaggaaggagagcaaggagaagctcgtcaagatcgaggaaaggctgccgtcgggagcccgcgtcgtgatccagtgcaccgtgccctgcgacgacggcgacgaagatgcattctgaagcctcctggacttgcagctgacctggccacgtgacgtggcgctctctttgcttctttagatgatgatgaatgagttgctgacgagtttgtgttttctttcttgagatgtgtagtgtgttagctttattcttcaggcgtaatgtatattttttttttctgttctttggttttgttgaaattttgtcctcgttatcagttgtagtaagtgcctgttaatcccattttgtgctcgttatcagttgtaagctttatggtttaaaaaaaaaaaa

SEQ ID NO: 85396 - DNA, 197 bp, Triticum aestivum
  unsure (1)..(197): unsure at all n locations
  Clone ID: PAT_TA_85396
ttttttttttttttttttttttgtnttacacntatcttgtcttttacattactgcaaatacacacgtgctgttgcgtgaaatttttcagattcatacatcctaaacttagtaacgaaatattgaaacttnacggaaaaattcgctcatnagcacatgaccccagcantttntgggtagtgtngcccctcgtcggatg

SEQ ID NO: 85397 - DNA, 544 bp, Triticum aestivum
  unsure (1)..(544): unsure at all n locations
  Clone ID: PAT_TA_85397
ctgtcacatacacacacacaagtgctagctagctaatcgatcagccagccatggcggnaggagaagcaccaccaccacctgttccaccacaagaaggagggcgaggacttccagcccgccgctgacggggcgttcgacatgtacgggtactcgaccgagacggtggtgaccgccaccggcaacgagggcgagtacgagcggatcaccaaggaggagaagcaccacaagcacaaggagcacctcggcgagatgggcgccgccgccgccggagccttcgccctctacgagaagcacgaggcgaagaaggacccggagcacgcgcacaagcacaagatcgaggaggaggtggccgccgccgcagccgtcggcgccggcggttcgtcttccacgagcaccacgagaagaagcaggaccaacaaggaggccaaagaggccagcggngagaagaagcaccancactttcggctagatcgtcgttnacgtgcggtggccggcctcgccgccggccgtncgtgtgnttacgttacgtgtgttccataaantg

SEQ ID NO: 85398 - DNA, 537 bp, Triticum aestivum
  unsure (1)..(537): unsure at all n locations
  Clone ID: PAT_TA_85398
ctgtcacatacacacacacaagtgctagctagctaatcgatcagccagccatggcggaggagaagcaccaccaccacctgttccaccacaagaaggagggcgaggacttccagcccgccgctgacgggcgtncgacatgtacgggtactcgaccgagacggtggtgaccgccaccggcaacgagggcgagtacgagcggatcaccaaggaggagaagcaccacaagcacaaggagcacctcggcgagatgggcgccgccgccgccggagccttcgccctctacgagaagcacgaggcgaagaaggacccggagcacgcgcacaagcacaagattcgaggaggaggtggccgccgccgcagccgtcgcgccggcgcttcgtttccacgagcaccacgagaagaagcaggaccacaaggaggccaaggaggccagcngcgagaagaagcaccaccactttngctagattgttcgttgactgcngttgccggncttgcgccggcccgttcgtttgcttacgttacgtgtgttccataaan

SEQ ID NO: 85399 - DNA, 269 bp, Triticum aestivum
  Clone ID: PAT_TA_85399
atgtgaagccggaaaataaatccaaccctaaagtattaaggcccccaggctacattgcgccagactcgagcggaattcgacgtaaagccggaaaactgagcaggccccctggctacatcgcgccagactcgagtctggtgcaatgtatccagggggcctgttgggtaaaggtattgccattctgccctcggttggtgaagtgcgttttccggtttcacgtcgaattcgacgtgaagccggagaaggcccccaggctacattgcaccaga

SEQ ID NO: 85400 - DNA, 548 bp, Triticum aestivum
  unsure (1)..(548): unsure at all n locations
  Clone ID: PAT_TA_85400
ttttttttttttagactagaagtacaaataagagttttcagggctagctgagtacttcagtacaaaataccatttctttacaacatattcgaaatctaccaagattcctgacttttcaggaaacaaatcggtacagcgtagggagaaaagatatgagaaggcgaatactgcaagtggaatcatcgacacaaaataatacattcagaacgacacaatacatctctcagcagggtcttcttttgtccactttcaaatgatggatgttgaaccatctcttcctgcgaancgctctttaggnttcntttcntttttaataggggcctcttcatcgctcgtgatgcctccatcgtcgtcggactcttgaattcctcncctttcttacacttgatcatcatcacntttggancccttagaaggatggttttccctttgctggtaannggaactccgcttanangttgggccgttggggtaagnatgcatgaatggaatnccttcggtgannaagccaatnanccgtttgaancccctgggganatcngggggga

SEQ ID NO: 85401 - DNA, 316 bp, Triticum aestivum
  unsure (1)..(316): unsure at all n locations
  Clone ID: PAT_TA_85401
ctcattagatatttccatgcttgcaactacttgtacataggggctacttctcccatatttgtacaacacatcagctattatgcaaaccatctgactatgtagccatacaattggttttctttgcacttttcagctccacgtgagaaagttgtgctgaaatggagaaatgctgactttgtcctcgacaacttcatcagtgtgcaacacaggagttgtgggtgagtcatctgattatgtttgacagatgacagaacttgtttgcaccagcttatgccatctttttagtcgaaatacggggacgcacatgtnggggggg

SEQ ID NO: 85402 - DNA, 587 bp, Triticum aestivum
  Clone ID: PAT_TA_85402
cgatggtcgtgttatctgctccatgggtcttctgcccatcaagaccaagcaccgtggccccgctcaggtcgtgagcgaccccaacgccttggacatcattgatgaggctcttgacttcttcaaggccaacgtcttcttccgcaactacgaagttgagggatgcgccgaccgcgtgctcatctacctgaccctctacattcaccaggctctcaacaagatcatcggtaaggacaagggtggtgctgagaaggaactctaccagcttgcgattgccaacttctccattcccggcgatggtgctttccctctcggtggctttgtcaccaaccctgcttctcgcgccgacgccgacaccatccgtcagtacttcactcagttgcgccaggagtcaacatccgcctgattgcccgtgtctacgctttcaggaaacgtgaaccttcaaagtggtggacttgcttttccaagcgtaagttcctcaacatgagcttggagtaaacttccaatttgcacttcttccttccttcttcttctcaaattgttgctatgattgatcgcagacaacaatgtaaaatcacaaaaaaaaaaaa

SEQ ID NO: 85403 - DNA, 397 bp, Triticum aestivum
  Clone ID: PAT_TA_85403
cggcgttcaaggccagcatgatgcagtacaagacgatgccggccaggagcatactggacacgtgcttcgacttcacagggctggagctggacagcatcacagtgccggacgtcgcgctggtgttcgacggcggcgcggtcgtcaacctcgaccgtagcggggtcatcataggcaactgtctcgcgttcgctgccatcaccaaccccagcggcgtccccagcgtcatcggcaacgtgcagcagcggacgctggaggtgttgctcaacgtcggccagagcgtcgttgggttccggccaggcgcatgctgatcactcatttccggtgactacttccttgtttgtcattgtgaattgtgcggtaagggacaggaaggtcaagttcgttcaaaaaaaaaaaa

SEQ ID NO: 85404 - DNA, 570 bp, Triticum aestivum
  unsure (1)..(570): unsure at all n locations
  Clone ID: PAT_TA_85404
gaggcagtgaaggatctgagaaaaagttcatgtgctgaggctccggccatctggatcgcccgctggacgcatccttctcctagctcctttttcctctgtgtgcttggtgcagcacccatatgtaaatcgaaaccattttgaatccctgtttggacacaaacttttgcccacagatcatgacttatctgggctatacattttccgatcagcgttcatctctcgatcgatcatgcgccttaagggaaatcgagtattcgtatttcatagagcatctaggcgctgcaccatgaaatttcttaaggttaggcgcgcagacaccgcttgaatgagagtatgtatgccgctctgttatgaatcaaactgccgtgcaaaattcctcggttaatcatgtagacaggggatggacttgcacaagacttgagaagattccaactttagttaagttagtgcgcgctacaggaaaaggtaggaaaagagacatgaaaagagattcgttaagcattcacttcactttcgtctaagggattgtatttctgacgagcaattcatggtcttangagtaaatgcatt

SEQ ID NO: 85405 - DNA, 379 bp, Triticum aestivum
  unsure (1)..(379): unsure at all n locations
  Clone ID: PAT_TA_85405
tcgagtttttttttttttttttttttttttttttttttttttttttccttcctctgctagtatgtttcttccacacggngtaaaatttcttttctttctttctttctttctttcttccctgggatacgacgagntaactagggccctcctactactgagcaactgaaaattcgattctttgacagggnttggatcgaatcatcgaatggaatgagcagattaagcncaagatcgttgaaccgaatggaaccgatcaagaggatgcagnagctaattagaagaaggctgtgccggcgaggccgcggtggaggaggttgngcgcgatcttgtccctgggntttggcggcggcgtcggagcgcaccgggttgtccagcacgg

SEQ ID NO: 85406 - DNA, 508 bp, Triticum aestivum
  unsure (1)..(508): unsure at all n locations
  Clone ID: PAT_TA_85406
tcgaaatgttcctttgaataatgtttcttcaatattttggaccctttgttcaaatagtgttcgctaaataatgatacttgaaaaaagtttccctaatctctttaatgttcacttcaaattgttccttctataatgttccctacaaaattgttccttcaatatttggtctataaataatgtttcttcaaaaatgttctctacataatgttccctaaatacttgaataatgtttccctaataatgttatatttgggaatgttcctttgataaagttttttgctcaattttttgtatgcctccaataatgttccctacaaaattgttcctttaatatttgtttcctaaataatgttccttggaatacncaggaacaacagattccttttccagactgtaactttcaaggataatgaaattcagcttccgtttgtaacttctttccngtagagacagtaagttcctccattcctttggttccaaggatacttaggattttggtaccnccttt

SEQ ID NO: 85407 - DNA, 527 bp, Triticum aestivum
  unsure (1)..(527): unsure at all n locations
  Clone ID: PAT_TA_85407
aatgcacataatcccctatatatggtaaataagttcggaaaaatgtcaaatttgaacacgttgcatttgaggcagtatgttgatcgttggaaaaaaaactgaatgacaaactaggacggaaatttggattccccttcaatcttggtgatttccctctcgaaagcattgaacttcctcggcgatggtttgatttatgaagggcgtgcatgacgacataaatcaaaccttctcagcttttaaccagggcacggtgaggccataccatggcaccatgcagccctgatgtttttcaagcacatatttcattgttctatagttgataacccagtaaatgacgcgtttgtggttgactattgccacgcattccattgaaatctctgcccattccttgtaaaagggcttgagaaattactaaataccacgagtatggnttttccagaccattcttgtgcaccctttcatgcatcgattgtttgaatttgaattacgtgcattaatgcctacaaaatgcacataatgcccnaaat

SEQ ID NO: 85408 - DNA, 531 bp, Triticum aestivum
  unsure (1)..(531): unsure at all n locations
  Clone ID: PAT_TA_85408
ggggtgacgagtttgattgcgagtgtggactttgcagccatgtgttgaaggtgctggacttcatccgcatgaatcagatacatgtgaagcatatactgaaaaggcggaccaaagatgcccgggatgtactggctcaccatctgtgtcactatcagaaaaatctgcataataatcctttctcatacagacacttcaacctgtacatgcaagccatggagctcttttggcttggagacacaagcatggatgcatacgaaaggttgatggtatgggtctgggagacatgacggccaataatggttctcaaccagattgaaacaataggacgcgaacctgatgatcggagcaaatggtagcaggccactaccactagtgttgancaacaattttgcatccatctcaagcaacaggctgttgggnctatcagcaccagcaaagaggaaggagaagcggtcggnaaaccaccagttcgaaagaaaggcnccatatnaagggctggagnaagangacatgattctgcaccattttctg

SEQ ID NO: 85409 - DNA, 575 bp, Triticum aestivum
  unsure (1)..(575): unsure at all n locations
  Clone ID: PAT_TA_85409
gaggctctagaggctcgggcggcctccggaggaccgtctccatctccacccggactatgtgatgcctggcctcctgacctgccaggattctctgaaggttgcgctggaaggtggctaccatgctcggtaggccgaagggcatgtgaatgtagctgtgaggtggaccctcacaccgtccaacacgcgaaggccagaagcgctcctgagatgcggcccggttgagccctaggatgtcgatgcagaggcgcantcacaaccctcgcctgggtggggagcaacgccaggtgggcggcggtcgccgcgtattgttcttgcttcctgaagctcctgagatgccttgtctatgaactcctgagtgccaggagcttttcggctggcgccctcctgagggaaacatgccgcgaanaacgcctacatgtggtgcccgagcgcctccctcatgatgctggcaaggtctgaaggccttcaagaagggagcccccgagccttgcccgaagaagggcgccgggcaggcttccttanacaagggaggaagganccccaggggcgggcntaaatctaaanggggtcccgnt

SEQ ID NO: 85410 - DNA, 336 bp, Triticum aestivum
  unsure (1)..(336): unsure at all n locations
  Clone ID: PAT_TA_85410
tcgagttttttttttttttttttttataaactggccattaagcctgacaggtttatccaaacaagttgctcttttaattacaccatataacaacatacccacagcacagcgccgagtatataggtaaaaaacgaaaggaaaaggaaaaaaaacccgaaaagaaaagttctgagcagaacatgtcctttctgcaatgtatacatgatgcntatatttttggctcnacagagatatcttcaaccgnctcatttctggnacggccgctgcnanggntctgcttcnaaggggcnttcngngaaatttnccnaaaantnaaagccttcatccggggggggg

SEQ ID NO: 85411 - DNA, 230 bp, Triticum aestivum
  Clone ID: PAT_TA_85411
agatgcagtcgcctatcgacctctccgaccaccgtacctcacgggcacccaatctcggctacctcaaccactcctacctccctgtagaggcctccatcgtcaaccgcggccacgacatcatggtcaagttcaacggcgacgcgggagcctgtggatcaacggcaccgcgtaccacctcaggcaggttcactggcactcccccagcgagcaccgtgtaaaggacgccggta

SEQ ID NO: 85412 - DNA, 538 bp, Triticum aestivum
  unsure (1)..(538): unsure at all n locations
  Clone ID: PAT_TA_85412
ttttttttaaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagttggcagagaggtcttgatgtagcgttcatgtgagagataaactgtcttgtcaaaanaggttntctgaagcggaggtgcacaatgtcaccaccttacggctggtatgacacctatatacacacctagagaggattgctcaatgtcacatcactgct

SEQ ID NO: 85413 - DNA, 169 bp, Triticum aestivum
  Clone ID: PAT_TA_85413
gtgccaccttcacctccagctctctcttggcggcctctgcagttgcggcagcatcccttgcccccttgagagccccgccaagtgtttcctcgcgcgcaacaagctcctcctcgtagctgtcgaggttggccttccgctgcaccaactcgccttctcgcgcagactgctt

SEQ ID NO: 85414 - DNA, 537 bp, Triticum aestivum
  Clone ID: PAT_TA_85414
agctcgtagtcattacctgcatctcagacgtgccaacagtatccgaggtaggcgagatcactatctccggaccttcctccactccaggaacctccactctcggaccctcaaggtccaacgcaggtaaggagtgctcgaaaacctcagaagactccacccgctcactccatagtctcgggggagttggtgggtacgtacttaccacatatttttagctcagttcactgatgtccaaacagatttgcggtgactcatgactacaaatgtttctctctttcattataaattaaccttacaggctccatattttgcttcttcactgggtatcatctattgtctggtcaaaccggctacttatgcgatcatctctagggaagtagtctcagctgaccagggaaaggacagggattcatcgaacagtgaaatccacagtatactgatggcccattgttatgagccctctaacctcctacttcatttggagagaccttaactgaaaggttagttcttgtgcgggttttctgaatatattgcatt

SEQ ID NO: 85415 - DNA, 544 bp, Triticum aestivum
  unsure (1)..(544): unsure at all n locations
  Clone ID: PAT_TA_85415
aggaaacataaacctcatgggtctcgccatgcttgttctaccagtgctcttagggttgttttatggagcaagtgacattaattgctcaacagttcatggtaacaccacagatcaccgttcactgcttgatttcaaaggggccatcagagcggacccaagaggagccttgcgctcttggaatgagaacatccactactgtatgtggtcgggcatcaagtgcagcacaatgcacccagaacgtgttacagtgctaaaccttgccaacatgagcttgacaggccaaatcacaccctctctaggaaatctaaccttcctttgggaacttacactatccaacaatctcttctctggccagttgccctctctcaatcgtcttataagattagaaagctttacttacagaacaacttgttgcaggggaacattccgaatgcacttacaaattgttccaaactccttttactagacctctcttctaacatgctagtgggtcgattctggaatatagggtcctctacaatctaanggatgactttccataata

SEQ ID NO: 85416 - DNA, 378 bp, Triticum aestivum
  unsure (1)..(378): unsure at all n locations
  Clone ID: PAT_TA_85416
ttttttttttacatcgcaactaacagggtaagcaagttaaataccaatgtatttcacggtttgcatgggaccagcaaacaccttaccaaccgccatacataccaattggatagataacatgtgaccagattgcaaaataaacactggacgaaatctttagcatggtcagataacatgggagcagcttgtatagccacaacccaacaacaatataacaccttgacttcagtcctgaggaaagagccatgctgccagacgtgttnaaatgcggcgcttccaggagatcattggatgaggggaagagacgtgccgatcgcatgtcataggnctccatatgnttccccncgtgtaaangagctataggatcccgggtcatat

SEQ ID NO: 85417 - DNA, 269 bp, Triticum aestivum
  unsure (1)..(269): unsure at all n locations
  Clone ID: PAT_TA_85417
ctgcgacaactcttgtagcagatcgttgaagacccggacatctcctcttcgggacaaccggtcagcgtacctgcagacataactctatcagtcctttctatctctgaattattcgaaggnaagttcgaccacatactgaatatgccgccccgcagccttttattctcctttacggagtccgccanctgggcccgtacatcttttagttcctcgcccagttgggtattgnaatccnanatcntgtttntctccatcangactttngttcg

SEQ ID NO: 85418 - DNA, 163 bp, Triticum aestivum
  unsure (1)..(163): unsure at all n locations
  Clone ID: PAT_TA_85418
catttttnaggggaacatctngtacaagtnatcctgactaaatttngtcttcgacngccaangggaccggcgatgacgncatcttgggnncnacggtgncctccgtnctgncgctctnctggtcntggtatcattgcaccgaaatggtaacctttncttgatg

SEQ ID NO: 85419 - DNA, 257 bp, Triticum aestivum
  Clone ID: PAT_TA_85419
tttttttttttcacgctttcataatctcttccattctataatgtgtacacgtatatgatgacagcacaatcatgctccacaaaggggccgggagaagaccgagaccaagaacatcgtccatggtctcaaaacgaagttcgattttaaaaaacgaaaaggaaaaaggcgccacctctcttctatgaacaaagcgagtagaaatggcggctaacgccatggatggatgatggatccctcctctaccctttggtcccctg

SEQ ID NO: 85420 - DNA, 283 bp, Triticum aestivum
  unsure (1)..(283): unsure at all n locations
  Clone ID: PAT_TA_85420
acaacgacgattgctacgacaantgcgcctattaccaacatctngccaggagacanttctctntcgaccagtnccacanccagcagcatcatcancctaggcaganaagactncgacttnaaatntcaacactaacaagacccaacaagaaaggaattatgcntncaacantncatgagcttctgcctcaacctccatgtgacnngcagcagcagcgnggacgagcaccnccncggctggaaagcgtggccgnagccatcancgaggangnggtgngaccncc

SEQ ID NO: 85421 - DNA, 171 bp, Triticum aestivum
  unsure (1)..(171): unsure at all n locations
  Clone ID: PAT_TA_85421
tcgagtttnttttttttttttntgttntttttgacaagataacattacttaaattcccttacatcttggcatatatatatatgcataatgnatgcaaccacatgtgnngcacttgcatatatacatatgtgttcnctgatctnangaancaaattnatncatccangcaga

SEQ ID NO: 85422 - DNA, 252 bp, Triticum aestivum
  unsure (1)..(252): unsure at all n locations
  Clone ID: PAT_TA_85422
cccattcccacctccattcgaaagcggaaacctcccagatttccccatctcctcccantcccccaaaaccctagctccgctcctccttccccatgtgatgggatgccgcccaaaccctacccccggtccctgaccgccgctgcctccttccccgcgacctggatgtccgcatggagggcttccgggccctgatcgcngccgcggccaccgccgtctgctgcgtcgtctgcgccatctgggcattccgctccc

SEQ ID NO: 85423 - DNA, 152 bp, Triticum aestivum
  unsure (1)..(152): unsure at all n locations
  Clone ID: PAT_TA_85423
atcgcttcnaaggnttgggtcggngctncagtcnactttngctgcttccggntntgattntcttgcgtcgtgtcctgcttctggtcctcncntgagatgatcctatcctgnngccgcttgngttgattgttgcttcgattgtcnctcagggc

SEQ ID NO: 85424 - DNA, 358 bp, Triticum aestivum
  unsure (1)..(358): unsure at all n locations
  Clone ID: PAT_TA_85424
acatcttcaaggtgctcaagcaggtgcaccccgacatcggcatctcctccaaggccatgtccatcatgaactccttcatcaacgacatcttcgagaagctcgccggcgagtccgccaagctggcccgctacaacaagaagcccaccatcacgtcaagggagatccagacctccgtccgccttgtcctccccggcgagctcgccaagcacgccgtctccgagggcaccaaggccgtcaccaagttcacctcctcctaggcgtcttcctcgtttcatgagctgatggcggcgttctgtgtgtagttagcagtgcgatgttacaatctctgtaagaattgtgctgttgttggttttaaaan

SEQ ID NO: 85425 - DNA, 347 bp, Triticum aestivum
  unsure (1)..(347): unsure at all n locations
  Clone ID: PAT_TA_85425
gttttttttttttttttttctcaccaaaaccagatcagtaagcattgtctcnccctttcngcnctctctatttttctantagcnacggccaacagcngcncaatcaagcccnatatctaagttgcagcaatcaacgnctctcnctacttagctgattttagtcaactcaatgactaaaccatgctttnatccaccaccctcaatcagatgaaatatcaagtaatgcagagcacaagatctctaagctctgggcttcagatcgactcaataacatggagaacganganttctgcaagctggtggtaantccncattcttactcgnaggagcggctnnaccacccatgg

SEQ ID NO: 85426 - DNA, 581 bp, Triticum aestivum
  unsure (1)..(581): unsure at all n locations
  Clone ID: PAT_TA_85426
gcaccatctcttccattatccgactgatgaagatctcgccgcttgccatcaccgaactaattcccaaaccatcgcggctgcacttgttgattcatttcttccaacttctcttcgtctggcgcagtttgtggttgcgcggagtgcgcaggcgcattctcaaggatctggatcctcgacgacctcgtgaagtccggcggangttctcaagggtttcggccaaggtgatgacatggccgacggctagagaaccatggcagaggtgttgtagtttggtccaatggaggaggctgttacggaactcaccgagtcatccgctgatggtgaattattggatctgactacagtgagatgctggcctcctcattgttcttgctggcctcctcattgttcttcttgtaaactactatnaattgcttgcggtcatcgtgctccttgccggactgttgcgctggtagttgttgttgctgcgtcgctcgcgtcgtgtactggtcgcgctggtagtaatgttgntgcactgcgtcgtgcggctcgcggacgcngctggtgtgttctgactgcgtttangtcggggcgtgaagttt

SEQ ID NO: 85427 - DNA, 527 bp, Triticum aestivum
  unsure (1)..(527): unsure at all n locations
  Clone ID: PAT_TA_85427
gctatatacctacatagtacagccatggcccccaccgtgatggcctcgtcggccacctccgtcgctcctttccaggggctcaagtccaccgccggcctccccgtcagccgccgctccaacggcgctagcttcggcagcgtcanaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaaactgctatgttcgggtgaccgacgccacgaggtgattaacgaggtggaggaggtaanaagggtacctgacgcgtatntcgcatatcgattganaanatgngccaggtgagtgcgtaattcatgccttaaancaccggggtgcgangntcggnaa

SEQ ID NO: 85428 - DNA, 247 bp, Triticum aestivum
  Clone ID: PAT_TA_85428
tttcgaatgaatggattgtcttgtggtgcttagtttggttccgaccattcgctcgaaaagacaaaattgattggttttttagtgctccttcccgtgtttctgtgtatgtagcttggatgtgttgcaagcacctaatggattattaaaacgacagtaactttgttacacccaaattagaagacactttgaataagtattgtatgatataaattatagcagaagtgcacatttccttaaaaaaaaaaaa

SEQ ID NO: 85429 - DNA, 187 bp, Triticum aestivum
  unsure (1)..(187): unsure at all n locations
  Clone ID: PAT_TA_85429
ttttttttgccttaattcatgcngacnatgggactacgaaaaatattattagnattttnggtcacattgatgtgccattcaattataccgaccgttgggccaagagactagaaganaggcttatttacggntagtttagcnacaganagacagaactcagcttaaatggagatgctgttggggatgc

SEQ ID NO: 85430 - DNA, 462 bp, Triticum aestivum
  unsure (1)..(462): unsure at all n locations
  Clone ID: PAT_TA_85430
aacttgtccttccggagagcatctctgcatcatcatcctccagtggcttcgagcagctcccaccactcatcagctgcctcagtgcggcggccgggtattcacctggattgctcgggcgggtcagaatgcaggcgttcgtttctacaagngcgtcaacaaggacgtgagtacgacccattctcgnagctctcnatctactcgtgtnttccaaacatctaatacattcttctnctttgcngattcgatttgttttnaagncggggctcngaaactacatgngaaccagggncgagtacttnncngagtgagtatcatctgggggcggcgcacagccagtgcacggaagtagccagggggatttatctgaaccgcaggttcgtgtccganagcagatgnaatgttcacncgttgcacaattttagggcccaccatgggttaataagggggcaatcacgcngcctc

SEQ ID NO: 85431 - DNA, 270 bp, Triticum aestivum
  Clone ID: PAT_TA_85431
gcgaaatgaagggattgatcgagactgcaatcgcccatgttgatgtcgcaggaagtagtattagttactaagtgactcatgggaacttacgatattcatggttgcatgttcatcttagttagttacgcatgatcacgtgtactccaggataaccagaacactatagtgttttggcaaaaatggaaagagactaaatattatttagcgccccactgtgtttgtctcatggtcagttaataagcaataacctcttataacaaaaaaaaaaaa

SEQ ID NO: 85432 - DNA, 560 bp, Triticum aestivum
  Clone ID: PAT_TA_85432
ggtatattgatatggtcagtttgtaataaaacaagcttttggatgtggtgtttcaaaatataatacgctgctcctagtgcaacatatgagtacaggaatgcactcatgtcaataataatgcacagtaccttgttccttaaaggtgatcttaccctttggtgcttgtgtcacatttatgttgtccttgaatgttcaatgctacctggtgtgcattggtgtcactgagtcacatcttctgtttcactgttatccttcgatctcttggctcctttcttttgtcaccattcttttactgatttttgtgcttgtagttcatcttctgctccggttttgaagggacacaaaattaatggagtcatgattaatctgtttgctgatctatgggtgactcatatcgagtgaatattcaacaagaagtcccataatcactggctgtggtaatttacaagctctcctctccgctgcttccatgtaaatgaatgatggcaagagcttctgcgatgaagaggaactcagaaccaactctgagggcaagctgctgtacaagacggatacgcacg

SEQ ID NO: 85433 - DNA, 561 bp, Triticum aestivum
  unsure (1)..(561): unsure at all n locations
  Clone ID: PAT_TA_85433
gtcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggtgtcaagatggagttgattgatgccgcatttccacttctcaagggagttgttgcaacaactgatgttgttgaggcctgcactggtgtgaatgttgcggttatggttggtggattccccaggaaggaaggaatggaaaggaaggatgttatgacgaaaaatgtttcaatctacaaactcaagcatctgctcttgaagctcatgcagcccccaattgcaaggttctggttgttgcaacccagcaaacaccaatgctctcatctgaagagttgctcatctatcctgagagacatcagttgtttnaccgctagacacacaggatcgtagatttgagaacttggn

SEQ ID NO: 85434 - DNA, 305 bp, Triticum aestivum
  Clone ID: PAT_TA_85434
attcaatgttttctttaattactgattacacttgtgcttaacaagaattccaaaaagccacattcatgatactattaaggtaggtactcaatctgctgcgtacacacaatacaatggaccaatgtattaatcgtgtggcactacgggaacaaggaggagcttctccttccggtgcactgtcatcccaaatacttcagtcatatcgataccaccttccatcaactccattggtagcttccagttgaagtggtacattagattcgctagcatgatttcaatggtcgcaatcgcaaagttgggggggg

SEQ ID NO: 85435 - DNA, 217 bp, Triticum aestivum
  unsure (1)..(217): unsure at all n locations
  Clone ID: PAT_TA_85435
atcactacnaaggattgggtcggngctncactcnnctttngctgcttcaggaatatgattatcttacgtcgtgtcctacttctggtcctcacatgngaaggtcatatcctgaagcagctaagttgattgtngcttcgattgtcatcagngcatcactacaaggattngctcgatttactgcnttcacgaactgcatggtcaatctattgaatgccac

SEQ ID NO: 85436 - DNA, 224 bp, Triticum aestivum
  Clone ID: PAT_TA_85436
cattcatccatgatccgtcgctcagcctcctcgattgctccatcatttgcagttccatcacttgcttgatgctttttcatacatagcagcagcagccttcttgattttatccaagaaattaaacgtttatgtattcagtacgtgtgttgtacgtgtcaggcaggttctagctagtttgtaataatgcgtgctcagctagctagcagataaataaaaaaaaaaaa

SEQ ID NO: 85437 - DNA, 509 bp, Triticum aestivum
  unsure (1)..(509): unsure at all n locations
  Clone ID: PAT_TA_85437
gagagggcccaaacctgggtaaaaatcggtgtccccatgtgtcctgttgccatccagcaagacaccagattggtaccccctactcaagatctgccggatttagctccgtcactaactattatatatgttggctattacattgactataaatgacaagacaatatgatgtagctagcaactggctatattattaaccatgctcttatgctacttatcttgacgtcctcatgttttgaatttttgatttgtaggttccaaggagacctgaaacataactttttcttcaaatttctctctaaagaaaacttttcttcaatgagacgggccttcgtcaatgggctgaactcgcttgtgaacatactctcaaacggtacgctgacgcaccacctttcaccctctcttaacactttgtnaggaatctctgcgccattgacgggaancagcaccgtatgctcgaactgcgcgttgaaggctggcatccaccggnatngcggtccagccggtcgtnc

SEQ ID NO: 85438 - DNA, 371 bp, Triticum aestivum
  unsure (1)..(371): unsure at all n locations
  Clone ID: PAT_TA_85438
gacacgcccaccacccccgccggcgccgcgnaaccgtncancccgccgctgcgtgggtngccancgccgccgtggccgnngccggcgccttntactgagagatccgcagatnggctgcgatttaatttatncgnggggncccgctccctctccttttgtggtngggttcttcgagctgttcatcttccttntttttgttgcttntatgatgattacattnnggnattcgattcgggttaccagtaggcagtatntgtgggttggncnntggattgacagatntgattgtttggtcgtcntngtcgntggtggnggtgtttgatccatntccgttccattttanaaatcccccggntaantcatctgcanca

SEQ ID NO: 85439 - DNA, 211 bp, Triticum aestivum
  unsure (1)..(211): unsure at all n locations
  Clone ID: PAT_TA_85439
aaactaancagtagngtaaaaanagnttcttnctctcnagtccagtgcacncntcacacttnataaatcaatccgcaggtaaccatttggttccgcaaatccacaccgntagttcaacnaanaatacccgtggcactacnactctcctagcntaggantaggaacacacaccaaagaaatgaagaaatggggaaactccaaacaatccatc

SEQ ID NO: 85440 - DNA, 253 bp, Triticum aestivum
  Clone ID: PAT_TA_85440
cgccatgtacggtgcctaccccgtcatgtagttttttttttttttgaagcgacccgtcatgtagttagtactatatatcatatagtctgcgcgctgggtaatactccgtactagtacatatgacgcgcagtaatgtgcaattaaaataagctgcatcaatgcatgtgcacgcacatgctgactgtgggaacgatgataaattactttggcaccgtatctgcagatgatacgatatagtactaaaaaaaaaaaa

SEQ ID NO: 85441 - DNA, 395 bp, Triticum aestivum
  unsure (1)..(395): unsure at all n locations
  Clone ID: PAT_TA_85441
ccacactcatctgatcacccactagctagccagctagcagcttaaggaactagcttgcagctagcgatccatggctcgtctcaacagcaaggntgtggcggccgccgtggtcctggnggcggtggtgctgatgatggccggcaggnaggcctcggcggcgctgtngtgcgggcaggtggactccaagctcgcgccgtncgtgggcgtacgtnacggggagggcgtcctcgatcagcaaggagtgctgctccggcgtgcaggggctgaacnggcctggcccgcagcagcncggagccgnaagatatgcntgcaggttgcnncaagagccttggccaccagcatcaaatcccatcaagattgggaaggtctncggcgtggncggnaaanttcggcgt

SEQ ID NO: 85442 - DNA, 449 bp, Triticum aestivum
  unsure (1)..(449): unsure at all n locations
  Clone ID: PAT_TA_85442
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggnagcgtcagcaacggtggaaggatcaggtgcatgcaggtgtggcccatcgagggcatcaagaagttcgagaccctgtcttacctgccaccgctcancacggnggccctcctnaagcaggtggactacctgatccgcncaaggtgggtgccttgccttnattnagagggtcgggttcatcttccgtnacacntgcgtcnccggtacnacganggccgctantggcaattgganctccntntggggtgacgacccaacntntttaagggggnggngagaaagaggtncctgacnttctcaca

SEQ ID NO: 85443 - DNA, 276 bp, Triticum aestivum
  unsure (1)..(276): unsure at all n locations
  Clone ID: PAT_TA_85443
agtttttttttttttttttttttatctccaccaattcttcattcacgactagaatcgtgtcatttctcagtatcaccaaatgcacattacataacgcactgaggctatcctggatagagtctgaggcagaatttacagttcatgacagaactgtttgtcctggatactggttaggcattcttgncatgacttcnggcagtatgaccttggngtcancataacaggntctatgncagggncancctgggngngaaacccgcttgaatttcncgaagt

SEQ ID NO: 85444 - DNA, 419 bp, Triticum aestivum
  unsure (1)..(419): unsure at all n locations
  Clone ID: PAT_TA_85444
attcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaangggtggcaaaaagtctagcagtagtagttccctgatgtacgaagcacccctcggctacagcattgaagacttcgacctgctggaggcgnnaanatttctctgntgataccganctgcgcaaaanncatctgattcttngggcnccccttcnngtagttaggttttaagcantttancggacttttccccaaaatccggggttg

SEQ ID NO: 85445 - DNA, 378 bp, Triticum aestivum
  unsure (1)..(378): unsure at all n locations
  Clone ID: PAT_TA_85445
ctcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggnatggcccgcannactcggaccgcaagatagcgtgnaggtgcctcaagacctcnccacnagcatcattcatnaanatggacaggtcnccggntnccgaaangtgcggntcgtgt

SEQ ID NO: 85446 - DNA, 328 bp, Triticum aestivum
  unsure (1)..(328): unsure at all n locations
  Clone ID: PAT_TA_85446
gtgccatctgctctgctctctcctatcatctatctagcaactcaattccatttgcatgcctacacacatcttacattcactacctcaacacttaccactccaccctagctaagctatcttcacctccatcacaaatcatcaattgcttcagtttgatcccatcaccatgggcgagcaagtagccaccanggaggaggccaacanggaagaatcacctgcacccgccgccgnacctgaagctgcaccggcaccggnaccggaagagganaanagggangnggcaccanccgaccaacnccaaggggggaggacaagncgcgggaaaaaa

SEQ ID NO: 85447 - DNA, 539 bp, Triticum aestivum
  unsure (1)..(539): unsure at all n locations
  Clone ID: PAT_TA_85447
cctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcnattaacaaggttggttatcttccgtgagcanaagcatcccctgggtacacatggcggtactggaaatgtgaaactgctatntcgggtgaccgacncananaggttttaacaggggaaagtaaaagggntccctganctnantcgatatngttcaaaatccaagtgattgntaantaacccttnancacgggtgnagatcggaaggntaaaacnnccncagggcaaattagnnt

SEQ ID NO: 85448 - DNA, 517 bp, Triticum aestivum
  unsure (1)..(517): unsure at all n locations
  Clone ID: PAT_TA_85448
agcaatccaattccccaccagccccctcgcaccttccggcgaatcaccgcacctctccccggcgaagcagcagcgtccgatggcccccaaggcggagaagaagccggctgccgcggagaagactccggcggccgagaagaccaccgcgggcaagaagcccaaggccgagaagcggccgcccaagtccaaggagggcggcgccgacaagaagaagaagaaggccaagaagagcgtggagacgtacaagatctacatcttcaaggtgctgaagcaggtgcacccggacatcggtatctcctccaaggccatgtcatcatgaactccttcatcaacgacatcttcgagaagtcgccggcgagtccgccaactcgccgctacaacaagaagccacatcactcagggagttcagactcgtcgctctctccggggactccaagancgttcgagnacaagcgtacagtcaatcnctaaaagcgtcccgtctcggtgataagtccgtaggcctaacgtcgaattc

SEQ ID NO: 85449 - DNA, 528 bp, Triticum aestivum
  unsure (1)..(528): unsure at all n locations
  Clone ID: PAT_TA_85449
ccgagaccccatccgctgcactcgttgcctggagaaccaccaccgcgcccgcgactgccggaacaagtggcgcccgctgagctacctcgcccacctcatcgctcctctgccgctaccccgtcctgttgtcgtgcctcaggagggcactgccccatgctttggtgcgggtcgaggctgggcgcttcctccccagcagcctgcagcggccgccgtgttccccaacctcgccgccgctgctccaatggcccgcagacttggagacgctgcttcaaggccagaggtggactacgtggtcatcccggcaccccgaagatgcaggaggaatcggcgctcctctccagcaacgcagtgtcgcctggtcgagggggtcgcgacgacgtgcccgctgcactgttgcggagttcgctgcaaattcggataagangcgnctcacgtctgcgcatacccagaagtctttcnggtatgtcacacactggcaatcaangacgcggactcacanacggtcaattcgtcggctgngctgaacca

SEQ ID NO: 85450 - DNA, 466 bp, Triticum aestivum
  unsure (1)..(466): unsure at all n locations
  Clone ID: PAT_TA_85450
gcttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtncgtggcgtacgtnacggggaaggcgtcctcnatnagcaaagagtgctgctccggcgtgcaggggctgaacggcatgtcccgcagcagctnggaccgcaanatagcgtnaggtgcctcaanancctcgcancagatnagtncatcaanatnggnaaggntcggnntgcccgnaantnagggttattnccttcccatcagatntcacaantggacattaactagttaanataaaccttccncntgattatgacccncctttngag

SEQ ID NO: 85451 - DNA, 402 bp, Triticum aestivum
  unsure (1)..(402): unsure at all n locations
  Clone ID: PAT_TA_85451
ctagcaagctatatacctacatagtacagccatggcccccaccgtgatggcctcgtcggccacctccgtcgctcctttccaggggctcaagtccaccgccggcctccccgtcagccgccgctccaacggcgctagcttcggcagcgtcacaacggtggaaggatnangtgcatgcaggtgtggcccatcgagggcatcaagaagttcgagaccctgtcctacttgccaccgctnagcacggaggccctccttaagcaggtcgactacctgattcgctccaagtgggtgccttgcctcgagntcaacaangttgggntanttccgtgagacaannatcccctgggtantacnatggncggtantngacaatgtggagtgctattttnggatgccctacgcacg

SEQ ID NO: 85452 - DNA, 319 bp, Triticum aestivum
  unsure (1)..(319): unsure at all n locations
  Clone ID: PAT_TA_85452
ctcctctgaagatcgccgctgtctactctgttttccttttccacttacactgatgatgatttgtttttttcttccacgagctgattgatgtgcagctcggtacanccattccattgcattgccagatttgcctgcagcaattgctgtgattgttgatgctgagtttgttcaacatgttttataaaanangattatacaatcttattatganatgatgataccagcctcaatcagactcactttgtattgtatggtagcaagcatgtaaatttgacaacttggncaatcnacatatgattgctcagacaaaaaaaaaaaa

SEQ ID NO: 85453 - DNA, 479 bp, Triticum aestivum
  unsure (1)..(479): unsure at all n locations
  Clone ID: PAT_TA_85453
agcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaanccgnacctgctganaaaccagcaccggnagntgctgatgtagccaagcagattccagtggcattccaggnagccgggcgaacaactattaccgntcagatggccagaacacgggnaacttccttacggancgncttcaaccaagttcatgctgtcctggcggggtcctcctgggtantntttggnggaaagtgattntaanatggggctnctaattaacgagngatgaatgcctggatnctgttatcangngnaaaaacgnaagttttngtttncagtttnaanctggggngnagncttcngnagggtnatntgcaac

SEQ ID NO: 85454 - DNA, 428 bp, Triticum aestivum
  unsure (1)..(428): unsure at all n locations
  Clone ID: PAT_TA_85454
aatctttccctccctcccatcctttcttcccctccgnctccgcctcctcggccgccggtgacgcgccaggcgctagcagccatgtcgtgctcccacctctccaccgcgtgtcctcctccgcgcttgccagcacctccanccgcngccgcgcctccaccggcagcannagnagcctggtggtgcggtgntccctccgggacctncgcaaccgcatcgactctgtccgtaacacgcagaagatcacggaggcgatgaagcttgtggccgccgccaaagtccgtcgcncgcaggaagccgtggtntctcccgnncctttcngaggntcttgtggagtgctctacaaatnnacnaggagntnagtnggaggaattactgncctcaccgccagggggcgttaaggntcgnattgtntcnnacgggaggtggct

SEQ ID NO: 85455 - DNA, 420 bp, Triticum aestivum
  unsure (1)..(420): unsure at all n locations
  Clone ID: PAT_TA_85455
ctagcaagctatatacctacatagtacagccatggcccccaccgtgatggcctcgtcggccacctccgtcgctcctttccaggggctcaagtccaccgccggcctccccgtcagccgccgctccaacggcgctagctcggcagcgtcacaacggtggaaggatcaggtgcatgcaggtgtggcccatcgagggcatcaagaagttcgagaccctgtcttacctgccaccgntcagcacggaggccctcctcaagcaggncgactacctgatccgtccaagtgggtgccttgcctcgagttagcaaggntggggncatttcgtgagcacaaagatctcctgggtactangatggcggtattggacatntggaantgctatgttcggtgcactgacncacacaggtgtnaacnaggtggagg

SEQ ID NO: 85456 - DNA, 290 bp, Triticum aestivum
  unsure (1)..(290): unsure at all n locations
  Clone ID: PAT_TA_85456
cccacatggcctctcacatgcacccaccatnaccaattttctatcatccctaacctcctcctctcgctctctctaatcacgcactaatcaatcaatcgcgcgaaagtgaagcctcaccgcaccantctccctcccggtaagtncactgcaccgncggtttnatccaactancgcgcacctntaacaaggnagncccagcnnctttttcnttantnagctgtcgtgtacntnancacccncatcngntctcctggtngnnaattcgntctnttaaacaagcagatccaatt

SEQ ID NO: 85457 - DNA, 486 bp, Triticum aestivum
  unsure (1)..(486): unsure at all n locations
  Clone ID: PAT_TA_85457
gccgcgcccgcaagctctctcccccctgaaaccctagccgcccactactccccctcaggtccggatccacctctcccctctcctctggctcgattttgacatcgcaaactcacacggtcgcggtttccccgccatcgttgacgcatccaccggcctctccggcgctcgggagcacgtcctgggggtttgtcgtgttcgtccacgtccgttcagggcattggagcaaggcgggaagctgagtggacggagctgacgacctcttcatcctcctctcatctccgtcgcgtacatcgccggcgtccgtcaccaaatccggccgcctctgccgctcctagccttccaacgagccaccgtgtgctcctacatgccggagcccaggagccagatgccaccgccggtgcctactactacgtgaagaccgctgacgaccaggagtagttaggangctctaaggangaaggcttgcttttcgattgtagatgcttt

SEQ ID NO: 85458 - DNA, 522 bp, Triticum aestivum
  unsure (1)..(522): unsure at all n locations
  Clone ID: PAT_TA_85458
gaatgtagccaggagttgtcttaggttagtctaatgtgccaaaacgttagtcaaaccacctaggttgtgtttgttctggagagttcagctagtccgagtgatctgggttatcctacgttttatccctgtttcgatctttttttcgactataggggttttgtagcagcccagcagcatccgtgtgacagagagtcatattaaggatataataatgctttcccccccttgcagaaaaagtaggaaaatggactgaaattgttggataagtggatttgcagtatctcaacaatcagaacagcgaatattccatcatccaaactaagcttcctcagatcctaacccattggtcattatcgagcctcgtgactccggctgtgttgatacttcgtatacctgttatcattctatcatctggtantgcttatgtgtggttggatttcactattaagtagtatagttactgattcaatgactgaagattgcaatgctgacatctgtgtatgaagcgagggaaggcaccaa

SEQ ID NO: 85459 - DNA, 251 bp, Triticum aestivum
  Clone ID: PAT_TA_85459
cctaaagtttgcagcagaaaatactttttatggaccgcggacaacgaggatgaagacgatatcttgacatcgagtaccaaggccaagagttctgcatcatcgaagggcaagagttctgcatcatcaagggcaagagttctgcatcggcgaaggatgacgatgatgccttcatgtagtttttaagctgtatttttagtttttaagttcagttctacaatttattcagatgtacttgcattaaaaaaaaaaaa

SEQ ID NO: 85460 - DNA, 335 bp, Triticum aestivum
  unsure (1)..(335): unsure at all n locations
  Clone ID: PAT_TA_85460
naccagcctcctcagtcctcacagcatcctctcagtccttagcttccttccctcgccgccacccaccaangaaaggaggatgtcttgctgcggcggcaactgcgggtgcggcgccggctgcnagtgcggcaacngctgcggcgggtgcnagatgttccccgacgtggnggccaccgccgncgccgccgccanggtcatgcccanngcctcccncaagnngatctccngcgggttcgngacggcnngngagaccngcggctgngactgcaccacctgnaantgtggcaccggtgtgctgctnctgctgcagtgcaactganncngcgtccatgagg

SEQ ID NO: 85461 - DNA, 188 bp, Triticum aestivum
  unsure (1)..(188): unsure at all n locations
  Clone ID: PAT_TA_85461
tgcgcggctgaggcagcacccaaantaccaccggcgggagaatntcaagaagaagtaccagncgcacgnccccgncnaccatttcnaggtcgncgacgtngtcgagctcgtccgcncncgccccatctccaagnccaatcacttcctcgtngtccccgtnccgncccgngacaccngccgcaagncca

SEQ ID NO: 85462 - DNA, 182 bp, Triticum aestivum
  unsure (1)..(182): unsure at all n locations
  Clone ID: PAT_TA_85462
gcgcggctgaggcagcacccaaagtaccaccggcgggagaagatcnagaagaagtaccaggcgcacgaccccgacaaccagttcaaggtcggcgacgtcgtcgagctcgtccgcncccgccccatctccaagaccaagcncttcctcgccgtccccgtcccgccccgcgacacccgccgcaa

SEQ ID NO: 85463 - DNA, 254 bp, Triticum aestivum
  Clone ID: PAT_TA_85463
gtgaacaccgccatggagcgccttgccaaggctgacgtgaggtatcgattcgtcatcgacatcggcaacaccctcgacaaagccgccgccgcctccgagtgactcgggatctctgtttttgtcagcagtaacaagagagacaattagtctgaatttatatttttgtgtgtgaaagcgtacgcctgcaggtataggcgctacttgttgtatttataattttattatatgtgaaggaatacattaaaaaaaaaaaa

SEQ ID NO: 85464 - DNA, 195 bp, Triticum aestivum
  unsure (1)..(195): unsure at all n locations
  Clone ID: PAT_TA_85464
ntttttttttttttttttattcaaanagttcccagtatttcncnataaaacattggtctcttacanttcnagtggttgaagacgagcaaaagagggaggacaacanggcangtttaaaacggnacatgaaangaattaagatgcgncaaaatgaancttagnttcatacgggcancgncctcgtnatgacncctt

SEQ ID NO: 85465 - DNA, 437 bp, Triticum aestivum
  unsure (1)..(437): unsure at all n locations
  Clone ID: PAT_TA_85465
ttgttccaccgtgagtgagtctgtcagcgctgcatccatccatggcgtccatgctctgctcctactccgtctccatgcccgccgccgccagggctccgctcctccggtccagcgctantgcctacgccacctcggtcgggttcgccacctcgnagctcgccggcntcagcctcagcctcggcntcacctccanggccgcggtctccntccccgccaagaacaccatcgtngcgcgccggatctgccccttcttggagaagaagacgaaccgggccaacaaggtgtncttctccaaccacaagaccaagaagcagcagnttgtgaacctggagtacaagaagctttngtgggaggccggnaagcgntangtcaagctnanggntctcannaaggccctcaagancattnggaagaaggggcttcgacgcngtngccaa

SEQ ID NO: 85466 - DNA, 515 bp, Triticum aestivum
  unsure (1)..(515): unsure at all n locations
  Clone ID: PAT_TA_85466
tcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaagttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatganggatangttaanccttctcactgagagtggnaacactaaggatgacctgnagctttccccctnangatnttctgcnttggcanattaanaatggggntttnttaatgnnaggaccntatccntntctggaaantncccccaaaagggggaaa

SEQ ID NO: 85467 - DNA, 488 bp, Triticum aestivum
  Clone ID: PAT_TA_85467
tcgaggttgagtgttgcgcctggctacgcccagctcctcccttgcgaccacgtccatcgccatgagctcctccttccttctctgatccggccatgagctcctccttccttctatgctccggccatgagcgactccgccgctgtgccacacgccaccacccgacagcaagcgccgctagcatcctgccggcccttcggctccatctccctccaccatcggtcactgcccacatccacataaacaacattttcttctggatgcagttcaacaaaagaatatgtagcaattcttcagtgtcttattaccccatcaacaattcatcccgtgttggtttttgttgcttgttgtttaaaaaaagaaccatttcggccaattttgaaaaaaatgcagtgtaaaagatgtgctctcaaacgtacttcaactacttaactggttatgtatcatttaaagtggaatatactgtagtccaatgtttgaaaaaaaaaaaa

SEQ ID NO: 85468 - DNA, 274 bp, Triticum aestivum
  unsure (1)..(274): unsure at all n locations
  Clone ID: PAT_TA_85468
acacacgccaaaccgctattattagcacccccgaactcctacacggcggcgcaattgcatccagttctcgcgccgcccccgtcccanaatcccttcncgncctcgcctcgtngccggtaatggcgggtcccggnatcggagcggccgcgcntcgcctgnngcngctgctgcngcngctcgtcgtcgtcttcgcgggcncctnccgcnacagccgcacnnaggcggcngtgcggacgtgcacgtacacggnnaaggngaaganganctgngcggg

SEQ ID NO: 85469 - DNA, 407 bp, Triticum aestivum
  Clone ID: PAT_TA_85469
aatgtaaacaaaaatagcagcctttatttaattatgagcatatgaattatgaatgaaaacaacacataggataacaaacagtttcattattcagcttcaaagtcgagactatatagtatagtcctaggcattattctgattcgaaagcaagcaaacatttggaaatgggaagtacatttggacacgaaacccccggaattcatgggaatacttgaatgagtgaacgagcgcctaagactggcatcatcttgtagtcgctaaatccagcttcaaagaaaatcttgctccactcgtgctcgtcccgctcagccccattctccatcatcatgtaaagatcaaacagaacctgtgtctccgtctccttggaagaaccagcaccgacgaacgaaatcgattataaggggggg

SEQ ID NO: 85470 - DNA, 512 bp, Triticum aestivum
  unsure (1)..(512): unsure at all n locations
  Clone ID: PAT_TA_85470
cttcacacaggcaagtagtggggttcgattcagaggttcagtcatggcagctccgacgagagggctcgtcctcgccgtccttctggcgatcgccgtcgccaacgccgaggcggcgtccgtcgtcgtcggcctggccaagtgcaccgactgcaccaggaagaacatgaaggccgaggaagctttcaaaggtcttgaggtggcgatcaagtgcaagaacgtccacggtgactacgagagcaaggccgtgggtgccatcgacggcaccggcgccttcagcgtgcccctcgcttctgacctccatggcgccgactgcgtcgctcagctccacagcgncgccttccaacgtgcccgtgcgccggccangaggcgtcaaagattngtgcccgtgtctgagagagccanctttcggnatcatcgccggtgacaacaccgccanactgttcngaggnattngcagaggtgcgngtcatgaaattttgcggacgattaaaaagccatnatcgaanaatttc

SEQ ID NO: 85471 - DNA, 161 bp, Triticum aestivum
  unsure (1)..(161): unsure at all n locations
  Clone ID: PAT_TA_85471
ccatggcgccagggacatgcgtggcggccatccccgacctccccgacgcctataagccacccccgcgtcaccggcgcccaaccctagttttgctcgcccccatctccctctgcntccctcctnagatccccctccttcttgatctccgcnanggacncgtc

SEQ ID NO: 85472 - DNA, 292 bp, Triticum aestivum
  unsure (1)..(292): unsure at all n locations
  Clone ID: PAT_TA_85472
cccagctcggtttttgggccattctaagccaccatgcctgcctccatcgccttcggtcggttcgatgactccttcagcttggcctctttcaaggcctacatcgccgagttcatctccaccctnatcttcgtnttcgccggngtnggctctgnaatcgcctactccaaggtgagcggcggcgcgccgtttaancnatcggggntnatcgcngtggaatttgccanggggtttcggggttttnagnnggggtcncgtgggggaaaaaaaattncgggggggaaatntaaaaccc

SEQ ID NO: 85473 - DNA, 447 bp, Triticum aestivum
  unsure (1)..(447): unsure at all n locations
  Clone ID: PAT_TA_85473
agacgctgccggcgaccacgacatggttcatggacaactcctacgcgttgccttccccgccccgacccgctgccggcgtgggcgccgccagtagcaacatcaacagcggccggagtagcggcggcgggcggggatgataacgccacgtcggacaacaacaactgcggcggctcgatcccgtcatggggcgacatttcgacgttcgcaatgctgccgtagaaacttcaacgacttccgagtgcggattccgaagaatcggagcttgttgctagggaggctaatttatccctgttattaattcattagcggatggttggtcnctaacngggttnagatatacnaagtgtattaattttagntcttattatgaagtgatatagnggcccgtcaattnttcanagaaaccctaaatnaggaattccntggtattcangtaatttttcntta

SEQ ID NO: 85474 - DNA, 231 bp, Triticum aestivum
  unsure (1)..(231): unsure at all n locations
  Clone ID: PAT_TA_85474
gtacaagcctgtccccaagccctcancgccgacgtcgccgantccgccggcgccgaanncgactncancgccctanaagccgnngacgnctaatcctccggggtanaanccccccagcccgagncccccgnctccggcgtaccancantaagaagntccaccactctgtnaagttgggaacccnggatgcngtcgagaagagttnttccaaggaaggccaagaagagccaa

SEQ ID NO: 85475 - DNA, 187 bp, Triticum aestivum
  unsure (1)..(187): unsure at all n locations
  Clone ID: PAT_TA_85475
ctnggaanaaacnttcctcggtcttgtaccncncgcatggataaaaccncatgcttttttccncagaacgtgttgccaaanattcaaactccgacttttancttgaacantgcttatgatgggtggcagcntcaagaaagtctgggtcccanaacgggttnnccccggggnnctaagggnaaagttg

SEQ ID NO: 85476 - DNA, 298 bp, Triticum aestivum
  unsure (1)..(298): unsure at all n locations
  Clone ID: PAT_TA_85476
ggtaatccaatccgcacagaaatccccatctcaaaaccctagccctcatccccgatcccggcgagcgagatggccaacccgagggngttcttcgacatgaccgtcggcggcgcgccggcggggcgcatcgtgatggagcnntanaaggacgcggngccgcggacggnggagaacttnngcgngctttncaccggcgaaaaagggggtnggnaaaaaggggaaaccggntgaatnaaaggggancgcntttcaccgggtgntncccgttttttncaagaggggggattttcnngggtaa

SEQ ID NO: 85477 - DNA, 400 bp, Triticum aestivum
  unsure (1)..(400): unsure at all n locations
  Clone ID: PAT_TA_85477
tttttttttggccaaattctgaattcctccacaggccttgacataggccagcgaggtccagttctgaatttcatgatgttctgaatagagctacagcttgtatatcatcagtcaagcgcataatcgacacgccaatagatttctcagttgctaaaacgagaggaatttcccgctaaacaacaatagatatgcgccgcttccancgcggganaagggatcgaatccgcgctancagccagttaatcatcccctgncgngcaatctctaaaatggtgttggcttcggcggcagatggacaaaangaggtcgtgtgggattgaatggtgctgatgacgatcacactttgcncataacttacaanntcgatttttctnnaggggggccggtancaaatncccca

SEQ ID NO: 85478 - DNA, 454 bp, Triticum aestivum
  unsure (1)..(454): unsure at all n locations
  Clone ID: PAT_TA_85478
atcattgctatgctagttgcttcgttctatcgctttgctgcgctacctattcacttgctactcaagcctcccaaattgccatgaacctctaacctttgtcacccttcctagcaatccgttgtttggctatgttaccgctttgctcagcccctcttatagcgttgctagctgcaggtgaagatgaagattgctccatgttggattatgtttatgntgggatatcacaatatctcntatattattaangcatctatanacntggnaaagggnggaangctcggcttatgctggngtnttnttccacncttggcgcccnagttttgtcataccggggttatggnncntgattttgcgtcctcanacgggtgggngnattatnggaccccctgaagncggnttgaaaaaancnttcaggaggccnaccntgggntacnattgccnnccaatttttccc

SEQ ID NO: 85479 - DNA, 334 bp, Triticum aestivum
  unsure (1)..(334): unsure at all n locations
  Clone ID: PAT_TA_85479
ctcatcctcccanntctgttcctcggccattcnanccaccatgccgggctccatcgcnttcggtcgcttcgatgactccttcancntggcctctttcaaggcctacatcgctgagntcatctccaccctcatcttcgtcttcgccggngtcggctctgccatcgcctacactaaggngagcggcggcgntgcccttgacccatccgggctgantgccgtggngatatgncagggttcgggntgttcgtcgcggtgncatnggggncaanatctncggngggcacgttaaccctgncgncacttcggnctcgnctcggtggcagntaccatgtca

SEQ ID NO: 85480 - DNA, 233 bp, Triticum aestivum
  unsure (1)..(233): unsure at all n locations
  Clone ID: PAT_TA_85480
tgacgctcaagcagcccgggttncatgggctccgcgatatnctacaagtccgccgagangaagaagctgcaggacgccgggtangtcatnntcngccaacatangcgancagtngancgntttcctcggcgcgcccnacgganctcgtactttcaagctngcccgaccccctgtactanatcagnnaancttgcgggcattnattggaacgaatcctcntggnccangaataa

SEQ ID NO: 85481 - DNA, 169 bp, Triticum aestivum
  Clone ID: PAT_TA_85481
ggcctgcctagcgcgcacacacagtcacttaccatggctccaggtgtccaccatctccttgtgctgctcctagccttcacagccttcaatggcagctctgcggcgtctcgtcgtcttttggacacggcagctgcaccagaaaccaccacagccgatcaaaaaaaaaaaa

SEQ ID NO: 85482 - DNA, 247 bp, Triticum aestivum
  unsure (1)..(247): unsure at all n locations
  Clone ID: PAT_TA_85482
cctagccgggtcaccccacgaacccaagaaaccacatccgaacccaaatcttcgcctctccgtcgccatggctctctcatcnctcttcntctccctccccctccccatcccgaagcngccatccacctccaaatcaaaccgcttcctccctatccgggcctctgccgccgccgccaccgcctncccatcntttgnnctgcgccgctantggacntcnctgatctcggatgtnganggcgagttctat

SEQ ID NO: 85483 - DNA, 505 bp, Triticum aestivum
  unsure (1)..(505): unsure at all n locations
  Clone ID: PAT_TA_85483
aacaattctagctagaaagtgttccagttcctctgcagaaattaaaatcaagactttagtaagacaataaagaaatttcaatgctggaatactgcaatgcgcaccatttcaggacttgctagtaagcatctgtaattgcaatttctttaggtgataaatgcaagtcataccatcagtttttaaccaatttaaataatgacagtgctggatgccaagatagattttctccgtactgaagtgcaattaaaaagaaaaggcgcatatatcttgtagctttacttcctatttccgtttgttctttctcctagggaaagtaatatggcccgtgcccttgtttccnaatgccggaaggtaccctaatttcctgatttccattccatgccatactancnggacgatgtaagtttatccccccaaaccgataaggttgccnatgaaggctttaagccattgcttattttccctnaagccaatacaccggaattagttcatttccccccccccn

SEQ ID NO: 85484 - DNA, 179 bp, Triticum aestivum
  unsure (1)..(179): unsure at all n locations
  Clone ID: PAT_TA_85484
gaactagtctcgagttttttttttttttttttcggacgaacataccatatattgctgcaagtaacagctgatgctgcaacagcttattgtgtaggtggatacacacggaagaccctgggttgcaacgaaaatccccaattgggctgnccttttaaattccccgaaaacnaatggatgcc

SEQ ID NO: 85485 - DNA, 468 bp, Triticum aestivum
  unsure (1)..(468): unsure at all n locations
  Clone ID: PAT_TA_85485
taaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggaagggcgtcctcgatcagcaaggagtgctgctccggcgtgcaggggctgaacggcctggccccgcagcagcccggaccgcaaagatagctgcaggtgcctcaaagacctcgccaccaagcatcaagtccatcaacatgggcaaggtctcccggcntnccccggnaattcggtntaagtngccnttccccaatanaaattccaaacaaattgnaanatttnaaacnttncaaataaaaaccctcccaaa

SEQ ID NO: 85486 - DNA, 332 bp, Triticum aestivum
  unsure (1)..(332): unsure at all n locations
  Clone ID: PAT_TA_85486
acggctagggtttatccagccgcccgccgccgccgccccgcccgcccgccgcttcccgcngncgcccgacnagggcttactcncccctacncaccaccnaggcgccgggncatggacgcagcggcgctcgangacgtgatccggcaactcctgnaggcgcgcggcgggcggacggtgcgccccgcncagctctccgacgcggagattcgncgcctctgcgcngncgccaatgacgtcttcctcagccancccaanctcctcgagctcnaagancccatcaagntcngcngggacatccatggncnatattctgatcatcancgantacttga

SEQ ID NO: 85487 - DNA, 241 bp, Triticum aestivum
  unsure (1)..(241): unsure at all n locations
  Clone ID: PAT_TA_85487
ttcaaggcctccccgcagagctctcgatctagatctcagatcgaggccaccaccaagcccctcgaccacctcctccttccttcaccggctcagctccctctggcgcgcgccgctccacctgagctccagtgcctccccgcaacacatccttctccctcctttccccttcttcctctcttccttcccctgcctccnagtttttttcccttttnccctggganatgaacggggnnccanaaaa

SEQ ID NO: 85488 - DNA, 516 bp, Triticum aestivum
  unsure (1)..(516): unsure at all n locations
  Clone ID: PAT_TA_85488
gcgcctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccgccgaccccgagaccttcgccaagaaccgggagctggaggtcatccactgccgctgggccatgctcggcgcgctcggctgcgtcttccccgagctgctcgcccggcaacggcgtcaattcggcgangccgtctggttcaaaggccnggtcccaagttntttaancgaagggcggcttcaaatacttngggnaancccangn

SEQ ID NO: 85489 - DNA, 396 bp, Triticum aestivum
  unsure (1)..(396): unsure at all n locations
  Clone ID: PAT_TA_85489
gccgaagcagaaaaagcatcgtctcgtctcgtctcgtcgaggaatcaacagccatgggcggcggcaacgcgcagaagtccaagatggcgagggagaggaacctcgagaagctgaagggcggcaaggggagccagctcgaggccaacaagaaggccatgaacatccagtgcaagatatgcatgcagactttcatctgcaccacctctgaagcaaagtgcaaggagcatgccgaggcaaagcatccgaagagcgagtccgtccaatgcttccctcacctcaaagcaatgatatctgcccaatcaagacagagagagagtannagagagagagagagagaagctgtccataatccaccttactatttacatgttccccgcaaattgactgattgtttga

SEQ ID NO: 85490 - DNA, 224 bp, Triticum aestivum
  unsure (1)..(224): unsure at all n locations
  Clone ID: PAT_TA_85490
ccgctcccccacaccccgccggcgatcgcgcgatggcggcggccgcttcccctcccgcggcggcgctggagcagctgagcaagaccaagatgttcggcggccacaacctccgcttccgccaccagagcgccgccctcggctgccccatgaccttctccctcttcctccccgcgtcgcgggctcaaagctccccttgctttanngggtccccgggctaanttgaa

SEQ ID NO: 85491 - DNA, 334 bp, Triticum aestivum
  Clone ID: PAT_TA_85491
ctccgttggttggcaaaccacaggccaccccgttcggatagatagccgcccgcctccgctctccccaccacacggccacaacccgactcaccaccgcgcctcttcctcctcccgctcacccacccatggcgacggctatgatggctgcagccaccacctcctgctccccgcgccgagcgctcctcaagcccgcggcctcctccagctccgcgccgccgcccaggccgcagcctcggtccttcctcaagcagctcccggggctcgccgcgacggcggctgcggcggccgtcgcctccgtgcctctcccggccctggccgtggagatggaaaaagg

SEQ ID NO: 85492 - DNA, 233 bp, Triticum aestivum
  unsure (1)..(233): unsure at all n locations
  Clone ID: PAT_TA_85492
gataaatanaanatagncacatngtatcacanntacacacatctcccatacacatgtcatttanttattccccanacanaggtatatctagcagaanacnacccttaaccnacatctcccaanaaccttttttaaaaccgggggttnnttcccaaaanggaaagcttcccggnggntcccccgttnaaaaatttnaattttccnaaggggcccaangggnggaaatttttttt

SEQ ID NO: 85493 - DNA, 180 bp, Triticum aestivum
  unsure (1)..(180): unsure at all n locations
  Clone ID: PAT_TA_85493
ttttttttttttttttttttctgtcatattttttttctcctatttttcnatttttattttaaaaataggaagggcgagatagaattcgagcactataggcggggcgattaccatatataacataagacttctcccccaattcngttaagtcaagcttcccgatcngtcatnatnccccaa

SEQ ID NO: 85494 - DNA, 204 bp, Triticum aestivum
  unsure (1)..(204): unsure at all n locations
  Clone ID: PAT_TA_85494
cttcctcccgctcactcccgaaccgaagcctcaagagctcccaatggcttccaccacgttctcctccgccttctccatcctctctctcnnctcctcctcaccatccccctccgcatcggcccccaggaccctccccgtcgccaancgccggcngntgcncgttncgatggcnnaaangcaggggntncctaaagggctttanac

SEQ ID NO: 85495 - DNA, 284 bp, Triticum aestivum
  unsure (1)..(284): unsure at all n locations
  Clone ID: PAT_TA_85495
cttcctcctcctcttcctcccgctcactcccgaaccgaagcctcaagagctcccaatggcttccaccacgttctcctccgccttctccatcctctctctcccctcctcctcaccatccccctccgcatcggcccccaggaccctccccgtcgccaaccgccgccgccgcgccgtcgccgtcgcttcaacggcaatgaatncccaaaggcctttanctncggganccaattgcngggtnancttntggnggncccaaccttttgaaaactccaaaaatttggggt

SEQ ID NO: 85496 - DNA, 188 bp, Triticum aestivum
  unsure (1)..(188): unsure at all n locations
  Clone ID: PAT_TA_85496
actctccactctccactctccacaccagagcccaagcattcgcttcccgtcgtctcctctcctctctcgatctcagtgaagttttccgcaaccaacagcagccagatggctcgtttcgccgtgctcgcggccatcatcgcggtcctcgccgtcggcggcaacgggntaangggcccanncgggggccc

SEQ ID NO: 85497 - DNA, 235 bp, Triticum aestivum
  unsure (1)..(235): unsure at all n locations
  Clone ID: PAT_TA_85497
gccangtatgtccanaaggtctggaaagtacgatttganttagagggaaagttggaganggggangattganaggantgttagaaagttgttttgccaccaacaaggtngagagatnaggtggagggcgaaagatctcnaggacaaagcaaccnagtgtatnaanaaaggangctcttcagaaactatantcaatttgtgggggaatttttangaacccataaccntttnccatt

SEQ ID NO: 85498 - DNA, 193 bp, Triticum aestivum
  Clone ID: PAT_TA_85498
gatcatgtggcccttcatcgagagcaagaggggggactggtacgacgccaacctccccaacagcagcctccacggcctcaacggctaccaggtcttcatctccatcgccatgatcatgggcgacggcctcttcaacttcttctccatcctcttccgcacctcctacgacatgtacctcaagcgcaccggccgc

SEQ ID NO: 85499 - DNA, 313 bp, Triticum aestivum
  unsure (1)..(313): unsure at all n locations
  Clone ID: PAT_TA_85499
ccccaatcccactcgcgcagcagctccaagaggatcgtcagcgaccatgtccgggcgcggcaagggcggcaaggggctcggcaagggcggcgccaagcgccaccggaaggtgctgcgcgacaacatccagggcatcaccaagccggccatccggaggctcgctcggaggggcggcntgaagcgcatctcggggctcatctacgagganacccgcggtgtgctcaaaatcttcctcnanaattcatcgggnaacncttcattacacgaaaaacccccgcnaaaantttcccccaggggtttttnaccntnaagc

SEQ ID NO: 85500 - DNA, 279 bp, Triticum aestivum
  unsure (1)..(279): unsure at all n locations
  Clone ID: PAT_TA_85500
ccgagatcaacctcgacatctcgcgcacgccgccgtccgacggccccatggatgcaccgccgtcgcaccagcagggcggcgggggcgggggcatgatccccttctacccctccgtcgcccgccccgccggtgtcgacatcgaccatctcctcnangcctccgtccccaagatggnggcaccaccangggggcccggaaanggcnactttcggnaaacctgttngngcgggnttaaaaaaaccccccctttcgggccgngggggtttnacaatntttaaa

SEQ ID NO: 85501 - DNA, 240 bp, Triticum aestivum
  unsure (1)..(240): unsure at all n locations
  Clone ID: PAT_TA_85501
cgtcggcctcccctcccctaaaaaatccccaatcctctctcgtccccatccccaatccccgatctcccgaccccgacccccgacgaaaccctagccagcaaaccgcggcggcggcggcaatgggcaacccgganaagctgatggcncagatnttcgacctcaagttnaggtcnaagtcgctnaagcggaaggcggcncaattgcganaagggggaaagggatnaaancccnagggataag

SEQ ID NO: 85502 - DNA, 160 bp, Triticum aestivum
  unsure (1)..(160): unsure at all n locations
  Clone ID: PAT_TA_85502
gcagccctcctccccgccgctttcttctcccgctcgccgcctccgcctccgccaacctcctgggctgatccccgcgccttgaaccaagatgtatctccagtactacatcaacgagaagggcgtcaaggtgtacacacaangaaggaatcccccccggtgt

SEQ ID NO: 85503 - DNA, 297 bp, Triticum aestivum
  unsure (1)..(297): unsure at all n locations
  Clone ID: PAT_TA_85503
caccaatgaggtccgcgccaagtccaagttctggtacttcctgaggaagctcaagaaggtgaagaaggccaacggccagatgctcgccatcaacgagatctttgagaagaaccccaccaccatcaagaactacggcatctggctgaggtaccagagcagggaccggttaccacaacatntacagggantaccntnacanaaccntnaagggngggntggnccatttntacanggaaatggttcncnnaaccttttgtttcccccnggaaacaatttnanaaagcngcngggnggttt

SEQ ID NO: 85504 - DNA, 243 bp, Triticum aestivum
  unsure (1)..(243): unsure at all n locations
  Clone ID: PAT_TA_85504
ctcgacctcctctttcctcccactcaggatacaagtggaacaaggcaagggcgtaggtgctactcaggcacggcggcagagccaagcacaccctcctctcccaaggaaatcatcgagcgagcaaggtccacttctaggttctaacgctcgctgcgtcctccctgattcccacccttctcttcttcatcgcnagtgccggcggcggctggtaaanaggcaacccganaggtgaaggggntaaaa

SEQ ID NO: 85505 - DNA, 291 bp, Triticum aestivum
  unsure (1)..(291): unsure at all n locations
  Clone ID: PAT_TA_85505
catccatccatggcgtccatgctctgctcctactccgtctccatgcccgccgccgccagggctccgctcctccggtccagcgctagctcctacgccacctcggtcgggttcgccacctcgcagctcgccggcctcagcctcagcctcggcctcacctcnacggccgcggtctccctccccgccaanaacaccatcgtcgcgcgccggatctgccccttcttgganaagaanacgaaccgggccaacanggtgtcnttctccaaccacaaggaccaagaagcatntttttgt

SEQ ID NO: 85506 - DNA, 333 bp, Triticum aestivum
  unsure (1)..(333): unsure at all n locations
  Clone ID: PAT_TA_85506
ccctcccggcgccgcctccagcctagggtttcctcccgccgcccgtccgccccacccgccgccatggcccgccgcagcggaggaggaaggtcttcccgccctgctccacgtgctgctccagtganaaacccaccagcgccagcccgtccagctcctccacctgctaccacccagagcagcggtggtggtatcatgagcgggattgggtccaccattgctcaagggcatggctttcggtactggaantgcaatggcccanagggctntnnatgctgtaanggtcccnttacnattcancatnaaatnttctcgntgnggctgcngnatntaatg

SEQ ID NO: 85507 - DNA, 224 bp, Triticum aestivum
  unsure (1)..(224): unsure at all n locations
  Clone ID: PAT_TA_85507
ccctcccctgcctgccaacccccaatctcccgtcgcagccctcgaatctccccccgagcatcgaccatgtcggcctactgcggcaagtacaaggatgagctcatcaanaacgctgcctanattggcacccctgncangggtatccttgctgctgatgagtccaccgggcaccatcggnaagcgcttcgccangcatcaaattttgaaaaanttnnaggaaaacc

SEQ ID NO: 85508 - DNA, 400 bp, Triticum aestivum
  unsure (1)..(400): unsure at all n locations
  Clone ID: PAT_TA_85508
cctgcttctccctcttctccccctgttagttagcgcagcggnattgcccggnggcgggtcgctcttggtcgtggtcgtgggcgtgggcatgatgatgcggngggtggcgccacccgcgtcngangacgacagctcggggtccggcgtgcccggctggctggaggcgntcntgngaacctgtttcttcctggcctgcgcggngcacncgggctccccncgnaangagtgaaacatgttctgnatngactgccgcgccaccgcgccgcattctgntantacngccnctcncaggcgncacacgtcgcaccgggtcatncagatacggnggtcgtcnnacacaactggtnngcgtcangagtggaggacgtctcaanancgcnggtgtnaanantagtnataa

SEQ ID NO: 85509 - DNA, 179 bp, Triticum aestivum
  unsure (1)..(179): unsure at all n locations
  Clone ID: PAT_TA_85509
gcagcacacaactctctccacccccagcaatccatccaccnccacccccctttcccctcccctcccgagctcggnantggnaaacgcttcgtcagganctgggatccatgangactgcantctgaggttcgtggagctcatntcnaagaggatgcaccgcntcatancctacaggntgg

SEQ ID NO: 85510 - DNA, 447 bp, Triticum aestivum
  unsure (1)..(447): unsure at all n locations
  Clone ID: PAT_TA_85510
agaacctctctgccaagcttgaaggggatgacctagatgctttcaagaagaatgttgagtccgccacaaagtatcttcttagcaagctcaaggaccttcagttctttgttggcgagagcatgcatgatgatggcggcgtggtgttcgcctactacaaggagggagctgctgatccaactttcctgtactttgcacangggctgaaagnggtcangtgctaancgcantgtatgcnaaaatcnatgctgtcntcagtatttntgctcntancnatggttgtcactcnactctccantgttggngtcagtanctgtcagatnttgagtgtcttgaaaactttccngaaaattgtggatttgctttgtanggggnaatcgngaaattggtgggttgtgtttggnnaaatcagganattctgcncggttaanccaacnggnnaaaaaaaaa

SEQ ID NO: 85511 - DNA, 166 bp, Triticum aestivum
  unsure (1)..(166): unsure at all n locations
  Clone ID: PAT_TA_85511
agaagangctgccaaggtcgacggcgganaagaagangcnatggcntccgggtggggcatcaacgggagatcaggaaagantatgggaanagcgtcagganagcgtnaaatcatgtnctcttttaaccacncaccagaacatacacannttctttcnatnancatc

SEQ ID NO: 85512 - DNA, 152 bp, Triticum aestivum
  unsure (1)..(152): unsure at all n locations
  Clone ID: PAT_TA_85512
cagacaccgcccctcctcttcctctgctctcctctcctctcccacacgcgtcctaacgcaagcaaagctcggcggaaagcggntcggacgcnatgggcanggantgcggaaannaggganaggaaaacntcgggcaaatttgcngncttttg

SEQ ID NO: 85513 - DNA, 204 bp, Triticum aestivum
  Clone ID: PAT_TA_85513
gagcgatgagtccgtgggggaagaagtgatcgtcagagtggactctcccagcatgctctcgttcaatctaccctccggcccaccgcgaggcagctgacggttgcagcttgtaccgatattttctccttgttgtataataaattttgtgaccaatggtagtatggtaccatggcgtgtgtatatcagtatattaaaaccccccgt

SEQ ID NO: 85514 - DNA, 235 bp, Triticum aestivum
  unsure (1)..(235): unsure at all n locations
  Clone ID: PAT_TA_85514
ggaagctgcaaggtacgaaggtgtccgtgggttttacaggggcatcacttccaacctattgaagaaccttccagcagcttccgtgacgtttgtggtgtatgaaaacgttatcaaactattcagagcagccaaggagaagacgtaattccaacttgcaactggagccaggagaaacataggaggaactaggaaagacactaatgttccgcgcaaaatacaaaatcntcattcacaa

SEQ ID NO: 85515 - DNA, 160 bp, Triticum aestivum
  unsure (1)..(160): unsure at all n locations
  Clone ID: PAT_TA_85515
gaggaaaatttgcaaaataagcttatctttttgctaattgttgtgctaatcctccgatgtctttgatcaccctagccttttctatgtaatatatactctcatttgcccttacccttaatatctggctcacgctccgccaaaaaangaaaacnaacaaaaa

SEQ ID NO: 85516 - DNA, 283 bp, Triticum aestivum
  Clone ID: PAT_TA_85516
gatcgaagcacttgggcaagggcacctcagcttatacctgttggcaccgtggataacaccctgcatcacatgatggctaggtcacatttgaattagcgaaatttgacgcatggaagcaatttgactttgtcttgaagcatactctccatttgacagtagcgtttttttctttctttgcaaacaaatccttaatttgaattagaaccgtgtgtaattgtgattggaaatatctttctctttggtggaagcaatataatttttggttgaaagcaaaaaaaaaaaa

SEQ ID NO: 85517 - DNA, 190 bp, Triticum aestivum
  unsure (1)..(190): unsure at all n locations
  Clone ID: PAT_TA_85517
gttganctacctctccctctccaacaanaanctcanagggcnaatcccaacatcgattanacacatgcaagacnccatcctctatatgntcntccgcaatgatccatactctccggctgcntccccantagaactcggaatgntcactaaggaccgccgtcatttacgccgtggatgnaccagatcaccg

SEQ ID NO: 85518 - DNA, 531 bp, Triticum aestivum
  unsure (1)..(531): unsure at all n locations
  Clone ID: PAT_TA_85518
ccggagtccagtccaggcacctagctaccgccgcgccgcgccaagagccacctcgtccccggctagcgcgcggcaatgtcttccaacggcaagcccaacccgcagccccccgccgccgccgcggccaccaacggcgcgggcgcgggcgggccgcccaagatgtaccagcgccccatctaccgcccgcagggccccgccaagggccgccgcgggggccgctcctcctgccgcttcagctgctgctgctgcttcttctgggccgtgctcgtcgtgctcctcctcgccctcgtcgccgccgtcgccggcggcggttctactcctctaccgcccccaccgcccggcttcacctctcgtcgcgcgggtcaacaactcagctctccantccgccacgggccgcgtcacgatccatcgactacctaacgccaagaaccaacaagantctctactgtacacgactcacgtcacgccgcanggcgcaagcgtgcctcgggaagcacgtccgggtctgcagaggcaacacacacgtataan

SEQ ID NO: 85519 - DNA, 468 bp, Triticum aestivum
  unsure (1)..(468): unsure at all n locations
  Clone ID: PAT_TA_85519
gcccctggtactgctccttctcacgttcctgctgctgttgctcgtcttgtgcccctggtgctgctcctccttccctcgtccttgctgctgctctctccctctctgttgctcttctctgaatcccctactgctactactccacttcctctgctccccttcttcttctctgaatctcgctgctgctgctcctcctcttaaaactgctgctgctccctctcncactttcctcgctgctgttccctctctcttctcancaaaattgctgctgtcctcntctcnatttgcttgctgcgacaccttcctgaagctctntcaacttnantntgttctgtatagtactgttttgtcgtatgcaanttanttngcngtaatattcanatacntgtatattntgttgaagcgatncagtgaactgaaattgnatatnctcaaattantctaaangtagaanttntgaacgggggtcaa

SEQ ID NO: 85520 - DNA, 513 bp, Triticum aestivum
  unsure (1)..(513): unsure at all n locations
  Clone ID: PAT_TA_85520
ttctgcgagggcttctcgtcttacggccccttctgggaccactgcctcgagtactggaaggagagtctagccaggcctaacaatgttctctttttgaagtatgaagagatcaagtcggatccggtgcaagttcgtgcggaggctaanaaaattcctcggngtcccgctgtctcgaaaggaggagagatctgggtgttgcccaanaggtggtcaggttgtnnagctttgagatgcttactaccctacangtaaaccagatgggtggcattgatcgtggaaacaaatgttatgtaggtaatcnatgttttttaaaaaagaaaattggaactggaggaacacatgancangaaatgggggaaaaattagacgcacgtccgaaagaanccaggatnaggccncttttgataacttgatttgtacttanaacgntccnacttagccntaagggcatgtgcatccgttaatctggangaacaagttaacttanagggggccgnaccaatccctaatgat

SEQ ID NO: 85521 - DNA, 229 bp, Triticum aestivum
  unsure (1)..(229): unsure at all n locations
  Clone ID: PAT_TA_85521
atccagcccttgctgctcctcgtctccgtcttcttggccgggaagaaaggaagggaaaggaagcggcggagaccaggcgatggcggcgccgctggatttctggaagngcaaggntncaaccngncgggacttgggggtttgaaaccccccncgcgnantttaanangggggaccttgggaaaantcncccaaagttngnaatttcccccccccctnttttnaaaggggg

SEQ ID NO: 85522 - DNA, 364 bp, Triticum aestivum
  unsure (1)..(364): unsure at all n locations
  Clone ID: PAT_TA_85522
gctcatcggactccccgacgccgccgtcgccgccaacatgaccgaggtctgcgtcaaggccgccgtcggccaccccgacacgctcggcgactgtcccttctcccagagggtgctgctcacgctggaggagaagaaggtgccctaccagatgaagctcatcgacgtcagcaacaagcccgactggttcctgaagatcaatccggagggcaaggtgcctgtgtataacggtggtgatggcaaatggattgctgattctgatgtgatcactcaatcattgaggagaattacccaatcancattgngacccnctgantntcacagnggataaaantctcccactngaattttttnaaaacaggtccag

SEQ ID NO: 85523 - DNA, 371 bp, Triticum aestivum
  unsure (1)..(371): unsure at all n locations
  Clone ID: PAT_TA_85523
cccgcttcctcctcctcttcctcccgctcactcccgaaccgaagcctcaagagctcccaatggcttccaccacgttctcctccgccttctccatcctctctctcgcctcctcctcaccatccccctccgcatcggaccnaggaccctccccgtcgcnaaccgccgccgcngcgccgtcgccgtcgcctccaccgccactgagtccccnaatgtccttgagctcggcgacgccattgccgggctcanccttgaagaggtcgcaaccttgtcnatatctccangaacgtcntggcgtcnctgcagctccttgntcccgcagcgcgggtnggggtccnccggggggggggccnggggnccgttaaaaacggttt

SEQ ID NO: 85524 - DNA, 247 bp, Triticum aestivum
  Clone ID: PAT_TA_85524
tgaactttgaactgtggcatatgcgttgccacaccataggtacagcaggacgacattttaagtatccagtaaaagaaaacaattaatcacactcgtgttctctagatttattttccagtacaagaaaactaagccgtcgtcgccgtcttgttgctgttctccctcgcgcgcatttcgtcgagcaggtgcctcgccggcggcgagaccatgacctcccactccgcaaagtcggcctccacctccgccg

SEQ ID NO: 85525 - DNA, 295 bp, Triticum aestivum
  unsure (1)..(295): unsure at all n locations
  Clone ID: PAT_TA_85525
gaaatcctttggctgatgttctctagccacgacgacgtcgacatcagttggtgtcgttcccctcctcggaggcgtcgtcgaggtttgtgccctctctcccccgctgcagtcccgggagaaatcccttatctttctaagactggtcagcaacgatgcgtcatgcgtcgcctccttcttgaaggtgctagcttgggcaaggttggatagtgatttgctgcgtctttggcgagggatttggnccatggttctttgtctcnnanagtgtaggcnaccgtcctcttnttttggttggngc

SEQ ID NO: 85526 - DNA, 341 bp, Triticum aestivum
  unsure (1)..(341): unsure at all n locations
  Clone ID: PAT_TA_85526
cgaagccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcntcggcaagagcggcaanccgctgcactanangggcancnccttccacngcntgntcccnganttcatgtgccagggcggttanttcangagggggcanngggcangggaggctanccatngagggg

SEQ ID NO: 85527 - DNA, 354 bp, Triticum aestivum
  unsure (1)..(354): unsure at all n locations
  Clone ID: PAT_TA_85527
ccccctccagccgacgcaacgcctcctaccacaacatcttcttcacctccttctccacccccaaaccctaccccgtacccctctcccagctgctcccctcatccgtttcccccttcctccttgccatccacaacganacttcctcgcagaagcctgcctcgccccggggcggtgagctcaggctgctcgacctgaccaggcgcgacgctgnggcgatnncagcctcctngctcngctcgcgtnggcnnacgtgctngnatcctcgggtaangacngtgcaccnanagctctgggnaggggtnttcncttgtgnnggggggcccanngctngaaggngggnggggggttntcttt

SEQ ID NO: 85528 - DNA, 236 bp, Triticum aestivum
  unsure (1)..(236): unsure at all n locations
  Clone ID: PAT_TA_85528
gcttccaggcctccgacggcgtgctcagcctcggcaacagcaacatctccttcgccgcccgcgccgccgcgcgcttcggcggccgcttctcctactgcctcgtcgaccacctcgccccgcgcaacacctccagctacctcaccttcggccccgacgcctcnaacggcgcctcatcttcnaggacgccgctgctgctcnacgccctggtggccccgttctangcngtgacggtcgac

SEQ ID NO: 85529 - DNA, 263 bp, Triticum aestivum
  unsure (1)..(263): unsure at all n locations
  Clone ID: PAT_TA_85529
ccaccgtcgancggcaccaatccacggtttancctgtcaggtgnttctcaggttccatggnttccatgcagcaagggagcggnggnatccttgctctgcatcaagctcgtggtctgcctcngcttcctcggatnatcccanggtgcgggccncacctctgcttccatgctgtccgtgtttcatnagcatttctgcttncgtccaaanacccctgctccantcttcgcggtnaataacttgcaatnctccctgggagatgattc

SEQ ID NO: 85530 - DNA, 277 bp, Triticum aestivum
  unsure (1)..(277): unsure at all n locations
  Clone ID: PAT_TA_85530
gtccaactgcagcagttgatccgtgaggttcaaggtgaaggtgagttgaacgtcgacatgctggagaagattgtctcggtggcggaggggtctgtcgtgttttgtacagacaactgcgtggggctcatctccatcgacctcgacaccatggagtgtaagcgcgttcacgacgagaacaagtactacgggccagagtacgtgtaccaggctgacatggcctcccacnatccgancttgnttaccatganccancantcccgcnctctttttatttggg

SEQ ID NO: 85531 - DNA, 297 bp, Triticum aestivum
  unsure (1)..(297): unsure at all n locations
  Clone ID: PAT_TA_85531
ctcccttcttgctgagctgagcacgccccttctccctcaactttgggctcgaggcaatggcggcgctcgctccgacgaagatgctcggcacccggctcaacttcgccggctcctccaggtacgccacagcggcaccaactgctggcgcacagaanatcgtctccctctttgatcgcttcaagaagaagcccgccccgaagccgaagcccgcccccgtggccacctcgagcgtgggcatcgacgacnanctcgccaagtggtacggtcctgacaggaggatctacttgcncaacggtc

SEQ ID NO: 85532 - DNA, 304 bp, Triticum aestivum
  unsure (1)..(304): unsure at all n locations
  Clone ID: PAT_TA_85532
cgcccccgaangccctagctccaagctccctccccatccgcgggggncgnctcgtccccctcctccncctcggcgcctccaacaccggactaacccgtcgggaaaatgagtcaggagacngtcaaccccaaggnctacccgctggcggacncgcagatgacgataacgatcctcgaactcttncaggcaggtcgccaactacangcatgtcangaagggcgccancgangcgaccaagactctcaanangggaatancngngttcgtggtgatggcagctgacacggngccgctctaaatcttc

SEQ ID NO: 85533 - DNA, 510 bp, Triticum aestivum
  unsure (1)..(510): unsure at all n locations
  Clone ID: PAT_TA_85533
ttcgagcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagattccagctggcattccaggtagccgggcgaacaactattaccgtgcagatggccagaacacgggcaacttccttacggaccgtccttcaaccaagttcatgctgctcctggcggtggtcgtcctgggcactgtttggcggaatgtgtnatgatggtctgcttaatgaacgacgataattggctgtacncgtatcangtggnaaaatggatgttggttganantacactgcntcaantaccgtcggaaggtcatggntcaactacnccncttggaacactgccaaactgtcctc

SEQ ID NO: 85534 - DNA, 503 bp, Triticum aestivum
  unsure (1)..(503): unsure at all n locations
  Clone ID: PAT_TA_85534
ggacgaggtaagaagcagcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctctccaacttcatgaagggaaaggaggagaagaacattgctgtggttgttggtacaatcacagatgacatgcggatcaagaggtccagcaatgaagttaccgctctgaggtnanagagacacganggcangattgtcaatgctggtgggatgctcactttgacacttcacccgtctcactgggaaaaacatctgtnagggaccagatgccgtaggcgtgagactcgaaggct

SEQ ID NO: 85535 - DNA, 510 bp, Triticum aestivum
  unsure (1)..(510): unsure at all n locations
  Clone ID: PAT_TA_85535
cacaaacctgctcatactccagtgttttctgaactcccaactcaagtggatctgtctgcaggtaatttggttcctgtgcaagtcctcgaacggaagatggtgaagaaaggcaacgccgcgcacgtgcaaatccgggtccagtggtcgggtcttccggaagcagcagctacgtgggaagattatgaagtcctgaagaaacgctatccggcggcaccagcatgggggcatgctggatttccagcgggcggcactgtaagcgaccaagagcatatgggtggcgaggcaagggagtaaaggggcacgagtgaatagaggctgttgggctttggggccttgtaataggaatagggctagtgggcgttggctctctattggactacgtactatacacgaccgttctcagatcgcagcaatttatcatactcctcatttaccccttccaatcttctcactcaagacaaccatcgtaatgaatccctaagatgataccgcantgtatctaaaaggggn

SEQ ID NO: 85536 - DNA, 356 bp, Triticum aestivum
  unsure (1)..(356): unsure at all n locations
  Clone ID: PAT_TA_85536
cccactccctctgatccaatcgagattgaggcgcaccacaccgacgtcgctccgcctccacaccgatgccgccccatccccacctcgctccctcgtccctcttggtgccgtcccgaccgcatcgcccctggcacggctacccgtcgccctaagacgtccaccgccgcctggaacaccgcctgnaccttgccggancacgtcctcgcanacgttggagcccaggagccagacgccaccatcgacgacgactcctaatacacctggagtgcctactactatgngcaggccgttgtcnacnacaaggantattttaggaggatcctaggcaggagcctgnnctctttcnntnggtaccc

SEQ ID NO: 85537 - DNA, 241 bp, Triticum aestivum
  unsure (1)..(241): unsure at all n locations
  Clone ID: PAT_TA_85537
gccgagctcgccgtccacccacaccactccccgtcatcttggattgaacgccagccaccaaagcatatcataatcccctcgctcctccctcaccacgccgcccagatccgcnatggcgctcctccctaatccatcttcctcatctccggtgcggccccggggcgacattacaggtgctccatcccgacnttagggggccgagcctcncatctccatctcnattggggcttcggntgccggt

SEQ ID NO: 85538 - DNA, 437 bp, Triticum aestivum
  unsure (1)..(437): unsure at all n locations
  Clone ID: PAT_TA_85538
ctagtctccagtttttttttttttttttttaattaacaagagtacattctacataatcagtgcatgagtagccttgaagtagatagcctattagcaactcttttttagttactccctctgttccgaaatagttgtcgttgggagtttctagtgcaatttccatcgcgttacgacatttctgtcatttccgaaactaccctcccactccctctctcgctcagctcagcnactcgctcgctggctcccgaatccctatctcacngnagccggcgcctctccgtngcacgcgtccccggngcctctacnccgcacgcagcgcctcgacctctccctctcgcgtcatanccgccttgcaangttgcatacgccntcgcctctccctttgcagganttaattttacccngncggttggatagaaancncggntgctcaannn

SEQ ID NO: 85539 - DNA, 330 bp, Triticum aestivum
  unsure (1)..(330): unsure at all n locations
  Clone ID: PAT_TA_85539
agacagggtccgcaaagcaagcaccgcccggcaaaggcaagaaagagccatccatccatccatcatccccttcctcgtgcgctgctgcctcttgcttctttcttcttcgtctagtaccangctcaagctacatagatatccatggtttttctctccttgcttgcttgcnaattgctgcangttgtaagtagataggtgttatacgtagtaggagctactantagataggcggcgggtgggagaggagatgaagctccatctcctgctgaaggtcctgttcggccccgtgccggtctacttcncggcgctggncatcctatcctgctgaca

SEQ ID NO: 85540 - DNA, 191 bp, Triticum aestivum
  unsure (1)..(191): unsure at all n locations
  Clone ID: PAT_TA_85540
ttttttttntcacnganaatcgcttntatttcnagattagattgcaccanaagatgccacngntgtanattcgcgtgctactttgctatttgaatggnccttttgctaantaagccaaccaatcgattnntcgtcaacatcatttacatcancnttagacaacccgtgtnatataaagtacacagcangtt

SEQ ID NO: 85541 - DNA, 431 bp, Triticum aestivum
  unsure (1)..(431): unsure at all n locations
  Clone ID: PAT_TA_85541
cgcccatctctctcgctcatgtctggtcctctcgatccccttgcgccgccgccacagacgctggccgattccggccgctccggtgagctctagcgccgcccagcacacctacggctgctcctcgatgagctctgtctattcctccgcatcgatttattttcctctgctccttgtggtcgcccccttcagttatgtcttgctagggtttcggtcttggtcgtgctcctcctgctcgccggggctccgcgtgcgcggccaagctgccgccgccgccgccgtgcagccggtcgtgcncgatgctcaactgcnactcggtggggatccggtacggcaagttctgagncgtngggtggancggntgnaaggggatgaccctacgacgacntcnatgngtnctgcngcgagnacnanagttgcctcaaaaaaaantn

SEQ ID NO: 85542 - DNA, 356 bp, Triticum aestivum
  unsure (1)..(356): unsure at all n locations
  Clone ID: PAT_TA_85542
cttccctcccctgcctgccaacccccaatctcccgtcgcagccctcgaatctccccccgagcatcgaccatgtcggcctactgcggcaagtacaaggatgagctcatcaagaacgctgcctacattggcacccctggcaagggtatccttgctgctgatgagtccaccggcaccatcggaaagcgcttcgccagcatcaatgttgagaacgttgaggacaaccgtcgtgccctccgtgagctcctcttctgcacccctggtgccctccagtacctcagcggtgtgatcctgtttgaggagaccctgtacagagcancaagggtggcaagccttcgtgganatncnaaaggggggga

SEQ ID NO: 85543 - DNA, 466 bp, Triticum aestivum
  unsure (1)..(466): unsure at all n locations
  Clone ID: PAT_TA_85543
taatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggnganttcacccggggcaacggcaccggcggcgagtccatctacggcgagaattcgccgacaanaanttcgtcaaaagcacacaagccggggatcctctccanggnnaacgcggggcccaacacnannggtccanttttatctgacgtccctgnantggctcganggcaacantggtcttcggn

SEQ ID NO: 85544 - DNA, 447 bp, Triticum aestivum
  unsure (1)..(447): unsure at all n locations
  Clone ID: PAT_TA_85544
gccgctctccattccccatcccaccgtctcccgtccgctccacgcccccaccttcccaccgccgtccccagctcaccggcgccgtcctatcctatccttgccgctgcgtgcgtttgctgccgcgcggcgacatcggcgccctcatagctgggactcagcctagtcaacttcgattgggaggtggtgacgcgtccataccggcgaggaggtggtggttggggcacggccatttgcgagcagcaggagcggtggtggtggccagggctgcgccgtgtccggggcgaagtgcgccgcactgaggaggcgtcggcatcgacggcagggcgcggaggcgcacctcgattcaggagatgcncgcgcaggaggcgagttatcgctgtcaatancaatgcggcggaggcggnaanccnctgtcggcncttcgggagggatncccctccaactcna

SEQ ID NO: 85545 - DNA, 471 bp, Triticum aestivum
  unsure (1)..(471): unsure at all n locations
  Clone ID: PAT_TA_85545
gatggaaggaacaagaggtggaagtgagctcccagcatatgaacaatcgaggcttgcaagtattgcaaaaaacaaaaaaacaacctgaagaaacagctgaaccaccaacaacacttgcaatggaaattcaatttcatcgacaagatgaacaantttctactctactagggcacacagaaaaaatgcaacgataaattggagagatgcatcaagttcttttttctcaaggcatcagaaatgtggaaacattagggacaaatggtagaaagtagcaagtccactggctgattgaagatgttctcgtgattgcttttattgggaacatggatgacacattttgttcatacggaagttgatttggtttggcaattgaagagtggtcttcataagattctgtacagtagcatccantgaacaacacttggtccttatgaactttggccatatgttgtacatgtcnccctgtnaatt

SEQ ID NO: 85546 - DNA, 211 bp, Triticum aestivum
  unsure (1)..(211): unsure at all n locations
  Clone ID: PAT_TA_85546
atggagtcttcatgttcgccgctgtcatacttcactcagtgtcatggataacgagctacctagttggcgaggacaagatcgaggagattgcagcaacagagcagcggtaggcgaggtcagtagaagcgcatgttaaccaccncccatgtgcaagctaaaatgtcaanccccctgccancatngtcattgaccatggaaaaancantttcgg

SEQ ID NO: 85547 - DNA, 173 bp, Triticum aestivum
  unsure (1)..(173): unsure at all n locations
  Clone ID: PAT_TA_85547
atggcagggcgagcctgaattacagcagtgaagaggaaaaagctgctgctgttgaagcatgggttgcttgccatggcaaggaaccaaaatccgtaattggcctgcaagcatctgagatctcgtgggatcatganggtgancaccactattacaaggctggggtcccttggtgg

SEQ ID NO: 85548 - DNA, 182 bp, Triticum aestivum
  unsure (1)..(182): unsure at all n locations
  Clone ID: PAT_TA_85548
attaattgcctgaacaagtacgtcaagcacatcacacntacacatcgggtanactatagtacagcanngagttgacanttcantcacgcatacggncncatgcatacatgtcgcatanntatatatgcncacacagtgtgtgcgcanggtncatncatggncacanncacacactgacacag

SEQ ID NO: 85549 - DNA, 223 bp, Triticum aestivum
  Clone ID: PAT_TA_85549
cccaagcagagtgatgcaaccaaacagcggacttaaccagcaattctctgtgcacagctcctgaaaaacgaagatctggcagcttctttcttttttcaccttccatctttttttcccggacgtacttttggagcacacttctgtgcggcttttttccaattgtcccgtggatgtacagatggatgcatgtaagaataatcacattgtgatttcgaatacaagg

SEQ ID NO: 85550 - DNA, 482 bp, Triticum aestivum
  unsure (1)..(482): unsure at all n locations
  Clone ID: PAT_TA_85550
ctcgcgctcttccctgtgttctcatcctgttctgcgtctcttctcgccccgaattctgcaattcctgatccaaatcaacgcccttcgccacacgacctggccccaagttttgattgcggctggcggcagaggtgagcgagatcaggcggcgcggatgaatctgtttggcggcagtggcattgggagcggcgacatgccaccgccgcagcatcagcagttggaggaggtgatgggccacggcgatcccatgctagtggcgatgcgcaacaattaccgccagaggatattggagcatgcanaaagggtggtanctgcgagattacataaaggattgagggtactgctgactggcancgggggctgccggacttgcaaggcgggtcnanaaatcttgtttgaaaaacaccaancangngggagtactacancatganagngaccaatcaccnnatttganttggggtnaaaccnccttgccaaaa

SEQ ID NO: 85551 - DNA, 338 bp, Triticum aestivum
  unsure (1)..(338): unsure at all n locations
  Clone ID: PAT_TA_85551
cctcancgccaccattcctcgtcccgttctcanttcctcaatccgccccttcnacaatcccctcgcttcgcacngtcaagcagccangagccagagnccgncttcnagaacgagcncgnccgccatggcaagcttcggcnaggcatgancaccagnttcctctncnagctcggcntcgcgccgcgcaacacgggctccttcncctncggcgcntggggcggntcgggcnccntcntgaccancangaacactagcancaaccgaggtcattgctgaggtcttcgaggngtccatgntcgactacaagaaggggatnagcgcgtgcttctacnccgcga

SEQ ID NO: 85552 - DNA, 370 bp, Triticum aestivum
  unsure (1)..(370): unsure at all n locations
  Clone ID: PAT_TA_85552
cgcagcttcccattcctcgccgccgccgccgcttcgtacccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccanatgttccccgctcgcgcccgcagaaggttcaagaggggtctcaagaggaagcccatggcgctcgtcaagaagctgcgcaaggcnaaaaaggacgctcctgctggtganaagcctgagccagtgaggaacatcttcgtaacatgatattgnccnganatgattggaancttatcggttc

SEQ ID NO: 85553 - DNA, 250 bp, Triticum aestivum
  unsure (1)..(250): unsure at all n locations
  Clone ID: PAT_TA_85553
cgagtttttttttttttttttttaaatagaaatatacgttatagaattgccatcgataaaagtttaacagctgccatgatttctgacctcaatctaaccacatgtatacngtagataacaacaccagataattaacagccctgtgacctagggtactactacaggtacacatgtttaagcnanaggnccaacttaaaannccaggggtgttaantttgccangcctcggaattaaccagggnaccacaaa

SEQ ID NO: 85554 - DNA, 355 bp, Triticum aestivum
  unsure (1)..(355): unsure at all n locations
  Clone ID: PAT_TA_85554
aagagaactagtctcgagttttttttttttttttttatttcgtttcttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgancaatatcgcncccttcgnaacnatcttgnacanaggcttcaancnccnctcgattaccngcngnacaaggtgaatncccccagggntnncaaaacctncccccaaanttnnaaaaancccccccaaaantttgngnaagggggggga

SEQ ID NO: 85555 - DNA, 268 bp, Triticum aestivum
  unsure (1)..(268): unsure at all n locations
  Clone ID: PAT_TA_85555
gtcaccgcgatcgcaccccctccatacaaaatccctccgctcacccatcgacagcgcaaccaccaccaccgccccgccccgccatcgccatgcgcccccgccgcccatgacgccgccctcgtcgtcccagcccctcctcctgctcacccaccagctcctctccgccgtctccgtcctcgtcctcgacctcctcggncccgangccgantccgcncgcaancgnaggcggancgacagcgacggnnacggntacggcgctgtatgccgg

SEQ ID NO: 85556 - DNA, 184 bp, Triticum aestivum
  unsure (1)..(184): unsure at all n locations
  Clone ID: PAT_TA_85556
atcananttngtggtanatagtgccttctggttttgaaaggaatctgtactcacaacattcggctccaatttttaacttgtgtaaggcattacnacnaaantatttatttacnttttggcaacacaaccatgtactcnncacantganaaatatcaanagngancagtaagttagntactctaa

SEQ ID NO: 85557 - DNA, 400 bp, Triticum aestivum
  unsure (1)..(400): unsure at all n locations
  Clone ID: PAT_TA_85557
gagatccacctcgaagtaacccccctccctccctccccatcctctccttcctccccacgccctcctcccagcgcgagagcacgccgctgctgccagcggacgactgcggncaaggcggngaattgctctgctccgctccgctccgggccgggccgcgaggatgagggaggaggaggagcccanctggttcgcgcgcttcgacgaggacctgccggcgcccgacgagctcatgccgctctcgcagtcgctcatcacccgcgatctcgccgccgncttcgacatccccancacncacggcgggggcggcccgctcagcggcggcgccgacngggccggcggcgcgggcggccagganatgaacggcngcgcgtcctcggtcgccggctcaagcggcggcaac

SEQ ID NO: 85558 - DNA, 484 bp, Triticum aestivum
  unsure (1)..(484): unsure at all n locations
  Clone ID: PAT_TA_85558
ggaacatcattctacagcaagatacatccagatcatagaatagaacattacaaacgaaaacgaagaggaagggaaaaagaaaaaagaaaaacactcgctgttgctagaaaaacaaaacattggatctcactgacctttcaacttattgcgaatttgatcttggaccaactgtttcttgtcccttgaataatcagcttcctaccagctccctgaacatagtatacccctcatgatcgccaatagatctccctcctgtatacccaatctttgcaacgcatgcatgcgcgacgcatgcgtgtaaatagcaccaagatcacaaggtcagtccaatgaacaatccagcaatgcataagctctccatctgtaccggatatcaatagcttctccgccatttcaaacttcgtgatgtctcgtcgtgtgagtgtagaactgtggattgcactgctagacatggatcagaacgtggctgactcgccacgccgcn

SEQ ID NO: 85559 - DNA, 290 bp, Triticum aestivum
  unsure (1)..(290): unsure at all n locations
  Clone ID: PAT_TA_85559
gttcagggcttcaggctcagacgaggtgtgccgcctaaaataaagctcagatgagatgagcagtcatggtgcctatgcttgtgtgtgggtcgtgctatacggccaacaatatgtatactgctatcgtcgtgtcttggtcaatgtgttttctctctcgagaaaggctggtggtgcttgtacttgttcacctattctccgtcaataaacacatgtgangattgtacttgttcacctatccgccgtgaataaacacatgtgangattgtgcttgtaaaaanaaaaaaaaaaaa

SEQ ID NO: 85560 - DNA, 471 bp, Triticum aestivum
  unsure (1)..(471): unsure at all n locations
  Clone ID: PAT_TA_85560
aacatcttttctcccccgcggctatgatttctagggttcatctagcagtcgatccgtcccctgtctcgcgctgtggatccgttgttgcgctcgctagttcacacgcgagatcgagatggcttccactggtgaaaatgttcctgtacagtctaaagcaattttccagtcatgtttctctactattcgatgggccaaagctgttagtaagatgtctgttagtaagatgtctgtattgcagagaagctttataccagagcaatttaaacatcttctgaatgtgcgcgaacatgttattctgcccatggatttgcttcaatggctagcaaaacatatccgctatggtcaagtagtatttttgagcagagatagcattcatatcacctgagatatggttgatatggttttgggtggcgttctggnctgtcctttcgtcntgagacagtgatataagttgttgacaagtatgttaca

SEQ ID NO: 85561 - DNA, 491 bp, Triticum aestivum
  Clone ID: PAT_TA_85561
ttcaaactcaacgcctgcagataagcctagaatctaactgtgggagggattctacatcgtgttgaaattaaattgctcctcaagaaaagatctatgtgtatggcttctataaattctggagtcgttcatcttttgccccctgatcgttgccgtggcggaagcacttcggctcggcaagacctgctcttcccgacgagatctgaaggtatggtgatttttttgtacagggttggggcgcccagcgaagagcacctagcatctagttatttgacctccttgttctactcctggtagtgttgccgcaagagattttgagaaaagggcaagttggtatgcagatttgagtagctatagatgagcaaaccttgcttgctacagtacagggcatagatggatactagcagcagtattaataaaggccgtagttgtagatttgagaaatcaacagcatatcaaactggatatagataaagatggtcacacgtacacat

SEQ ID NO: 85562 - DNA, 474 bp, Triticum aestivum
  unsure (1)..(474): unsure at all n locations
  Clone ID: PAT_TA_85562
gactagtctcgagttttttttttttttttttaaactctaatgctccttgtttatccagagtgcaaacacatacaaattacaatgacaggggacttaagagtataaatccacaatttttccatgaaatgcaagccggtcgccagtgcactgcaagtccaacccccacatcactacactcaaaaagaagatacaacaaaagagagacagtgagctacaaaaacaaagatatggaccgctagcaccagctatactgcatgcctgctaggatctagcattcccgtgaaaacaattccaatgaagagaaaaaatgtgtacgccaagcggtggcatctcgcaggcggatgcaagcacatcatgtctcctcccctgggagctcatggcagcgggctgggaaaggcgaatcatggattgtcgctgccttggcaccagaacaaacgcgatctgaacgcatgcgctgatccaacgnacgtacat

SEQ ID NO: 85563 - DNA, 473 bp, Triticum aestivum
  unsure (1)..(473): unsure at all n locations
  Clone ID: PAT_TA_85563
actctttcccacttagctagctagcagccatggccgccctctcctctgcagccgtgtccgtcccttccttcgccgccggcgccaaggtggccgctccccggagcagcaggatggtggtgcgcgcgtccctgggcaagaaggccgccagcgcggccgtggccatggccgcnagcgcgatgctgctgggcgggtcggcgatggcgcaggacgtgctcctgggcgccaacggcggcgtgctggtgttcgagcccaacgacttcagcgtcaaggccggcgagaccatcaccttcaagaacaacgccgggtaccgcacaacgtggtgttcgacgaggacgcggtgccctccggcgtcgactctccaagatctccaggaggagtactcaaccccccggggagacttctccgtcngctcacgtcccggcactacgnttcactgcaacccacccggaccggatggtcgnaagtaacgtcaa

SEQ ID NO: 85564 - DNA, 468 bp, Triticum aestivum
  unsure (1)..(468): unsure at all n locations
  Clone ID: PAT_TA_85564
accagatttcatttctatctcatccacatacccactagttttatatacccagtcctccgttgcctccggctgttcttccttatgcgttaaagaatatcatgtatttctgatttgcttgaactctcgtggctttgtaaaggctcttagcttctagttatgtagaggtcggatgtatgtggtaccagcttgtaggtaattcctaggttttcagagcagtggtaattgctctggaaggctggttggtgcttcctgctccaaaccttgctttcgtaatcacatatctatcaatctatggctgcaccagtagtgtacctgcaacnccctganacgcatgtggctcctgtnaggcactattatagttagagaaataagtgacagagccttgtatagtgatcagcaaatcgcataatgctgcgcgtcgtatgcatcagtcagctganacatatacttgtgcatgtacttgcanac

SEQ ID NO: 85565 - DNA, 204 bp, Triticum aestivum
  unsure (1)..(204): unsure at all n locations
  Clone ID: PAT_TA_85565
ncaagtggnagtanttcgattcaaaggttcaggcatggcanctccgagaacactcgtcctcggtntcctgctggcantcgccgtcgccaacgctgaagcggcgtcagtcgtcatcggacagnccaagtgcgccgactgcaccaagaanaacatcaangccgangaagccttcaaaggtctacaggtggcantcaagtgcaanaa

SEQ ID NO: 85566 - DNA, 273 bp, Triticum aestivum
  unsure (1)..(273): unsure at all n locations
  Clone ID: PAT_TA_85566
catcctctcctcccctccgccacacaaactccactccgctccgctccaccgccggcaatggcttgagctgagcgacgaatcccctcccctcctcgcgccgaccggggacagccaatggcggcgcggccgccgcccagcccggccaccaccccacaccgccaccaccaggtccacaaccacctccgcctggcggcaaggcccggccgccgnaaccgcnagctnacccgctgnttccnggagcgttccnantccccaaanatcccngaacccccc

SEQ ID NO: 85567 - DNA, 478 bp, Triticum aestivum
  unsure (1)..(478): unsure at all n locations
  Clone ID: PAT_TA_85567
ccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaacttgaggatacgttccttcatcccacaactgtgactccccatgttgaccgccaagatatcagtgattgacataactgatgatggtattcagcttctaactgagatggaacacgaaggatgactgaactccactgatgatttctgctggcagtnaagacggttgctgatggaaggactatcttctgtgattc

SEQ ID NO: 85568 - DNA, 482 bp, Triticum aestivum
  unsure (1)..(482): unsure at all n locations
  Clone ID: PAT_TA_85568
tcgaaccaaagcggtacggaagggaagcaggcgccgtctccgtcgccgtcgtctcgttcgtccccaaatcttcaccgagcttccgctccgctncncgcccngcgaagaaacccggaggaaggaatggacaattatnacagaancacccgctttgaaccccttaganacgctcnatttgctctccgtggtgcctttgggtacctccaactcatctttcaacaacatggatggccttagacactcctcaagcattgggcaagcaaagagctacaatcttctcccttangantctgcgacagaagatcctccatctggaaccgttcctacataaattctcccctgtccgtcctgttnccaaccgccatgtctcccactcctctgaagaacacagtgacgcacttctcactcaaccgtttattgggttgccnggngctgcatcattcatcctctgcnaacatttggtnattttaggccaantaann

SEQ ID NO: 85569 - DNA, 439 bp, Triticum aestivum
  unsure (1)..(439): unsure at all n locations
  Clone ID: PAT_TA_85569
ggataccanaangcacaagccgctcacgcccacgccttctccgncctcctcctccntccaanttttcncagnctcagnaaaggaccacctgcngaaaggcacatccnccgcagaattacatggactttcctcgcangagattcgattcngtcatctgcttnatgtgatgatagctcntataccatggtttacattatccattacagnacaggantcctgaaatgctganaagctccatgtttcntcctgctggttccttgaccaaacaactgtactactatnaagggaggaaaccagatgaatattgcagtnccacgtgtnnctcggcattacacatacttggtgatgaanananccaagatggcaagttcgaaagatcctccctcattggtgtggatngatgggttgtttccnttacnttccgtgccctnattgggac

SEQ ID NO: 85570 - DNA, 472 bp, Triticum aestivum
  unsure (1)..(472): unsure at all n locations
  Clone ID: PAT_TA_85570
aaaccggcggcattaaaccctccccacctcttcatatccgcttccagacacttctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcangtacgacaccgttcanggccactggaagcacagtgacatcaactcaangacacaagactctgctctttgggcgagaacnagttacgtcttcncgtcangaacccnangaatnccntnggtgaggtggtgccgatacttgtgggtccaccgggtctnacgaaaggaaaggcnctgctcntnaaaggnggtgcaanaggggtan

SEQ ID NO: 85571 - DNA, 473 bp, Triticum aestivum
  unsure (1)..(473): unsure at all n locations
  Clone ID: PAT_TA_85571
agaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaatttgctgcggttccatctgggtggtggtggtgtggctgtttcagctgctgcccctgctgctggaggtgctgctgcccctgcagctgatcaaagaaagangagaagncntggagaaggaagagatgatgatgacatggcttcatccgttgactanttgtgggcactgtgtctgaagtacnaccctgggcaggaaacagatcatgagtttaccttatg

SEQ ID NO: 85572 - DNA, 471 bp, Triticum aestivum
  unsure (1)..(471): unsure at all n locations
  Clone ID: PAT_TA_85572
ctttcttcctcacaggcgccattggcgaccgcccaacgagcacctcccccccacccaccttctaccgcggagcggccccgtgggttcctccccaatcaccaccccatccttgcgccggcccgtgggcagccggatccagtccgccgcgacgcctcgccgctggatcggggacggcaccgccgctcgccgctcggccacacgtcgccccctggccggccttcttccagaggcccgacgacgcgccgccacaacaagcctccccgccacctccctccctgtcttcctcagctggacgtcgccatggcgggcgatgctctgtctccgcccgcagcccacccatccctacagatngacctctcttctcattcgtgtcncccgcggtnangatgagcccgcataactacgcatctggtcntccgtggtgccggcacatcacnaagagccantncacatgcaantcctnaactcctc

SEQ ID NO: 85573 - DNA, 461 bp, Triticum aestivum
  unsure (1)..(461): unsure at all n locations
  Clone ID: PAT_TA_85573
gtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccatggcggcgacttcaccaggggcaacngaccggaggcgancatctangcgagaattcgccganaaaattcgtcacaagcaaccaaccggattctctcatggcnagtcggcccacacaaangtccattcttatctgacgtncctgaatggntcaaggnaacactggtctcggcagtcgtcaagcat

SEQ ID NO: 85574 - DNA, 234 bp, Triticum aestivum
  unsure (1)..(234): unsure at all n locations
  Clone ID: PAT_TA_85574
accgagttccagcttttggacggcttgtctcagaaccaccactatctgtccatctggcatatatttatcctcgatatcctcgcaagaacaagctacaaagtatgaattgaaaaatgtgggtcagcgtaagcgacagcattgcaccaatgtgtactcacactatcacatgatcaagacgaaaccntgtcaaganttgggggccnangaaaanaaaggggccaaaanggnattttt

SEQ ID NO: 85575 - DNA, 174 bp, Triticum aestivum
  unsure (1)..(174): unsure at all n locations
  Clone ID: PAT_TA_85575
tttttttttttttttgtcacggattatcacaatgcacaataattggcttgcttacactttcctcaatcttcagagttcaaataaattcctttggataatgttcnangaaaaactggaatcacgtcctaagtccgtnaanaattttgccccgtaacagacaaaaantacaactca

SEQ ID NO: 85576 - DNA, 263 bp, Triticum aestivum
  unsure (1)..(263): unsure at all n locations
  Clone ID: PAT_TA_85576
gctgaagcagcccggtttcaagggctctgcggtgaactacaagtccggcgagaggcagaagctgcaggacgctgggttcgtcatcgtcggcaacatcggcgatcagtggagcgacatccttggcgcgccggagggcgcccgcactttcaagctccccgacccnatttacaaaatcggtagggttttccngnaacaatgatccccnaatcgntttcacaangaaaanccccnngcttaaaaaaanggagtttgnaaaaaacccc

SEQ ID NO: 85577 - DNA, 227 bp, Triticum aestivum
  unsure (1)..(227): unsure at all n locations
  Clone ID: PAT_TA_85577
cttcaaggcgatgcaggagcgcctcgacgtatacgtcgtcgaagatgcggccgaggaagatgatgtaccggctcctgcatatgatgtcgtcgtgctcattgcccaggccgaggaggtcctgcgtgcgacgcaacaacaactcgaccaggcggtgctagccgcgtctctgtcgacgatgcatgcagccaagcgccgggcanctgaaaaagaggctgcaactcnaaacc

SEQ ID NO: 85578 - DNA, 186 bp, Triticum aestivum
  unsure (1)..(186): unsure at all n locations
  Clone ID: PAT_TA_85578
gcctggtgttttcaccttgcttgcctaatataaagttgaagcatcacacagcttgtacaaccaaaccaggaacacagggacaaggttgtgttttcaattaaactgggaaacattgcttgctttcgtcagcaagttaaaacatattccaaancaccanaaacatgcttancccggtgatacacctta

SEQ ID NO: 85579 - DNA, 252 bp, Triticum aestivum
  unsure (1)..(252): unsure at all n locations
  Clone ID: PAT_TA_85579
ccgggtcatcaaatcaaatgctcgtactccctcccacctcccgcccggctgcttaaaagcccattctcggtgccgcctctgacctcacctcacctcacctcatctcactccggtgcaacgcctcgcactcgcagtcataattccatctactatctttcttaccactagtaggagggccgaggantgctgctgctgctggagtttgtctgggtagagaggagagganaggaaaggaaaagganaggaattgaa

SEQ ID NO: 85580 - DNA, 469 bp, Triticum aestivum
  unsure (1)..(469): unsure at all n locations
  Clone ID: PAT_TA_85580
tttttttttttttttttttacccttcgaatcattcattatcgtcttcgacagcatcttaaatccgtaaaagctaattaatataaggaagtatcactgcattccactggtagtacaacactatcatgcatcgtccacaatcaaattaacaagaatggatgggccaatcaatcagagatgcatgaggggcacgtagttcttgaagatgtggtcgacgatgatctcatacgccctctgcgtggggtggtagctgtcgaagaacacgtgcttgtccacgtcgtcgcagacccccatgtacctcgtgtcacagagcatggtgacctcgatgagcccggagccgcagcagccgtgcgtgagctccgtgaaccccaccggtcgccgtgcacgcgagctctcatgatgtcgtaattcgaatagacacaaggtttgaacttggtcgggtnagcctgtcataactgctcaaccctgttg

SEQ ID NO: 85581 - DNA, 329 bp, Triticum aestivum
  Clone ID: PAT_TA_85581
gttagagccttttgcctaggctcggtatggacgagtcttttcgagagtgtggtggctagattggttgctctcgagcttcgtttgttagttttgggtcttggcgctcttccgtccagttaagatgatgcttcttgatgtgtgtgcgtgtgttgttctagtccctaccgccaagttctagtgtcttttttctgtttttctttggttttcgccaggcattgtggcttcggcctagttttcctcataaaccaggtcactttgtatttttttttctatcttaatgtaatcggcagagctcctggcttgcaccgtgaatttttttcctaaaaaaa

SEQ ID NO: 85582 - DNA, 512 bp, Triticum aestivum
  unsure (1)..(512): unsure at all n locations
  Clone ID: PAT_TA_85582
gcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatgatattcagcctctactgagagtgnaacacgaagatgactgaacttccactgatangtctgcttgcanattaaaatgattgctgatngnaaggctgatcngtcngtangtcgcatggggaaaaaaattgccntaagaacgtgg

SEQ ID NO: 85583 - DNA, 509 bp, Triticum aestivum
  unsure (1)..(509): unsure at all n locations
  Clone ID: PAT_TA_85583
agttttttttttttttttttgaaagtttgctgccttacattctggagttatataaaaattacagaggtgttctgaaaatttacacaaaggaccctagaaaggaaaactgaaaagccatcaagtccttctccaccgccgcaacagctacttcaccgccggtagtccttctcaccggagacaaaacaacaggactccacttccgccagcctgccctgctcgccgtgccgctacctcgaccctactcctcgcgccaccacacatctgcgctcccccgcgccgctcgcccggcccttgtctccgcatcgccgctcagccgtgctcgctggttcccggagaaagagagaggaccgccgcgcgccagtgcagcgtcgggaagctgacgccgaagggangactcctccgcatggccgtcgccgggcatcaccgctgctcggatancgatgctgagggagacncgtcgccgcgctagtatcacgtggaggacagcgcgccgccgtctccaggcacat

SEQ ID NO: 85584 - DNA, 495 bp, Triticum aestivum
  Clone ID: PAT_TA_85584
aacagacgaaacaagatgaaatactaattcgaactaaactcaaattttaaattgtcaaaaacatgttcaagttggtttactggacagaagggatcgttacgaagatttaggcgttggtttcctcgaaaacggaggtacagataaaaagatatgatcaaaagaagtttgagtatgaatctgaacaaatttcgaaatttgaaagttgcaaaaagtttatttgatagattcactagataggtggaatcaagacgaaaatattgacgttggtttcgtctaatttggatgaacgagtaaaaagttatggctatttgaaaaatcaaggcaaactgttttacggaagaaaaatatctacgtataagctacgagagtatttaaaacaaaaaagaggtagcaactcactccaagaggtcccgacggggtcctcggcgtcatcgcttctgggcctaagccttggtctcctgcggtaatattcaccacgtaatttctgccaagacg

SEQ ID NO: 85585 - DNA, 510 bp, Triticum aestivum
  unsure (1)..(510): unsure at all n locations
  Clone ID: PAT_TA_85585
tcgcctcctcctaaaccactctccctatccccgtgtccagaagctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaactcttaaaggtgtcaagatggagttgattgatgccgcatttccacttctcaagggantgttgcaacaactgatgttgttgaggcctgcactggtgtgaatgttgcggtatggtggtggttccccaggaagaagaatggaaagaagatgttatgacgaaatgttcatctacaaactcaacactgtcttgaactcatgcaccccattgcaagtctggtgttgcaaccacaaacatgnccatccgaagttgctcacatcctgagagaanattttgccncagacaaaaggnancgnaatcgaaac

SEQ ID NO: 85586 - DNA, 465 bp, Triticum aestivum
  unsure (1)..(465): unsure at all n locations
  Clone ID: PAT_TA_85586
ctcgagttttttttttttttttttcaaaataaacgaagcttggcattagcatgaattatttgccgcatatcacctcttaatctaatacccactctataaattcaaaattctgaactctaaaaaaatactccctctgtacaacttttacggttcaatgatcattgaaccgtaaaaacatcttacattagtgtacagagggagtaaaagaanaatataaatcacacggtaacatgaatgactgataaatgatcacttttaagttaaacatcggtgtaacattgaggtgattaaatncagttcaaattattccctatcaaaccatgttcgcttcttaggtccccaaattcnactcaantttgggcttgagttcacatgcttcctggtctgggctaaggactggtggcggaacacggcctgaangtcactagcganaatgnacgacnangggataccatanantaaacg

SEQ ID NO: 85587 - DNA, 534 bp, Triticum aestivum
  unsure (1)..(534): unsure at all n locations
  Clone ID: PAT_TA_85587
gaatcttattatggtccaatatcgcaaacacacttcaatttcagatagaaggatatacatctagatattgttgggtgcaggggttggagtttgtcgaattgtgcaccctctcccttctcaagtagaaatgcacatatctcgcgcccttacgcgcttgtagaattcagtagtcatatttactccctccttttgtatccaagttcttccaaaaccatgtaaataaactcccacatattcactggctccatattagttataaagtagntttgcctccacttctctttgcaccgtctttcngtagaaagggtttctcggcacatatatgacatgcaccacatctcaacatatacaaatcatcacattcttgccacaccaacatgatacatcctccgtaagaaacaaattggacaatgtgtcaccaggcaaagnggaccggactatacacaatgagaccactatcatggtccacacacttcgctcgctggttgtgtgagcacangaactacanaatgggtgtcactgccaaaaagcata

SEQ ID NO: 85588 - DNA, 252 bp, Triticum aestivum
  unsure (1)..(252): unsure at all n locations
  Clone ID: PAT_TA_85588
gcgccgccgtcatctacaacaagaaggccgcatgggacaaccactggatcttctgggtcggcccgttcgtgggagcgctggcggcggcggcgtaccaccagtacatcctccgggcggcggccatcaaggcgctcggctcnttccggagcanccggagnaactganccgcccccngggggggcaaaatttaatgcaacggtcaccaaccgcgcaagtaacngtnttggnanaagggccccccnntnaatgggc

SEQ ID NO: 85589 - DNA, 268 bp, Triticum aestivum
  unsure (1)..(268): unsure at all n locations
  Clone ID: PAT_TA_85589
ngncgcatccggccanccttcnccgccgcatccggccatgggtagcaagctgtgccgccgcatgctccacttcgncaacctccccatcaagctcatgctccccccggcccccctatcctccgtccanaagttcnctgtcangacngtcccctcngcctcnaangtcaacatccgccgcngcctcnagtccntctacggnttctccatcgccgatgtccgcacnctcaacatggagggaaagaagcaccnncgacgaccttncncgccg

SEQ ID NO: 85590 - DNA, 504 bp, Triticum aestivum
  unsure (1)..(504): unsure at all n locations
  Clone ID: PAT_TA_85590
gtcacatcccaatatcccatccctcggcaagctaaagatcccggcgggcgcggaccctcgacggcgggagccacgcgcgtggtcgttccttcgccgggcgagcgccggcagctccggttcttccttgtctccaggccggtggaatctccactgggtcagcctacgtgcctgcttgcacgccaggacggaggtttcggtctcggtgggttcatcaattccagtcgtgttggtgctgttgtgatgcctaaccacaagagggtggagtaccattgcatccatccatggaattgngacgggcaccgcctgtcacatcctttcagactcaatttgggaaacaagtcaccaagacatccaaggaggagatnncacctccgtnaagggatcgtaaatacatgatgaaggaactaaacgttaagatgcggtacgagaatagagaaanaatcncaaggatcngataagatcccccngctgggcaanaaatanggngacccaaggaaaaggttt

SEQ ID NO: 85591 - DNA, 171 bp, Triticum aestivum
  Clone ID: PAT_TA_85591
gtgtggcggccggagctcgagagcatagtggaggaggcctcggagtagagagctcgaagagttctctcgcctttctttaccccctcctcctcctattattcttgcttcctctctgtcttccgatgtgaataccacgatggagaacgtatttccagttctaaaaaaaaaaaa

SEQ ID NO: 85592 - DNA, 507 bp, Triticum aestivum
  unsure (1)..(507): unsure at all n locations
  Clone ID: PAT_TA_85592
agcagttcccctcctcaacccccgagagtccgccgcgcccacccgccagccccgatggcccgcacgaagcagacggcgaggaagtccaccggcggcaaggcgccgcggaagcagctggcgaccaaggcggcgcgcaagtcggccccggccaccggcggcgtgaagaagccgcaccgcttcngccccggcaccgtcncgctccgggagatccgcaataccagaagacaccgagctgctcatcngcaagtgcccttcngagcgcctggtgcgggagattcncgcangactcangaccgactccgcttccagactccgcgtgtccgcctccatgaggcgccgnggctactcgtgngctgttcnaggacacaactctgcgccatccatcnaacgctcacatcatgccangacatcanctcccncgcaccttgnanaggctagttgctctggtgtctatntganacgggtaanagttantctccnttacagttcgatntgcacngtagaaan

SEQ ID NO: 85593 - DNA, 508 bp, Triticum aestivum
  unsure (1)..(508): unsure at all n locations
  Clone ID: PAT_TA_85593
cgcccaccgcatccacactctgtcgcatcccattgccgcctccaccaccaccttgatccatctctctccttggtcctctctctttgagtagcatgcggcttccggctgcgtggtggagacgcagttggtcgagggaacgtgagtgaggtgtactgtgtatcattcatcgatttgttcccatctcctgttcctcttcaatcgaacatcgcgtctaaagttgctgcaacacatggtgctctcctttcctgtggtgatgcatataagtgacaacaatggtgtcctattgtcccctccatacgtccggccatcgtggcgccgaagtagccggagaagtngcactcngcgtacaaatctgcctgttgcntgtgcccgacaagtaatntcttcccnaaattctcnnanggaacttggcgctttganggaancgtcatttccaaggaanattggnatggcttttctccaggtgtgcaanccaaataacnggagttacaaatatcctccaggttaa

SEQ ID NO: 85594 - DNA, 383 bp, Triticum aestivum
  Clone ID: PAT_TA_85594
gaggacaacacaaccccggcggccgccccggctctccggcgcacgcacgcacgcacctctgaagaagaagctaaatgtcatgtcagtaaacgctgaattgcagcgaccggctacgatcgacggggctacgggtggttccgtccgtccggcgtgaagaggtggacggacgacgaactccgagccgaccaccggcatgtagtaatgtaatcgcttcttccgttcccattctcccgcacctccatgatcacccgtaaaaccctcctaagccccattattactactactactattattttaaatgtctattattgctactgtatgtgtattcctccaaccgctcatatcaaaataagcgcgggccggactttgttaaaaaaaaaaaa

SEQ ID NO: 85595 - DNA, 388 bp, Triticum aestivum
  unsure (1)..(388): unsure at all n locations
  Clone ID: PAT_TA_85595
gctacatgcatcgggtgcgtgggttttggtgcgttctctgtggcgattgagaagttcatggagcgatataactgaatcggtgatggaaacgttgcatcctataaatcgagtgatgctgtctttctagcaagcattagcaggattcagcattggccgaacaacttttggtttattttgcaatattcagtcgttggcatgtatgtactcagagatggcgtgacctaattttactctccgcggtatcaatcgcactgagtactatttgttccccaatctgtacccatttgattcatggattgggaancnantttgccttaaaaaaaagggggggcccggacanattcncccnanagtganctataaccnccanaggggcgtcttttaaaac

SEQ ID NO: 85596 - DNA, 476 bp, Triticum aestivum
  unsure (1)..(476): unsure at all n locations
  Clone ID: PAT_TA_85596
gcttggtggagcacggcgcggcaccacgcgcaaatcaaagcggcgcgagaaacgagaaaatctgacgcgggctccttggtggatcgcggcgcggcacccgcacggcgacgcggcgtgccaagcgagcccgacgaccgggaatgcctgccccatccttcctgccaccgccaaagggtctcgcatcgccgccggcgaactggctggaggcgggtgctaaaactgtcgcctagtactacacctcagcccatctgcgtcctgggaagaaataagattgggcctgtttgaacatgggccgagggttccaatgtgtgtcattcttatctccnactcgaatactcctggtagattatgctccaaaaaaaaaccctgtaattgtctgtttgtcncccaaaaaaaattaaaatttctctttccccataaaaaactaaaaatgtctaaaaaaaagggggccggtaccattcccctatatgatccta

SEQ ID NO: 85597 - DNA, 316 bp, Triticum aestivum
  unsure (1)..(316): unsure at all n locations
  Clone ID: PAT_TA_85597
gcagcagcagcattgtcccagagcgagcatcatcaactagctcatccggcaatggctttcaacccaaaccctccaggcctcggcttccccttccccttcttccctccacccaacacctacgctcctccaaaccctttcggtccaaggccgccaccaagccctttcggtccaaggccaccgccacgccctcaagcaccaccacctccacgacagcctgcgccacccgttcaacccccgcngngcctcaagcccaccaccacaacggaagcctgngcaaccattcgaccccgcggcttcaaggcgtgctcccccaaca

SEQ ID NO: 85598 - DNA, 481 bp, Triticum aestivum
  unsure (1)..(481): unsure at all n locations
  Clone ID: PAT_TA_85598
nctcnctccctcccctgcntgccaacccccaatctcccgtctcagccctcnaatctcncccgancatcgaccatgtcagcctactgcggcaagtacaangatganctcatcaggaacgctgcctacattggcacccctggcaagggtatcctcgctgctgatgantccancggcancatcggcangcncttcnccagcatcaatgttgataacnttgnggacaaccgccgtgccctccntgagctcctcttctgcaccctgngtgccctccantactcaccggtgtgatcctcttcgaggataccctgtaccatancaccaagggtggcaanccttcnncganacctcaagnaggaagtcctccccggatcaaggtgacaaggtccatccagcttgccggaacaacgtgaacaccaccaggcttgntacttgcaacnnncccaagtacatgagtggtgccgcttgcaatggctncatcctc

SEQ ID NO: 85599 - DNA, 277 bp, Triticum aestivum
  unsure (1)..(277): unsure at all n locations
  Clone ID: PAT_TA_85599
tttttttttttttttttggcactcgaatcgaattcattcctttgtagagcaaccagtccgtccaaaatcatcctgccaaggcaacatgttccacaccaacaaaaatcaaccacatgaagctaagcttagctcttcaacacaattctaaaaacaagaggctatttcaacaccacaacaaactagctgagaagcctatgaatctaacagccagcttctgggcacaacccagatagccacttgagcgtgtcaattcccccaatggctggntgcnaaaagc

SEQ ID NO: 85600 - DNA, 477 bp, Triticum aestivum
  unsure (1)..(477): unsure at all n locations
  Clone ID: PAT_TA_85600
gagtcgcctcgagccccatcccttctcctctctcccacgcaacctccccgggtgggcgcctggctagggttgccgccgccgccccataggcccatcccagctcatcctacgccggtcaccggagaaggcgccttcctcttctccccaaaccttctcttctccgcgttccatccgtcctcatcatggctgtanaaggggccngggaaggggtgtcatcgattgctgttcaagcggcaattgcaaccggaggggcccggcaaaaaggtgctatcnaaggtcttgcggaaatgttnttcttccnggttgttggattggccaaatactgacnacgggtaaatanagggctgttaaagattaagctccggtgcaacaaaaggnttnaatntccaaaanaaaaatcaaattggatttctccgtctttaatntgacnataacgggttcangctttaaattcctgcgtntttgnaaaaactaaaa

SEQ ID NO: 85601 - DNA, 377 bp, Triticum aestivum
  unsure (1)..(377): unsure at all n locations
  Clone ID: PAT_TA_85601
cccaccctcatgggcccctcgtagctccaccgacctacttctttcgcctatatatactcttataccctgaaaacatccacgggagccatgaaaccacttttccatcgccgcaaccttctgtacccgtgagatctcatcttggggccttttccggtgatctgccggagggggattctatcatcgagggcttctacatcaacactatacctcttcgatgatgtgttgagtanttaccacagaacttcaggtccatantaatagctagnggttcctctctctccttggntntcaaatacaantctcctccatcttccttgcaatctattgatgtatactttttncgtgtgtttctccnagggggcccgtaccattcgccc

SEQ ID NO: 85602 - DNA, 473 bp, Triticum aestivum
  unsure (1)..(473): unsure at all n locations
  Clone ID: PAT_TA_85602
acgaacccccctccgccgccgacctcgcgtcttctcctgtgcatctcggaggtgcttcttggtttccacgatgaagctgatcgctgcctacctcctcgcctatcttggtgggaactcttccccaagtgccgctgatgtcaagaacatcctggactcagttggtgctgaggctgatgaagaaaagcttgagttccttcttgctgaactgaaaggcaaggacatcacagaagtgattgcatctgggaagggagaatttgccgctgtgccttcaggtgggggtgccattgctgtgggagtccagtgctgcatctgggtggtggcgcanacctgctgctgatcaaagaagaggagaagttgaagagaaggaaatctgatgaaaatgggttcatctgttcgactaacactcatcatccccctacctctctttacctanactgtcccgtggctgcanaacgngctgcanaccaaanacn

SEQ ID NO: 85603 - DNA, 507 bp, Triticum aestivum
  unsure (1)..(507): unsure at all n locations
  Clone ID: PAT_TA_85603
agaggagccgggccgccggagtccatctccaccagcagtgcatccctgaatccaggcaggccaagggacccaaccgagctcatctccccaacgccctcacgtacctcgtcgtccaagatccacggcgtcttcccctcaatcacgccccccgctgaacgcccctgtcggcgtcttcctcattgcggtgccgtctccagttgctgtctccactccactgtcttcaatcttctgcttgggagaggtatgagcaatcttcggcttggtgggtatgattcggcttnaatggccgttaatggcattggttcgacaaccttatgtatatagtagtagtagtgtaacattattggttccntaattagtgttnggtgcgcatggggattgctgattggtnaaatactctgccctcttgttctctctgatgacgaaggnttggatatgnantgtgaatatccgttntcnaaatgaaccaaaattgcntttgtnatatgtcaattcncgnaaataant

SEQ ID NO: 85604 - DNA, 485 bp, Triticum aestivum
  unsure (1)..(485): unsure at all n locations
  Clone ID: PAT_TA_85604
gaacaccatgtcggtgaccaagttcaacgccatgatctccggcctgttccagctcgggagcgcctatgagtgggtcgtcaccaagaaatcgggccgttcttcggagggcgatctcgtcgccctcgtcgagaacgagaagcaatccaagcagctgagagtagggtccgcgcccaacctcgactccctcgcagcaaaggaggaatgtaccccgaaagcggaacccaaacccaaaaagaagaaacataatagttatacaggaaagactacatgtccttcctcctcttgacagcagcactcccacttgctctcggtcaagnataattcactcctcctgttccangggctcttcttggcctccgntcgactcatccgcagcagtcaatgatgatgatagntactacacaacaacaatatacgggttcccttttttcatngatnaccctggattgcattntacacacngaccnaaagntctggntgatata

SEQ ID NO: 85605 - DNA, 315 bp, Triticum aestivum
  unsure (1)..(315): unsure at all n locations
  Clone ID: PAT_TA_85605
gagctcacttattctctcgctccatctttccttctcatcccaaacgccgcagccagtgtgaagcctccaaagtcgctggcgcccccacgttccaccggagcgaggcgccgccgccggatctcgtcccctccccctccccctttgtgtgtctctcgctcttatttctcatctcgggtcnatctaaatcnaattaatatgcatgaaggcgatnngaaccaantccctngggcaaaaattttgggngnctcnccaantttccctngganncccggggaaaccgntnagggcccccccnaaaaggggggttccccggga

SEQ ID NO: 85606 - DNA, 227 bp, Triticum aestivum
  unsure (1)..(227): unsure at all n locations
  Clone ID: PAT_TA_85606
caccgcgccagctaaggcttcgctgtgcgctcccctcccccacgcgcattcattctcgcccgctacccctcgccgccgccgcgccatggccggcgttaggagcctcgtgctgctcctcctggtgctcgccgtcgcgctgtcngcttcggcctcgtcaatcgccggnggggaccacttgaagttnggnttcttttcngngggcnctggcncnggggattnaagggcac

SEQ ID NO: 85607 - DNA, 476 bp, Triticum aestivum
  unsure (1)..(476): unsure at all n locations
  Clone ID: PAT_TA_85607
ctgaagcgcggaggcgccgcgcagccgcagccgctcgcgcccgtgactccacgtacgccccgcaggccacgcgctccgtccggcgccagcgcgagcgtttcagctccggcctcggctccgccgcgagccacgccacgcgtcccccctgtcacgacatgtgtcctgccgggagggcggcgtctcntcgcgtgtccgcgcttcccaaactagccctccccctctctcgcacctcgaaagcaaaanggcacggcngatggcccnggagacgancaaattattttgttgcgacggagcgtctccntcctcctcaccgtgcgangcancggcancagancagaccggannagnacatcacggctctaantaaatggctcaactcctccangntgctcatcctcgctcttctctgacgacgcgggancactccctgaccagcacganccctcagggacttctcagtcactnacattctggcn

SEQ ID NO: 85608 - DNA, 523 bp, Triticum aestivum
  unsure (1)..(523): unsure at all n locations
  Clone ID: PAT_TA_85608
tccgagcggatctgggcgaacgcccgatcccgcgcccccgacgctggccacgactacgccgccgccccccgctcgatctggacgccaccgagcgcccctcgacgccatctgcctcaccatccccggcgccaccacgccggcgcccatccccgtcgcctcctcgcccctccttcgtcgcgtgtcgctcgcctgaggcctctgcctcgccatcaccgacccggtgccgaccgtcatcccctactccccatccccggcgccgcccatcgctcgccgtccccgactcttcctcacgcacatttttgcacatctacagggcctgacctcaagaccgctgctgatgcccctgtgatcgactacatcgacgacacctccttcttgtctgagtaacaaatggtggcccttggagcagatgccaccgctgatggatgctatacgtggagctgcgacacaaggatattaggaggcccaagnaaggagcttgcccttcggccngtgctttntnaacttctaagggccttttant

SEQ ID NO: 85609 - DNA, 353 bp, Triticum aestivum
  unsure (1)..(353): unsure at all n locations
  Clone ID: PAT_TA_85609
gaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaattttcccaagaaccttantgatgtgcnaaangggttcaaagggngggnaaaattcntccaataanatttcccngnttttaaaaaccccccnggaaaaantttaaaantncgcttgtgggggnccnaaantttngggggaaanccaanggncaaaaancncccggaanttttgnacccccccc

SEQ ID NO: 85610 - DNA, 178 bp, Triticum aestivum
  unsure (1)..(178): unsure at all n locations
  Clone ID: PAT_TA_85610
accagatcaaaaatggcgctcntcccgctggtcctcgcggtcctcatcgtctcctgcgccgcgcagcagncaccggtgcaacctccgccaactcccancgcgccgcctgccggnaacccgcctcctgctcncaangcncctcnggccggnaacccaccccnagcnccaacngtncccc

SEQ ID NO: 85611 - DNA, 338 bp, Triticum aestivum
  unsure (1)..(338): unsure at all n locations
  Clone ID: PAT_TA_85611
tacctactagctagccggcagcaatggcgtccaggaccttctcggcggcgtgcctgctggcgctgctggtggccaacacgttcctcgccggcgatgcctgcggcagctgcaagcaccaaaccccgccgccgggtctccccatccccgcccccaccatcgccgtctacnacgccgtgccnacctccttcgtnaggcggnngtggcggnacttntgcccaagggacacantgaagctgggccttgcncaaattgctgggctngatnaacgtgggttnggnaaaccccccaagggggggnggaaaattgctgcacctcttngggggctggcaactnangcc

SEQ ID NO: 85612 - DNA, 500 bp, Triticum aestivum
  unsure (1)..(500): unsure at all n locations
  Clone ID: PAT_TA_85612
gcatgatctaatgctttgagcgcaatactcaaagtacgtatcaagcattgttgctttgtcgttcagtaaggatgggcatctgcttgctgttccatttcgaagagggggtaaaactgtaagagaacctaccttttctgttgcaatttccctacaaattgcctgcgcttgtgagaacctcatagatataatgcatactgttgtaatctgctgggatatgctttatgaatgaatactacccctccgccccaaaataagtgacncattttacaccaactttgtncnaaattaatataaattggcncncttattttggaacggtgggatatgttgctacacttgtaacttgaactacatgttaacaaatacaccaacacacatgnaagnagggnggcgccgccgcgccccctgccaccntttgatacaaaaaaaggggggcccgtaccattccccnatatgancctataccncgccacggctcgtttaaactctgacgggaaacc

SEQ ID NO: 85613 - DNA, 460 bp, Triticum aestivum
  unsure (1)..(460): unsure at all n locations
  Clone ID: PAT_TA_85613
ctcctctcctcctgcatacattatattattttaacctcactttactatataatatatttatacagccctcgtgtagcatattttcttctccttctttttcccggcggcacgaccagtagtgtatatatttcccaactacctgacctgcctgtcctggcctgcatgttcctcggccggtcccgtgacaagcgagtcacgataataactgctggatagacgtaccccaccccacacacaaacggcaccgtgcgcacagggaacacactcacgggcagtacagtaaactaccaattgaacacattcctgcagtatgaacctccantaccctccctacctagtgattttggaaatgaaatgaaaaaatttgctttgaaacgaaacatatgcccnggcnctggatcaatngggcnagacggggtnaccaaantttgacccantaatggnncanatccctcctttt

SEQ ID NO: 85614 - DNA, 315 bp, Triticum aestivum
  Clone ID: PAT_TA_85614
gctgagggtgcctactttttcagtaccgggtttggtaggcgtaggatcatcttttttgtgagcggaaaggatatggcaatgatgttgtacacttatgcgttagctaactcctgccaatgatgcttaagttggtgtgctcatcatactgcatttgggatgcaactgcatcagtatgtcactgtagtcatgtgttcattatgtcttgtgatgtggacagccctcgggtagaactgaaagcccacaatcactcacagaattggttcacatagtcctccatgaaccatctgtaattcgattgtaaaaaaaaaggggggg

SEQ ID NO: 85615 - DNA, 476 bp, Triticum aestivum
  unsure (1)..(476): unsure at all n locations
  Clone ID: PAT_TA_85615
cctagctgtagcgtatccccctacccacctacccctatccctccgaacccaggcaccaagatggcggcgccgacgaccttctccggcgaggtgtgggcggagctgcgcctggcggacgcgcgcgacgtgccccacatccacagcctcatccaccanatggcggagttcgagctcctcaccgacctcttcgccgccacccacgagctcctcgcctccacgctcttccccacgccccagccggcccccttcacctccttcaccgccctcatcctcgatctctccccgtcccccgcctcggcctccgccgacaccgtcggntcccgccgcctcgantctccgcgtcgtcncgctcgccgacccggagcggccgccttcccgtcccgcgcggnggcnggcgcntcagggcgggtntcattgcntcccaactatcaacttctcgncagccggggtgtantggaggaatctcgngcgcncgc

SEQ ID NO: 85616 - DNA, 241 bp, Triticum aestivum
  unsure (1)..(241): unsure at all n locations
  Clone ID: PAT_TA_85616
cttatctctctttactcccgatctgatccacgtcttgccggtgcccttgccccgacctcgccggccaccacatcatcggatccacccatggcgccctgttcccgagctcctcncctccgcgcccgcnccctggctggctggcttgctgctcggcnaaagctcnctggaggaagccggngaccangccagnngcacctccccggctgctgctnggcgngangctcannganggaatcngggc

SEQ ID NO: 85617 - DNA, 467 bp, Triticum aestivum
  unsure (1)..(467): unsure at all n locations
  Clone ID: PAT_TA_85617
cctgcctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcgntcnggtgnaggtggtgctcnanctgcngctgctgctgccccggntgctggtggtgctgctgccgctgaagagaagaaagaanagaaaaaggaggaggccaaggaagagagcgatgatgacatgggcttcagctttttgactaacattcattcaantcncntgtggaatcngcangcnaaagatnctactaggnnttnagggtgattgg

SEQ ID NO: 85618 - DNA, 237 bp, Triticum aestivum
  unsure (1)..(237): unsure at all n locations
  Clone ID: PAT_TA_85618
catcgcctcgcgcccgcaccccaggaaggtaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagttcgcactccngtgacatttnacggncccaaaactgttnaaagcganggacccaattacccangttagaccct

SEQ ID NO: 85619 - DNA, 260 bp, Triticum aestivum
  unsure (1)..(260): unsure at all n locations
  Clone ID: PAT_TA_85619
cttgtattcaagtgctcgcaactaagcttcacttcttgtttgtttgaattaactggtaaaactgaataatgagatggatgcattaattggtaaaccaatgtgttcatgtgcctaggttagcagttgattcaccattttttgcaggtccagacgtctcaagctgctaaggctaaannnccctgccaaagtccgatnnccngtccaaaatggncntggagtncccnggcnttaaanaacacacggggtgttntcaacccccc

SEQ ID NO: 85620 - DNA, 302 bp, Triticum aestivum
  unsure (1)..(302): unsure at all n locations
  Clone ID: PAT_TA_85620
ccaccgctggccggccgccctcccggcatcccccgcccgagcgcgccgcgaccctgcgccccgacctcgtcgcccccctgcgccccggcctccgccccggccgctatgctgccaagatgctcccctgccggcctcccctccgccctgtatcgccctctccacgaaccgctcccccaacaaccgcgctgcggcaggaaatacatgttcttctacagacaaatgttgcaanccccattgttatcatangaagntgcacnangcaaangtggtggttgcttgatngaccagcagaaaatttctcc

SEQ ID NO: 85621 - DNA, 208 bp, Triticum aestivum
  unsure (1)..(208): unsure at all n locations
  Clone ID: PAT_TA_85621
tcagatcaaantggcgctcntcccgctggtcctcgcngtcctcgtcgtctcctgcgccgcncagcagccatncgtgcagccgccgccaangcccaangcgccgcntgcnggcaacccgcctcctgctcccaacgcgcctccggtcggggaaggcgcctccagctcncatcgcgcnnccggncggnaacgcgcctccagctcccagcnc

SEQ ID NO: 85622 - DNA, 216 bp, Triticum aestivum
  unsure (1)..(216): unsure at all n locations
  Clone ID: PAT_TA_85622
ctccaccccccagcgccgccgccgccgcctcctcaaccctagctcgcccgcagcgccgcggcctcctccctcccatcctccccaccggcagccatggcgacggagctggcctacgcgccgccnatgaattcgggaaanctcggtttcgngggcacacangangtgcaacaccnnatccncatcancttctccnanaagttataaacnnctnaaaga

SEQ ID NO: 85623 - DNA, 193 bp, Triticum aestivum
  unsure (1)..(193): unsure at all n locations
  Clone ID: PAT_TA_85623
ggcggacgcaaggcgtgccctccctcacccccgacccccaccccgtctcccccgaccccggcgccgactccgccgacgcccacnccgagccccacgccctcctccgacacntgccccgattgaacacnctgaagctggncttttgcctgnacctgctcggnaacgagctgcacatcggcgactccagngtcaa

SEQ ID NO: 85624 - DNA, 475 bp, Triticum aestivum
  unsure (1)..(475): unsure at all n locations
  Clone ID: PAT_TA_85624
actttccttctttcttttcatggtaatcagagccacgatctcttccaaaaaaacgcatctacagccatgtcgcaagcctctgctccagcgctcgtgtccctctccaacgtccagatcgccgagaagctcacccgggacaacttcctaccatggaaggcccaggtgctgccgccggtgaggggtgccctgctcatgggctacctcgacgggtcacaagcagcgccaccaaaggagatcgaagaggcgagggcggacaagactgtcgttcaggtgcagaatccggcgtatgtcgcctggatgactcaggaccaaaacgtcctgggctttcttctcggttctctctcccgagagtacttctccaggtaatggagcacaccaccgcaagcagtttgggcggcgctcctggcattttgctcgcagagcgcgcaaggtgatcantgcggaccagtcacaacancggaaggtgatctcggcn

SEQ ID NO: 85625 - DNA, 436 bp, Triticum aestivum
  Clone ID: PAT_TA_85625
catatctctgtcgcattatgcattttcttttgtttcttctggaggaggcgacagcatgcctggtacaagccagcagatggcatatgctctcacaacgcatgttgacagtttgtttgccgattgcgacaagatcttccagaagtgggtgtatcaattagtcgcccatgtatgatgtaccaaaattttgcatcgtttttcttcttttaggaaattgacgggccagaaaatggcgacgctgttgtgttttgagaatgtgttaatcactaaccactcagctggtcaccaatgttcagttgagtaacttaagttactcgaactgaaggactaagtgtggtatatttatgttcctctgttgtagaaatgtaatctagcttttgaataataaagcttgtagacttaaaacgcatgtgatattttaatgcttaaaaaaaaaaaa

SEQ ID NO: 85626 - DNA, 210 bp, Triticum aestivum
  unsure (1)..(210): unsure at all n locations
  Clone ID: PAT_TA_85626
gaacactgacacgccacagcaccaagctcctcgctactccacggccatggccaccgccgtcgccgccttccgctctttcattcaccccaccgccattgccgccgccatcccactccctccttctcacttcaacctcaacancttcagcggnantgcttcgggtncggctaattcccctncttccaanggtggcaaccaatttntctgccc

SEQ ID NO: 85627 - DNA, 485 bp, Triticum aestivum
  unsure (1)..(485): unsure at all n locations
  Clone ID: PAT_TA_85627
gctcagtgaagatgataagatgacggttgctcgtgcaaggaagatccagaagttcctgagccagcctttccatgttgccgaagttttcactggtgctccagggaagtatgtggacctaaaggagggtgtccaaagtttccagggtgttttggacggcaagtacgacgacatctcggagcacgcgttctacatggttggaggcatcgacgaagtcatcgccaaggcagagaagatcgccagcgagaatgcctgatgacgaggtgttaccaccgctctgtacaattaaatttttggnttcagctgttcgcccgagacttgctcacgacaagagtgtncaccctgctgagggatcttgttttgttcgtttttacccaatttaccgtaataacaacgcagtgacatggttatctgcacaacagcaacacaccctggctggnaaaactgtgccttgtaagcaatcgacagtcatgatggttaaaaaaaaa

SEQ ID NO: 85628 - DNA, 225 bp, Triticum aestivum
  unsure (1)..(225): unsure at all n locations
  Clone ID: PAT_TA_85628
ctcctctcgcccgggcagctgcttccancccccgctttcagatttctaggtactactaanctcaacttctttcgattcntctgctgcttagcactgaatatcgtatngtnattttcaactgtgtgtgcactaacanacaagctgattancatcaacngtcntccttctnganctgtngantacacggtgtgganatngcanaacntgtnctgtcattttcgattt

SEQ ID NO: 85629 - DNA, 490 bp, Triticum aestivum
  unsure (1)..(490): unsure at all n locations
  Clone ID: PAT_TA_85629
gcgaccgcctctccctatccattcccctctctgctctccaaaaccctaaaccccacctccacctccaagctctctcctgcgcactccctctccctctccctcctcaccaccccagcgcccctcctcctcccccgcaggcagggccggcggcagcgtgacatctcggcggcgtacggtgacggcgacatggacgacgacttcggcgatgcgggcgacttcgacctccgacggagacgacggtgtgggggacgacgacgacctcgacaacgagcaggactacgacgtcgactacgaccgctcctccccccgtcaanctcggccgcantctccgggttggcagcggagcgagaagggagggggacatcgcatggcgcggcgaantcgtnccactggggctccgctccgaacgtcgtcgataacgtcgacaaaatgattcacagatcgctgtcactgcgatttcatcgcaagngccgttctgacaaactcacac

SEQ ID NO: 85630 - DNA, 215 bp, Triticum aestivum
  unsure (1)..(215): unsure at all n locations
  Clone ID: PAT_TA_85630
cagcaacgacgcccatgctctccgccgccgcctcggccattcccaggctccgctgggccgccgcgccgccggggcacgcttcgccgagcaaccggtggtctctgctgcggcggcgcccgctctcctccttcccgaacgtagcgcccaccgcggggccggggcccctggagccgcnggaccttccccgcctcacaaattctgcccgcatatctctc

SEQ ID NO: 85631 - DNA, 230 bp, Triticum aestivum
  unsure (1)..(230): unsure at all n locations
  Clone ID: PAT_TA_85631
cctagccatcgtcccgcgccccgtccatggccaccgccacgctccctctccgcctcctcccctcgagaaccccactcctccacaccgccgccttcctccccgcaagcgcctctctctccgtcaccgcgtcngtgccccgccactggngcatcttcncggccgccnaggaggcgcccgctccggtgnaagccgaggcggaaggaggtgtanagggntccngggnttncaga

SEQ ID NO: 85632 - DNA, 267 bp, Triticum aestivum
  unsure (1)..(267): unsure at all n locations
  Clone ID: PAT_TA_85632
ctccatccatcctcagccgcctcttcgccggccggccatggcaaatgcctccctccagtccttcctcccccagcaccaccattctttccccagcagcacgacccacganggctcccctcccgcgctcctcaagctcaccgccaacaccaccaccaacgccagcaacagcatttcattcaagctcttcgccagnagctcctcctcagtgacnaaaacggnaaactcgcngggttccnattcngggtcncntccncagggggnaaaacc

SEQ ID NO: 85633 - DNA, 267 bp, Triticum aestivum
  unsure (1)..(267): unsure at all n locations
  Clone ID: PAT_TA_85633
cctcaatctcttcttcctcgcgcaagccgaacgagtccctcgccatggctccgccgcctgcgtagccaccgagccctcctcgcctcgctgatatgcccgggagatccgccgtcttctgcttcgtcttcctcgcccacgagctcaagcccggagccaccacatcgtccggatcgacaccatcttcttcctcggtcgtcgtcgnngttcttnatcgatcggtcgctnggaantctaagcaanaaaggggcctngtnncccccaaatttt

SEQ ID NO: 85634 - DNA, 234 bp, Triticum aestivum
  unsure (1)..(234): unsure at all n locations
  Clone ID: PAT_TA_85634
ccccgctccaaaacccccaccccaccccacctcgccggaaccctaaccctagccccgccgccgcnccccgccccgccgccatgagggagatcctccacatccagtgcggncagtgcggcaaccaagatcngggncaagttctnggaggngatctgcgacnagcacggcatcgnccatgacgggcaantangcgggcgactccnanctccagctcgagcggatnaacntctacta

SEQ ID NO: 85635 - DNA, 261 bp, Triticum aestivum
  unsure (1)..(261): unsure at all n locations
  Clone ID: PAT_TA_85635
agaagaaaaagaagaagaaagacgcagaggaggcgacacaataggtagagcttgtagtttacatcggctggttatgttatatggttgcaattgtgggaaagtttgaactacctgttttatttaccctgcacaccctcgcaaccatctatgtaggcctaatgtactatcgttaggttactgccattcaaccgaantgctatggtaattngagaattcccaattaanttcctgaaccaangancctggtttgccnaaccgtaa

SEQ ID NO: 85636 - DNA, 276 bp, Triticum aestivum
  unsure (1)..(276): unsure at all n locations
  Clone ID: PAT_TA_85636
acagggtattggttggcacttggaaattttggtgcattgcttgaacaagattgtgcagattttctgtcatggaaccaatctactgagtaaattaacagcctctgctatattggatttacatccacctcgacttaaccatttatattanttcttgataagtgactattctcttatgttgaccagcaaagtgcanatanttctttcanattcantggtcaatgtatccnaaatcatatttgtancatgattnggcttcacncagcagggccntcnagt

SEQ ID NO: 85637 - DNA, 390 bp, Triticum aestivum
  unsure (1)..(390): unsure at all n locations
  Clone ID: PAT_TA_85637
gtgaagtgggccgtctggctgcagggcattgcctcccattccttgtgcccagtgccacatctttccaccgcgccccatccagcagccgcgccgtccctagtcgctggccttcttcggtttgaccccctcagtcctcgtcgctcgtcggtggaggnagaagcatggcaggtcagggatgaggacggtgatgaaccacgcgaacaanaggcgcaggcggttcaattcanacccagaatcttgagtcagcaaccatcttgggtggttgggggcaagctgaattgacagcggatgtcagctgcctggaagcactggaggctccttcacacctctggttgcgtgcaaacaaagtgggaaacttgtgatntttgaaaatccngtngattgnacttt

SEQ ID NO: 85638 - DNA, 517 bp, Triticum aestivum
  unsure (1)..(517): unsure at all n locations
  Clone ID: PAT_TA_85638
tgccaatataacccgccaccccgcccgagtcccacgcacgcccacagctccacacatcgccacggtcttcttggttcctccgtccacaggctagccagcccctccgctccgctccgccacctgcagccaaatggcgaagctgctgccagccggcgtcgcgttcctcctggccctcgccgcggcggcggcgctggccccgtccccggcctcggccttgaagggagccggcgggctgggcctcggcggcgcggcggcggccgtggtgatgcgccggggcgggcggacgtgccggggcacggtgggcgagtgcatggagtacttcggcgtggacggcgagggcgagagcgaggtggcggcgatggccggcaagcggcgggtgctgcangacgggtccgggtaatcggtacacctctgcggcgggaaactgccgtctcgcancgcggggctctantacaacgcaagccggcgccgagcaaccctatccgcggatcacgcataccagncagggtgatcataa

SEQ ID NO: 85639 - DNA, 456 bp, Triticum aestivum
  unsure (1)..(456): unsure at all n locations
  Clone ID: PAT_TA_85639
cctccttccactagggtgaagaaccgacactgtgatcgtggcacaatcttccactcaccctatgctcgagccgacgcaccttcgctgctaccgcacaagttccttccagcccgcaccaactattgggcagagcgggcagtggccaccatggcaggaaccagtcgtaacatgttttgagctggacatctgagcagcatagccacaaccaccgacaagctctgcttctacctgtacatgcacgccgaggaggtgccagcttgagtgaagggcgaaccggctaagcagtggctgtgaaagtggcataggttgtgcagcggctgcaggagctgccgccaccgaggcaccgctgcagacatccttgtgtcactcctctgcctccacagattgatgacatgaagatgatgacgttggtgttgtatcacgtatactatagctatcatacaaggccttnnttag

SEQ ID NO: 85640 - DNA, 497 bp, Triticum aestivum
  unsure (1)..(497): unsure at all n locations
  Clone ID: PAT_TA_85640
atttcctcctcttcctcttctccctctgctgaaccttccttccttccttgtcgccctctgcatcctctcaccatctgtcttcttcttcttcttcttcttcttcttcttcttcttcttccctgcgagcacggggatctgatctgaaaaggcttccgaggctgctcatacaagtcaagtggatccatcttgggacctgtcgcgtcgtggtgatcggccgacctccatgatgaatgtgctctccagcggccacccgcagagcctgcgcatccatcgccaccaccaccaccacgacgtgtcatcatgtccacgccggagcggctcaggccatgtcgcagttaacctcatcctagcatgaccaggaggcttcttctagctcctccgccgangcgccgtcagggccgtcgccgacgangcgcaatcaacagcggcaagacacacgggacacgacgacaanagagancnangaaagacanaggaggggctctcaggcggacgga

SEQ ID NO: 85641 - DNA, 496 bp, Triticum aestivum
  unsure (1)..(496): unsure at all n locations
  Clone ID: PAT_TA_85641
agccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaagtcgtggagaaggaagagagtgatgatgacatgggcttcatctgttcgactaattgtggggacttgttctgaatatcatccttggcaagaaacagatcaatgattttagcttantactgattgtaaacacggcagacatgtttgatattaatcacc

SEQ ID NO: 85642 - DNA, 205 bp, Triticum aestivum
  unsure (1)..(205): unsure at all n locations
  Clone ID: PAT_TA_85642
cttgctgccagcctcctctgcccgagttgccaccccgtagcccttcgcctgcagccaccatcgccttgcctctgccgccttcatcgaacccagccgccacgccggcgacccgccgaccaccaccctgncccagcnaggccaccagagggccacttnaccctcaanaacggcggccaattttcgttcgcccaaaaggnaantcccc

SEQ ID NO: 85643 - DNA, 337 bp, Triticum aestivum
  unsure (1)..(337): unsure at all n locations
  Clone ID: PAT_TA_85643
ggctgaccgtgctccgtcgccgcattgatgaatgccgaagctatagcggctccccgtcgtcgctcttcccagggatgccacggtcgcccggatcatggcattgccaaccgcggtcgtagccggcgttgccgcgtccgtcgccctgctggtgctgctggcggtcgccgccgcgctctgctggtggcggctcggggcgcgccgtanccggacctccgacaccgcctccgacgaaatcctcccacgctagcggattggggaagtnccgccggattnttcggggccggaananaagggccaagggttaaacccggggnaattccaaccccanaaaaaattt

SEQ ID NO: 85644 - DNA, 510 bp, Triticum aestivum
  unsure (1)..(510): unsure at all n locations
  Clone ID: PAT_TA_85644
gagcatccagcagccccccgcccgatcccggctgcttcacccccgctcccgcgcctcatgcactccgcctccgcctccaccagatccgacgaccccaggtccaggtcggagagctgccatgggttcagacaacatcggccccagagatgtctgcgttgtcggggtcgcgcgcacccctatgggtggtttcctcggcgccctgtcctccttgcctgccaccaaacttggctccatagctatcgaagctgctctgaaaagggcgaatgtggttcacccttgtgcangagtcttcttcggcaatgtcctgagtgctaacttggggccaactccagcgagcaactgcctttagngcaggatacaaaaaggttntttgcacaacggcaaaatnnggcntctggnatgaagcaaatttgctganatcatcaacgggcacanaattgtatggaagggatgnagantcnatgcccgaaaatcctgaanaaaaagtcccttcggaanaaactgttacgn

SEQ ID NO: 85645 - DNA, 216 bp, Triticum aestivum
  unsure (1)..(216): unsure at all n locations
  Clone ID: PAT_TA_85645
tttttttttttttttttttatgttcaccagtcatcgccttttgcacagtaagttccacaattgttcaaacaaaagcaggcacccaaaattctctacctcaaatgctggcacaagtacgtatatttcaaaaatttgtgtccgcgtcttggctttnccctaaggtggcaccactacaaaanngtggngtccctcacngaaancggccaaccncccaaa

SEQ ID NO: 85646 - DNA, 189 bp, Triticum aestivum
  unsure (1)..(189): unsure at all n locations
  Clone ID: PAT_TA_85646
tcgagttttttttttttttttttcggacaaactgcaactcacttcattcctgaagaaccccacaagaccaaaccattcaagaattgtcccctaaatgcctcgcagagttgcagaagcttaaaactcaggctatacagtagcaaaatagtgcacaccanactaaagatgcaaacccctacatagtagcct

SEQ ID NO: 85647 - DNA, 261 bp, Triticum aestivum
  unsure (1)..(261): unsure at all n locations
  Clone ID: PAT_TA_85647
tttgcaagtacaaaagcacttcttccataaaaatactcattaagctgtacaaggtttattttctaagactaggggcaaaagataagagacgtgcacatatgacctcataaaacagccatatctataagatacattcatcaacaangtggnagttccaaangtgaacatacgttcagtggatcaggatgagaaacaccaggtgttctacttcggtacagttcgcnatntcaagntttnaaccttctnaaaaacaaccncttc

SEQ ID NO: 85648 - DNA, 304 bp, Triticum aestivum
  unsure (1)..(304): unsure at all n locations
  Clone ID: PAT_TA_85648
cgtgcccgtccgtcgaaccttatccagccgccgctcgccgcccggccgccgtgccccgtgtctgtcccgtgtcccgttcgccgtgcgcccatgcccatccggcgagccccgtgcagcagcgagcagtcctcccctcccatctccttcctggctgctccccttgctgatctgcaggctgctgccccgtccggctgaggctgaccgacgaggcggcgcgccggtgactcgtccgtccagccagaatcnaccccnattcgggttcgtanttcggggtccccnnnaaaaaaaatnnanaggggggggc

SEQ ID NO: 85649 - DNA, 491 bp, Triticum aestivum
  unsure (1)..(491): unsure at all n locations
  Clone ID: PAT_TA_85649
gaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatgtctacgttgatggagtgctcatacgatactgactactaaataataaaatgaattgcttgcgtgtgttattcantactgtncactgtgtgtctgttccatgtcctgtaccttgcgcaacactgtgtgtgcataatattatgcacatgtagcagctccgtatgctngantgactgcatctttgctgacctatgtaccgagtgtactgtgattgcctgactacttttcaggnattatgatanatattcccaaaaaaaaaaaa

SEQ ID NO: 85650 - DNA, 478 bp, Triticum aestivum
  unsure (1)..(478): unsure at all n locations
  Clone ID: PAT_TA_85650
gttccataaaatgtcattgtgttaaaagatgcacaaactattgtgttttttggtacctcacggcagtgtgtagcccttgtatgccttctaaataccgatgcacgttgttctttggtacttgcctccagtactagtttggaaggccaggaagttctacttctggcataagccaacggagtatcggtcgaaggtcctatttgttcctccactgccccggtgcactcaccatcgagcctatccatgcacagctctagtattgatgancttcangcttgtcgttgttcatgcagattaatcnnttgtnaattgctattgcacattcagtaaatgtacctttgtcttctcagtgaattttatgtnaanattttaatgcacaccgaaacagtgtcgctgctacatgcgcatcatatgcgtatttccaancanaaacccacatagtnagtctccnaacccaaaatttgnatgatcaaattnatcg

SEQ ID NO: 85651 - DNA, 183 bp, Triticum aestivum
  unsure (1)..(183): unsure at all n locations
  Clone ID: PAT_TA_85651
ttttttttttttttancaaatatttaggtttggcatcacanctataattttgatttttcnaatacatgatcngancaacaacanactcaagcanaccntcncaaattcaatacatnaanaagagggccantatgcaaatcangatggntcttcaaccantttcggcaacnagntactcgtaca

SEQ ID NO: 85652 - DNA, 428 bp, Triticum aestivum
  unsure (1)..(428): unsure at all n locations
  Clone ID: PAT_TA_85652
gcctcctcactcctcacagcatcctctcagtccttagcttccttccctcgccaccacccacagccaaggaggatgtcttgctgcggcggcaactgcgggtgcggcgccggctgcaagtgcggcaacngctgcggcgggtgcaagatgttccccgacgtggaggccaccgccggcgcggccgccatggtcatgcccaccgcctcccacaaggggagctccggngggttcnagatggccgggcggggagaccggctgctgcgactgcaccacgtgcaagtgcggcaccgcgttcngctgctcctgctgcaactgcaactgagccggcgcccaagagccggccggcaaaagcaacacgangatgaggaggagaagcaanatcanatcacatcacacaccancgtanaatacaatacngcggatcgtcgcgc

SEQ ID NO: 85653 - DNA, 484 bp, Triticum aestivum
  unsure (1)..(484): unsure at all n locations
  Clone ID: PAT_TA_85653
cacagtctttgtcaaacatccgccaaatatctttgccaaacattaccgtatcctgctaatgcatgtgttagctcgccataaaaaaccaatgcatgtgtttcctaaaccaatgcatgtggccttctataagggtcggatacagcacggcagatccaacgctttgccaaattctccacgacctatatagaaactcttcacgaacactttgccattttaactccactgggtataggcgctgcctctccgtagcgggtgtgttatactttgccgaaccattgctccccgttgaagggtcgantccttggaacantttggcattcccggcgtactgcttgcatggtgtctgtctctgcgagcnctcctccccgtgggccgcgccccggcngcgggtccagcggngctccgactcctatcngggacngacggagcggngcgtctctctcccncccnngtggancctccaaccgcantggccccttcgann

SEQ ID NO: 85654 - DNA, 488 bp, Triticum aestivum
  unsure (1)..(488): unsure at all n locations
  Clone ID: PAT_TA_85654
taaacaaaacaaaactggttgtatagataaatcgatcaccagccacaccgccttatgaatgttatccccaccgccaatataaccgcataagaaccaagatacctcatcttgagaagctggaatttaatttcttggtttaggcatttagaaacctcttattacaaaaaattacaacagaaacttgggtatgctatggcttgcattcagcgagttcattcggatgacatacaaaaaaagctgtcaaacacgtcgatgggactaattcaattgaaacttgcnggancatccttcgtcccacctgagctgagtgaggggtcagccctgttcgcctggacgaactnggaggcctgaggctccctcnggtgaacccacggtnacttgggtgacgaaggcccgttacgggaacccgcaaggaaggcaannccggccatcctcncggaagaaccggcacggccnacgcgcatacccatgccctccgcgtctnggtn

SEQ ID NO: 85655 - DNA, 424 bp, Triticum aestivum
  unsure (1)..(424): unsure at all n locations
  Clone ID: PAT_TA_85655
gaacgacactccaatccctctcaatggccgccactgcttcaaggcctccccgcaaagttctcgatccagatcagatcgaggccaccaccgagcccctcggccgcctcctccttcgtcttcgccctcgcgcacgccgccccacccccaccggtgctccagtgcctccccgcggtacctccttctccctctcttcctcccctacatctcagtcctttcttcttcccttgngcaatgagcagaggaagcacgcagggagcctcgctcctgctaccaccacgaccttcgtcgggccgcngcactccgagtcttcggcgtggcganattccntgcnaccgacgcgcgacctatgctcgcctccanatatgttaggatgatgaganantcngcatcgancgttccgggncgtcctcgctgcnccnttggg

SEQ ID NO: 85656 - DNA, 486 bp, Triticum aestivum
  unsure (1)..(486): unsure at all n locations
  Clone ID: PAT_TA_85656
agatccaccagatgttgagctcctcctcacagcggggtggggctacagcagcaccaccaccagcaccaccaccgctgcatgaagctccttctcgttttcttcccccgtgttgttaccctgtagccatgtccgactagttcgacagcgagatgcgcccccgcggatgccgacccgtgatgctgcatctatggcatggcagagctggtaccantgggttacggtgctggaaccagcggccatggcttttgcatcaaattgagaagattgtggcgtcgtcgcggccatgaatgtttgctacatcgaatttttgctggaacctctgttgatttttgctagaaccacttctttttctgccggaaccttctttgattttactgcaaattggaggtggattgtctgcgtcatgaatttcacacatcaaattttgctggaactcggttactttgctggaacaacattgaanttgctaatagacacatgatttng

SEQ ID NO: 85657 - DNA, 471 bp, Triticum aestivum
  unsure (1)..(471): unsure at all n locations
  Clone ID: PAT_TA_85657
ccacgacacaacctccacctcccaccccggcaccgcacaacctcctttcccacgccgccccgcctcctcatcctcccggccggtgcctccccgcctcctcctcctcccgtccggtgctgcctcgcctcctactcctcctcccgtccggtgctgcctcgcctcctactcccgtcccgcgacgtcccgccgccagatccangtcgtgtcgacccccggcgacccccaatcaccanatncaggccacgctggccctctggcgactcccggncgcctatcaaggccgcncnggtgccgaatccaggctgcngtganccccccgcaangccatgcgcagntcnaggccgnnatacccgccgccagagaaagctgcganaaccantgatcgcctggggcaaatntaggaagaaggggtgtcaaattcgtcctccnacgcgggcttgcggctctcccanggntntccaanatttcggt

SEQ ID NO: 85658 - DNA, 358 bp, Triticum aestivum
  unsure (1)..(358): unsure at all n locations
  Clone ID: PAT_TA_85658
nggcgctgctaccgatctcctccanagtccaagcctcctcacccaaagccatggtcgcgcggngtcnctccctcctcatgctcctgcccctcctcctctcccacntcntctccctcgccgccgccttccagtcggacgagctgctcctccacnacgacgacgagttcgagggcanccgggtctcctccaccccctctcctcggccgccctcgactccagccggtantgtcctcccgcngccgatccgcggacgcgantcangcggctggcgcctccgagtctaacacagtcnagttcacctcgaacatgantcngagncggnctatggttcgcncccgcctggtcttcacggccgtct

SEQ ID NO: 85659 - DNA, 500 bp, Triticum aestivum
  unsure (1)..(500): unsure at all n locations
  Clone ID: PAT_TA_85659
ttccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgccccgccgcccccgccgaggactcaagaatgggacccgattcgtcaagtcgacaagcacctcttcnactatctggctgcaatactgaaatcaagggctgctggactgactgcanatgttctgaatatnaaggcanacccacngagnttna

SEQ ID NO: 85660 - DNA, 486 bp, Triticum aestivum
  unsure (1)..(486): unsure at all n locations
  Clone ID: PAT_TA_85660
gcctcccggatctacccgcactcccctcgtttgcccctctcctcttccctctccctctcacacgagccgcccgagctcggccgtcaccgcgtcgccttcgttgacgtgcaccggagcttccccgagctacaagaaggtgcccaggagcctcgtcacctcgtctccttcgtcttcgcctgtggatcgaggctaaagcgccgcgtagcctagtcatcgggccgtcttccccgccacggccaccgcaaccccgccgctcgatccaccgccatctgctcaccccggnatccccgagcactccacaaacaccgcaaccccgagactgaggctgcccctgtgatggactacgtcaatgaggaccttcttcgcttttagcggagcttnaaatggtggagccaagagcagatgcacaccgacaactactanaaccnagggtgcctacactactggaggcgccgacacangagtantaggaggtccaagaagagg

SEQ ID NO: 85661 - DNA, 486 bp, Triticum aestivum
  unsure (1)..(486): unsure at all n locations
  Clone ID: PAT_TA_85661
gagcanctccccaccaccgactactaagcaaccaagcttgcatgcgagctcggccgtccatccgtgtgangatcgatcacgtcncgtcatcgtctccttccttgccatcaccatgagtcgttttagtttgctttgaatgaatccatccatccctgggtcgatcggtcggccagtactcgagtcantttgtggtgcgttcgtgcgtggagctgtaaaagcttngatgatctcnatctgggacnaccgaccctgtcaatttgnttctgtaaaantgtgaantcgcncgccccgnccgagtaaattcaagttcagttgagtttgaaggctacatttacnaanatcganggggggcccagtancattcgncnatatgagctanacncgcgccaggngcctcttttaaacgtcctgntggnaaacccggcgtaccaattatngccatgcagaaatncctttcccanctgnntatacnacaggccnacngtt

SEQ ID NO: 85662 - DNA, 471 bp, Triticum aestivum
  unsure (1)..(471): unsure at all n locations
  Clone ID: PAT_TA_85662
acacagtgcatccggcagtgatttggagctagctaacatcacgtaggcggctcggcgcttcttggaaatggtcaagcgagccgtccagtacgccatggtggatgccttcacgggcgagccgttcaagggcaacccggcggcggtgtgcctcctggaggatgacgacgccgacgaccggtggctgcagtccatcgccgcggagttcaacgtatcccagacggccttcctctctcgctgcgacgccagctccaactcgtcaccccgcggttccgcctccgctggttcancccgccgtcnagtcncctgtgtggccacggacacttgcgtccgccacttcctcttnacgcgtctcgcggacaacanactggncattcntgaaaatcgggttctgacnccggaagttccgcggnacncntgcacgggtacaaaggccaggnggaaacntcatcancngattccacggtgatntta

SEQ ID NO: 85663 - DNA, 478 bp, Triticum aestivum
  unsure (1)..(478): unsure at all n locations
  Clone ID: PAT_TA_85663
cgccgtgggatgctccccccgcacaatcccctctcctccctctctccccctcgatccagaccaggctccgaccccggtgccccctgcatacctcgccgtcggtgttccccgacgccgttcgtcgtctctggcgccgccccgccatcgctgcctcgaccccgtcgcccgcctccccgtcctcacccctctcctcgatccagaactggatcagggcacgacctcgacgccgtccgacgccgcctgccggagccacctcgccggagcctctctgcctcgaccacgtcatccccatcctcctcctcgccggactgcttgtcctcgcctcatccccgaatacttatcgcgcctcgccgccgattccctgatcgccaacccgagatgcggcgacccaattcgacacgattgatgacctcntcctgcagagaacagtgnggaccanatcagancaacgccgagatacacacccgaggtgcaatan

SEQ ID NO: 85664 - DNA, 356 bp, Triticum aestivum
  unsure (1)..(356): unsure at all n locations
  Clone ID: PAT_TA_85664
ccagaaccccctccccctccctcctcagcctcccggcgcatcgagccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagangagcacggngctggctaatcggcaagctccccttcaagcgcctcgtcngcnaattncccagnanttaaagacngactcggcttcnaancctcngcngtctccgcantgcaggaggccnccnaggcnactctcggctctt

SEQ ID NO: 85665 - DNA, 488 bp, Triticum aestivum
  unsure (1)..(488): unsure at all n locations
  Clone ID: PAT_TA_85665
ccagtctacctccaccgcccaccccgcaaccatgcgacgctccccatctcccccgcccacgccgccttgatcgctcctccgagtcctcccaccaggtccaggccggcgccgccttcttcccccatgctgcgccgccgctgcctggttccagatctaaagcttggatgcttttcaggcttctccagcattaaccgggcatgctctccagtatgaacaatcacttattcagatcatgcagtgacactcttgactgcacaacaataatccgcggtgccggcagccgaagcggacgaagtggctggtcctgcgagtggcggtggtggtcgcctgcgtggcgcaagtgggcggcggtggcatcccatggcagcggctagtgggtgtggcgctgagccgacatggatgactggtcgctccgtgctngtggtggggagtgccagtgggcacgtggtcnactccagtgtcggtgtggccctcatgtggcggcagng

SEQ ID NO: 85666 - DNA, 485 bp, Triticum aestivum
  unsure (1)..(485): unsure at all n locations
  Clone ID: PAT_TA_85666
ccgagcccaagcagcgaccgagacgcccacccgacccgacccgacccnaccccccaccaccagcctcgcntcccccgccgccgccaccaccggcgacnaccggagcccttgaagaaaagcgcnagcgccccgcgaatctaagcaggagganatggtgggcgcctcnacntcgtcngtggtnaacgtgtaccctctcnacaannacacnttcggnacnaaggagcccaagangganaaggacacctccgtcgncgaccgcctcncccgcatgaaggtcatctacatgaaanaaggaangcngacaagtgttgangcaatcctactggtgcaagagcacactcaccanacatactgttatgcaaattgggaatacattttgaaactcctgtggactttgaactggtaaataantgangctgacagaaatgtgcanagantgcatgnatcactcctttcactaatggcaagttgtganggttctgttg

SEQ ID NO: 85667 - DNA, 503 bp, Triticum aestivum
  unsure (1)..(503): unsure at all n locations
  Clone ID: PAT_TA_85667
gatcgatggcagccgccgctgcacggcgcacctagcccctcccctagctcgcagcttctcccagctccgcccctcccctacctcacagcttctccctaccccgcccctcccctacctcccggcgatgggcaggtcgccggcagcaccaaccccgacccccaggtcgccggcagcatcaatcacgacccccgggtcaccggctgtcccaaccccgacagccaaggcgccggatgcgtcaatcccggcgcccaaggtgccggatgcgtctcggnagcagatcttgaggagcacaagggtgagctcttgcgtgccataaaaattgagaaggtactggccggatcttgagagcacaagggtgctantgagctcattggaaccacaanntgaagaaagcagaagtggagcctaagacaaggacgagaccgggggcaagnagaagcgcaccggggaactgtatcagtaagntttctnanctctgatggcntcatnacaactgaacttat

SEQ ID NO: 85668 - DNA, 231 bp, Triticum aestivum
  unsure (1)..(231): unsure at all n locations
  Clone ID: PAT_TA_85668
ttttttttttcgcanactatgacttgcattttcttcatccanttanacttgatncaatcatangatattccaacatcanatcccaatccacganataaggggattgctgcatcancnantgacanaccgaccgaccgactgattgtatannatcacatgcnagnatcctccncacgtatctaggctctaattaagccangacagagngcggactcgncctcgcnatcagtt

SEQ ID NO: 85669 - DNA, 593 bp, Triticum aestivum
  unsure (1)..(593): unsure at all n locations
  Clone ID: PAT_TA_85669
cgacgctcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgaggatgtgcaagggatgaatgtcctcaccaacttctggggcatggacttcaccactgacaagctcagtccttgtgaggaagtggcanacactcattgaggctcatgtggatgtgaagacaactgacaactacatgcttcgcatttcgcattggctcacaagagaccccgaccaagtgaagcgcactgctatgccaacaatcagtnagacagttcgcccaagatgtnaatatggcaacaactcagctgtacttaaggactgnacagtcacctgg

SEQ ID NO: 85670 - DNA, 580 bp, Triticum aestivum
  unsure (1)..(580): unsure at all n locations
  Clone ID: PAT_TA_85670
tttttttttacattcttgaaatattagagcatgaaaaatcaaaggatatgattgccgggactcgagtcatactctcgtacatgcaccgtcgctttagcctgcttattactccctctgttaaaaatgtttagatcattataaagtagtgatctaaacgttcatatatttctttacagagggagtactttctagatcttcacagggtactgatggatggaatcagcccagggcgcgccaagagtggtgacgtcgctgggcgaccttatgcactcccacacggcgctgttgcacttgaagccagagccgaagccaaccatccacacgcggtcacccttccgcatccgtcccttggctcgatgtacgccagctcgtaccacagcgagctgctggacgtgttcccaaaccggtgaagcgtcatccgtgatggtcaacgttctcatccgacaggacagctggtctgaacgcatcgattacgccggccgccggatggaccaaaatgccgaaggcatcggaacaggactaagtgatcccgccacgcctccggcataagtacgnaagacactccggcggggagacacgc

SEQ ID NO: 85671 - DNA, 552 bp, Triticum aestivum
  unsure (1)..(552): unsure at all n locations
  Clone ID: PAT_TA_85671
gcccactggcatctcaggccaaactggcaacatgacatctgagtcccaaagccctgttgggaaaatctcatctgctgccacatctggtacagcagccattccttatagtgaatccgttccaagtgcagaaagttcaaagacatttcctattgggatttccaaagaattatcttccagttcctctctatcatcaaatgtggagtgtcctcctggaaatgattccacaatgaatgccgtctttacagaccctgggtgttgcgcagtgaggtgctggagcggagcggatcgagaagagccgacgggattctgacactcttttcggtggccgtctacacagcganctttacagatcggttggaacatatgttaaatcatacatggaactgcgaagactgggcgattgatttacgatcttgggggaaggggaacatatacgggcatttacagacagctctcgccatctagttatagagtgaattaatgtgtttggtactgtncaatcatacagncagtacatcatatcggcnaaacgtggnatgtgttgttttgtgc

SEQ ID NO: 85672 - DNA, 205 bp, Triticum aestivum
  unsure (1)..(205): unsure at all n locations
  Clone ID: PAT_TA_85672
ctctcctctcctctcctctctttgcgtttcttccctcacggcttctcctcctgtgtttccctctctcttganggcnagcggctatggcnacngtgcangcggtggccaaagggaccctggtctcgccgtgcggcaancgggccgcangatttggtgcccggcggnncngtgctgtngnggaccgcaagtctccctgcgcnccggc

SEQ ID NO: 85673 - DNA, 561 bp, Triticum aestivum
  unsure (1)..(561): unsure at all n locations
  Clone ID: PAT_TA_85673
tccagattggctctagagagatggccctaaaggtgttcaattggctgaatcggaagatgcattccaatgcggagtactgcaccattgatgataataaggccatggagaaggaagactctgtgcacgggagtgtggctgagcaagacactgaagccctgctgctccgtgatgtgcttcttaatggcatacttgcgattggcacgcttggccacaacgtgaactccctttgccctgaggcccgccatgaacaagatgattcatcgtcatggatgaagaaaaggtggaccaagaaaagtgtgaagaggaaaagtgtgaggacaaagaagaggattcgctacagcaccaatgcaccagaacctgctattgaacctgccaagagcatcacgtcgatgaaagatacactcacgtttctgtaaaggaagaacctgatttgaattgaatggagttcctaaatcaagaacaacactcgatggtagaaagtggaaaatgagaacacactgcgattattcagccgaacatcccaagcatcaggaagagatccagagacgtatatncnggntc

SEQ ID NO: 85674 - DNA, 557 bp, Triticum aestivum
  unsure (1)..(557): unsure at all n locations
  Clone ID: PAT_TA_85674
ccacctagcaattcacgtactccgccatggccccagccgtgatggcttcctccgccaccaccgtcgcgcccttccaggggctcaagtcgaccgccggcctccccgtcagccgccgctccggcagcgccggcctcagcagcgtcagcaacggcggaaggatcagatgcatgcaggtgtggccgattgagggcatcaagaagttcgagaccctgtcttacttgccacccctctccactgaggccctcctaaagcaggtcgactacctgatccgctccaagtgggtgccctgcctcgattcagcaagttggcttcgtcttccgtgagcacaacactcccccggctactacgacggtcgatactggaaatgtggaactgcctatttcgggtgcaccgacgcaaccagtgctcaacaagtggaggagncaagaagatacctgaccctattcgtgnatcgctcgacacatcgcangtgatgctagctcaatgctnaggcacaagctgcangatcggaaggcaaatnaattaataccataaatgcagtattaatttcgagccgc

SEQ ID NO: 85675 - DNA, 557 bp, Triticum aestivum
  unsure (1)..(557): unsure at all n locations
  Clone ID: PAT_TA_85675
tttttttgctgaaagaagccttatcatggcccttataaatgtacttataaatgtattttacagcctttatgctagagcagacctcgacgttgatgtggcaattaaacatccgcagaaggtaagggttatatggcacaacccatcggttgtccaacattttccctcgaaccttagcgcgtctaccatcgtttctacgccgataaactgggtatgagtccttgccttgtatcgtgttctcattgaacggccgcgggtatctgcacttgcattcattatcttgcatgcaaacattcttcgggttgagagcaccgcatggtccgtgcatcatatgttttaccaccattgcatacaattccggatacttttgcttgtctgggactctgcggaaatgatcggcatactgcctgggacaagaacttatacgttgaatccatgataacaaanatgtgcgtgggggaggctctctctggaaccaactactaacataacancacacaccaggacactctnacacatactcatagctctagtgcatagaaaagcagcaaattaggcgn

SEQ ID NO: 85676 - DNA, 547 bp, Triticum aestivum
  unsure (1)..(547): unsure at all n locations
  Clone ID: PAT_TA_85676
gctaccctgccatatctgccaggaagacaaccctagaaacactcccatctacattgatgaaactaatatgaagtctcactgcaagatgcagcatcgcagggctactatcaagtgcactgagcagaactgcacagttctgttcaactcactggctgataaagaactgcacagattctattgccataagaaagcctatggttggtggatcctttgatggtgcggtggtggatcctttgacagaagacccggatgtgtatatatcgtggantcttttattgcttgccaaagatctcgactgttatgtggtactgcattcccgttgtcctttcccgctccaagaacatatgcaggatttcgataccacgtatgcatgatcgggcttganatgtacttttgttacccgatgcatgaactttgggtattcgtacaancctcaagttactgactgatgatcatcataaatatcatatacagnggcatactaatcgagctatcacataggacagtgaccacactagtgaactatctaagaggatacattccagtt

SEQ ID NO: 85677 - DNA, 541 bp, Triticum aestivum
  unsure (1)..(541): unsure at all n locations
  Clone ID: PAT_TA_85677
gaacgcccgcgccggccgctcatgaaggccacgaccagacccgccgcttcccgcgcctgccggaccaccctgccacgccgtactccttccccgagctcctcctcgtcgatccagcagcagcactgagccaccggcgagcagtagcggctccttcctccctgaccatggccataccgcgacccttgccggcgaacccagcagtgttgccgccctccttttcctgccttccatctcctttctctttgctttgctctcccactctcaactccatgtttcttctgccctagcgggattcaagccgccgtcggagctcgttcntggccggatncgccgcccttcaccgcgtgccctcaccggactccttcctccgccaagaccgagcgcgccatggcgccaaaccctactcccttggtctacttgggacgcatcatgccggatcgcatctctcatgcctncatgcctgaagtgaccgcttgatgccggtctctgctcttgatcgacacactcggatcacactgccactggtgactcccggacggnt

SEQ ID NO: 85678 - DNA, 550 bp, Triticum aestivum
  unsure (1)..(550): unsure at all n locations
  Clone ID: PAT_TA_85678
agaacatgggtttctccccatcagatcgatcacgcccatgcataccttccccagtacgccacagcacgatccgactctgccgcaggccaaaacgatttaactagtcctcaccgtcgacggaaacccgccattaattccggtgtccagagatctcacctccaggctccagtagtatataaacaagggcgcacccaccgactgaatgccacgctccactcggcaagtcgtctaacacttcaacaccatacttctctggccactgccgcgcggaagctagaacctactgcagtagctagaaagaaagatggcacagtcctccccctcctcgtcctggccgtctcgctggcgtggccggttcgtgcaacctcttccgngtgctcgttccggtcacanggacccgccacctcctctacacatcctttcactaggcgccgactcgtcgtcgacacgccggccgctcgtctggtcacgtgcaacgcggcactgccggcgagtccgtgacagccaactgcggccgcaagcttcacgccaagctgcgcccgcgctncgn

SEQ ID NO: 85679 - DNA, 546 bp, Triticum aestivum
  unsure (1)..(546): unsure at all n locations
  Clone ID: PAT_TA_85679
gcaccgccgctcgcttcagctcctgctcgtcgatcgccgccgtgtggagccaccttcccagcgcgccgctccgcctgcgtacaccggggatttagtccaggccctccaccggctcaagacccagtggctctctgctcctcaacgccccacatcgagcgcccaatccaggaaaacaaccccgtcgcgctgccgctccccatctccctgcgtcgtcccaagatggtcgggctgggcaccaccccggcggccgagcgtgtgctttccacggaagccagctcctccacccagacccttctctacaaggacggcgaggacactgcttcgtcataactgatcgtgacgaccacgcgcaatccaattgggagaaaacagatgatcgaggtgagaaaaaaataaagaagattgtacaccggaactgggcatcggtgattgatattnattgccgacgtttcatgcgtcatttgagattaanactcttcccggcataaggattataatactgattgncaanangaataatattcattatcagaaanggccaatttt

SEQ ID NO: 85680 - DNA, 533 bp, Triticum aestivum
  unsure (1)..(533): unsure at all n locations
  Clone ID: PAT_TA_85680
gccggccttcccatctccccaccggaaaaccaccacaccccgccgctctccctccccctctctccatggcataaggccgcggcaagaagaagctagcttctctcacctgcaagagcggcattgctgcccgccctttcctccggccagccggtgtagttcttggttctttgcttgctcggcatggcggcgggactgctgctgccgcaggcggccaggctctgcttctgcgtctgggccgtggccgtcctctcgctcgccggctcctcggccgccgtgaacggcacgagcgccggtgcagcaggcgcggtcggcgangcggtggtggtggacgcgcgggccgccgtggcggagacggactcggcgttcgtgtgcgcacattggactgtggcgccgganaattgcactacggacctgccctggggccgcccggctctcaactggactgtnaacaattttgaaaaccctgaaactttccctctcgggctcggtcggggccctgaagactgtgtcatgcacgnnaacgggccctcncc

SEQ ID NO: 85681 - DNA, 561 bp, Triticum aestivum
  unsure (1)..(561): unsure at all n locations
  Clone ID: PAT_TA_85681
catctctctccctcacacctccttctccaccttcggccgccgccgtggtcaggtcggtgtggcggcgcgccactgcatatccatccaccactccacacccatccaccaatgcaccaccagcgccactatctccagccaccgccgccatcagcaccagcgccacctcacgcgcctgaccagatgagggaaggcacgattgtctgattcaccgcgtgactagcacccctggcccntgctattcttcttcttccccacgtccttcctgctgctcatcttcctcaccattgccctgtcggttcctttcttcttcccccatctctgctgctcgccctcatcgcctctggtgcttctctctcgctgatctccctgctgctatcctcctccaagcccgcctcctctctgaatccctactgttgcacttcctaattctctactgctgctgcttcttcttctcaactctgctgctaactctctcaaacccgatcgttgtcttcgtactctctctctctcgccaaatgatgctctttcgtaaacaaaagcgctacatgttattcctccctn

SEQ ID NO: 85682 - DNA, 561 bp, Triticum aestivum
  unsure (1)..(561): unsure at all n locations
  Clone ID: PAT_TA_85682
cctaacccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgnaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaagtcgacgacccaccggcaagtgacagctaagaaggagtgcccaacgccgatgcgggccggaacttcatggcaacactcacgcactactgggaatgcggctaactacttaaacagaggttaangtggtcgctttgtcngtcntttagtactatcagatcaatattaatt

SEQ ID NO: 85683 - DNA, 561 bp, Triticum aestivum
  unsure (1)..(561): unsure at all n locations
  Clone ID: PAT_TA_85683
aaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaattcgtccacaagcacaccaagcccgggatctctcatggcaacgccgggcccaacacaacgctccattcttcatctgcaccgtccctgcaatngctcacgcaacactggtcttcgcaagtctcaaggcatggactctcaagaaatcagaagtggtcccancgnactgtcaacaagtctcatcccgctgcgcagtctaatcgccgccgcgt

SEQ ID NO: 85684 - DNA, 556 bp, Triticum aestivum
  unsure (1)..(556): unsure at all n locations
  Clone ID: PAT_TA_85684
agcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggangtgctgctgcccctgcagctgagtcaaagaaagaagagaagtcgtggagaaggaagagagtgatgatgacatgggctcagtcgttcacaanttgtgggnnacttgttcngaagtancatcctggcaagaaacagatcaatgatgtttancttaataactagttgtgaaacacggaanaaagtttgatagtatcagcccggtgctggtgattacggtgaacatacttgcatcaaaaaaaaaaaa

SEQ ID NO: 85685 - DNA, 542 bp, Triticum aestivum
  unsure (1)..(542): unsure at all n locations
  Clone ID: PAT_TA_85685
gtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttatctgccaccgctcagcacggaggccctcctcaagcaggtggactacctgatccgctccaagtgggtgccttgccttgagttcagcaagtcgggttcatcttccgtgagcacaatgcgtctcccgggtactacgacggcgctactggacaatgtggaactgcctatgttcnggtgaacgaccacacagtgataacaagtgaggaggcaagaaggantacctgaccctactcgcatcatcggttcacacatcncaagtcatcgtactcantcctcancacggctcaagatcggaagctaaactatacacggc

SEQ ID NO: 85686 - DNA, 543 bp, Triticum aestivum
  unsure (1)..(543): unsure at all n locations
  Clone ID: PAT_TA_85686
gtttccccttgcactggatctggaagaggagccggagtttccggcgccgcgccatagttgtcatcgcggccgccggcctccccttgctgcaccaaggtgtccagaagcctccccgtgctcgtctccttcggccccactgaagaacccgagccaagccgcaccgtacgctctggatcgagcggtttctccgccacggccgcagcatctcgccattgatctacaccaccgcgccacccgggccgtcacaagcacctccccgacctccctctcgaccccgagaccgctgccgctgtgatcgactacatcaacgacgaccccttcttcccattcagcgganttccaatgtcgganacaggaccagagccaccgttgatcctactacactggagacgctgacgacaagatattaggagtcccancangagcttgcctttcgatntagagctttgtgctggctcttaaggaaaagttaactangttgtccagaatgttgctcgctgatatgtgaataactgattatcagcatgagcctgctntataaaa

SEQ ID NO: 85687 - DNA, 273 bp, Triticum aestivum
  Clone ID: PAT_TA_85687
ctgcagtctcattcctgtatgccgcatcgtatttttgatcattcaaataagtttgtgactattgaaatcaccagtagcatttggcccgtacttgtatattgtaacaccatttattcctcgaagatttatgtccactgcctttcagaggcctctgtactgtttctatgttgatcgtgctctgtacgtttgtgttgtttaagttgcatgctttagtaccaatttcatgtaacaacatgcattatttgtatcgaacatcttctgaaaaaaaaaaaa

SEQ ID NO: 85688 - DNA, 543 bp, Triticum aestivum
  unsure (1)..(543): unsure at all n locations
  Clone ID: PAT_TA_85688
cccccctctctcctgtcctaattcactacgccgctatttattttactattaattgccccgactgcgtctccgtccccgccccctccgccgtcgccaccccaaattcccacgcaaaccctaagccagccagctagctcggcagcccagcccagcccagcccaatggcggaggacgccggcgacagggaccagcagcagcagcagcagcccgccgcggccgcggggcccggagcagggcatgcctgcggggaggacggcggcggcagggacgagagtccgtcaagtcttcgtcggccaggtgcccaactcatgaccgaggccgactggccgcatgttccgcgactcgccgtcgtcgacgagtcaccgtcatccgcgacaagncacaagctccgangtgctgctcctgatctgccatcaaggaggagctgacaaggattgaatgcatatacaacaaagcacctcctgggcccaatcatgcaagtaaatatccgatgaattggaaggtggacanaatttatcggatgtcccaaaatttaagatctga

SEQ ID NO: 85689 - DNA, 352 bp, Triticum aestivum
  unsure (1)..(352): unsure at all n locations
  Clone ID: PAT_TA_85689
ccgccttgcctcctcctgcgacgccggccgccacgccgttcctctttcggggcaacgcccctccgccgcgctcctcctcccggcaacgcagccgccgctccgctcctgctgccggctacgcgcccgctgccgcgcccctccggccgccttccgatgacgtacgccgtgcccagcatgcgtcaggccggtcncgtcctcctggngacgcgagccgcgcccggngggcctgctcccctgcttccgtatgcctcgtatgttgcnggtcgcctcttcctcttttgcttgcanaagcgccgttgtgccatcnatctgcangtcacagcctcnttnagcaacangccgangctgacgt

SEQ ID NO: 85690 - DNA, 560 bp, Triticum aestivum
  unsure (1)..(560): unsure at all n locations
  Clone ID: PAT_TA_85690
nacttctacacnttgaactaangcttcntttgttgctgtgaacaangggaaaggttcaacaccncnttggtatatatccantgacgagcttgattcattgtcaacggtacatnaccggggaggctaacattggcgaaggttaacatttcgatnacacgaggtggctanatangcatcatgctaatgctcatcttgntgcatgtcctaatgaaaaanttatcagaagacacatgggaaaaactttggaactaaccggacataactgccantnaggcattgaacgggaagcatttcttcctgtnagctgatataaaggggcctgagctaanncttgatcacacaggcanactatccntaccgtccttcnccatcttgggcgcgtccatgaaaccnnatgggatcatcgatctcatacttcaaaaaatgctgannacnggttgttatnacatnagtctgcntgatanatggcgggccanaatcttgcaccgttgttncgctaantggttgaatgaagtaccttgggtaattcgacaatggtgatcatttagngtcgttctcan

SEQ ID NO: 85691 - DNA, 510 bp, Triticum aestivum
  unsure (1)..(510): unsure at all n locations
  Clone ID: PAT_TA_85691
cgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacatcggcatctcctccaaggccatgtccatcatgaactccttcatcaacgacatctttgagaagctcgccggtgagtccgccaagctcgcgcgctacaacaagaagcccaccatcacgtcccgcgagatccagacctccgtccgcctcgtcctccctggcgagctcgccaagcacgccgtctccgagggcaccaaggccgtcaccaagttaactcgtcctangctctcgtgcattagttcttgtgttcttcctgttcctgtctgataattcgtactactgtgtgtgtcgacatgtcatccgtacnatgtgctgctgataatnttacttctgctgatggcacttcnngtggatctgtttcaaaaaaaaaaaa

SEQ ID NO: 85692 - DNA, 557 bp, Triticum aestivum
  unsure (1)..(557): unsure at all n locations
  Clone ID: PAT_TA_85692
gtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactcgtcttcatcgtcgacctgaaggccgacaagaagaagattaaggccgctgtcaagaaaatgtacacattcaggccaagaaggtaacacctcatcaggctgatggcagaagaggctactnaagctgacacagactacaagcnctgattggcaacaaatcgnatcatataatcagaggaggtctcatagccttgttctggtctgtgtatggattgtatgtactacaaagggtcatggtcatgctacatacctgacactcanaattgtc

SEQ ID NO: 85693 - DNA, 585 bp, Triticum aestivum
  unsure (1)..(585): unsure at all n locations
  Clone ID: PAT_TA_85693
gccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgatccatctacggcgagaattcgccgacgagaattcgtccacaacacaccaagcccgggatctctccatggcaacccgggcccaacacaacgctccattctcattgcacgtccctgcaantggtcgacgcaacactggtctcgcagnctcaaggatggactctcaagaaatcanaagtggtccgaacgnactgctcaacagtctatcncatgggcactcaatcgccgccgcgtcnctctctatcnccgtttcctgtcttctatt

SEQ ID NO: 85694 - DNA, 487 bp, Triticum aestivum
  Clone ID: PAT_TA_85694
gccgccgcccggctcctcctgaagacaccgccgcccggctcctcaacacgctgccgaccgacgcctcgacgccgacgtacctcctccgccgtactggccttctccccggtggtcttcttcgggtacggtactgagccagaaaagaagcaattggcaaacctacccaagggtcatgtattaacgctgggtcttcacatgtatggttgcctggtgattcataaggttgagaaatggaacaaagcagaggaagaatgggacgtttgcaggatccctcgaaattgtgtcagcgctattgttgtcggcatgcttaaatgtacgcatgtcttatgtattctcagcgtgcttaaatgtacgcatgtcttcctcggacttgtgaatgccgaaaacgtatgagatattttggtccaatcagctgattgagaatatgtgcgtaagtgacactgcaatattatatatatggtcaatcaacaaattatgttgtcatgtg

SEQ ID NO: 85695 - DNA, 568 bp, Triticum aestivum
  unsure (1)..(568): unsure at all n locations
  Clone ID: PAT_TA_85695
acgacggcggggaagaagcccaaggcggagaagcgggcgccggcgtccaaggaggccggcggcgaggggaagacgaggggcaggaagaagggcagcaaggccaagaagagcgtggagacgtacaagatctacatcttcaaggtgctgaagcaggtgcacccggacgtgggcatctcctccaaggccatgtccatcatgaactccttcatcaacgacatcttcgagaagctcgccggggagtcggccaagctggcccgctacaacaagaagcccaccatcacgtcccgggagatccagacctccgtccgcctcgtcctccccggggagctcgccaacaccctctccgagggcaccaagccgtcaccaattaactcctcctaggagctaggattgatcccgctcatgaactgatggcggatagtacatttacaactttgtaaaatgtgctgctgtggtttgaaaatatgtttctttgaagggggccggtaccaatccctangtatctaacccgccatgnctcttaactctacggaaaactgcgtaccactancctganaacccttccagt

SEQ ID NO: 85696 - DNA, 561 bp, Triticum aestivum
  unsure (1)..(561): unsure at all n locations
  Clone ID: PAT_TA_85696
gctacatcgtcgtgccgcattgagcccaccagcaccgcgtgggagatgcccctcacggccgccggccagatcaccaactttcccatcctcttctccttcgccttcgtctcttgcctgctgctctttctatatcctcttctctgccgtcatggatgacctcccgtagccatccaccacgcggttcgaccaggagatggtgtcgacgccagtcgctgcgacggcagctcggcatgcgcgtcagccgggtgaacgagcgcatccggtcgtacacccatgattgggtgttcggcgtcatgggcaccatggacgattgcacctcggggcgtgcccgagtgtgctaccggtgccagccggtcnctgtgattccaacacgaaataccgccgtcaacagcgctaactatacctgaggctcgtcggcttgcatcatcgaggagaaagcgcggaaacgcgacgaacgaagaaacatccttgcacacgtcnnggntggtggacaangcgcgctgatatctgtccggacggtnccgcctcagaagagcagctgcgcgcaggtagttcctnaca

SEQ ID NO: 85697 - DNA, 569 bp, Triticum aestivum
  unsure (1)..(569): unsure at all n locations
  Clone ID: PAT_TA_85697
tcacctttccctcacggtactacttcgctatcggtcacccaggagtatttagccttgcaaggtggtccttgctgattcacacgggattccacgtgccccatgctactcgggtcagagcgtaagctagtgatgctttcggctactggactttagccatctagggtgcggcactcaaccgcttcgcctagcagcacaacgcttgtattgctctcccacaaccccgttttcacggtttaggctgctcccatttcgctcgccgctactacgggaatcgcttttgctttcttttcctctggctactaagatgtttcattcgccagttgtctcttgcctgctcatggatcagcaggcatttaaaagttgacctatttgggaactccggtctatgcttatttcaatccccgaacattcgtcgctgctacccctcctcgtctctggngcctannatcaagggggccggtaccaatcgcctatatgatcgtataccgcgccacggcgtcgttaaactctgacgggaaaacctgcgtaccaactaacgctgagacatcccttccagctgngtatacaga

SEQ ID NO: 85698 - DNA, 570 bp, Triticum aestivum
  unsure (1)..(570): unsure at all n locations
  Clone ID: PAT_TA_85698
acagaggttcacctaaaaaaaggctagcagttcttcccaaagagacaacagttctaagaaaagaagcaggagctgcagctggtgagcgtctgtgccctgctgattgcgtgcaagtacgaagagatttgggctccagaggtgaacgacttcatattgttctccgacaacacatatactagggagcagattctgaggatggagaaggcaatcctgaacatgcttgagtggaacctgacagtgcccacaccttacgtcttcctcgtgtgattcgccaaggccgcatcctcctgagataagaagaacggcaaggaggtaaaaggaacaccagattttaacaaatcctcagatgtagtacgtatctccatttgccaaacatgatctattgctgaattctgttctccctggtgtattgtctaaatggagacacgtctttttttcgtggactggcgctctgtagtatggacagaatatgtttgattcagcacacaagagacaggtnatcaacacacagtagnnacagtgtctgtacagccgtatacataacattatacttctcanagaccactttgg

SEQ ID NO: 85699 - DNA, 229 bp, Triticum aestivum
  unsure (1)..(229): unsure at all n locations
  Clone ID: PAT_TA_85699
cccgacacaaacctacagctagctagctaacccagtgcacctacctctctactgatcagtttgccggaaaatcatcagcaagatcactcactccagaaatcgagatcaggaaccagcatggagctgctgctcatgctcaccgtgctgctgtttgcgcacacggtggggctacctgacctgngcgggcgccttctngggccggcagtcnccggnggtacctcccggnata

SEQ ID NO: 85700 - DNA, 558 bp, Triticum aestivum
  unsure (1)..(558): unsure at all n locations
  Clone ID: PAT_TA_85700
tttaaataaatacagaaaccatgggcaagactagccttctctgaaccttcattacaaaaatgttgaacaattcataactccgggtatcagagatgaatacgcataaatacatggtcattgtcttacatgaaagttacaacaacattttcttacatggaatttacaatacatttgcctagaaaaagagaccatgtcgccgatgatcaaacttgcagcacacaaaagcttagcagaaaagaaaatcacattaacactcacatgatgtacctggatgaagcctcatctttttttggttttgacagtatcatccttctgagtaagtaaagcaccatagtgattttcaacttacagacttgcaaagaaacaccgttgggtctcacttgggtcatcactgatcaaggatacctgggcccntgccatcggcctcctctcacgctgtcctactcagcgcactcttcgtcatatatcacgtcttgtcctcaagtangtgcacacttgagtccgcaagtttcacgccataaagcctcagcagcgaacgtgctaagctctcagctctgg

SEQ ID NO: 85701 - DNA, 560 bp, Triticum aestivum
  unsure (1)..(560): unsure at all n locations
  Clone ID: PAT_TA_85701
ttttttttttgcaaaccgcaatgttacatgtgttcataatttgcagctgaaatgtcctgactcgtgatcaaaacaaactggcgaagccaatttacggcccatttcccagtcccttcatgtctacaacatccattttcttcgatacattaactacatcatccatgcatttgcactattcctaccctttttttggggcggggtcagtaatctgcttgtgtccacatataaaaggaacacaaatcactcgcgtagccacttgccacgctgcttgaatcgttgccacggagatgactggattatttagggctagagaaaaaaataatcccagctagcacatatcagaattatatgacatgtgctactgaaacagctgaactacagacgatgtgtgggataaagcancagaggaatccattgatgccaacatcctcatgtgctcttcggtaacgattaacacttggcattgtccggtacntcaacgatcgttccgcccctcgcgttcangtcaggcctctcgtgtcaactcagctctctcgatgatggtttgactctcatctggg

SEQ ID NO: 85702 - DNA, 188 bp, Triticum aestivum
  Clone ID: PAT_TA_85702
gaacttgatattaaaaggctgcagcgcataatgtccgaatgctacagcaataagtgtcaatgttgagtaatcatctatacaaaaactatgctgaaaactgctaagtgttgagagcctttccccttgtgtgatctggaccgtaggatgtggattgaatgaagattagaagggtaaagttgcaggggggg

SEQ ID NO: 85703 - DNA, 206 bp, Triticum aestivum
  unsure (1)..(206): unsure at all n locations
  Clone ID: PAT_TA_85703
caaacccttgcncactcgccctccaaccctccgccgccgccnctncanagcctcancgccgccgtcganatgggataaggtgcacggatcnctggcgcttgccgggaaggtgctcgganacacncccaaggtcccnaancaagagatgnagaatcagcccngcggacgcncncacaanangatccagtanaaccgtctcttcgtca

SEQ ID NO: 85704 - DNA, 239 bp, Triticum aestivum
  Clone ID: PAT_TA_85704
cgcagttccgctccacccacgtgtacgacgtagtcgtcaagaaccgaggccacttcaaggtcgtcgacctctaaacatctactagtagtctagtagtatgctcacgtacgtaaccactgctttcccggtcagttaagcttgcaaccttaagctctgtgtgtatgtttttttccttttttttgcgggtgctgtgtgtatattaaacgtctgggtatatcgttgtgagtaaaaaaaaaaaa

SEQ ID NO: 85705 - DNA, 545 bp, Triticum aestivum
  unsure (1)..(545): unsure at all n locations
  Clone ID: PAT_TA_85705
ctctccttctccacctccggccgccgccacggccaggccggtgtggtgggtgcgccagcagcctccatccactacaccaacagcacccagtaccaccatcacctccatccaccagcgccacaccacccatccacctctccctgctgcttccccttgctattcatgccctagaccagccattggggtcgccggcgtctgatctcccgcgcacctccaactgctgctgctttccccctcgtccctactgctgctactccaattcctctgctccccttcttcttctttgaatctcgctgttgctgtcttcttctctcttcacctgctgctgctcatccctcacccccttctctactactgctgctgtcttcacttcccttgcccaactgctgctactctctctcaactcctcctgctgctctcctcactcctgcgctgtcattccatcctgctgttgttcttttcttctctctcaaattcgtgactcagaagtgtantacaatacatgtatgtcaaattgntatgtataccacgttggtagttcaatt

SEQ ID NO: 85706 - DNA, 557 bp, Triticum aestivum
  unsure (1)..(557): unsure at all n locations
  Clone ID: PAT_TA_85706
gttcgcccagctctctctcatctctcatctccttggctacgtacttcttccacctccccctctctcccacgcacctctctcgcagcgcctcggcgatcggagcaagccgcttgttgggttctttgcttggcatgcctaggtgcacctcgtcggtcaactaccaaacggagacagcgaccatgtcgcagctcatctgcaacggctgcttcagcctgggtgctctacaaccgcaccgcagccaacgtacgctgctcccggtgcaacatgctcaactccacaagatcagcgagccagtacgcccacctgaagtgcggtggctgccggacgacctcattacccgccgggggctccaccgtggggtgcccactgccacactcaacccgtcagacccaaggtcctcggtcctccggatgccatcgcggctcagacattctcgtggagatccangacatgaacacaagnaaatggtaacattggcggtcgtgtactcatggaaaaatacaagangatctggtttacccaaggtcggaatgatcatgcctgggatcgttatctag

SEQ ID NO: 85707 - DNA, 423 bp, Triticum aestivum
  unsure (1)..(423): unsure at all n locations
  Clone ID: PAT_TA_85707
gttgcctctcctccttccccacggacgcgagcacagatcgcccgccaccgcccaccgctcctcctctgctggctgctgccccatgggggcgtgtgcagattgacgtcgccgctgtccgctcctcttctgctgctgcacggacgcgtaacacaggactcaatcgccactgtccgctcctcctctactgccacaaggatgtgagcacaggccgccgtctgccgcttgccgctctcctctgtggcctaatcgatgcgagcgaggtctccggcaccaccgtccgtccacctctgctgccacacagacgtnacgnggggcgccgtngccgcctgccgctgtcctctgctgaccacgggtgcgagcgcatctgccgctcgccacttgagtctcgcacaaccaccgaatttgtcaagtaaaaaaaaaaaa

SEQ ID NO: 85708 - DNA, 524 bp, Triticum aestivum
  unsure (1)..(524): unsure at all n locations
  Clone ID: PAT_TA_85708
gtctcgagttttttttttttttttttgcatctcccacacgtacagattgtaccataccatgagcgatgagacaattcccaaaaaactaacgcatgcagcatgcagatacaatatccccaaacaaatccaaactatcatcaataatgtacaaagattcaatctctgcaaacagaatatctctctttccatcgtgcaaacttggtaaactcagacatccctagactacctccccatgcaatgcttccacggcgtcagaggttcattgtcctctaggttttagggtacaatttctacatcatcttcctccggcgaacaacactttgaggcaacttttcccaaccagtggcactcagaatgtcttcctccagcgggcacaagcaactccatcgacatcagaccatatcaataattacatctgcaaagctcagagtcattgcccnangttttanggtcattcacatatctccccaacgaacaaactcgnggtcactcaacaacagtggactcanattgctctcagcggg

SEQ ID NO: 85709 - DNA, 476 bp, Triticum aestivum
  Clone ID: PAT_TA_85709
ccgaagaagagaggagacgagaaaggggatcgccgccgccgccgccgccgtcgcccaggatgacgtcgatgctgtccgcgttctcgtcgtggttcgtgaacccgcgccgcaacccgctggcccgcatccacatgctcaccatctccaaccgcctcaagaactacggcactacagacaccattcaaaagctatttgagcgacatgctggctctggtgaaaaaggaggcagcagagcgtaaagcactgggagcccttcctctctatgagagaacccttccttgaagacatcttccttgatatgcgccacagcttttgctccttgtagcatcacaatgcatgaaataaaatgcagattatgacactgttcctccttcgggttcattccaatgcctgtagcattcctgtgcccctcccaattaatgcgacagattcgttgctgttgctgatataaaatttatttggtgaaaaaaaaaaaa

SEQ ID NO: 85710 - DNA, 498 bp, Triticum aestivum
  unsure (1)..(498): unsure at all n locations
  Clone ID: PAT_TA_85710
ctaaatcttgcttctcactctaaaattgctgctgctggatatctcgcatcagctttctttgctgattcacttcatggaggtttatcttcctcacctggagccacccccgcagctggttatggcacatgttcagcatggacggcggcttgtctttgtcctcctacgcctcttcggtcgcctaagcttgtaaagggcggcggcggcgtccatgcagtttctttgggtcgctgatttcatctcctgcggacctgaaccctcttgcatctagcttgagtatgagattgctggctacattttctttcacaagtgcgcaaagcagacacacgtttcaattctgctccaggtacccggcacacatcctcacctcacanggtaacatcctcaaattcgacctgaagcctattttcctttccgatctgtattacccctttctatctttcctctggtgtgcggtgaacatatatgtaacaacaaatgacttagtggaaaaaaaaaaaa

SEQ ID NO: 85711 - DNA, 559 bp, Triticum aestivum
  unsure (1)..(559): unsure at all n locations
  Clone ID: PAT_TA_85711
cgtcgatcgacgtctataggtcaatgatgtgcgcttggagcccaccaccactggtctcccatgccgacggcgctgttgtagacaggcagtgggctcggatggcgcccctccgcatatcccggagctgctcctgctgctggccgcgtccttgagcttcttctgctggccatctctttgacctgctgctgccggggtggtggtgacgttcatcctcggctacaactccctcagggctcctcggttcccttctttctcttctatgtgctctgttgtaccacacggccattgaccgtggtttgctgctccgggcatcgatcgatgccttgtgttgaccgttgaactttttgggattgtgggtgcttttcggactcgaatttccgttgctggtgtattgatctggcattacaatgacaaagaaatgaccatgcaaggatttggggatgggcgtgtgtacatgacagaaaggaaggatgcaatgcatgtcangctacgnggtctggcacgctctgccctcccgcggtanggcaagtggactggccaaatactatcacttctcnca

SEQ ID NO: 85712 - DNA, 316 bp, Triticum aestivum
  unsure (1)..(316): unsure at all n locations
  Clone ID: PAT_TA_85712
cggtgaatgccccggccgtccccgcnccaaccaccacccccgccgcaccatcnccagtcgtcnaaggccccggncacccctgctcctgcggccgcnccgcccaccactccagttgccaccaccgcgccggtcaaggccccagccacccctgcgcccgcggccgcgccgatcaccgctcccgtcactcccgcccccgtcactgcccccgccgnagctccacnaantcccgctcncaagcccaaggccaangcccctgctgcatcancactcgccaangccatcgcccccgctccagcagngctccctcccaccgtct

SEQ ID NO: 85713 - DNA, 527 bp, Triticum aestivum
  unsure (1)..(527): unsure at all n locations
  Clone ID: PAT_TA_85713
cccagccgtgatggcatcgtccgccaccaccgtcgcgcccttccaggggctcaagtcgaccgcgggcctccccgtcagccgccgctccggcagcgccggcctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtggtgccctgcctcgattcagcaagttggttccgtctccgtgagcacaacantcccccggtactacgacggtcgatactgggacatgtggaactgcctatttcggntgcaccgaccaaccaagtgctcaacaagtggaggagncaagaaganacctgaccctagccgttcaacngttcgacaaancccaangcatgctcactcatgcctcaggcacanctgcaagancggcaagcaaatcaattgaataaacatatcancagtantaatttcgagcncng

SEQ ID NO: 85714 - DNA, 430 bp, Triticum aestivum
  unsure (1)..(430): unsure at all n locations
  Clone ID: PAT_TA_85714
aaatagccccgcaccaaaacgcaccccactaggcatcatcatcacacattcncagcgcagatcgtctcaacaactcagcagctccgtcccgatggcgtcgctcaccatgatggcntccctctccgcggncgtggnggtcgaccggngcgcggcagccccgctccgcggcctcgtggtggcccgggccgccaangtcnagggccagcangagccggcggtnaacatggcanccgtggntcccgccaccgacngccgccgtnccgtggtgtttgctgccgccgctgcggccttgtcggccattggcggngtngcgttcgccgattcggacntcaagaatgggagtcncgaagccantaagaagtacgcnccgtctgcatnancatgccatcgccannatctgcncanctgatcnggggatggggcgatatat

SEQ ID NO: 85715 - DNA, 427 bp, Triticum aestivum
  unsure (1)..(427): unsure at all n locations
  Clone ID: PAT_TA_85715
ccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgagccggcgcccaggaggccggccggcagaggcgagcacgaggatgaggaggacaagcaagcaagcaccatcaccaccagttcaccaccacccagcgtatcatcaccagccgccgcatgcgctcgcgggcgcgcgcgctgaataaaataaaacaccgttcgtgttccgtattctgtatgcccctgtcgcgtgtgttcgaccagtactgtccttcctcgtgcctccactctaatgaatatatggcgcctcaacttngaaaaaaaaa

SEQ ID NO: 85716 - DNA, 175 bp, Triticum aestivum
  unsure (1)..(175): unsure at all n locations
  Clone ID: PAT_TA_85716
ngtctcgagtttttttttttcttttttcttcatccatttaaanntgttcanacagtangatattccangcaacacatcccaatccatgcacagaaggggantgctcgcatnaccganctgancgancgaccgacngantgaaagatagtnacacatgttgtttcttccncncgta

SEQ ID NO: 85717 - DNA, 549 bp, Triticum aestivum
  unsure (1)..(549): unsure at all n locations
  Clone ID: PAT_TA_85717
agcaccagaacctcctccccccggcgcatcgccatggcccgcaccaagcagacggcgaggaagtccaccggcggcaaggcgccgaggaagcagctggcgaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgcgagatcgcccaggacttcaagaccgacctccgcttccagtcctccgccgtctccgccctgcangaggccgccgaggcgtacctggtggggtcttcgaggacacaactctgcgccatccacgccaagcgcgtcacatcatgccaaggacatcactcgcacgccgcatccgtgggagagggctaactctgttcgtctcgtcttagcagttgttatcngtggaangtatgtgctgatcnatgtacactgttgtatagtanttaantaaaatttggaanggntaanttnaaaaaaaaaaaa

SEQ ID NO: 85718 - DNA, 236 bp, Triticum aestivum
  Clone ID: PAT_TA_85718
ctcagagacaacctcaccctctggacctccgacatgcagggctccaacgctgagcagggtgatgccgcagaaccccaggacactgaggcctaaactgtcagaacatgattttctccttttttcagttttcatctcttcccctatgaaagttggcgttacgcgcgtcttgttttttttgtgatgcttgacaatgctaataaatccagcaacccccattcaactcgaaaaaaaaaaaa

SEQ ID NO: 85719 - DNA, 253 bp, Triticum aestivum
  unsure (1)..(253): unsure at all n locations
  Clone ID: PAT_TA_85719
ccccagccncatcccgattttaacctcctcccctcgcactgancaaaancantnatttgcctcanagccatcccctcccctcgactcctccacctacccctaccccgcctcgcctcctccangctcggcnacctcaaaggcctccntcgaactcatgtcggnctcncnctctgtcgccgcncncaccntagaggcaacagtcnatcacatcatgctcatcancgtcacgctcggatggatngcctntgaggca

SEQ ID NO: 85720 - DNA, 545 bp, Triticum aestivum
  unsure (1)..(545): unsure at all n locations
  Clone ID: PAT_TA_85720
gtcaagattgcggccggagcagctcgtggaattgcttacctgcacgaaagattgtcatccacggattattcatagagatattaaatcatctaatattttattggataacaacttcgaagctcaggtttctgattttggacttgcaaggttagctgccgactccaacacgcatgtcacgacacgtgtcatgggaacatttgggtatttggctccagagtatgcattgtccgggaagttgacagcaaatctgatctatattcttttgggantgttcttttgggaacttattaccggaagaaaacctgttgatcctcccagccgcttgggagatgagancttgtcgaatggntcggcctttctctcgcaagcancngacacgaactcgggatctccggacccgaggatggaaaaaaatccaagaaaatgagngtacatatgatagggtgcggtgcatcatcctcatccncgngatgagacacggtgggcangggtaagacacggtattaaccgatctaactaaaaacggctcaccggccacgagttct

SEQ ID NO: 85721 - DNA, 557 bp, Triticum aestivum
  unsure (1)..(557): unsure at all n locations
  Clone ID: PAT_TA_85721
cttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatctcgacccactgtgattgatgaggtgaggactgggcgcttaccgccagtcttccacctgagcagttatcatgggcaaggaggatgcaccaacaactcgccctggcattacaccattggcaagaatgttgnctcgcctagtcgtacaagaacttcagnaactgcactggtctcaaggatcctgtctcaaccnttggagtggacggtcggctggtcctctctgagctcctcgtgacatggaagatcaactggtcan

SEQ ID NO: 85722 - DNA, 215 bp, Triticum aestivum
  Clone ID: PAT_TA_85722
ttttttttttttttttaaatgaacctcttgtcagctttgccatctcttagatttattgggattatcgcatcttaacaagcagactgcatatcaagaacataaaacaaaaatcaaactttattcaactgcatgcgcaattaagcagaattataaaatcaaaaaaattgaggaaagctagcagcatctctttgggatggtgaggtggccgggggggg

SEQ ID NO: 85723 - DNA, 552 bp, Triticum aestivum
  unsure (1)..(552): unsure at all n locations
  Clone ID: PAT_TA_85723
ccgcttttccccacctccccctatacgttcatctccttctcttgtgtatattcaagttcaacatctcgtgattcttcaggtcaccatagtcggcattttcagttcatcttgcagatgatggagctccccttcggttcatcttgcaagtgtgtttttgggcagtacaaaatacatcgctatagttagtacagatgtggcaccttgcagagtactaaaaagaccaactgattaggattactataatgaactaataataaaatttgagtccttcaggatcctctagttctggatgtccactgccatccccgtcagcccctatttcttcactgtaaggaggtctctgctcgtcgctcggttgtcctctatttgttctaatttctgaagaaatgcaaatcaatttagtttgatgatggctgttgaggattacatgtgtgtgcttgattgattaagtttccgaatcctgacttgctaaaatgaactacctgtttcaaacaantgtggatgcaggaaatcaaaacgtctacgttactcatcatatcagcaattaatgcn

SEQ ID NO: 85724 - DNA, 203 bp, Triticum aestivum
  unsure (1)..(203): unsure at all n locations
  Clone ID: PAT_TA_85724
gtccgatcaacttcagccagcaatgacacaacgtacatcattacttccgtctagcgaaaacaccacctcgagcaggtaccatcttctgcacgaaatcaagccacctccaganggatccatattggaaaacnggttcaaatantttacnaatagtgtacngcaaccatntactttataaagcatactggaaatccaaggggggg

SEQ ID NO: 85725 - DNA, 201 bp, Triticum aestivum
  unsure (1)..(201): unsure at all n locations
  Clone ID: PAT_TA_85725
gttttttttttttttttttggctgcaaaatgtgttcccatatgaaaatgccaaatgtgttggtaacaaggatggatgctacatcatttcccagttaaacaagcactgtgtgaaatatctgaatatatcagacctctaagctacaatttgattatatccagcatttggttatcaagcacatcctcaaaaatgacantcccag

SEQ ID NO: 85726 - DNA, 402 bp, Triticum aestivum
  unsure (1)..(402): unsure at all n locations
  Clone ID: PAT_TA_85726
cttacagtcaattancactggaacttataaaattacagtgtantgaacccatttgcantcatgacaagcaggtgaaaaaccttgaaattacagtaagaanaccttgcaggtatantaccnagtgtcttctacagattatanagacacaactgaaccaacattgcgatgcagaggccgggggcaatcctccttttcgaaaagaaaaaaacagctgaaccaacatacacacttganacttcctancatacagatgactacacactgaaccaacatacacactgccctanccatagtgtgaaaaangcattcatcatctatctaatgcaaacaatccttcttctccatcattgttaattcacagtcatggacnacgaggaaatcgccaagaatcncctccctctc

SEQ ID NO: 85727 - DNA, 617 bp, Triticum aestivum
  unsure (1)..(617): unsure at all n locations
  Clone ID: PAT_TA_85727
ccgcaccgcccccgctccctcccaagaatcccccaccgcagtcccccggcagcccccgcgcggctccgatggcccgcacgaagcagacggcgcgcaagtcgacgggcggcaaggcgccgcggaagcagctggccaccaaggcggcgcgcaagtcggcgccggccaccggcggcgtgaagaagccgcaccggttccgcccgggcaccgtcgcgctgcgcgagatccgcaagtaccaagaagagcacggagctgctcatccgcaagctccccttccagcgcctgggtgcgggagatcgcgcaggacttcaagacggacctccggttccagagctccgccgtgtcggcgctgcaggaggccgccgaggcgtacctgggtggggctgttcgaggacacaacctctgcgccatccacgccaagcgcgtcacatcatgcccaaggacatccaactcgctcgccgcatccgtggggagcgcgcctaagcctctctgcctctgcgtcangcctgccgccgcggntcctctgggtgatcccgccgacggatttgttctgcctgtaatccaatctgtctgcttcaantgtcattaaaanttgttcggttcatatccaccngttgatt

SEQ ID NO: 85728 - DNA, 354 bp, Triticum aestivum
  unsure (1)..(354): unsure at all n locations
  Clone ID: PAT_TA_85728
ccgagccagggagagcagagcagagcatagcatccgagaagcactcatcgccatggncatggcttccaccgccctctcatcggccttcaccctcctccacgccaagcccgccgccacctccctgccccggccacaaccattcttcgtccccatgcacggtcgccgcccctccgtcgccgtcgcctgcacctcaaccgcggnggcctccccgaaggtgctggngctgggggacgccatcncggggctgaccctgganngangcgcgcnggctggtggaccacctgcangagcgcctggggcgtgtctgcggccgcgttcgcgcccgccgccgccgtggncggcnccggtcggacc

SEQ ID NO: 85729 - DNA, 607 bp, Triticum aestivum
  unsure (1)..(607): unsure at all n locations
  Clone ID: PAT_TA_85729
agtgagcacatgccattatctctcaaaaatggaagctccgatctccttggcccatggctcgatacttagagtgcgtgtccgtactgtaggcagttcaatgctactactagttgggtctacagtatgtgcaaatggatgcacagtacaggggtagtgggtggaagtagaagaggtcttgcttggtgttcaccggccgtacgtacgctgtgcgataaagaaggccaggtcgaagccgatcccacctgcaagcaaatggatctgcgcgcacctacccggccgggcacgaccatcccgtgcccttctttaatgcctgcagcagcgctaccgcagttactataatcgaagatgcatggtgtacgtaccatcctcgtctctgcttgccacccacccaggtctcctctggcagctccggccaaaacctgtgtcgtactactgctagcaatgcgctgtgtgtggccgtgttgtgtgtacgtacagtgccaccacacgcgttagttaacaagttgcactgtggtggcgatatatttgggcgggcaaccaatgaaatggtcctgctnanttgcnttgtcgtgctcncctctgtgatnctgtctggaagcaacggcng

SEQ ID NO: 85730 - DNA, 562 bp, Triticum aestivum
  unsure (1)..(562): unsure at all n locations
  Clone ID: PAT_TA_85730
gcctcctgcgcctccacttccatcgcctccccaagatcgcagatccgctccggtgagaatccgtcgccatgtcttccagcgaggtcgcctgcacccttgccgccctcatcctccacgatgacgggatccccatcacttccgagaagatcgcgacggtggtgaaggctgccggaatcaaggttgaggcctactggcccgcgctcttcgccaagctcctgggagaagaggagcgtcgatgacctcatcctttccgtcggatctggtggaggtggtgctccagctgctgctgctgctgccccggctgctggtggtgctgctgccgctgaagagaagaaggaagaaaagaaagaagaggcaaggaagagagcgatgatgacatgggcttcaacttgttcgactaactgttcaatccattctcctgtgggttcctctatgcgaaagactgtctaagtgcntttaagtcnaatttgaagatttataagttatgctgtttgagacaagtactgtcaatgagtactgcaaaactcctgggatggtcctgtngaatgaaaanggtcacant

SEQ ID NO: 85731 - DNA, 607 bp, Triticum aestivum
  unsure (1)..(607): unsure at all n locations
  Clone ID: PAT_TA_85731
acaaaacgaataaagcccacctacccaccatcgaacccaaccgatccccacgacccaccccatcatctccatcaccgatctggcgccgccccctcaccccgggcaggaagctccaccacccccaaccaccgccgctgccgccgcccgaaacgcgcctccacacccaatcggcgccgccaccatccctcgtcgcggattgcgccgccagcaccgtctcttgccccggatcgggccgcctccatcgccccttgcccctcactgctgccaccgtcgctcgtccctcccggatcgggccgcctccaccgtgcctcgctgcggatcgcgccgccaagtccgtcccttgccccagatcaggttacctccatggagcacaaacttgctccacctgctgccgcgaccttcctccaaactgtcaccatgaccttcttccctccanaagccaagatgccgctggcacagggcccccacaacctccaaaccctgctacggccaccccaacatcctctgtgcttctccccgacatcgcaacagggnacaacccacggttctataaggacggagatctatcgtgctcctcccgcgnggatcaanatgtcaacnaaaggtg

SEQ ID NO: 85732 - DNA, 608 bp, Triticum aestivum
  unsure (1)..(608): unsure at all n locations
  Clone ID: PAT_TA_85732
caggaacggaaccaacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtgggcatgcagtcttccgtgaagaccctcactgggaaagactatcacccttgaggttgagactctgacaccatccgacaatgtcaaggccaagntcaaagacaaggagggcatcccccgggaccaacagcgcctgatctttgctggcaagcactggaggatggtcgcacctcgccgactacaacatccagaaggagtcaaccttaactgggtgctccgcctccgtggtggtcagtaattgcctctactcaactgctgctgctgctgtacctgttctcctgtgggtgccccttgttaaagt

SEQ ID NO: 85733 - DNA, 610 bp, Triticum aestivum
  unsure (1)..(610): unsure at all n locations
  Clone ID: PAT_TA_85733
cgagtttttttttttttttttttaagacgatcgagtgattaaattattaaacgaaacaacaatatccatagcaatgtcacataggcataaattgtaactagagcggctaaagcaaggctcaagctgagcaatgcgctacaaaaacatagcatgcataataacctgatttctatacatggcggcaaagggtggaagcacgtcattggatacatctcatttagtgcccagcggcagtagcatcctcaatgatcaacctggagccttcggctcaacacatcaagctcatcaatcctctgcgccctccatcgcctgggcgattccgctttcctggggcattgccaccattggactattccatcggctttgcctctctcaaacactcctcaaatacatccagcacggccttgccatccgatgctcgctgctatgcggcaacaatacattgcagttaccgttctgacggttacctccaatgttcacaagcattttggggaactgcatcgttgccaacaaacccaatgtcacggnaacaactccattgtcaccgacatcgtgaggaacagccatgggcccagccggtcancgcaatccgtcatgtaacccacanggg

SEQ ID NO: 85734 - DNA, 576 bp, Triticum aestivum
  unsure (1)..(576): unsure at all n locations
  Clone ID: PAT_TA_85734
ctctccctcgcgccgctctcttctccccaacgcgaacccgacgccgtcatcgtcatggccgccgtcgccctcgcgcccactgagctccccgacgcctaggagcttgtccttctgcttcatctacgtctcctacttcgcctacgaggagcagatcgaccggagtcgcactagcgcgagcagatcgacctcgacttcgtcttcggccaccagagctccgccgtgtcgatccacgcctctaccgctcctaagctttcacttagccgtcgtgtgccttcgcgacctcgagaccgatgatgcccctgtgatcgactacgtcaccgacgaccgttcctttgcagcaaagcttccaaggagccagatgccaccgttgatgcctactactacgtggagaccgccgacgaccaggcgtatttaggaggtcccaggcangaggcttgccttttcgatcgatgttgcntttgtgctagccttcttaaggaaactggctaactcatgtcngtaccagatattgttgcttccctgagtctgtgtaccgcctttttttccccccnngggcccttttttaaaaaaaaaaaa

SEQ ID NO: 85735 - DNA, 594 bp, Triticum aestivum
  unsure (1)..(594): unsure at all n locations
  Clone ID: PAT_TA_85735
aaaccccttccggcggcgaagcaacacaccctcccttctccccctcccgaagcagcgatggcccccaaggcggagaagaagccggcggcgaagaagcctgcggaggaggagcccgcggcggagaaggccgagaaggcccctgctgggaagaagccgagggccgagaagcgggttccggcgggcaagaccgcctccaaggagggcggcgagaagaggggcaggaagaagggcaagaagagcgtcgagacctacaagatctacatcttcaaggtgctgaagcaggtgcaccctgacatcgggcatctcctccaaggccatgtccatcatgaactccttcatcaacgacatcttcgagaactcgccggggaggctgccaagctcgcccgctacaacaagaacccaccatcacctccaaggagnccagactccgtaccctcgtcctccctggggagtcgccaagcacccgtctccganggcacaaggccgtcacaagtttactcctcttanatngcgtccctgtatcantaacaaatgtagtccctgctgttggcttaatgctgtcngtggacncngggtanctgaantaaaataatc

SEQ ID NO: 85736 - DNA, 611 bp, Triticum aestivum
  unsure (1)..(611): unsure at all n locations
  Clone ID: PAT_TA_85736
aagatacacccagtctttcatgtcagtcagttgaagaagcatttggggaagaaatctatccctagtccagatctgccaatggtcaatgaggatggttcaatcaaaaccgaaccggctatggtgcttgaagtgagacaagtaccaagacacaacctgcatgttgttcaatggctaattcagtgggaaaacatggcacccgaagatgctacctgggaagatgctgaattcataaagcatacatttccagcattctttcgttcgacaactcaagcatggagatcagtctcataatcgccgtgaggacacgtcgagtctcaagacaggggcaatgtcaggcatcagctgttctgaacccaaaccaagtgtcatcttcagttaacgacctccatcgagctggtattgcttccgagccccatcggacggtcgccatcgagcagctcaagttacttacgctgtcaaccgtccggatgcatctacggttttactttcancttaagctgtcgctacagtgaactgaaacttctcgcctaaaagtgaaccgggctgtggctgagtagtaacgtgaattgatccaattttgcnttgagcagaagaatacctataaacatatt

SEQ ID NO: 85737 - DNA, 387 bp, Triticum aestivum
  unsure (1)..(387): unsure at all n locations
  Clone ID: PAT_TA_85737
caccttcctccctcctccccctcacgctccctctcctctcctcgctcgggtgcttcatccactccactcgccactggctccgttcgggccttgaatcttgaccgacccgcctganccggcagccgccgtcggncnactgcttgtccgggtgaacctgctgcttgtcgcantaaactccatgtatgtatacttgtananttctcttcccgcngattantgcggtatcccgattcgccaangccaactatangagangaggatgaccagatcttgagaagaatcaagcaactacaaaagagcttccttcgctgccgtgccncccantggttgttcgggatcggancnagaaagcagcaatcctggatccttcntgctggcttctgccga

SEQ ID NO: 85738 - DNA, 197 bp, Triticum aestivum
  Clone ID: PAT_TA_85738
tcacgctgaactatacgtccggcaccacgtccgcgcccaagggcgtggtctacagccaccgcggcgcttacctcagcaccaccagtttgctcatgtcctgggaggtgggcaccgagcctgcaatggtacttctgctctgtttccagatgtatactactcctgtgagtataatcttgtttttcgtgtctaaggggggg

SEQ ID NO: 85739 - DNA, 610 bp, Triticum aestivum
  unsure (1)..(610): unsure at all n locations
  Clone ID: PAT_TA_85739
cttatcataatttctacacatatgttcactctctacatgaagaaaagtaaacttataacattaaaattgtgactagggttatgtgcacagagggagctgttcagctgttcctcgccacatctatctcatatgctgccttctgttgggaagctccaacgacataatgcttgtacgatgcgtctctacaccaagcactaaagaataacatgtgttaaactttgaagtgaagtgcacattctgtacagcagcaattcacagctactaccctcagcatcctgtatctcctgaatcagggcttcaagtacattatgtgcaattttccatttcaacataaaccttgtcagcactccgacgcatcaaaactcatgggcactccggatgaangtggcaaacaatttgcaagttggtccaacacatcacctaagtgaaactccgttgtgctaaaaatacagcgttcatgtcccaatcgtgtggtgcaagaccaaccgcgttgacccggggctctgacccnaggactgtccagagccaaatccccaaacggccanttacnacgggttcttcagcacaccggtgggacgcgtttgagataattcgttntagctacanaggg

SEQ ID NO: 85740 - DNA, 565 bp, Triticum aestivum
  unsure (1)..(565): unsure at all n locations
  Clone ID: PAT_TA_85740
gcggccccggcctagatccttcctccaagctgggcgagtttacctggtggaggtgctgttccatctctccgatggctcatcgacgttgtgtcgccggtggcccagtttgaggcggtgcagatcggagctcatcggctgctaagcttcgccccgtagtgtgctcatcgcggccttccatctgaagctccggttgcgttgggtttctttgcctcctcctctctcttaggctccagatcagctcgcgtcttctacccctcgttgacggcaagccaatgtggtttcctcagccccttcccgactgggccgaacctacatgccgtgaacacgacggttcattttcctgggtctgatctctcccagcacaagaagcttgatgaacgagaagcactagaattggaggcaaggctgcaactttcgttgtgtaccatcangcttgccaagttgatgcatttcaagtgacaatgctgttgagctatgataattaagtcattcataantaatcctgcccgtgttgtaccaaaaatgacctccaagcaatgtaacacttgatatcaaaaaaaaaaaa

SEQ ID NO: 85741 - DNA, 482 bp, Triticum aestivum
  unsure (1)..(482): unsure at all n locations
  Clone ID: PAT_TA_85741
ctcgagtttttttttttttttttttaaaaagacaacctgaacaaaattttattccacgtacatatacccatttacaaatacttgaatcatgcacttagataccataatggggaatgactaactgaagcatgcatgcacttgcgagggagcccatgcatgcacgcgactgacatatactaccatattgtaattgcgagaaaatatataggtgcatgcggatacgagaaaatattgtaagtacgagtacgacgacgacgatgatgcgatgcaggtaaaaaatgcatggtttgtgatggatggatcagctagggcaggtgaagtcagcggggcaggtcttgccacactggttgaggaggagcacgaggtcgacggaaattggaaaaaaaaatattttgtttagaaaaaagtgatagataacatattgtacgcatgtttttacacaaaggaagatcncccgttactttgtgcctaaaaaaaacaaa

SEQ ID NO: 85742 - DNA, 565 bp, Triticum aestivum
  unsure (1)..(565): unsure at all n locations
  Clone ID: PAT_TA_85742
cttttttccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgatggggctgccgccggagccggagccggagcctcggacgccgcccccgccgcccccgccgaggacctcaagaactgggacgccgagttcgtcaaggtcgacaagccacctcttcgactcatcctggctgcaactacctgaacatcaagggctgctggactgactgcaaactgttctacatgattaaggnaagaccanaggagatcgcaagactcaaatnagaagacttacccgagagagaganttccaggaa

SEQ ID NO: 85743 - DNA, 582 bp, Triticum aestivum
  unsure (1)..(582): unsure at all n locations
  Clone ID: PAT_TA_85743
ccccctctttccttccgagctccacaggccacagcaggcagcggctgctcacccagcggcggcagcaggccggcggcgagcctacgaggagctgctcctccttcctcaccgactccccgtcgtcctcgtctccgactccccctcaccctcagcccctctcacgcagcagcccagacctcttgtcaagctcgatcctggtggcagctcatcggttgaggtcggcacaaccaccaacatggctcctcctgctgaacctaccaatctaagggctccattgtggagccatgttacaattatagagaaatcaccagctgaggttgtaatggctcgaattgcattagcacaaaacaagacaaagaatgtgtccttgcctagtgattaagcaagttttgcttcaacaaaatgcaagcactgagaagaanaggggagaaggacaaaatactcattacagaatgtttggtgagttgatttacccaagcaaattgggttaaaaaattgcaagntcttttaatcttgagaagtgaataaatgtnnagccaaaccaattattcatttaancatcnanaagattancggtggttn

SEQ ID NO: 85744 - DNA, 653 bp, Triticum aestivum
  unsure (1)..(653): unsure at all n locations
  Clone ID: PAT_TA_85744
actgatcaatgtttttgattcgtactggtcaatgcttttaattcaaacaagttttcctttctagcacaaacatctaactgttatgtacactttctttaagaagtagcaatgaaatcatcatagacagaaagttcgaatttgcacttggtgttatgtgtacggattccatgttttggtcgtcctcattgtctatgtcatgtacttcattctcatcctgctggtgttcttcgttctagtgatcggcggcgtcatagagagctagtgatcagcgtctgtccaaacctctctccgtgcaggagaagtacacgctcaaccgaggtccttcaaatcagtggcactgacggggtgttgggaggatggtcgtgagcctgcaaatccagtgagggaatagcagtacttctcatgtcgtaatacatggacntgctgttaaatacacatggacctacgtccttgccacttctcctgcgcctcctaatcgtgttcgcttcgcctcccaattgancaacagactctaaagggaacagtgatcatgctgtcagataaaagtncctcaggtgtaanncatcaagtccaataaaccgatgtccgnggctacaaaaatcagatgccaatggcttnacggccatcaaaatttgtgataacccccccacctg

SEQ ID NO: 85745 - DNA, 596 bp, Triticum aestivum
  unsure (1)..(596): unsure at all n locations
  Clone ID: PAT_TA_85745
tttttttttgacattacaaacaacatcgaatacttctatatatacaatacgaacgtagttgttacaccaaggcacacccattgcatttcatagcaatgccagtagaaagatgaagctgtatgtaaatagcataccaagcatcctccgcaggattaaacacgcaaaattggagccgatacctactgtaagacgactccttgtttgttgaggcaaatgagccttaaaagctcctctccaccccaatcgcctttttatcggcataaacaggaagcctagctgccaattagatgggttgcggagcaagagagtagcgatggtagacatgcataccacaatggcgattcgctcactaactgggctcaagacaacataagctcctagtgcaaatgctgcaaccatgcctcttgtcgcctgctccatgcaaactacagagaagaacatgtagagtgcacgaagcagtggatgaacatgattcgaaccagcataggtgagccagatggtggacaacgtggagccacaaatgcaatgtgtttgcatcacaaatgccttgaangggtancaagtgacaaaattgtgcaccagcatgcggatgacgt

SEQ ID NO: 85746 - DNA, 284 bp, Triticum aestivum
  unsure (1)..(284): unsure at all n locations
  Clone ID: PAT_TA_85746
nctcttcttcctcnactcnctgatcataccaacacacagctancnanctaacaatngcggccctccaancccctcgncctcctgctgctcgtggctctgtccncaacngccatgtctgccnccggtcaatgctgctgcngncacaaagtgacggtgnagancctgtgcggccacgacctgaacctgggtancgcggcggtggcggacancatggtcctcntccccaancgctggctgctcnccaangggaagcacaagtcgttcnacatgtnctcgtggtccgg

SEQ ID NO: 85747 - DNA, 464 bp, Triticum aestivum
  unsure (1)..(464): unsure at all n locations
  Clone ID: PAT_TA_85747
gcagattgtgtcaaagctaggaagcagcttctctatagcgcctttcatcattgtggtggcatcctgtaccatcctagctatgattgctttactgccgattgctcaacttctctttttccacatccttctcatcaagaagggaatcagtacctacgactacatcattgccctgagagagcaagaacaagaagaggttagtggggagcagagtccacagatgtctcatgtaagctcctatggtgggcttagcagtactagttcctttggtgcactccgtcgtggttcatggtgtacccctccaagactgtttcttgaagatcagtttgacgttattccatcagaggctggctcttcacataactccgctaccaagagaaaagacgaagaagtaaggaggaagaaaacctcangggctgtgaaaattagtccatgggcactggctcgtcntaatgcagaagaagttt

SEQ ID NO: 85748 - DNA, 652 bp, Triticum aestivum
  unsure (1)..(652): unsure at all n locations
  Clone ID: PAT_TA_85748
cctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgagccggcgcccaagaggccggccggcaagaggcgagcacgangatgaggaggagaagcaagcaatcatcatcaccatcaacaacaccaagcgtatcaatacactaaccgccgcatcgctcgcgcgcgcgctaaataaaataaaacgtcattgttccttaantctgtacgcctcgcgtgtagtgttcgacaatgtcctcctcatgcctcaacttcaagtgaatatatggcgctcaactttaaaaaaaananaaaaaaaaccagggggggccgtaccattcncctanatgagtctttagccgctcatggcctctttnacttctacnggaaaaccctgnttccaattan

SEQ ID NO: 85749 - DNA, 636 bp, Triticum aestivum
  unsure (1)..(636): unsure at all n locations
  Clone ID: PAT_TA_85749
aggaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactccgtcttcatccgtccgacctgaaggccgacaagaagaagataaggccgctgtcaaagaaaatgttcgacattcaaggccaagaagttaacacctcatcaagcctgatggcaagaagaagcgttacgtnnaagctgacacaagactacgatctcctgattggccaacaagncngcatcatataatcaganggagggtcctgcagtangcgctgtgtctgggttcctgtgttaatgggaatttgtagtgttcttacaaaggggtcagtggctcatncctacataacgctgacactttntaaatttntcatccaagtgcttgtgttaaaaa

SEQ ID NO: 85750 - DNA, 637 bp, Triticum aestivum
  unsure (1)..(637): unsure at all n locations
  Clone ID: PAT_TA_85750
cggcagcggattccccttcgtcttcatcttctccaatcttcatcaaatcccactacacaacaattactttgttgattcagttgctcttacgatctggtatttatctccgggccgcttgcgatttggcaaggtaagcgatggcgaggacgtgcccccttgcaacgagatccacaggcagtcgtcgcagccctgcctccggcttccccaacgtaggggcccccaccctggaagaagtgcgcctctcggcggatgccactgtgccgacatcgattccggccactatcggcgattaccttgccgccctgtgtcgggtgcctcgacagaaggccgggaggctcccggtgggagcggccaacccatctcggtgccgctcaacttccccacctcgcattcgctgggtctcgcttgggatggacgctcttcccggctactcanccatgggagtgggacatcgcgcccgggaagtctccaaaccggtgggacttttaatttncggccttgaagggtgtgctggtggtgaatcgggtagggcctccattgatattgatancaagacttgcaggagtgctaaattnagtcctcccgnagtgcccctcggctgattanagacaaattacggcggaaangnggccttata

SEQ ID NO: 85751 - DNA, 599 bp, Triticum aestivum
  unsure (1)..(599): unsure at all n locations
  Clone ID: PAT_TA_85751
cctagtggttccccggcggccgcgcccgcgccagctgccgcttccggcggtagccttcaactcccgcgtcacccaaccgcacgtgcccgactcgccgccagtagatctggcggccgccgcggagctagtcgagcagtccgtgggcagaacagaaagcgcgccgttcctggccgtgggcaggccgccgcggtgaaggccaactccggcctccccgtgggcttcgccccctcctgtgccacctccccgttcggcggattcatccggttcaaccccgggccagcagccctgttcggatgcatgccccagtacgcgctgctccgcctcgcctgatacagcggcgtcacggtgtgctccaaatccgaaggctccatttcctttgtgtttgtagcggggcgtaagatgattttggtgctacattnaagatttggcaaagagaggattgctaatcaccatagatgagggtgcatctgttgaaancgaaagtaatgacaatccacagagtatctccaagcaaaagaattgcacaaggagctgctgggacaatgtatanttcangggancttcttctgggtggggaatccctcagttacggttctggn

SEQ ID NO: 85752 - DNA, 617 bp, Triticum aestivum
  unsure (1)..(617): unsure at all n locations
  Clone ID: PAT_TA_85752
ttttttttttttttgggacgaaccgtctttttttccgctagatcaaacggccagaaaaagtggcatcctgcagcagctaggatgcgaccggcccaaactttgggccggtgcgccggcgcagatcgctcgccttatgcaaacccatcccgttctagcacgggtactgtttgaccaaggtcagctcgaccgctttcaagcactgtcctggaaacgacctacccaatattgttcaaggttcacgctgttcaggatcatatcatatcatgggattgtagtaggctcccaagattattccccccgtgaggaagtcctgggcaaacctcaacacatgagttccgaacaccacgcagccgtgtgggttcaccgccgctgagactcttcctcngaggagaccaaagatcctcccactccaaacttcaactgcagctgcatgagtgttttccgtacgaaggtgtcccaagaaccttttccaagtccgatattgtcgcggttaatttccggctcaacgagtcnaggttgaaagaaccaangtagattcccccttacttcaagttgcaatccatgcacgaactcaagtatacctacggctccntgcnggatcacggggcaanaatctt

SEQ ID NO: 85753 - DNA, 260 bp, Triticum aestivum
  unsure (1)..(260): unsure at all n locations
  Clone ID: PAT_TA_85753
ctgcacttccctctcgtctcccacactcacgctcacactcccggctcacactcagnccaanccggcggggcagngaangttggnaatggcgccacgggctgccaccgtcctgctctgcaccgcgctaatctgcctctcggcgacgcactccctcgcgcaggcgcccnccccggccggtaacgcnccgcccaagtcncccaacgcgacnccggnccccgcggcngccgnggtcacncncattgcntcccccgcngtgcccg

SEQ ID NO: 85754 - DNA, 380 bp, Triticum aestivum
  Clone ID: PAT_TA_85754
gcgaaataaataaaacggcgacctggtggcggcggcagcagcagcagcagagttatttgtttcgccggttttcctgaaacttgtgggaagaaggtggaggcttacatagacagacagcctgacaaatgtagtggtgtaggtacaatacctgtatatgtttcctgcaggccgtagatgatggatcgacaggatataggatttttgtttcttatttattctattcccccccttttgaccccattgaattgagcaaggccacagttttgctcagtggcaaaatccaggttcagttaatgtgtatattaactatcctgttaccatctttgatgctcctgagactctgcctgctgctgtaaaattctgaagacaaaaaaaaaaaa

SEQ ID NO: 85755 - DNA, 606 bp, Triticum aestivum
  unsure (1)..(606): unsure at all n locations
  Clone ID: PAT_TA_85755
gattgctacaggttcttgttgtgtgtgtgcttgctgacttagtgttgtgtgtgtccgggcacccattgtatttttttgctggcttgctgttgcgtgcatgattgttgtggctggcttggtggtagcatcatatatacttggtcgtagcgctcgcttgctagctacaagttcttgttgtgtgtttggttactactggcttagttatgtgtatgtgtctgggcacctgttgtgttattttgctggcttgctgctgcgtgcatgattgttgtgactgggctctgngttgttcggtgttgggctcttganggcatgcgacctgcttcaaaaaaaaggaagaaacaacattttttaatagaacaaaatantgaaaaaaaatccaatggnaaccgtgcaaaatttancaaaggaaaaganctaaaaaaccttanatcctgtnaggtgttgaattacaaaaattctggnagcaaaaaattggcncaaccaanaagaaatatttaacccaacctcagtanatgtattccaattgncanaancctgaaatttgtaagaatttgcaagaattcaaattatggtacttcnaaatgtanatnatcccgaagcccgntn

SEQ ID NO: 85756 - DNA, 364 bp, Triticum aestivum
  unsure (1)..(364): unsure at all n locations
  Clone ID: PAT_TA_85756
gcggatcggccattgagagagaacgaagggagagcggcggaggaggcgaaggcatcatccatggccacccctccacctgctcccaccaccccgcccccggctcccccgacgcagcctccgcccgctcccaccaccccgccgccgtcgcccccggccaccccncctccagcgcccgcnaccccgccgccatcaccgcccatgtcgccaccacccgccacacctcctccnactggngaccccncnggcnatggcncccacgacatccccgaccgtcgccccnacganatcncccaccgcgacgccntcgntgtctccgaccaagcccangaccacctcccnacaaactcaccnacttcgnctccac

SEQ ID NO: 85757 - DNA, 628 bp, Triticum aestivum
  unsure (1)..(628): unsure at all n locations
  Clone ID: PAT_TA_85757
ccctggccgactacaacatccagaaagagtccacccttcacctggtgctccgcctccgtggtggtatgcagatttttgtgaagaccctcaccggcaagaccatcactctggaggttgagagctccgacaccattgacaatgttaaggccaagatccaggacaaggagggcattcccccggaccagcagcgcctgatctttgctggcaagcagctggaggacggccgcaccctcgccgactacaacatccagaaggagtccacccttcacctggtgctccgcctccgtggtggtatgcagattttcgtgaagaccctcaccggcaagaccatcacccttgaggttgagagctccgacaccatcgacaacgtcaaggccaagattcaanacaagganggcattcccccggaccagcagcgcctgatcttcgctggcaagcaactggaggacngccgcacccttgcaagactacaacattcagaaggagtccaaccctcacctggtgctccgcctccgtggtggtatgcaagatttcgtgaagacctcaacggnaagacatcaccctgaggttgaaactccgacacatcgacaantcangccaanttaagacangagggaatccccggaca

SEQ ID NO: 85758 - DNA, 593 bp, Triticum aestivum
  unsure (1)..(593): unsure at all n locations
  Clone ID: PAT_TA_85758
gcatcgccttcctcccgccgccacaccacctcccgcccctaccgccacaccacctcccgccccgcgccaccgcaccaccttcagcccccgcgtcgccggaccacctcccgccccgcgccgccctggcgacggatccgacccgccgcgatgcccagccgatggatctggcggccgccggtcaacagcgccgtcccgatgactgcctcggccgttctgcaccgcgggatggtcgccacacccagccgcagcaagatgcgtcgtgttatcgtcgacgcaccgcgcgagattcgctcgtcgagcaccgatggacacgtgccctcctgctgtcgtccgtgcagagatgccccaccctccgccgctccctcgtggctgcgccgcgccgtcccgcaatggccgccgtcctcgcgtgtgggcctgctggcattcctngcgccatcgggaccgaggctgcctccaatcntcgggcgccaacttcccgaagaaagccctctcgaaaanancttccctctccattgaaccaaacatcaaactgtatgtgcaggccacatgcgtttggccgcccggcctgnaattangcnccggggnatcaatan

SEQ ID NO: 85759 - DNA, 554 bp, Triticum aestivum
  unsure (1)..(554): unsure at all n locations
  Clone ID: PAT_TA_85759
cacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgagccggcgcccaggaggccggccggcagaggcgagcacgaggatgaggaggagaacaagcaatcatcatcaccatcaccaccacccagcgtatcagtaccactagccgccgcatgcgctcgcgcgcgcgctaaataaaataaaacctcatgtgttccttantctgtaccctcccgtgtagtgtccgacaatgtccctcctcatgcctcaattcnagtgaatatatggcgcctcaacttgaaaaaaaaaaaa

SEQ ID NO: 85760 - DNA, 260 bp, Triticum aestivum
  unsure (1)..(260): unsure at all n locations
  Clone ID: PAT_TA_85760
ccgggagcnancaantcacacnnacnaccatgaattgnnggtgcacacatgcgcccaanggagcantggcgacgccgctctccanccctttctccgtccncaccctccnntcnccgctctggcacggtcgcctccacgcgcntctccgancaagctccggtncangacgccnccgccgggccggagacgccggccccggtcaccacngcacnagccnaccgacgagganttcgagaagcncgtcctgcagctgaagtccc

SEQ ID NO: 85761 - DNA, 427 bp, Triticum aestivum
  Clone ID: PAT_TA_85761
ctccaggggatcttgaagccctgctacacgggcaagagaaatgggaggaggccgaagattctaaggcgcggtggttcatcatctgctcttagctcatggaggagcgcccggactcgaaagaagaggaaatcgtagatgcagatggtctcagtgaacacaccctatcctctggcttcggttcttccgtttgattagatgatgatgacggcaattgcgcactccctctcttttttcttttcttttccttctatctgactgatgacattttctgcggagccagaagagattatggaaaatggcgctatggctttcagccgcgaggtgcttgtaaacctagcgatgtctgtttctgtttctattgttgttgttacgtctggctttgttctgaaagatcgaactttggttgttacagtgtaaaaaaaaaaaa

SEQ ID NO: 85762 - DNA, 593 bp, Triticum aestivum
  unsure (1)..(593): unsure at all n locations
  Clone ID: PAT_TA_85762
atcacctccctaaccttccccaatccctctgctctctgagcacctcatctctgagcacaccctcgcctactttgctcgctgcccaggtcgcgccttccgccgcccgccgccggcgcaggcgcgggcgtcccatcaccggacctccgccgaacttgccgtcgccggatccgtccgccgagcccgcctcgccgcgacggccgcagcgctcaaggcgacgaggcagagcgcaggtagcagtcgaagccgaccacgccgtcacgccacgcgacgaggccccagcagcaggcgtcccccgcccgcgccgactgccgggggcaccaggaccactcgcaggcctccgccacccgcgccgagtactgggacgcacaacgcgcactcctccgccgtgcggtccggcgccactcctccgccgatgtgctggttcccgccgttagtagcgaacccccaagtggccttggagtactngttggtgagtggttgccgancgcgtcaacacggcgcggcagacaaattctcgaggcgataactnatcaccactgggctcctctcgcgctcaagaaggcgtgatgtcgggtcggctcgcaacggttctt

SEQ ID NO: 85763 - DNA, 614 bp, Triticum aestivum
  unsure (1)..(614): unsure at all n locations
  Clone ID: PAT_TA_85763
aacagaggagtgagggtcgaacccaaggaaaaggaaaaggatcaggggccttcttctttctctccttctcctcgctgctcaccttcctcaccagatcgaagcaagagaagacaaggggttcgaccagatccaaggaagagaggggatggggggcaggcggcaccgtctaccggacagcggggcgtcgggctgtctggtgctccacgcgagggctcctggtggtgctctgctccgggcaaggcgcgtgggtggctgaccctccacgaaggccaccacggttcttccccaagggtcctccgctgctcatcttcaccaagttcttcaccacgctgcagttctaccccaaggatcctcctctgctactcttcttcaacgtccacgcggaagatctccaggcctttcctgctacagatcgtctccaactcgtccctgctcttcttcctcttcgcctgctgatctaaaagctcgggaatcaactctgtaatctctcctctcctgttgcaantctctcaaaactctctaacgtttacttgaantgctgatatcaattgaatcgttgcctgaactanagattacngtagttanancgtttggntaatacntggggaaatctg

SEQ ID NO: 85764 - DNA, 228 bp, Triticum aestivum
  unsure (1)..(228): unsure at all n locations
  Clone ID: PAT_TA_85764
ccagcccaaacagaactagcgagcagagccatggcgcccaacggagacaacaccgtggccaacgtccacagcggcatcgacagcaccaacaagacgctgctcaagagcgacgccctctacactttaatnctncaaaacaacgtttttcccccgnagaacaagtgtntntgcgaccatgctgcncatcatcaccgacaaccacnngtggggttacatgcattcttcctc

SEQ ID NO: 85765 - DNA, 593 bp, Triticum aestivum
  unsure (1)..(593): unsure at all n locations
  Clone ID: PAT_TA_85765
gcgaaacggatctcgcctagagctccgccgttcgccggagattttcgccaccgtaagagccagtgccgccgcatctcttgccctcttagatccatctctccacgacccacgtttttcacaaagtcttgtggccagaaaccgagcagggagagaggaacgagctcgaccaccgtttgccggagcactccggagttcgcgacgccgccgtcagtagaggatgcccccgtcgccgtactcacgaccaccgcctccgccgctcaacgccgcacccacccatcacttcaccctcgccggagagtcgccggagcagcgccaccgcagccgccgactgccgccgccgttttcctccgtacacgattgtctggagtgcgacgtaaacctttgtcaggagtgtaactttctgaaccagaaccaaggatatcagacgaatagtaaggtaccgttagggtcntgcgtctgactcagcatcgcaagtggggctatgatgggactcatcattatttttgcnactttccgtggtttgnttgaataaagcaaccatgtgatangcanattgttttntttaaaaantcnggttatacttgtnnaaatgg

SEQ ID NO: 85766 - DNA, 490 bp, Triticum aestivum
  unsure (1)..(490): unsure at all n locations
  Clone ID: PAT_TA_85766
gtcacgccccgactcccctgctcgcctgcgccctccgccgctccccgctcgtgatggccgccggtgactccgccgttcgcccgcggccctgcgccctccgccgctcgtgacggccgccggtgcgacctccgccgctcgtccacctggcctgctccgctgctcgccccgtcgcccgtcctctgctcccctgctgccctgctccgccgctcgcgcagcccagctcaccgcctcgcccgctctgctggttcctgctctccgccacgcgcagcccagctcgccgcctcgcccgctctgccagctcctgctctctgctgcccaaggattggtgttgggtcttcttccacggttgattaagttatggaagacactgatgaagcaagcaattgatttggtattcntttacngcacgtattgttctagcttttgtcatctttttanaantttgttgtgtncncnaagcantaatttaaaattcnaaatttttgggtgc

SEQ ID NO: 85767 - DNA, 621 bp, Triticum aestivum
  unsure (1)..(621): unsure at all n locations
  Clone ID: PAT_TA_85767
aaaaaacctgcgaatcatgtagagcacaccatctccagcatcgacccagatccaacccagaaaaccacaaaaaaatcagtcacttccctcctagtttcaaaaggttgcagagttgcatatctagtaggctggattcacccgcaccgagtccttagcacgaaatctagaaaagcctccatatcatgtaaatttgtccgccgtcttttcttgccacccagcccaaaaaatcaacaaaaaaaaagttgacagaaactccaatcatgtatcgctagtcgtagccatcagtcgcggtcctgtgatcctgctggagataatccgtcattgccgtagcatcatcaccttcgcaaaaaccgtcaaatcatgtagttagtgagcctcctatctccattccaccaccgcattcgtccttggaaaaaaaccggaaaaaaaagagangggagaaagaagggggttggcagcttgaattagcaagagtgggtgttgatggagggcggcggcggctggggggcggagacccgaacctgtccggcgccggcgaanccgggcangccggggccgctgttcccggggcccgggtggactcctgtcgtacnagcgaatcnatgccgcggtgaaatcctg

SEQ ID NO: 85768 - DNA, 275 bp, Triticum aestivum
  unsure (1)..(275): unsure at all n locations
  Clone ID: PAT_TA_85768
ctcctgtcgaccgcggtccttcccccacactgacacngccgcgccgcggggcgagaaaacctgaggctganatngcgcgaggcgaggncagcccacacncccgcaccgcancgcaccgcatcggcatctctcctcgtcacnactcgcaacccaatccacacgctcctcggcnccggcggcgtaccanggcnacggcngagctcggctcncccccgggcgaaggcctccaggatggcnctccgccctcaaggtgtcacncccccgctcancgccgg

SEQ ID NO: 85769 - DNA, 618 bp, Triticum aestivum
  unsure (1)..(618): unsure at all n locations
  Clone ID: PAT_TA_85769
ccccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaaggtgaccaagctcaaggaaggagtgcccaacgccgactgcggcgccggcacttcatgggcaaacaattnnaacggccactactgccgcaagtgcgggctcactaanntctacaacaagaaggcttaaaggtnccttgcaattgtcngcncntttacctacctaccagantcnaactcacttaatgttcccnttttccgttaa

SEQ ID NO: 85770 - DNA, 618 bp, Triticum aestivum
  unsure (1)..(618): unsure at all n locations
  Clone ID: PAT_TA_85770
ctcctccctctcgatcacccacacccgaagcccctctcctcgatcctcaccctccctttgcctctgccatgccagtctgtgccgccacccccgcgaacctgtgagctcgccgcccttgacccggctcgccctcgacgtaccttcgccggagctcttcctccgcctcttccagcctccatgcgtgccccggcctcctttgccatctcgctgcttgccatgaccgccgtcgcgaagctcccagtctctgccaagccgttgctgcagtccggcgcccctgcttcttccacgtcactggcgagcgccgcgccgtctccctgcctcgtctgcggtgccggcggcaacaacagcagtgggaccgaagcccctaccttgctccancacgtcgccgcgcctcctggcatcggcgtcnacctcgtcaccaaccgcaacatggtctcaagctcgccaagccgctgctccctcatcccgccantggcaagttggatgcccatctgccggattcaaaaatcccgtggcgcatcttnattccggagttctcgcaccgctgcaagcccaagctccgcaacggtcgcctctactgaagtccgnnanatccgaactctccntgggtccggtagg

SEQ ID NO: 85771 - DNA, 421 bp, Triticum aestivum
  unsure (1)..(421): unsure at all n locations
  Clone ID: PAT_TA_85771
gcctccgttgccgcccttcagcggccacctcgctgccgctccaatgcccaccatgaggcattgcggaggaaggtgagcaagtagcagcacttcgaggaagccatcatcaacctcgccgccgcgctccacgaccgctatgaaggcgcctcacccgccctccgctagtcgatggctgtggaaagctggaaatttgcctgtcctatcaagatgagaatcaacaacataaagttctagaaggattcaaggacaggaaagatatctccttttattatccaattgattgaagaagttggcttctcgccggcatatgatttcttgtactacaggaagaaatacccacgtngcagaggctattctgacattgcttctgaccatgaaatatgatttcctngtactacaggaaganaaaaaaaaggggggg

SEQ ID NO: 85772 - DNA, 604 bp, Triticum aestivum
  unsure (1)..(604): unsure at all n locations
  Clone ID: PAT_TA_85772
ccccacctcccctccctccagcaaactcacgcatcccaccaccgaagctcccaaccccacccnaagcggcagccatggcccccaaggcagacaagaagccggccgccgagaacaaggtcgagaaggcggcggagaagacccccgcgggcaagaagcccaaggccgagaagcggctgccggcgggcaagacggcgtccaaggaggccggcggcgagggcaagacccggggccgcaagaagggcagcaaggccaagaagggcgtggagacgtacaagatctacatcttcaaggtgctgaagcangtgcaccccgacatcggcatctcctccaaggccatgtccatcatgaactccttcatcaacgacatcttcgagaagctcgccggggaatcgggccaagctcgcccgctncaacangaacccacatcacctcccgggagnncagactccgtccgcctcgtcctccccggggagctcccaagcacccgtctccgaagggnacaaggcgtcacaaantnaactcctcctanacggaagatgcncncttgtngtgcaaattggctgtcgatgtacncnctgttgcccggcttactgcagtnaanttg

SEQ ID NO: 85773 - DNA, 633 bp, Triticum aestivum
  unsure (1)..(633): unsure at all n locations
  Clone ID: PAT_TA_85773
acaatctagttcacatcactatgtgattaacactcaatgtgttctggtttgatcatgttatgcttgtgagagaggttattagtcaacgggtctgaacctttcagaaccgtgtgctttacgaatatctatgtcatcttgtggatgctaccacgcgctatttggagccatttcaaataattgctctactataagaatccggtttactactcagagtcatccggattagtgtcaaagttcgcatcgacgtaaccctttacgacgaactcctttccacctccataatccgaagaaaatccttaatccactaggtactgaggataagttcgaccgctgtcatgagatcctttcccggatcactattgtaccctcttgaccaactcaatggcaaggcacactacatgtngcggtacacagcatagcatactatagagcctacgtctaaaagcatangtgacgacgttccgtcctttctccatcntccggctgtggtcaagtcctgtgtcctactcaatactcacaccttgttacacaagccaagaacccctccttgcngatcaattttgaactcttcaaatcatgtnaagggtgcgtnctttgaangtacacaagggtcctgatnnaccccatgggttg

SEQ ID NO: 85774 - DNA, 348 bp, Triticum aestivum
  unsure (1)..(348): unsure at all n locations
  Clone ID: PAT_TA_85774
gatcgccctccttctcntantcntcgncgccgnccatggcntcnccgtggncatcanccctacacccatcancaacaccatatgctctgcgctcnctcacagccccaatgtcacaatgcacgtccactacnaattctgcgtcngctcgctttcagccgacacngcgtcctcgnntgccacggacacccgcnggctaacggcggncgcngcaanccttactgtcgnnaacctaacatccanngagcacatcatctcggaccncctccataatctgggccnttgtctcancgactacanacagattaaccgcanngttgcngcattcgctcnaataacatccgaagcggg

SEQ ID NO: 85775 - DNA, 571 bp, Triticum aestivum
  unsure (1)..(571): unsure at all n locations
  Clone ID: PAT_TA_85775
gcttcctcaaaatctccccgatctgacgaccctgccgctggtttgcgcctctcgccgagatcgccgctcgcttctgcctactctattcctccctcggaagggggctcttggcctcgccggtcatcctagtcgagctcgtcaccttccactccgcggccggcggcggcagcgaaccctcgcgcgtgctcctcgcctctggcagcggagctctcctcctcgtcgccggattgctaggcgccgtcccgctgcgtcgtgtacgtctgtctttgtcgtggacggagggaacacaagccatccacctgtaactcgcggcaggtcttccgggaaccctccccttttccccaccacacaacatgccgacgccgtctcatcgccattgccctaaccatccaaaggggggtcacggtgactgtgctggagcatccgtggggacggatccccgtcatcgacctcggcgtcctcctcaangcaacccgagcaacgattcaagcgacacacgagctcggcaagcctgcnaagacnggggcntcttcatngtgattaacatggggttcctaagggctcangaaga

SEQ ID NO: 85776 - DNA, 598 bp, Triticum aestivum
  unsure (1)..(598): unsure at all n locations
  Clone ID: PAT_TA_85776
ttgttgacggggattttaaaaagcttgaggtggtaccgaacgggaagcagttcatggagttattcaaggtatcatctttttgatatagaggtgacattcccattgtgtactacaaacttgaactggtaccttctgaactgaactttgaacacttgcagcttctgaactgaattttgaagcatgcacacaacttgatttcaagcatcgggttgacttgaggcctaacatcagtgaggtcagagacgacagttcatggcggtggctgtcgacaacggccaggacgccagaaaaaaactagcacgtctctctccctcgcgcgagtgttgaatcagtcgtgtgaaacctttgtgtgacatttcaatgcgcaatacgtgcttgggtgtcgccgccactccatgcctgctgcaacatcagccctcccatttatgcagtgtccccaccaccggggcggtagcccgtgcagncacctcaagcatcctccgctacccatgccatgtccctgtgtgacgcgggatcgcctcatcnggcgaggaaacagaactcggcggcatctacacgcgtcgnancactcantatcgggagaatgatgcatttccag

SEQ ID NO: 85777 - DNA, 151 bp, Triticum aestivum
  unsure (1)..(151): unsure at all n locations
  Clone ID: PAT_TA_85777
cncccttccagtcatctgacatctgctcccgtcntctncgctcctcttcncccgaggcaanaacgtccctcnntctccgaccngatcgcgatggccgccgggcgncgtcgccgncgattccactgatcnacaacctctgccacgccgtccc

SEQ ID NO: 85778 - DNA, 612 bp, Triticum aestivum
  unsure (1)..(612): unsure at all n locations
  Clone ID: PAT_TA_85778
caaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtgaccaggctcaagaaggagtgccccaacgccgactgcggcgcgggcaccttcatggcaaccacttcgaacgccactactgcggnaatgcggctcactactctacaaccagaaggcttaaagttgctgcnattgctcngctctttactactatcgagagtcaactcacttaatgttcccgtttgtcttaacggaaacttggtc

SEQ ID NO: 85779 - DNA, 599 bp, Triticum aestivum
  unsure (1)..(599): unsure at all n locations
  Clone ID: PAT_TA_85779
ccaggacatggcatgccttgctagtagacggaaggatcgtcgccatgaagtacaccagtagaagtggggtgtcgtcgaaggatcacaataccaagactttgcaagcagcctaacgcccaaaccggcgtgcgtaccaaaccccacggcgcaactcaggagcatccacaatcaacgagtgcaactgaacacgaaccttgaccaagagctccaccacggaaattcgaaacgattagcaagttggggaggcatcttgcgccatcaatgagcaaagatgaaccgagacatcaccaaaagcatgaagctcgccgcaacacatcggcagccatgggagggccttgatcatgcatagcaatagagacaagacaccttcatgagggggagacagatggccgccctgcgacgccaaaggcaccgccgccgacccccaagaaacacaccgaacaaccaccatcgaccctgccggtcgcacaacacacatcaaacccacagacatccccgcaacaacagtacccaacacggnaccganctgacttctaaataaggcttcaggaaggttccaccagattgnnccccatcatttgtcaagcaaacctgaacag

SEQ ID NO: 85780 - DNA, 629 bp, Triticum aestivum
  unsure (1)..(629): unsure at all n locations
  Clone ID: PAT_TA_85780
ccacaccgccgccaccacacacgcacaggaggggctcatcgcccgatccccatggccaccgctcgctgtcgcgaaccagcgcggccaccggcctccattcgccgcacctacatgcccatcagttgcgccaacctcctcttcaacgtcttcgcccatgagatcaagcccgggacccctacctcgccggatcgaccacgtctcccctctttgccccgctccccgccgccgttcgactgccacctcgccggactccgtcgagcctcgccggcgaacccctgcatcggggaccctgagactgtcggcaacccccagtacgactatggtgtcgacgaccagtcctttgcagcagagcttccagatgacggagcccaggagccaagctgccactaccgtcgatggctacctctactccgacagtggctacttctacgttcacgatgctgacgggcaggagtaggatcggagtccaaggcaggaggcttgccttttcgatngttctgtttttgtgctacctttaaagnaaactggtcaatngatgtcgtactcnntattggtgcttcgctgatcgcttgtcccgancttcgtattcagcctcnaggcctggctttaanagaagctgnttattcatg

SEQ ID NO: 85781 - DNA, 601 bp, Triticum aestivum
  unsure (1)..(601): unsure at all n locations
  Clone ID: PAT_TA_85781
accaagaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttccactgatgatgttctgcttggcagatnaagactggatttgctgatgcaaggactgattcntcgtgatgtcgcaagggtgaaaacaatntgnctgtnaaggaatcgtggggaagtaacacttgctggttctactcatatggtaca

SEQ ID NO: 85782 - DNA, 401 bp, Triticum aestivum
  Clone ID: PAT_TA_85782
gaggaacctccgctgcttggtgcctaggctcgcggacaagtttgttttctctatctggatcatgttacgttccattggatccctacagtgccccggaggtccggattcctttgctggagagaagcatccaaccacaacgtactacgttggccgacaatgtttccgtgcctcatcagctgcctgttcgcccgccagtgacgaagaatagcctgctgcctaaatatatctatctatctatctatcttgtctattgtttattacatgttgattcccgtgtgtaaagctagccacagttgcggtgtcctgtcctgtcctgtaagatggatcgatgttctccgtggtactgcatgtccccgtgcgtcggtatcaataaaccctccgctttctttaaaaaaaaaaaa

SEQ ID NO: 85783 - DNA, 608 bp, Triticum aestivum
  unsure (1)..(608): unsure at all n locations
  Clone ID: PAT_TA_85783
gcatcccgccgcctcctccgcgtctggcgccgccgcaccccatctggtgcttgaccccaatcccgccgctgccgccccacgcctccagcgccgtctccatcccatggagggccgctcccttgccttgccgtccagccactcctacgccgcctccctctcgtcgagggacgcctccctcgccgtccagcgccgccccctcgctgtccagcggctccagtgccgcctccatcccgatcgataggcgcctccctcgccgtccagccaccccaagcgccgcctctctccccgttgactgggtcctccctcgccgtccatatctgcttcccttgccgtccagatctgatccccacgacggccaagcagcctcacccttctgtctccctcccagtccagctcctcccactgccgagtcaagtcntggcgaactacaaccgacctgaggagaggaagaccaatanagggtccgaggctagcatgtcagctacacgggaaggaaggaggaatttccaatacatcatctctgcagtcnaaaatctaaattataacatgcacaagccttattacaagaaacactggaangtaaggggcgcgaaacatagctagcgcgg

SEQ ID NO: 85784 - DNA, 602 bp, Triticum aestivum
  unsure (1)..(602): unsure at all n locations
  Clone ID: PAT_TA_85784
accacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgattaagcaaggagtgctgctccggcgtgcaggggctgaacggcctggcccgcagcagcccggaccgcaaagatagcgtgcaggtgcctcaaagacctccgccaccaagcatcaatccatcaacatgggcaagtctccggcgtgcccggcaatncggcgtcagcgtgcccttccccatcaagcatgtccaccaaactgcaacaatgtcaactattcaatatataatccttcctacgtgcatgcatggaccgcctgcnttggagcttaatttcaacgttgatggagtgctcatacaatgttgagctactaaaaataaaatgaattnctgtgtgtgtaattnagtagtgtgtcaagtcgtacttcacaacacgtt

SEQ ID NO: 85785 - DNA, 467 bp, Triticum aestivum
  unsure (1)..(467): unsure at all n locations
  Clone ID: PAT_TA_85785
gctgcccagcacacacggattagctaagcggccatgggcagaaaggagtgcatctctctagcaatcctcgcgcttgtactgctcgctggcccgggcgcaaaggcaacggcctttgcgggcggcgccgccagcatggacgcggcggtggcggtgcggcaggtcatgccaacgtcgtcaatcaagctggaggacggcgtggcgcctgagcttgcagtggtcctggagatgcaccgccgcgtcctcatggacagcttcggcaacagcgtctacaacagcgacacgcaacgctgccttaaagctccgtgcatcgccggagggccgtacagcggnggctccggggaancaaccacgttacgggtgcgtccctatgttacagaatggacagcatacatangggcgtcaatgcaactccntcctgcacttccccttttaattccnnngttgcatttcngtntcaccgttgccaa

SEQ ID NO: 85786 - DNA, 483 bp, Triticum aestivum
  unsure (1)..(483): unsure at all n locations
  Clone ID: PAT_TA_85786
caccgtctccgccctccgtcgcgccaccggaccgccaccgccgctccccgtcccccccttcccggtagaaaatggccgacgccgaggacatccagcccctcgtctgcgacaatggtaccggtatggtcaaggctgggttcgctggagatgatgctcccagggccgtcttccccaagcatcgtgggccgcccacgccacaccgggtgtcatggtcgggaatggggcagaaggacgcctacgttggtgacnaggcgcaatccaagangggtatcttgactctcaagtacccatcgagcacggtatcgtcagcaactgggacgacatggagaagatntgggcatcaaaacttctacaacgagctccgtgtcccccaagaggaacaacctgtccttctcaactgaaggcgccgctcaaaccccaaaggcaatctnaagaagatgacacagattaatgttcgagaacttcaanactccctggctaagt

SEQ ID NO: 85787 - DNA, 312 bp, Triticum aestivum
  unsure (1)..(312): unsure at all n locations
  Clone ID: PAT_TA_85787
aagacgatggccaagaggcatgctgagtagtggaatgtgtgttcatgatttaacgtacaaccaccgtccgttcatctgtatatctggttacatctgcatttatagcttctgagtagtcagtcaccaccgtagctcataccgatgatttcagctcggctgtcatgtttcggtgtatgactacccagccagcctttcctanacgctcgatttgtatatatgcctggttacggttgcgtttacttatttgtatgttaaatcttcctagtcttgtatntatggctgcatctttcagcttgtcttaaaaaatanaca

SEQ ID NO: 85788 - DNA, 186 bp, Triticum aestivum
  unsure (1)..(186): unsure at all n locations
  Clone ID: PAT_TA_85788
tcaatgcaaacaccgacganccactcnccagtttttccaattgccacatccacacacagattaacaattgtgcacntggnaggtantcagtatcanatatgagtacaggagtcangtccagtccagtnaatncaaagctgactggnggtttnagatnggcgatagcantcccaaatgcgaaatttc

SEQ ID NO: 85789 - DNA, 605 bp, Triticum aestivum
  unsure (1)..(605): unsure at all n locations
  Clone ID: PAT_TA_85789
gatccccttcgagtccggcgtccccgcctcttcgagcccctctccgcttcccctcgatcctcctcacctcgtgcatcgccgccagatctgcgccacgccagccgcgggcgtgacctgcgtctcctggtagctagctatcgccaccgcccctggtcgccgccgcagctcaccctcgtcgccggccggaccgttttctgcaaggtgcaggctccctccctcgctcctccttctgttaatcaagtcctccgtcntccttcctccttcctncnactcnccttccnattcttgtcngctctccgaccccgtttacattacnagtctctaatcaaanaactccgttcaantggtaattganatcgcaatngctaataaaagttgggtaacccttgcccgncngttcttccaagcnaaattaagccngcgaacttaaatcnnaaacaatcctgaanggagctaangcaaccgcaaatctcctggctccccnaacctccngtccgcctcaactgggggaatccttgcgtccgttgcctaaaccgcaaatncggnacaaagctccaaaaaggaaggnggctcctnggtcaaaggggtcncccctnaannggaag

SEQ ID NO: 85790 - DNA, 588 bp, Triticum aestivum
  unsure (1)..(588): unsure at all n locations
  Clone ID: PAT_TA_85790
gactcctcatcccctttccaagaagcgcaaccgaagcaatgcccgctccgacgcgcccgcgcgggctcgccgccgccggcagggcggcgctcgcgctcctcgtcctcctcgccgtcgccgcgcctcggtgccgcgtcgcgcgcgcgcagcagcagtacgaggccaacaagcaactcaactgctacggcaccaaacgacagctccgtgcttggctacacctggcaaacgccaaccgccgcgggcccgccccttgcgcctcctaagttcgtctttcggctccttcccggccctaagantcgcccgtnaacatctcctacctcctnaangccaacccnggcggcctcgcaagngcaaagccgtncccaacgttttcngtcgcggctccggctcgttctcgcgncgtcaaatgcggntgccgccggcggtatacaacaaaaaaacgttctatacatccanttancaaagagaactaattnataacggcaaaataactacaaggggctcaacaactggcaaggcctcantnngcaaaaacccaaccacnatancngaagctcnttntcgggaaaaactnaacggntcnatngt

SEQ ID NO: 85791 - DNA, 583 bp, Triticum aestivum
  unsure (1)..(583): unsure at all n locations
  Clone ID: PAT_TA_85791
gttgcagaggcctagaacctcagcccaggcaagaacctctcccatggcgcaaccctgccatcctcctcctggcgctcctcctcctccttgcttcccccgccatttcatccaccaagagaacccagcagccaaagttcccggccatcttctacttcggcgactccatcttcgacaccggcaacaacaaccacatcccgactctgggcctggcgaaccacccaccatacgggagggacttcccggggagcaggccgacggggaggttctccaatggccggctcgtaccggacctcctcaacgaagaggctgcanttcaaggantcgccccccgttcctggacagaagcctgtccgacaaggacatcatgacgggggtgaacttccctcggccgggtccgggttcgacgaccggacgtcgcacctgggccaacaccatgccattgtcnngcgcaagtggganctcttcannggacgagtaccttcctcgccctaaggagcatcgccggggaacaaggaggcnccangatcattgcanctctctgaagttcanccacncgggaaacaatgattnactcaatactacg

SEQ ID NO: 85792 - DNA, 589 bp, Triticum aestivum
  unsure (1)..(589): unsure at all n locations
  Clone ID: PAT_TA_85792
gatcggtggaagactccataatatcatctccagcttcgtctccataataatcattgtcctcaaccatcactgtcttcttcatcatcactgccggtgcatgtgtctgtgtcatctagtatgatgtagtcttccgaacgaatgtccacttcaggttctggtttcaccacgggtatttctagcttcttcctcaggtcttcattctactctagaagcatagcaatttcctctttgtatccatcgcgagttgccttgagttcctcctctagttccatattccgggtcatcaccttcttggtcttcttcatgatagcgcacatctgattctcatatcgatgaatgtgctgatccatctcctgtatgtatgttgcaatagatccatccttcctgggtgcgaatcaatctcccaattgttcatcccggcgtccacatatctggtaaacggtgtctcgagatcctgttntacacctcgcaaatgcgtcaaaaagtgattngggggccaangctccttcntaagctcanngttggtgatcaaacgaaaacnnaatggctcagtattnggncagaagtccttctaggaacaaaacttggg

SEQ ID NO: 85793 - DNA, 565 bp, Triticum aestivum
  unsure (1)..(565): unsure at all n locations
  Clone ID: PAT_TA_85793
cccgattcttctccaccttccaccgtcgggcgtcgtcccccgcaactccggcggcctccttcccctggctcaggctgcctccctccccagctccggccgcctcccttcccagtgtcggcctcctccctccccagcgccggcctcctccccagcgtgccgccggccgacctccctcccagcgtggcgccagccggcctcttcccagcgcgcctccggccgaccttgcctcaagcgcgccgccacgacggccctcgccgccaccaccanctcncaccgcaaccaccaccaccacctcccaccgcaaccaccaccaccttctcatcctcgtnagcccacgcccgtcaatcncncacgnaaccccgccgcctccatccctcctacacnggcnccgcccttactcgccgacgacagccgccttcctcggngcngggcagccggcctttntnngcggcgcnggccttcttcnaccttcaagctcaaggacgccttccttnccngggctccgggtctcctncatcctcgngngccgggntttcccgaacccgcgcntggtcngcctttattc

SEQ ID NO: 85794 - DNA, 575 bp, Triticum aestivum
  unsure (1)..(575): unsure at all n locations
  Clone ID: PAT_TA_85794
ctccactccactagctaagccacacacccaccccacagccataccaagcacggtacagagagcggagcggagccatgagcaaggaccggcacgagcaccacctgcggcgctgctgcggcggcctcgcggcgtgcctcctgttcctggtcgtcgccgtcgccgtcaccgcgctcgtcgtctacctcgtgctccgccccgccaagccctccttctacctgcaggacctgcagctccgctccgtcagcctcggggacccgtccctgtccgccaccgcgcaggtcacgctcgcctcccgcaaccccaacgaccgcgtccgcgtcctcctaccgggcgcctcgaagtcctccgtcacctaccgcgaccaaccccgttacggtgccggtttcgctgccgcccgcgttacaaggccaaccggggactncacaatctgggcccccntnntgtcccggggattccnngcccttggcgggttcgtcgcngacgccatgaaacaaggaatcgccgccgggntacttggnacngcaagtcaaggtcaacggcgctccggtggaaggccgcanctggtnccggcaatt

SEQ ID NO: 85795 - DNA, 507 bp, Triticum aestivum
  unsure (1)..(507): unsure at all n locations
  Clone ID: PAT_TA_85795
gccacccacgacgaatcaatcactctcccatcccagtctccagctccccgccgtagcagcagccagctagccagatcgatcaatcgcaatggagggctgcgaccggatcaggggtccatggagcccggaggaggacgccgcgctgcggcggctggtggagtgccacggcgcgcgcaactggacggccatcggccgcggggtgcccggcaggtccggcaagtcctgccgcctgcgttggtgcaaccagctgtcgcccggggtggagcgcaggccgttcacggccgaggaggacgccgccatcgcccgcgcccatgcgaagactcggcaaccgctgggccgtcatcgcgcgcctgctgcaccgccggancgacaacgccgtcaagaaccattggnactgctcctcaancgcaagctcgccnaatgttggcgttcacaagatgaggaacngccntttaaagcgcgccaancgtnangccnggagagcaactccnggattggggtccgggt

SEQ ID NO: 85796 - DNA, 588 bp, Triticum aestivum
  unsure (1)..(588): unsure at all n locations
  Clone ID: PAT_TA_85796
ttttttttttttttttttttttttttttaaattaacttatgtagtactccctccgtcccaaaataagtgactcatcatgaatgtagatgttctgcaaggcgcaccccagcctctagtatatacaacaaatggaagtctgccttaaataagtgaaagttttgcattcggtgggagcctcttcaggagagggcctctaaccatatcaagagcagcactatctactctaggggttggttcccctggatccaaagcatcggttagcctttgagctgtgtctacagttacgacctgtattgcaggagcattttcaaccacgtgcatgatgaattcagcttggcctcttgcccctttggaatcctgtaacatgcatgtccttcangattcacatatttatcttccaacagcggtatttcttgtctccaaaggtccaatcggttgcaaacacatngtataaaggcaacggaaantacttccaacttcccaangaaacggngaaacccttagnanaagnaacaagnagaagattttgcactgnctcatgnagtntaaccancagtatctgcacaatgccnaaggnagaaaaccacg

SEQ ID NO: 85797 - DNA, 446 bp, Triticum aestivum
  unsure (1)..(446): unsure at all n locations
  Clone ID: PAT_TA_85797
agaaagtattactccatgggagctcaaaagggtcctgctggggttagtgtgatcatggtgagtctgatcatagtgatcatgtccactgcggctatgagctgctcgaagaaggcggccaccgacgagaagacgtcctggccggaggtggtagggttgagcgtggagaaggccaaggagatcatcctcaaggacaagcccgacgccgacatcgtcgtcctccccgttggctcnccggtcaccaaggactacaggtcccagcgcgtccgcatcttcgttgacatcgtcnccgagaccccccacactggctagctaagctacctgcctaaacataagtatttatttttgtcaagggtatacatggacgaataattcatatacgcccgccgcatatggatcaatgcntggatgtcacgggtttgtgtgctnctctgganccttgntattnc

SEQ ID NO: 85798 - DNA, 567 bp, Triticum aestivum
  unsure (1)..(567): unsure at all n locations
  Clone ID: PAT_TA_85798
tgaagatgcatatgtcatggcattgatgtaaattctggtaacacgatctagttgattagtgcttgatacacaatctagactcatttagttttgcttactgttatggctgttgataattctggtgtatgtagcaaggtcatttattgttattaagatcttatgttacttctcctagcatatatataaatatctggatgtgcaatgcgcataatgttggaacggaatatattatttacggagtacatttgttgcctacaatgttggttgatgcggaaatttttcaggtatttgatttttatgtgaagccctttaattgatttcctgtattttgtttggtgggctaccaggttaactgttttgtgttttttaatgtccgggcatatgcttaatcatacaaaaggatttgccaatactacattctatctcctgttagtgcctgtagcgtctnaataatttaattgacatgtcnaatttccaattggattttaagctanccctcaagatnccaanaacatcccantnatcctacttgggaacaagattgacgtncatggggcaaaagcaagg

SEQ ID NO: 85799 - DNA, 436 bp, Triticum aestivum
  unsure (1)..(436): unsure at all n locations
  Clone ID: PAT_TA_85799
tgcgttaagtgtcatgttaagctcagcacaggagcgctactgctaacgagcgcctattaggccggcccactgcaaacagtgtcaattttatttagtttttttttatcaattaaggactatagcttccgtataatatatgtttgggcatcaaatgaactctgaattggatgaaatctatatgtggcctctctagattataacaaggccacatgaaaaatacaatccaagtggacttcatttactatttatttagaaaataaatccatttgttaaataaatgggttttgaactacgagtaatangtaggcttaggctaaaattgtgaaataatttgagtagctcccaaatatcacaaaaagataatgtgcaaagtgtggaggtgagtcttggggctaaaacaccaaaanggagaagggtttatttatcaccagtatag

SEQ ID NO: 85800 - DNA, 486 bp, Triticum aestivum
  unsure (1)..(486): unsure at all n locations
  Clone ID: PAT_TA_85800
caccactccttgcttccagttccaccccgcgctcgtanaagcacctcccaacggagaccgatggccgctgctaagccagcctgctccgctcccgccaattccgccgacgcagccaaaccggcggcggcgccagaacccgagcagcagctgctggaggtggcggaggaggaggtggtcgtcgacntcaagcccaacgccaagtgccgcgtcgacctccgcctccgctcgctgcanccnangctccccgtcgccttcaaggtgcannacctcctcgncgctcaagttctcgtcaagcccgccgcgcggngccctgtcagccgctctccatgncaccatcngcgtcngtgctccagcccgcancctcacncgccgccgtccntcccgcgctcnngtcgccgaccgcttcctcgtnctnctccntcccttnctgccncgcancgcgaactccgnagnngccgttgccnnggcagcgccggngtctgcatc

SEQ ID NO: 85801 - DNA, 576 bp, Triticum aestivum
  unsure (1)..(576): unsure at all n locations
  Clone ID: PAT_TA_85801
gctcgacacaccaagtgaaagtgacgaaacccaaaagcagcgctccggaaaccaaaagactttcccattagaagtcaaaatagtgaactcacttgatgtgataacacacagcgcggcacctgctataccaggacaccgtccgcagactggggatagaacccaccaaaattcgctatagcggcacttccttcaaaggatcgacgccaggccttttaagccaattttacaggatctgtaccactagaggtcgtgttcggttcatccgacaacctccgtcgcgagaagctcactctccatcgccccatttaacangtancccttaagcactactggggcgcgaagctttcgcctgctttaacngcaatacaacattacgcgtctcttacggttagaaatgcccggtccatgtggcataatctcacaactccngantgtccctcgaccacaggagaatgtgcactgcgtcgacngtcacacattaaatcagncctttgtaggtcaaagtcccctgaanaancangtcatttanacctccgacatngtttagncaagtccggcgttatgcnaacgaggggg

SEQ ID NO: 85802 - DNA, 542 bp, Triticum aestivum
  unsure (1)..(542): unsure at all n locations
  Clone ID: PAT_TA_85802
gttctggcactcctgtaacctgttaccattttacattcccaagcaacagacttagaaaaaattggcaataacatacgtgtacacatttcatattcatatatgtatgtgcaaatagtcaggaaacatttgtggagtagaacccaatttgtgcattaatactgagaagtacatggaaataaacctttgtgagtacagctctgctatgtaggttactggtggaatctgcaggacttataggttaactattggtttgacgaataatgaaaatagcttaccaagactgttggattttttttccagaccaccattatattattgtatcatttttcttcccattattggaacccaaataaggtaggatcatttacataaaataataattgtacgggtcaatgaactcagtatgtatttgggatctttgaacagtttaacactttagatttggttcaggcaaagatcattgccagttgatctcccaagccgttgagaatgaaaacatgggggaaattgaacatgcaaatgtcaaccgccagtntgcaccn

SEQ ID NO: 85803 - DNA, 382 bp, Triticum aestivum
  unsure (1)..(382): unsure at all n locations
  Clone ID: PAT_TA_85803
gcgcagcgcagcccgctgacacccgctcgcagcttacatcacanaccggttnaanagcaatggncgtggaacagcggggacnccgccgccatggccgtcncggtcaccggcacccgcacggtggcgccggcnaanaccaaggtcaccctcgccaccttcganctgccctacatcancttctactanaaccanaatctgctcctctaccgcntcncgcagggngccgccgacttccaggacntcaccgngcncatggtcnatnctctcngggangcgctcgctacttctanncgctcgncggcaggtattngccatcagaatggntgactgcggttccnctgtaccgtcnncccggnacgcaggttagcggaaggntcatccg

SEQ ID NO: 85804 - DNA, 561 bp, Triticum aestivum
  unsure (1)..(561): unsure at all n locations
  Clone ID: PAT_TA_85804
gtggacacggcttttgccgtctatgctttcatccaccgaaagcatatttcctcgagtgtgcgttccgtttttcctattaagggcctgtttgtgatgatttctttacagataggtccctggcagaaaaacaactataactccgcaatcgtaactccgtttgaggtgaatcgaaagcccagttcttcattttgtcgagcccattctgatggaaccactttcaccatgttttgacattctaaaaatgaccattttgcccctgcccttaatcaccccccttcgaagagagtacgattttcggtgattcgttccgcaagtttctcacactttctcccggtgatttcttccaccccagattgcaggtgatgccgtgatttcttgattgcttgttgtggcttccgttcgtgcgagctanatcatgtccagccagagtccctgcggagtgtagttcaacaacttcctcgttgttccactggctagaaagattccgccgctttgagttgttccgctgcnagcatacagcaagtgtattacccaggcgtatggtcccaagctgattgattg

SEQ ID NO: 85805 - DNA, 583 bp, Triticum aestivum
  unsure (1)..(583): unsure at all n locations
  Clone ID: PAT_TA_85805
tgaaaccgcccccctctctctcgcgacgccctgcccacacgccgtcgccggaccacccccatcactgcgcgcccgcgccgtcccgcacccgacgtgcccgcgaccgtgccccgacgcccggcgctcgccgttgcccgggaccacctcgcctgacgccatcgtcttcgacctctccgtccaccgaactgccgcccgacgccgtccatcgccggagctcctcctcgccggcctgcttccacctccccaccggaatgcctcccctgcgacgtgtcgtccccgtcctcctccccgagccctgctgcctcgaaccctacggcccccactacgagaccgacgctgctgctgcccagttcgactacggagttgacgacccctccttcttgtccgagcaaccannacgatggagcccaggagccaagaagcaaccggtcgatgacgactactacaccgggaggtgcctactagtacgtgcagcccgcttgacgacaactngggagtagtttaggaggatccaggcaggaggcctaancctctttcgattcggtanccgagtttgtgctagccntcttaagggaaacttttg

SEQ ID NO: 85806 - DNA, 177 bp, Triticum aestivum
  unsure (1)..(177): unsure at all n locations
  Clone ID: PAT_TA_85806
ctgctgctgcttgtnanatctcgatcgccgangccttttcttggtcgaatcganntccaagctaacaacagntcagatggccgctgacgaggccaanaaggtngnggtgnagacgnccacggccaccanngacatcnccgacgagaacgccatcntgcccgtgcccgacaactccaa

SEQ ID NO: 85807 - DNA, 288 bp, Triticum aestivum
  unsure (1)..(288): unsure at all n locations
  Clone ID: PAT_TA_85807
cgacaaccaactccgcctcgacctcccgccgcatctccgacgacatggcccgcaccaagcagacggcnangaagtccaccggcggcaaggcgccgaggaagcanctggccaccaaggccgcccgcaagtccgccccggccaccggcggcgttaagaagccccaccgcttccgccccggtatcgtcgcgctccgcgagattcgcaagtaccagatgangcaccgangttgctaatcggnagntnccccttcaanggctccgttccgggaaatttccaaaganttttaaa

SEQ ID NO: 85808 - DNA, 487 bp, Triticum aestivum
  unsure (1)..(487): unsure at all n locations
  Clone ID: PAT_TA_85808
gtgcgatctcccccaatccaattccaatccgccgcggaagaagcgatngacaggcgctcgcgaggatgatctaccgcaactggtccctgctctcctccacggtggtcatctggggcagcgtcggcgccgccggcctcgccgggatcttcctcttcggcggcaanggctatctttctcgcgaaggtgagaggctgaggcagcaggacagagccatgatgggcaagaactagtgcagagcacggctcactttcgacgtgtcaacatgtgaactagacatgaaacgacgtatctctgctgtagaacaaactttctctgcctgccaatggcaccttttgcttccgggccccatgaataatcntgacgcggatgttcaatctgttccccaatgaatantctcgacgcccatgtttgctccggtccccttgggaacctgctgtttgtcgactttgttctgggcgctctgaataagattgntactgatattcca

SEQ ID NO: 85809 - DNA, 161 bp, Triticum aestivum
  unsure (1)..(161): unsure at all n locations
  Clone ID: PAT_TA_85809
gaananacaagcattttancatanatgcatcancttagntacaaaatcnatatacagnaactatgctangtctgcagtttgtttcatgcatcacctgagtgtactgcactttctgtgcancaccaacctgnngcnaaaagaanacancactgtncaaccta

SEQ ID NO: 85810 - DNA, 263 bp, Triticum aestivum
  unsure (1)..(263): unsure at all n locations
  Clone ID: PAT_TA_85810
tctgggcatccatgctcctggcaatggcaagattcgagatgtcagttgcttgtcttcaaagcctcaaccttaatccgactcctaataaggcaatcaagnttaagttaancccnaacaacttaattttccaattntcctccgananaancttcnttnccaagccttncccatcaactggaaatccaatnagaaangnaaggggcgcaacggnaaggnaatctcaaatcataatgggagttttaattaagtttaaaaaaaaaaaa

SEQ ID NO: 85811 - DNA, 562 bp, Triticum aestivum
  unsure (1)..(562): unsure at all n locations
  Clone ID: PAT_TA_85811
tgagtactcacgcccaaccttcacgaccgatgaaccacctccccacccctctttcctgctatggccaccccctgcgacgcaaagcctcctctccttcctgaactctgtcgtggcggagtcgacggggtgctgctacgaccccgagggaacggccgtgtttctgtggtgaaattgctggaaccgggcgcgagcaagctggagccacagtcgcgggatgctgcaacggtgctcgaccgacccggcactgggagctgctgaaaagcttcaaccgtggtgaaatttgttgaaaccggccgcgggaaaagctggaaccgcggccacgagatgctgcaacggtgctctactccgccggtgaggagatgcagaaaagctacaaccaccaagcggcggtgctgggaatcgtggtgtagaaaagctgcaacccccaagtcaaacagtggcaacggcaaggcttttcttttcttttgctgctgccggcggccaagcgtttttgcntgagccgggacctcaaatcacccgggtatttttgttaatccggcatcnatttttgctnnaaaaaaaa

SEQ ID NO: 85812 - DNA, 178 bp, Triticum aestivum
  Clone ID: PAT_TA_85812
ttgtttttgatttttatttttcacttggtagtcaaaagttatgtatccttgtgccaaataaatccattgagaatgactactggatttgtgttgattgttttcttttccaaaatacaatttgctgctactacttcataatgtttgaaataatttctgcatttcgattaaaaaaaaaaaa

SEQ ID NO: 85813 - DNA, 414 bp, Triticum aestivum
  unsure (1)..(414): unsure at all n locations
  Clone ID: PAT_TA_85813
gtccggctctattctgctctactaaccgatagttgccccgtccgtgcgcctcgacgccgccggcgagcgagcgaatgccggggctctagcgctccgcgtatcgccgacgacgggcgggcgggcggccatgaggaagcacctgccgcagccgggccgccacaggtggatgcgctcgctgctgctcgcgctgccgctcctctcgctcccgatcctctacgccgcgctcgggccggcgcgcacgcagcagccgccctccccgccgcggctcggggggaggcagcagcagcagcagccctgccgccgcccaggctggcgtacctcatctcgggcggcccggcgacggccgcggtttcgccgcctcctgcgggcgctctacaccctggaactactactcgtccgggtncggggaggagg

SEQ ID NO: 85814 - DNA, 603 bp, Triticum aestivum
  unsure (1)..(603): unsure at all n locations
  Clone ID: PAT_TA_85814
cccccaccggcgaagcatccaaaccctagactcctccccccaccaagctccgatggcccgcacgaagcagacggcgcgcaagtccaccggcggcaaggcgccgcggaagcagctggccaccaaggcggcgcgcaagtcggccccggccaccggcggcgtgaagaagccccaccgcttccgcccggggaccgtcgcgctccgggagatccgcaagtaccagaagagcacggagctgctcatccgcaagctccccttccagcgcctcgtccgcgagatcgcgcaaggacttcaagaccgacctgaggttcccagagtccgccgtctccgccctgcaagaggccgccgaggcgtacctggtcgggctgttcnaaggacacaaacctgtgcgccatccacgcccaagcgcgtcacatcatgcccaaaggacatccaactcgcccggccgcatcccgcggggagccgcctaagttttcggnccaccgccgggtgatatgcgtaataaccgttcccgtctggtgtcttcngtcngttggtgtttatatggcgtgtctcctgtccaagttncctgatgctgggatgaaatgcantgaaaattagttaaaa

SEQ ID NO: 85815 - DNA, 574 bp, Triticum aestivum
  unsure (1)..(574): unsure at all n locations
  Clone ID: PAT_TA_85815
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcacccggggcaacggcaccggcggcgagtccatctacggcgagaattcgccgacgagaattcgtccacaagcacaccaagcccgggattctctccaatggncaaacgcggggcccaacaccaacggctcccanttcctcatctgaaccgtcccctgcaattgggctcnangcaacaacttggtcntcggcgaagtnctccnagggaatgactcgtcaanaccannacaaggtggctccgcancgggactngctcaaagcagtggncntcgacactggnggcaa

SEQ ID NO: 85816 - DNA, 529 bp, Triticum aestivum
  unsure (1)..(529): unsure at all n locations
  Clone ID: PAT_TA_85816
ctagcttcagctagccaccctcttccactccgggcattttcttgcatccacgacggcaatggccaccgctgatgtccagaacccgacggccgcgctgacggaggaggcgcccgcggtggagacgcccgtcgccgccgaggaggccacgaagacggaggaggtccccgcgccggcggaggccgaggtcgaggcgcttgtccccgtcgaggttgaggagaccaaggaggaggcgccggcagccgctgagacggaggagaccaaggacccgagccagcagctgccgccgagccggaggccgangcgcccaaagaccagagngccaaccttcgtccangcagagaccaagaggcctttgctgaagcagaccggcatcctcgaagaagtgaaaggaggaggcgggcctgtgcccaccaaagntccggcgtcnccnaaggaacaccggtgcaccgacgggaccgctnccccgcaaaagaccggccccccgtggcaactcacctttaagcccggnccncgagaaggcggctagtac

SEQ ID NO: 85817 - DNA, 573 bp, Triticum aestivum
  unsure (1)..(573): unsure at all n locations
  Clone ID: PAT_TA_85817
cgcagctccagaaccaggacacgcccactgtatacgcacagctcgaccgcaatggcgtcgctcgtcgccgtccagccggtcgccgtgaggggcctggccggcagctccatctccggccgcaagctcgccgtccggcccgcctccgccgccgtctcccgctccacgcgcaggtacttaacacgacttactaacacacgtaccatctagagcaacagatcgtgaccagctccggcacgtgaacgcagggctcgcnggggcggcggtggtggccaagtacggggagaagagcgtctacttcgacctgggacgacatcgccaacacgacggggcagtgggacctgtacggcagcgacgcggcgtcgccctacaacggcctgcagagcaattcttcaacaccttcgccgcgcccttcaacaaagcgggggctgctgctcaaggtgctgctgctcggcggcggctcgctgctcgcctacgtcagcgcaacgcctcccccgaactgctcccaatcaagaaggggcccagctgccggccanccggggacaccggcaagatntaaatccatccttctcttcc

SEQ ID NO: 85818 - DNA, 570 bp, Triticum aestivum
  unsure (1)..(570): unsure at all n locations
  Clone ID: PAT_TA_85818
atttgttctgttcagaacgtcctattacttacctgggttgattacttggaagcttgctctgtcctagcacatttgaatctggatattcattggtgcaagggaacaagcgttgagcccagtgcacttgatgtgtatcaagctggacatcggtcctatgagctccattcagattatcatctcttttatgctatcgagttgttggggcctcactggggcatctaccagctggtaacaccttgggatcctggacgaattgcattgtggctgttattgaaatggacttgacaaactattattcaaggagggtggggtgtcatcgctttcactgtcggcttcctgcaaggctccatcgaccacaactgccccggcttcgacaacgacaactttggcacctcatttggttgggtcgccaccggccacgggcaacacaacccgatngttcaagtcaagcctgatttcggctacaacactactcaaaggtaatcaanggaacatccaatgcaattgggatcaagccggctccttggtggttccggcttgggggcaaacccaattttaaggaaggggggn

SEQ ID NO: 85819 - DNA, 292 bp, Triticum aestivum
  Clone ID: PAT_TA_85819
ggataattaaaaaatatatttcacgcgagaatttgttcgagatcacgcgtcagttcatcacaaacacaatgcgcacgaaaggagacgacttcatcgaacataccgaaaggattacatactaagagacttaactctaaccctagctcacttgccgtaagcgagaggtaatgcttcacggcctacttgcccagcgccaccaccagtataacaattatgtagccgtgtaagaacctgatgttgaacaacaacattacactggcaaaagactgcaaactgtggctggctttgattc

SEQ ID NO: 85820 - DNA, 568 bp, Triticum aestivum
  unsure (1)..(568): unsure at all n locations
  Clone ID: PAT_TA_85820
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgagccggcgcccaagangccggccggcagaggcgagcacgaggatgaaggaggagaagcaaagcaatcatcatcaccatcaacaccacccagcgtatcagtacactagccgccgcatgcgctcgcgcgcgcgctaaataaaaataaaacctcatgtgttccctanttcngtacgcctccccttgtagtgttcaacaattgtcctcctcaggctcaacttcnagtgaatatatgcgcctcaactttgaggggggggcc

SEQ ID NO: 85821 - DNA, 583 bp, Triticum aestivum
  unsure (1)..(583): unsure at all n locations
  Clone ID: PAT_TA_85821
attatcatatgcatcaaatttgtgtcaatatgggtaattttgtaacaattgtatttttttgttcatattcccatgaagtatatgttagcttggatttatttttaaaaaagtttgcatcaccaaaaaaaaatacataatttacactaaaaatatgtacatgcacttttccccctagattatgtacattaatcatatggtgttttttgtagttcatagctgattttttagaacaatttacagctgattatttttgttgtttctaagttcattagcctaacaggctcacgcagatgcacacatcgttcagacatctctcacacttgcttggggatcaacattgggcagttgcccacataccccgttattcataatcctgccatatcatgttagcattggatatgttaagttattatttccgaaatatattttgtaagtatacaaactttttcaacgtaattaatatggtccaaataaaaacgtgagtagcaacatctggttggacgaaagaactatcccaaaatatcctttttccaangccnttaagataattantaatatacnataaccctagntcacccttnng

SEQ ID NO: 85822 - DNA, 559 bp, Triticum aestivum
  unsure (1)..(559): unsure at all n locations
  Clone ID: PAT_TA_85822
gcttcgtcagctccccccaccagatattttccccactcctgcactccccccacatctacccgacgcctccatcgtcgtcgccttcgtcgatcccgcggccaccatcgtccccgcgccataagaccgagtccgagggcaccgccgtcgactgctccatcctcctcgcccactggatcatggagggaccccctgcagcgagcactgcgatctcttcttcaccttcggctctgacgagcttctccgacgattgccgtcgctctactgctcctaagcaaacaccgagcctccatgtgctcctctgatggtggatccttggacccagatgccaccgccgacggatgctactacgtggaggccgtcgacgaccaagtgtagttaggangtcccangcaggaggattgcctcttcgatcgtgttgcntttgtgctanccttctaaagnacccttgtttaacttagtcggtactcagatatgttgcttcgctgaccctgtgttcnagctatgtatcnagcctcnaggccctggctgtaaaaaaaagctgtataatttgttcggtcca

SEQ ID NO: 85823 - DNA, 595 bp, Triticum aestivum
  unsure (1)..(595): unsure at all n locations
  Clone ID: PAT_TA_85823
gagctctacaatatggcaagatgaaaaattctcttttctaaaccaagatgatcgagtgatcacatatcttcacctcgcccgggactgggtttcttggagataactcttatttcctccgcaagtgttcttcgctcctcctccactcgacgttcttagtggggacggagaaatctgcatcggatggattagatatgtttatcctggttttcttctgctgaaatttgttttctgtcgacaagttcaacatgttgaggagagccccacgcacccacttcccggttgtgaaggactttgatgacgccatcaaacatttggttgatcttttgcgtacaagcaacgaccgttctacagaaggcaaactcgaagtattcgtctgttatggctgggtttggagggcgtgggagcatctgctgtccttagagctacatccaaactcctaaaactccacaacatgtgatgatttcaacacgaagaaagcattttgacagatcgtctacgtgggactgctcaaattgtataaacagaagggccatgcananggcaaacnncaaaggagttgaaccntcacaancaatgccatatttgataagcaagg

SEQ ID NO: 85824 - DNA, 496 bp, Triticum aestivum
  unsure (1)..(496): unsure at all n locations
  Clone ID: PAT_TA_85824
cgctgtcgtgcgggcaggtggactccaagctcgcgccgtgcgtggcgtacgtgacggggagggcgtcctcgatcagcaaggagtgctgctccggcgtgcaggggctgaacggcatggcccgcagcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataacccttcctacgttgcatgcaagggacgccccttgtgttggaagcttaaatgttctaagttgaatggaattgcncaataacnaaaactggatgagctnctaaaaaaattaaataaaattgcctgcangggtttaattcaattatggggtccaagntcggtaccttgcanananaaacgggttttgcaanaaaaanttatccaac

SEQ ID NO: 85825 - DNA, 379 bp, Triticum aestivum
  unsure (1)..(379): unsure at all n locations
  Clone ID: PAT_TA_85825
ctacaagaagagacaaaaagctgcgaagctccaccggcggatgggcgggccggctcctataaactanttggggtttccccccggggtggcaaaggaaanatttngnacnaaagggaaaaaaggccggnggatnggacnaaatgggatttttctggggtngggggncanntggaatttggggggcccgcccaatcngnccggccgnccctaccaaccnangtaacgtngcctgnaaggggccaaacgcccgcccaaaagcctcggggtccctnanaaggggnggcnaacctaaaantcaacccggtttnccctccnngggcccgggancnngaaaatntttnaaantnttttccnaaaanaaaaaaaaaggggcccccct

SEQ ID NO: 85826 - DNA, 577 bp, Triticum aestivum
  unsure (1)..(577): unsure at all n locations
  Clone ID: PAT_TA_85826
gcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaagtgccattgcggttttgtcaactcctgacaattgcnttggggttttccttttccatttatctttccttgtttggtncccaaagataagaataagtgtantccatgttccccgacatgncccaanaaagcatctcgtantnaatgctaccgatggctatgtatatcccatgc

SEQ ID NO: 85827 - DNA, 584 bp, Triticum aestivum
  unsure (1)..(584): unsure at all n locations
  Clone ID: PAT_TA_85827
gcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcaagctgctgcccctgctgctggaggtgctgctgcccctgcagctgagtcaaagaaagaagagaaggtcgtggagaaggaagagagtgatgatgacatgggcttcagtctgttcgactaattgtggggcacttgtgtctgaagtaaccanccttgggccaaggaaacaagagtccaanaatgttttagccttnattaacctgaattgtgaaacactggcangaaatgtttgganagttaatcnanccccnggttgcnggttgattaacggggaaccaaaccttgcnaccaantttg

SEQ ID NO: 85828 - DNA, 572 bp, Triticum aestivum
  unsure (1)..(572): unsure at all n locations
  Clone ID: PAT_TA_85828
gctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactgggacaatgtggaagctgcctatgttcgggtgcaacggacgccacacangtgatcaacgaagtggaagaagtcaaagaaggattacctggacgccttacgtccgcatcatcgggattcgacaacatccccaaggtgcaatgcgtcagcttcaatcgccttcaagcaacgggctgcnaggaatccggcaagggctaaacactcatcacaang

SEQ ID NO: 85829 - DNA, 568 bp, Triticum aestivum
  unsure (1)..(568): unsure at all n locations
  Clone ID: PAT_TA_85829
cttctttttagcctttcttttctagcctttcttgcgagccggcataggggctgtttttacagagccccttcaggttgctcgcaccagcaattggtctctgtcctctgttcttcttcgcttttattgaagaaaacagggctttagtttttttttttcgatttctacattttagttcggtttctgcacaaaaagtttcgatttttcgatcttcttctagttggcaatggcggccatagatctgtatggcgccgcgaaccagttcagctcctcatcgtcgtcgtcctcctcggaccaggagctcatgaaagcgctcgaaccttttatcaggagcgcttcattgcccacctcctccacctcaacctccacctcgccattttcattctacgccacctccacctcaacctcgtcgccantttccgtattacagttcctcctccgctgccccaagaacctgctactccctgcaacctccccctacagttacaccaggcttcaagctccgtttggctccgccgccccctgcaactcgtcgtcctttcgcaactcccggcttcngctccgaactcgg

SEQ ID NO: 85830 - DNA, 458 bp, Triticum aestivum
  unsure (1)..(458): unsure at all n locations
  Clone ID: PAT_TA_85830
agctccccccgaagccaanccgaatcccctttctnccggggcctcaacaaatctcgaangacnangcaagggtgcccgancggccggaacccaatctaaatcgagctccttcaaaagtgngcaaagctcnagcncnaaanaaaaaataggtatgggcacccctgggggaaaaaaagcgtgacatctagcgcctgaganagactattgggggttgattanagacaaccatngtggaangccccgcaaaggatgattggctgcaaccatgaaanctcctcntttttgctaactttagcccnttnatgtttccactttgttagnanctanccttngttgngctgggattcccttntagcctaatatncttnaagccaangttgntccntttngaacnggtccttaaantttgncnttggtaantaccncnaaaggtgttgggattnccngcccttgggggg

SEQ ID NO: 85831 - DNA, 619 bp, Triticum aestivum
  unsure (1)..(619): unsure at all n locations
  Clone ID: PAT_TA_85831
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcaagcaaggttgggtttatcttccgtgagcacaacgcatcccctgggtactacgatggccggtactggacaatgtggaagctgcctatgttcgggtgcaccgacgccacgcangtgatcaacgangtggaggaggtcaagaangagtancctgaccgtatgtcgcatcatcnggattcgacaacatgcgccaagtgcantgcgtcangctnaatcgccntcaagccaacggggctgccaagantccggaaaggcctaaacagctcantcacaacgggcaacatntaaagtgccattccggtttntcaacn

SEQ ID NO: 85832 - DNA, 209 bp, Triticum aestivum
  unsure (1)..(209): unsure at all n locations
  Clone ID: PAT_TA_85832
ctgagaggtcaanagtangctgaaccgaacccgcccacacacacccatcgttcctcannaanccctctcacctctcgcgatcatgggcagctcacgggtggaaggntctcatccccttcagctacaaggccatcanggagcaccgccggagcggcagccgggccgccgcctacnggggcgcngacgtggaggacgacgtggacttcggc

SEQ ID NO: 85833 - DNA, 419 bp, Triticum aestivum
  unsure (1)..(419): unsure at all n locations
  Clone ID: PAT_TA_85833
acaggaatctccaccttcccgatctccctcgtctttccatcccagcgcctcccgagaccgcctataaaaccccctccctctcctcgttccattcctcccatcaccacgcccctccctgcccgtagccttctcgccaccgtcctccttttcctgcctagaaacgctcaccaggagctctcctggaacctccccatcgcccagcgcancntcccctagcgctggaaccccctcntccgncacccccancctcgccggcgacctcgcccccctcancggagcagccctccacatcggcgtctccttccngccatctctacctcacgtncanattttcaacgggagtgacgaaatagttctaccaagtgctttattctgagangngtngttagcttcataangtattannaggcnttgcaggt

SEQ ID NO: 85834 - DNA, 518 bp, Triticum aestivum
  unsure (1)..(518): unsure at all n locations
  Clone ID: PAT_TA_85834
ggcggcggcgcggctgctcgatgaatggtggcggcggtggccggagcttgcaggggccggatccgtgcgtcgaaggtgctggggaggcggatccagaggtgtgcggcgaggtgggagctcaccggagctgggcgatggagggatccggcgcgatggtgcgaattccttgcagtcggaggcggggcttcatggctggtaggtagagctctacagcactaaggagccgacgctgttggtagcactgagaacggagggaacatcaagtcattctcctcctagaaaaccagatgtataaccatttgttgctgttcggatggtgtccaanggcggccaaactatagttgggtccgtgtgctccttttggttcaaaataaatccaatcctcaatcccaatgctaattggtaccaagaccatccntttgccttttcaaanggtgtccaacgggcgggcaaactacagctggcttgtgtgctcnttttgttnaaataaanccatcctcaagtcccnaaaacagggg

SEQ ID NO: 85835 - DNA, 510 bp, Triticum aestivum
  unsure (1)..(510): unsure at all n locations
  Clone ID: PAT_TA_85835
agcgcgcctcctaccccgagctcctcttgtgctcctcccatggcgccctcgtcccgagcaccttgacccctccgctacgtcctcgccacccgttggggcaggccaatagctccaccacgcccgccccatctctccttccttcacctgcctccttctgctttctcctctgctcctcacttcccctctctgtccctcacaggaacacccagccggagcccccgcaacctcacgccgcgagctcctcgacgccggcgtgccccatctcggcccagagccggtggacctcgagtccctcgaccggttccctcctatctcgtcgccggacccacggcatggccgccgccatttcatcgggacgccgctgcttcccatcgcccggatnnaagacgctccaagcggcgccaaatccgtctccaaaccgcgccggaaccgctccntctcccggccggcnanctgccagnacccgccgccgttgtctcctgccntgccgccgctgctcctctgctnctc

SEQ ID NO: 85836 - DNA, 492 bp, Triticum aestivum
  unsure (1)..(492): unsure at all n locations
  Clone ID: PAT_TA_85836
cttactactaagtctcctttgtaaagcgccatccttcatgccttcaagggcttcaatacgggtgaatcactatgagcataacccggcccctccagggcggtttatactcaatagttatatccccaacattaggccccaggttgatttgaacttgttcatatcaatcttcaatacttagaaaaaagaccccttccttgttaccttcacgaaacttataactcgccatgatgtcatcttctggaatcgtgataatccgccatgacgtcacctaccattaattttatacatagcccaaatcttttaatataccttctttttttaatgaaactccaaaaatcgangcgtttgtatatcgacagatctgttttttggacttcctcgatcccgcgcttgccacttatccattttccttaataaaataggaccggggccctgttcacttttcccccgtgccctgtttgtctcaatcgcctacctcgcaagccctaagcg

SEQ ID NO: 85837 - DNA, 181 bp, Triticum aestivum
  unsure (1)..(181): unsure at all n locations
  Clone ID: PAT_TA_85837
tcggtggctctgccngcgggcacncncatgtccgaactcgacacccgcttcgccaccncnctcaaggacctnaccnccaagntcgcngcnganccgcncatcnaggtccgccanctcgccatcgccgacggngtcaccatctgccgcngcctcntcaaagcgggcnggcggtccggcccgg

SEQ ID NO: 85838 - DNA, 534 bp, Triticum aestivum
  unsure (1)..(534): unsure at all n locations
  Clone ID: PAT_TA_85838
gttactcccctctccccccctccccaggagcttgctagctggagcagcagccaagccaacaaccgcaaatccaagaaatccgccgccgccgacgagcagcagcagcagcagcaggggcagctagagcgggccgcgtggcagagcagaggcgctccgccatgggtgcgccggcgtacggcgccgtgctcctcttcgcgctcgcgctggccgcgggcgccgccgccgctgagacggcgcggccggaggaacccacattgcccgccgtggccgccgctggcggtggcgacggggtggtggtggcggccgcggcggccgtcgtgaacgcgtccggggcgggggtgaactccaactcggtgctggtggcgctgctggactcgcactacacggagctggcggagctggtggagaangcgctgctgctgcagacgctggangacccgtgggccgccacaacgtcaacatcttcgcgccccggaacgangcgcnggagcgggactcgacccggagttaagcgcttctgctcgagccccgaac

SEQ ID NO: 85839 - DNA, 590 bp, Triticum aestivum
  unsure (1)..(590): unsure at all n locations
  Clone ID: PAT_TA_85839
tcgagtttttttttttttttttttagcaatatagttcttttccattaataattatctgtggcctcagatacatccggacatccaatgtgagctgagcaccacttgactggaaaatctccctgtacacacgaggatgtggtgtatctgcagctccagatctgtggctgccaactttttggaacaagtgactagcaaaccaccaagccatgcttgatttttttcttttttatgatttaacttttcattcacctatgtgatactagcagaacttgcaggtgaatctgtacaaggatggcaggtggaaggtttccttgtgcaccttatatgagtacacaaagatggaaggtaagaaaatgaaaaaaggggaagagtccattcacaaaacaacatgaccacccacctgcagtgcaatggccacctggtgctgcatctaaccaagcttccaaggctttgccacctttcaagccgaactcctggagcctcccgaaagagcatgacaagaatgaaggatgaacttccaaaatcgctccacctcccgacgaaaccggccaactgtcggtgcanaaccgtccnggctgatcgtctactgn

SEQ ID NO: 85840 - DNA, 646 bp, Triticum aestivum
  unsure (1)..(646): unsure at all n locations
  Clone ID: PAT_TA_85840
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaangcccgtccctgcaaggttgttgaggtctccacctccaagactgggaaagcatggtcacgcaaagtgtcactttgttgccantgacatctttaaatggaagaancctnaaggatatcgttcccttatccanaaactgtgacgttccccaatgttgaaccgccaanatttatcaanctgattgacataactgatgaatggatatgtnaagccctcctactgaaaattgtaacactaangatgaacctgaaacttcccactngaagaatgttctggcttggcaaattaaaaacgggatttgctgatnggaaaggacctgattccgtncgtgaaagtccnccaatggggtgaaaaanaaatttncccctgttnaaggaaanccgtnggnggaaattaacaacctntccttggtnnccaactgcaanacttggaaccaatgcttccggggtttnanaaaaaa

SEQ ID NO: 85841 - DNA, 366 bp, Triticum aestivum
  unsure (1)..(366): unsure at all n locations
  Clone ID: PAT_TA_85841
cgccgtcgaccgcccgcgccgatctcttgttcttatcttctttttgaaagaaaaaaattcttactttagataggatacttgtcnaattttcttactattttattccttcttattacatagtgcgatggttttggtatccgcccccgtcggccctcgtcctgtctatgattcggatgtggtatatattatctttttataactatttgattcatttattatttatgacaaatataccgaccagcgtgacatagattttatttatctangaggtggttgaaccggaaattctaaccgaccctattgtcgagaggttaaatttagttgaagaagaaaacaattacttgaaggaaaaaaaaanaaaaaaaa

SEQ ID NO: 85842 - DNA, 280 bp, Triticum aestivum
  unsure (1)..(280): unsure at all n locations
  Clone ID: PAT_TA_85842
cacccgtaccatgcttttaacccancacatgttgccaaggnggacaacaangtggcaagntaaaacatancttaagggtanccatgtcaaataaaccgggttcggccntggctcanancccnaattgnggctcaanacaggggtttttngnacaagaggggtatcanatttcgnaaantgtatntcacanagacacagccatatttcacattacatttnacanggaaaaagagggnttcnccaggnnatcncatggtgagnacctcngtaacagtgatgt

SEQ ID NO: 85843 - DNA, 568 bp, Triticum aestivum
  unsure (1)..(568): unsure at all n locations
  Clone ID: PAT_TA_85843
gtcccacaaccacaaaccagaatccctgctgctagcatgcctcggcgcggtgtttgcggcaaggctcgccgccgtagcaggagcaccagcgcagcctagcagcgactgccagagcaagtgcggcgacattgacgtccctttcccgttcggcatcgggccggagtgcgcgatgccgggcttcaacctcacctgcaacgacgtcggtggccgcagggcgctgttccatggcaacgtggagatcgttggcctcccgctggagcgaggccaggcccggatgatgaatgtcatctcctctgcctgctacaacgccgcctccgggggcatggagtacaacgactgggcagctcaacctcacaaacacgccctacaggctctccgacaccgacaacaagttcacggccgtggggtgcaaaacgctcgcgtacatcagcgacgagcgcaacacgggcaagtacatgagcgggtgcgtggccaagtgccggcgaagcgagcaaggcgccctgcgcaacggccctgctccgggatangctgctgccagacggcaatccgggggagctgagttctaccc

SEQ ID NO: 85844 - DNA, 550 bp, Triticum aestivum
  unsure (1)..(550): unsure at all n locations
  Clone ID: PAT_TA_85844
agcacacacggattagctaagctaccatgggcagaaaggtgtgcatctcccctgcaatcatcgcgcttgtagtgcttgctggcctgcgcgcgaatgcttccgccttcgccggcggtgccgctgccagcatggacgcggcgctggctgtgcggcagctgacgccaacgctgtcgtcgatgaagctggaggacgccgtgttgccggagctggcggtggacctagaggtgcaccgccgcatcctcttgggcatcccccagcgaaccgagaaccgcgatgggccagcctgcctgaagaatgggtgtccggcggacggaggagcgtataccgaccgcggatgcctcaagaagtacggctgctcgttaacgccaccacagtccacagtgaactgaanggcactacgtacgggcgtcaatgcaacctccttcctgcacccgtccgttcatgggcgcactcgcgttccatcatccatccaatgttttaattcccttccattttcattcaagtatcgtccttgcaactttctgtcggatgtactacctnaaatactggt

SEQ ID NO: 85845 - DNA, 274 bp, Triticum aestivum
  Clone ID: PAT_TA_85845
cgcagctgaaaaagagcataaattctgcaacactttagagggcaaaagtgagaaacgaagtctattacgccgaatgttagaaagaaaaacaattttattaatgtcgaccagttaaaatgaattaccaagctagtacaatgctcttcagatccttggacagacagatattttcgtttgaattacacaaatgcttttgttgacagatttctagccaccaactgtgctagaaatgtgtataaagcaagcatccagtatatcctttaaaaaaaaaaaa

SEQ ID NO: 85846 - DNA, 603 bp, Triticum aestivum
  unsure (1)..(603): unsure at all n locations
  Clone ID: PAT_TA_85846
tccatagcagcacagcacacccaccctcatctttagctctgccgaagcacaagcacccaccctcatcttggtctctctatccgtacgcctcccccgtccctcccttcaccgtccgacacacatggaggcgaaccaagagaaggctccggagactgccaccggcggcgacgccccgaggccggtgcgagcggtgtgcgtcttctgcggcagcaggcctggcaaccggccgtccttcagcgccgccgccctcgacctcgggaagcaactggtggagaggcagctcgatctcgtctacggcggcggcagcggcggcctgatgggcctccgtgtccaaggccgtccacgacggcggccgccacgtcctcggggtcatccctagtgctctcctgccggaagaggtgtcangggagacttgggagaagtgaaagtggtcanggacatgcatgagcgcaatcagaaatngcaaaacatcggacgccttcaacgcactgccangcggatattggacntcnaagagctctggaganataacgtgggcgcanctggggatccataacaaacctgtggggtgctcaacgtggacggnaacacaacagctgcttn

SEQ ID NO: 85847 - DNA, 596 bp, Triticum aestivum
  unsure (1)..(596): unsure at all n locations
  Clone ID: PAT_TA_85847
atcacacttgaggtggaatcctccgacaccgtcgacaacgtgaaggccaagatccaggacaaggagggcatcccgccggaccagcagcgcctcatcttcgctggcaagcagctcgaggatggcaggacccttgctgactacaacatccagaaggagtccacccttcaccttgtcctccgccttaggggaggcatgcagatcttcgtcaagaccctcaccggcaagaccatcacacttgaagtggaatcctccgacaccattggacaacgtgaaggccaagatccaaggacaaggagggcattcctccggaccaagcagcgtctcatctttgccggcaagcagctgggaggatggccgcactcctgctggactacaacatccaagaagganccaacctccacctgggtgctccgcctccgtnggtgggtcaataattgccctgaacttgggacctggcngctattatcctgtgccttgttccgtgttaagtcnacggtatctggttggttcgaccatcnatcctgatgangtgtgttggttcntgggaaaanttgctgggtatgggttggtatgaataaatcaaattgaacanaang

SEQ ID NO: 85848 - DNA, 584 bp, Triticum aestivum
  unsure (1)..(584): unsure at all n locations
  Clone ID: PAT_TA_85848
aagcaatcctcgcacatctctccacctcccgaatcctctctcccccaccagcgcggcagctcgccatggacgcctcagccaccgtagccgccgggaaggcgaagaagggcgcggccgggcgcaaggccggaggccccaggaagaagtccgtggcgcggtccgtcaaggccgggctccagttccccgtcggccgcatcgggcgcttcctcaagaagggccgctacgcccagcgcgtcggctccggcgctcccgtctacctcgcggccgtcctcgaagtacctcgccgccgagctgctggagctcgcgggcaacgccgccaaggacaacaagaagagccgcatcatcccccgccacctgctgctcgcccgtcaggaacgaccaaggagctcggcaggctgctcgccggngtcaccatctcccaacggcggcgtgatncccnaacatcaacccggtgctgctgcccaataangacgccgagaatcccccaaaggagccaantcgcccaaagaagaccgccaatcccccaaagaaggcgtaagcaccaatngccaaataagtccggatnancgggaanggtgtattgg

SEQ ID NO: 85849 - DNA, 278 bp, Triticum aestivum
  Clone ID: PAT_TA_85849
gcgacctctggctcaactccacctccttcccctactcgctgggcctcggatagaatagagatgagtgggtttttgaatgacaaaataaggggtggttcatctcaggtttagtcaggaaaggggttatactaggctctcgtttcttcccgttcgtctctgctgtacactgaagaaaaactgttactgccaacgttcagatctgcgatactcatgggtactgactgagactattgttcagatctgtaatagtcattgggtactcatgtaaaaaaaaaaaa

SEQ ID NO: 85850 - DNA, 472 bp, Triticum aestivum
  unsure (1)..(472): unsure at all n locations
  Clone ID: PAT_TA_85850
gtcgtcttctcttccctccctgtcatccggtctcctctttgattcttctgctaatcatcagctgatccttccttctccctctcccctccgtgctccctgcacaatccgtaccctcctccgtcgtgccatttcgttttggccccgtccaatccccccatccgaggcggacaagaacacggccggccgttccctgttccctagatctgcgtggcggcggcgacaggccgagtccgtcaggagggcgctcccccgccgtcaaaacccaatcttggcgtctggctgcgcgtcttcttcttcctcctgcgtgctgtcgagggcgacaagggaaggaggangaggangataaattggtcagggatggtgcccgtgggaaaggctacntgagcgacgnagaccatgggcaacttccgcgcccatcctgctctactgggtctacgccggcngctacagctcgtcctgcacgccggcccgg

SEQ ID NO: 85851 - DNA, 589 bp, Triticum aestivum
  unsure (1)..(589): unsure at all n locations
  Clone ID: PAT_TA_85851
ggtatgcccaaatgtcagacgagaagaaagcagaatttctccagaagcatcatttagcccccaggaaaagaaggttgcagctctggaaagtgttgccacggaccaagtagcaaacacgcctgcttctgcgtcaaggtctatgcaatgtactcatctgagtgacaaaacatacagacgtataaatgcctgtgtaactacagatccgtgactgctgatcttcaacttgataaaaaattagtcgaacaaagaaaacaaacatgtcaaggttggtatgctgagctatcaaatgagaaagcagaatacctaaagaagtaacgaacggctcggctacaaaagaaagatgcagccgttgatgtgaatgtccaagtacctcaattatctggaccacatgtttcaactgggggatatttcccggtcctgacatggcgctccgcgaatatccgccgctctatcatgatgactgtggcattgccggatcnaacattcatcccgattcaccttcgatgaatccccagacaagaatcacaaaattgctgaactatgacagtccaatttagagagttcaagatccgcnttggggtangcttgg

SEQ ID NO: 85852 - DNA, 561 bp, Triticum aestivum
  unsure (1)..(561): unsure at all n locations
  Clone ID: PAT_TA_85852
ccttcgctctcctccccgatctggagaggcacccgtacgcagtcgtcaacgccgcctcgtcgttgacacgctccggcaccaccccgtcccgcccgaaggcacccaggagatgcgcctcgacgtcctctacctccacggcaaccggctcgagctagagcgccccggagccgccgccatggacccctcctcttcgaccagggacgtctgctctgcctcgtcgatctgctacctccggtcctccccgaaccaccccgagctcgccaccgccttaccctcgactacgagaccgatgccgctgctggtgccctgaccgactacgttgttgatgacccctacttgctagagcaaccaagatgccggagcctaggagccaagacgccaccgccgacgacgactcctactacactgggaggtgcctactactacgttgtaggccgctgatgacgaccaagagtagtttaggaggatcccaggtaggaggcctgngcctctttnatntgtacctantttgttgcnagcatcctatggnactttttaacttaagtcngttcncaagatatg

SEQ ID NO: 85853 - DNA, 569 bp, Triticum aestivum
  unsure (1)..(569): unsure at all n locations
  Clone ID: PAT_TA_85853
tgagcgtgtacttctcctggtatataatttcgttcctccctgtattgcagtcattttggttagtaaacttgtatggacgaaaaagaattgtgccaggaagttcatatcttaaaactagataagttaaaaaaacaaaccacgaccagtttgaaaaagaaccagcctcacccttgccaccctcgcgccaccgcggcgcccaggccgttcaccgccggcaacacagtccgttcaccggtgacacagaggtcattcaacgacgcaatggtgaggtctggcctttccccttcctctttttatgtaggctccgagtcgaaattcacctccatgtgctgcggcgacctcatacccggcaggcgtcctggttgaggagcacgccggactgggtggggtgcccatacccgggctgggcgtcctgggttggggacctcangtcctanatgttaggtttgggctgcaangtctgtttggtaataaggcctagactatcaagtgccccttcaatcaaactgggataggagtaacgacaaatgttgcctaaatgggtggctttggnctnacngttgtatgac

SEQ ID NO: 85854 - DNA, 593 bp, Triticum aestivum
  unsure (1)..(593): unsure at all n locations
  Clone ID: PAT_TA_85854
ttttttttttgatgtaagccaaaatttccatttcaccagagcaccgtgttttagtgtattttacatctctgtacagtgcacacccatcgcattgtgctaaaatgctttcagcgcacttcattaaccatgcattttccctaggttccttaaacatagaaaaagagcactaaaatatgtccccaagacttgtcaacattcctgaagcttctttcttggtgtcgtgctcatctctcgttgaacatgatgaaaagcttgacgacctctccgtcagtttggccattcactcagagatggcacaagtccaaagaccttcaggtcaaacataccacatacctgaagcagcactttgtgtattccgccatttgcactaatcacacttggagcagcactgtcactgtcttggccttcatttgtcggtgtaacacggcgcagttcatcaagtacctcgggtaaaacatccgggagggggacacgagaatcaagtacctttccagagtgagggatgcttgaacccaagcaatgcagcatggagacatggnctgtctatcttcgataccagattgtaagncaccatgatantttgaaggagttcg

SEQ ID NO: 85855 - DNA, 532 bp, Triticum aestivum
  unsure (1)..(532): unsure at all n locations
  Clone ID: PAT_TA_85855
gcgctggggactacagctgaggggacgccggagctaatgcgagccgcagctgcgtccatggatgccggagctacatcctcttctcgaatgatgtccggaaggatgacagcaggagctgcaaccggcgtccatgggagctacgatcgaaactcgagctccaatcatggatggcggggagctgcaaccggcatctggaggagctacatccggcatccggggggagctgcaaatggtgaacggcgtcacgctttaggctacggcggcgatgcgaccgtagaacggtgagctttttttttttttttttgctaccaccggcaagttgaggtgttaccatgggcaaggcaaggtgctggtatgacggtggcgangtggangtgctgcagcaagattcatgggcgcatttttgggatgttgttttgtcagaaacatcctcctttgagctggaactatatcaatgctggnatcgtgtaaaaaattgctggaagcataccaatgttttcaatgtgaacatcctgtttctgggaaaaaaaaa

SEQ ID NO: 85856 - DNA, 585 bp, Triticum aestivum
  unsure (1)..(585): unsure at all n locations
  Clone ID: PAT_TA_85856
tctgatccaacttggggatcaagtagatgtcgtccatataatggacagcgtgtaagccttaggggcatcaatcaatctataaggaaaaccagaaaacggaggttcacctccaccaaccctctcgcccacctctccacgccatggcacagcagcctcctcacgactacgctctctggagcttgggttgtgacatccacctgatatccaagcagtccatctagaatccgatatcctaaagatacttttcagggttgcactgaaatgaagttttcatcggatacattgcctttaacactgtcatttgccttaactgatctgcctaatcatatttttgtgtatgaactgccaaatttagtagcgcataggcagttgtttcgtcaattaattagtgcttacccgtcgtggtgcctcacaaataagaacatcttggggagcaacgacangtttcccatgttttgggatactaaattgcacctcgggtacaaacaacttgtgagtcgtatgcatacaggtcacatgacttgagaattgccatttgtgtcacnaatcttgttgggagtggataatccaaataagtgatcccaa

SEQ ID NO: 85857 - DNA, 256 bp, Triticum aestivum
  unsure (1)..(256): unsure at all n locations
  Clone ID: PAT_TA_85857
ccgatccgttggcttcctgttcatacattctcccctcccggcgccgcctccagcctanggtttcctcccgccgtccgccgccatggctcgccgcagcggaggaggaaggtcttcccgccctgctccacgtgctgctccagtgagaaaccaacaagcgccaagcccgtnaagctcctncaactgccaacaaccaagaataaccgggnggnancaatgaatngaatttggttcaacaatngccaaggnnatggtttcg

SEQ ID NO: 85858 - DNA, 607 bp, Triticum aestivum
  unsure (1)..(607): unsure at all n locations
  Clone ID: PAT_TA_85858
tttttttttttttttttttaatcgacgcatgcatccatattattaaaatcaaaacaaggttttaagatccacggaaactcaaaatccgaaagataaacaaatctgtaaaacgccacacccggcgagaaagcgccacatccggctatacaaaacaggctacgatgcttacacacctagcctattattagctcgccatccaaatcggctgaagatagcgcatgctagctctgcaatcggctgcacccaataaccataatctccctgtggtatgcatgagtgagtaacgaccacatacggatccagattgtagctctggtagataacctgggaggcatgccatgggacaggatgggagatgccgatgaccttgtgcaccacgatgttcctggacccgtcccccgttgaacccggaatcccgaggacaacgccgcgatgccgatgangaacccagcccctgcacggcgatgtggccgttagaacaattaggggcctgccgccgggaagtancgcgccaccatcatgcccatcgggnagcaacaccccaaccatcatggacaacaacccgtgcaactcctcgccggggaaccctctcgcccgantcgccgcg

SEQ ID NO: 85859 - DNA, 583 bp, Triticum aestivum
  unsure (1)..(583): unsure at all n locations
  Clone ID: PAT_TA_85859
ttttttttttttttttgcggtgaaagaaatactgcatttgtccttgtgttcgaatttcattttcaggtttacataacacctcccctacatccggcatttagttattaacaagaatgttcataacttctaaacctgccttacatcaagttttcacatagaggtctcataacagacagaaccctgaggctcatctccggccaaaagaatcatcatatggagaaacgtagccaggataccacacaatcctgaatatttcttttattccgcctctcattttcaatagattaacaaaagaaatcaagaactcgccttccatacttcttcaatcccgccacgtcgaacatgaatgtaccaacgtacagaaagaaaagcggcaacctggacaatatcaagaattacatatttatccttgaaaccttaanggcatgaaaagcaagaacccgaatttcagccggttaattaaactaatgggatttccgcagcccgatgcattctgatgatacaacactgagcttatatatgatgtanccaagagcagcatcaacaaagattnangggctgcccncacagtggtaaacacaaa

SEQ ID NO: 85860 - DNA, 475 bp, Triticum aestivum
  unsure (1)..(475): unsure at all n locations
  Clone ID: PAT_TA_85860
ccaggatgcagctcacttagaaatcctttggtggccccgaacacttcctgcagctctgtcctggcatatgtgcagctctcttcttctctgtgtgcaatgcaaaaaatttggttgatgtgcagccgccgatgatggctccggctctgttctctctgttgtgcacaagtccatggacacgattgcttttaggcttttcattttgagggctattgtattaaaaaagggttattttgtacggctggggtgtgcacacgcagttcaccggcgagccgctaccggttgcagcagcacgggcgagctctcttcttttctactgctatttttagtagaaaaggtgctttttttgtgtgttgtgggatttgcatgtcatgctgggagacgttcattgcactgtccgatggcatttaatacttggtaattgagaatgcctacgtaaaattcaattccccgtggcacaaccagtataaaaaaaaan

SEQ ID NO: 85861 - DNA, 596 bp, Triticum aestivum
  unsure (1)..(596): unsure at all n locations
  Clone ID: PAT_TA_85861
ccacgagctgctccgtgacaatggctccgccccgcgcctccttgcggctatgctgccggcgatgtgcgctgcccccagccgcgcgtccctttcctcctcccggcaacgtgccgctcgcctcctctagcccacatgccccagtgactcctccctgctcgactcctgacgagtcgcgccgcccccggtcacgttggaacacacctcctcccggctccatctcctcctccctgtctcctgctggtgaaagctccgtctcttcctttggttgagggtctgataatggacgtaagacagctgttggagaggagattaaaatatggaagatagcaacagacgaggtagctgaagttggtagattaaattgagcaagagccccagatccagacgtgtttataatgagatgtttgtaagaccagtgctacatggttccacttgggagtctctgtagttaattggctgatggtgtgcatgaatttgaactattaataatgtgtaattttgacttangaaccatgaattgtccctcctttaataaataactacatgtgtaaaagtaatctttcnaaggaaacaagncaagaatgggaataaaaaaa

SEQ ID NO: 85862 - DNA, 598 bp, Triticum aestivum
  unsure (1)..(598): unsure at all n locations
  Clone ID: PAT_TA_85862
ctcctagcaagctatatacctacatagcacagccatggcccccaccgtgatggcctcgtcggccacctccggtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaagttgggttcatcttccgtgagcacaacgcatcccctgggtactacgatggccggtactgggacaatgtggaagctgcctatttcgggtgcaccgacccacacaagtgatcaacgaggtggaagagtcaaagaaggagtacctgaccgttacttccgcatcatcggattcgacaacatgcgcaagtgcaagtgcgtcagcttcatcgccttcaagcaacgggctgccaggaatccggcaagggctaaacactcagcaccanggccanatcnaaagtgcaatggcgg

SEQ ID NO: 85863 - DNA, 641 bp, Triticum aestivum
  unsure (1)..(641): unsure at all n locations
  Clone ID: PAT_TA_85863
gatggaaaggtccgcactgacaagacctaccctgctggtttcatggacatcatttccattcccaaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctgggagaccaacaagattgttgacttcatcaattcgacgttggtaacgtggtcatggtgactgggcgggcgcaacactggggcgtgttgggtgtgatcaaagaacagggagaagcataagggaaccttccgagaccatccacgttgaggatgcccaaggccaccattcgccaacccgtccggggcaatgtatcaccattgggcaaagggcacaaaccatgggtgaacctcccaanggcaanggtatcaagctcacaacaatnaaggagcaaaggaagcggatccgctgccaagctgctgcaaggcctgattctaaggcttantcntttgcaatnccatttaccncaaggatatagaactatgttcc

SEQ ID NO: 85864 - DNA, 291 bp, Triticum aestivum
  unsure (1)..(291): unsure at all n locations
  Clone ID: PAT_TA_85864
cctcacagctcctcngcaccatcccnancgccaccgtgttcnccngcagcctcncncaaccgcaccggcacccncttccagccccacccgcccatctcttccccgcccccaggnaancatcgtacttctacgccaccgagtcancagcagcaccagcagcgcggccaccaaaagtgccgcggccantgaggacggcggngagcctgctgaggctgaacaacatccgcgataaccccggngcnacgcagcagnagacncacaagggcctcnngatnggctccgggaagggca

SEQ ID NO: 85865 - DNA, 303 bp, Triticum aestivum
  unsure (1)..(303): unsure at all n locations
  Clone ID: PAT_TA_85865
ccttgacattcctcctcccccaccccanccccgccgcttttcnccnccgtccgngcgtccgtccgtccgtcttccgtccggtnngaganagagagagggagaggagatanatacacttttgtggggagtgagangcattancggcagagggagccatcaccctttcggncaccgtcgtangtngttgggngtanttatatcttccccgancggagnatttcnggnatccgtccctcnccntcgcncacnccgataatantcgttngttcggantatgggggtcctttccgttgcacgnttcac

SEQ ID NO: 85866 - DNA, 376 bp, Triticum aestivum
  unsure (1)..(376): unsure at all n locations
  Clone ID: PAT_TA_85866
gtccggcacctctctcgcttcttcctccggtccatgcnacggngctganatctttgcccgcctgacctttcgatggncaccgccgncacngccgccgccgcgaccggcacacttcttccccacgcannanttgaatcatcgctcgcctccnccgccgcanctccttgcnctgtcctcctccttccgccgcctctccttatcnacctcccatcgcangaccacccatttangtcgcncantcagacnccggagccnttgagccggnncccgtgtctgagcctgcncctganggcgaggcctgtcnctgcntntgcngactccgangagggggangnggaaggaggntgtgnnattngcgggagaagangaagaagcc

SEQ ID NO: 85867 - DNA, 600 bp, Triticum aestivum
  unsure (1)..(600): unsure at all n locations
  Clone ID: PAT_TA_85867
gagtctcaacagcagcgtacgtagctcgaagagcagcacagaaggagagggttcggatcctctaccgccgtgctctcaaagacactctcaactgggccgtccatcgccacctcttttatcaagatgcttcagaattacgcgagaagttcgatgcgaacaaacacgtggaagatctcgacactattgatagactgacagatcaagctgaagcgacgtataacaacttccggcacccggatccttatattgttccttgggctcctggcggttcaaagttttgccgtaatcctactccaccacaagggattgagattgtctanaactatggccgagaagataatgactgaatgacatcgtttccattccaaaaataaggttgatgtggtccatggcgtatgtttgagatgcaacantcaagtctggggatcatgttacccgtggacaaattgtagtttnaanacattcttggatgttttggatttattttgaataactctcngggagttaaaagttcaaatatcntatatanngcctgtangggttaactgtgaaccataangcanagacttgttaggttttcntcacantaaaaaaaaaaaa

SEQ ID NO: 85868 - DNA, 380 bp, Triticum aestivum
  unsure (1)..(380): unsure at all n locations
  Clone ID: PAT_TA_85868
ctgaggcgataatgaaaagagatagatagattcgatggccatgggcatgggcatggcagcctccccctcttgctcctcccctccatggccagcctcctcctccgcacgcagccgcagcagcagctgttccctcctctacacagccaccaccactcgcccttccgcttctccgaacgcgcgccgccttggccgcccgcgcgcgctgccggagacggcgctggtggcggccggggtggcggcggctggggtcgccgccgccgccgtgctcctgcggtngcgaccggaagacggatcngtcggtgcccgnggagcaangcgagaangcatgtggnttcngtggnaggagtgccccgcctgcggttggganctggnctncttcc

SEQ ID NO: 85869 - DNA, 596 bp, Triticum aestivum
  unsure (1)..(596): unsure at all n locations
  Clone ID: PAT_TA_85869
cttcaatttcacgccgttgagtcttcttctgtacagtttgttgtcgacaaactggtacatacttgattgccgggctactcttttcgcttcttcttgctcttcgggaagttctcctgtctgaaggaaacggacaatctgttgtgcccatgctggagcttgcggctcgacaacaaggactaaaggcacatctgctgctgtgggaaaatccgcttctacggcgagaacctgcggctcagccggagcttgacgttccctggcaagcttgccggagcaaaacttgtcgggagcgtatgcttcaacagaacaaaccctagggcttgccggagcagactgctcctcagcacccttggtgttgatcttgaggaccttcttggcggcggcttcggggagctctgctggaaaatagtcaccaagaaatcaacttcctcttcttgctctgtccagttgatggcgttacagatgttgagtcagtttgaagcacaaagatcctggttcacaggtaacntaagtgcgggacacttcacaaggcatcggcaatgtcttctaactctgggacatttcatcgtaggccgtaaagnctctcaacttgtacttan

SEQ ID NO: 85870 - DNA, 252 bp, Triticum aestivum
  unsure (1)..(252): unsure at all n locations
  Clone ID: PAT_TA_85870
gtaccctgacgcctatgtccgtgtcatcggcttcgacaacctgcgccaggtgcagtgcgtcagcttcatcgcctttaggccancnggttgcnaggagtccggcaaggnctaaactacganttgnaacaatggnctanctcgtntgaaggtcttttgngaacttcacttttgnccaacnctcngctgtangactctgcntttctgaccggngcataccttttgnncnacatgattttgtgtatgtatctacga

SEQ ID NO: 85871 - DNA, 594 bp, Triticum aestivum
  unsure (1)..(594): unsure at all n locations
  Clone ID: PAT_TA_85871
tattcctgcaagttttcctttaaaattcctttgcaccgaatggagcctaaacctaagcactgctttcttaaggcttctgcctggcggtccatcatttcttcagctgatgcatgattcataaattgatttctagaattcagtatgttgaaatgacactctaggaaagcgtctggcaagttaacctatcttattgttcccttcacgttacccagccggcctataatatttaatccttactgcttatcctgcatacagttcttgtttaaagccatgtttgtttacgattcccagctgttccaacttgcagctcattatagtaacaatatataggtgcgtgtaagtggccaacatgctgattggaggtattatgacatatcatgtgttgttaggacaataagaacaacttagtcgcacattgggtattttatatgcggcgaacagaccaatctaaaatccctaagtaaactcactcttattttanttcgtagcgctagataacaaatgcttgttgatgccgaattcccncaggttcatcaccaccaaggantccggaacgtnatgcngtcctccggcaaaancccacggnggnggagg

SEQ ID NO: 85872 - DNA, 348 bp, Triticum aestivum
  unsure (1)..(348): unsure at all n locations
  Clone ID: PAT_TA_85872
cgaatgagcgttgtctggacagtcgggtgcctgcaaggcctagctgccaatcatgtgactcctatgttaaaatgagtggtgtgaacatttgtctggtcgttctgaaaaccatccaagtatccagtactgtgtttgaagttcctatatatctgaactgcatgcctggaatgataaattaaaattaggagatttatcttgtgatctgttctccgtggaccactccgtggttttgggaatccacttctatatggtgatttggtgtagcaccttctttgctgtctacaagtatactactatcccatgtttcttcctttccngactcaaagctattttctcaaaaaaaaaaaa

SEQ ID NO: 85873 - DNA, 587 bp, Triticum aestivum
  unsure (1)..(587): unsure at all n locations
  Clone ID: PAT_TA_85873
cctctctctctcatcgtatcatatgaggaaggattccttccaaacctataatctttacctcatagcttagctcctggactctctctctaccgtcgtctccatcacacctaaccaatctcgagctagacccacaagaagcggtcggcgacatcaaatccgttcccctcgcctgcaaacaaccacccatttacccggccaaagcatatacacgcagagatagctgtgtgtgtatataacatggcctaattgaccatggacatcgccggagacgccggaggcggccgtcggcccaacttccccttgcagtcctccgagaagaaggaggagcaacgtgctccagctccngctgcngggggacctcggcgggcggcgggaatggagcaacccctggcggtgccgccggaggggagatcaagtncggaangcggtgcccaaagcggacatcgacgaaaggaccggcacacaaangtggaaggccngggacgggcatccgggatcctgcgcntncnccgcgaaggtgttcaactganccggganctgggnacaagacggacngggagacatcgatgggtgctgaacaagcggac

SEQ ID NO: 85874 - DNA, 599 bp, Triticum aestivum
  unsure (1)..(599): unsure at all n locations
  Clone ID: PAT_TA_85874
gctaatcaagctctcagctccttcccagctccacggtttccaagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgccgtgcatgtcctacgcgagggggcaagcgtcggcaccctcgggggcgtgctgcagcggggtgaggaccctgaacgccaaggcgtccaccccggccgaccgggaaggcggcgtgcaactgcctcaaagaacctggcggggtccgggcatcaagcatgggtaacgccgccaacatccccggcaaatgcggctctccgtctctttccccatcaaacaccaaaaaccaactgcaacaaccttcaacaaattatctaccaacatcatcatcacacaaggctactaacccactcggtgtccaacngttgctgctctctgcgtgtgttccttggtgtttccncaatgngttcggactccaactgttgccgttaannattcgancaagatacngttnaaacaccataaaatatgtgttnccttaagg

SEQ ID NO: 85875 - DNA, 345 bp, Triticum aestivum
  Clone ID: PAT_TA_85875
gccaccccggccccgatcggataccactgaggctggccgtgttctgctgaattttgcatcgctactattactactactaccaagcaaatgagtgtttcgttttgaaggcagaggaaatgagagctctttagctgtataggatgttgcaattgttgctcgtttggtaactattccgtactgagaaataagcagtgtgcttgtcagttacgtatctaggatattgttgaaccaccatgtcgctctaagatgaacctatttggcgtacgccacgatgtcttcgttatcagaccaccattgatctacctcgctatgtacatatcccttatttgaaataaaaaaaaaaaa

SEQ ID NO: 85876 - DNA, 604 bp, Triticum aestivum
  unsure (1)..(604): unsure at all n locations
  Clone ID: PAT_TA_85876
ttcgtactcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttccgtagatctccgangcccactgtgattgatgaggtgaggactggcgcttaccgccagtcttccaccctgagcagcttatcaagtggcaaggaggatgctgcnaaacaacttcgccccgttggtcattacacaattggcaaggagatggttgatctgtgccttgaccgtatcaggaactttcaagacaactgcactggtctccaagggatcccttgtcctnaacgctgttggangnggnactgggtcnggcttgggntcncntccgcnggagcgcctctcngttgacaatggaaagaatcaaancntggt

SEQ ID NO: 85877 - DNA, 593 bp, Triticum aestivum
  unsure (1)..(593): unsure at all n locations
  Clone ID: PAT_TA_85877
ccttctccacctccggtcgccgccacagccaggccgtcgtggtggtgcgcctcctagccatcctaccttacccctctgtccacaacaccaacagcctccaacaccccatccgccgcaacatacatccatctcggccgccgtcgccgcgcctacagccatctccctactgctgctactcttttctcaccgctgatgttcctcctccttcaacctgttggtgctcaccctcaaacctagcccgctgcttctttcttctccagcgcccccttgccgctcttccacctctcttcttcacccaaactttgttgcacgctctctgccttctcctggaactcaacctccacttgccaactgctgcttcccttctctcaaccctccgttgcacctatctcaaacgctgctgcagctgctgctctctactctcntgctgtcctctcccacatccctgctggctgctactactttccccaaaacatgggtgctctctcaacnantggcgcaacttctctccttgctgaactctgctacgttaaacgcatctctctcgttggggtaantttgtgaaaantaccggggggagaantgntaacatt

SEQ ID NO: 85878 - DNA, 602 bp, Triticum aestivum
  unsure (1)..(602): unsure at all n locations
  Clone ID: PAT_TA_85878
ctgcctcccaacaatggctctccccctcgttcgcctcctcctctcgtcgctccacgcgtgccagccgccgctccgccaccctgagtactccgccccacctcgccacagccacgtttccttcgctgtccccgctgccgcccgctcctccggcaaccgcttggcgtttgctgtctgcgctgctagcgcctcggtcgccccggcgcctgcggaaactcaggcggatgcggaggatgagcagcccgtggggccgaagacgcggcttatcgcgatgaacatcccgtgggatttcacgcccgacgacattcgcgttcttttcgagaagcaaggcaccgtcgtcgacgtggagctttcgatgcacagttccaaaaaaaacagaggattggcatttgtaaccatgggttcagaagatgaggctctttcagcactcaagaatctcaatttgtcnactttggaacgatagaacgattaaggtggactttgcaaaacctaaaaaagaagcaacctgctgtgccgtcagctcctgtggagaaaaatttgtgttgtcggggaaattaacgtggagagtgagatccgtcaacctccgggagttatttcctcaaccc

SEQ ID NO: 85879 - DNA, 465 bp, Triticum aestivum
  Clone ID: PAT_TA_85879
cccaagactgctattatccaactatgatggtctaatcagattcacatgccacgaccatgtcttcgaaattgaaacataatcaaaccgctcttaaatatctgaaacacacatcgtattcctccccaagactgctattatccaactatgatggtttaatcagattcacatgccacgaccacacacaacaatcacatagtatgttacttggccctagttacttaaagcagttttaacaaaatacatgttacctcctctgatccatattaattgtcattgatttagtacactactaaatcagcgacaactaatatggattagaggaagtactttcttttgactaccttatgtgggagcaaaggccacacaatcctttatttcaatcaaaggaaatatatacgaacagagaataaacagtcccaagagaaaagaaagaaagaaagaaagaaagaaagagaaaaggggggg

SEQ ID NO: 85880 - DNA, 391 bp, Triticum aestivum
  Clone ID: PAT_TA_85880
ccctaatagttgttgccagcaaacccttggcctgaatcccacacgctgcctccaccaattcagatctgggcctgatgatggtctcatgaccttcccgttcattgttttctgcttgatttgattctcttgaggtgtgtgtgagtttgctggatggtttggatcgatgatgctcttgtagaaatactgcgttatcttcctgatcaatgtgaggccgccgcgatgaggggcggcttcctgatgacaccattatctcgctgagatccaactaccagcaacttcgcctgcctttattttttgttttcctccgtctcttttgcctgttttcctgggatgttactccctgtgtaaagaaatataagagcgagtactccgtaaagttaaaaaaaaaaaa

SEQ ID NO: 85881 - DNA, 299 bp, Triticum aestivum
  unsure (1)..(299): unsure at all n locations
  Clone ID: PAT_TA_85881
cacaaganaagctatccacatcgttccntcganaaacgcagggggagggcattgcattacacaccctcgcacctcacacnacccctccanccacctttttgccagcgtgngancttcttctttcttgcnaggganagagggtagccancaaccagnganctangcgtcaatggcganccatanccacgantnaccatgctcaagcccgccaagatcaccgncaggtcggnnccttcgtcgtcacngtcggccancaccaagggtgngcgtcccntangcatctcngctgcgcagactgc

SEQ ID NO: 85882 - DNA, 201 bp, Triticum aestivum
  unsure (1)..(201): unsure at all n locations
  Clone ID: PAT_TA_85882
gttctaagccttccantgccggaacagagcagcatataanaatggcatcccngaaggccntgaagccanccggtcttgangggcaggccaagggancctaccanggntagtgccgccaaggggccngnaaagctcagtgnccanngcgaccaagccancatccgccaagggtggcattcaagaaggccgagtcaaagccac

SEQ ID NO: 85883 - DNA, 672 bp, Triticum aestivum
  unsure (1)..(672): unsure at all n locations
  Clone ID: PAT_TA_85883
gagaactagtcgagtttttttttttttttttttttatgtaaacctgtaaatggccttgataaggtataataaaagttcccgcactcaattacacgttgcggatacacataactcacacttgaatgaccgctaaaatgagaaacaaacatctcacataaaaatatcagtagcacacccctcatgtgcccatacccgcacaccagtaataagggcctatgcaaacctgggacttgggaaaaattccacaatttagcttcacacttcccgataagaaaaatgaaaacagcgaagaaactgactccaatgccgaaactattcctgggtcaatacaaaaaggaagaaaagacttgggaaaaacattagtgtcgcaaaaggagatgtggaaacagtggcacaccttttccgtcacacttcaagtgtgtaacgaaacggcttccggataaaaaattgtcaatcccctggccatgaatcccccgacttgacccacgcaagtattctctccccggtgagcaaaaaaaggaaaagacaattgtccatgtgtcnctacanggaaaaaacacaantgatttgtatttcaatcaggataatgcnttaaaacaacggcaagacatgcnaatgctacctttttaacaagtaatcaattgtcacaaaaatgttgcacttccccctcgn

SEQ ID NO: 85884 - DNA, 445 bp, Triticum aestivum
  unsure (1)..(445): unsure at all n locations
  Clone ID: PAT_TA_85884
ccctcctccgctccgctcgctcgctctccttcccctcccccatggcggccttcgcctccacctccccctcgccggcgatctccgcctcggcctggcgcatggactccctccgcgccgcgctcccggcgctccgcccctccccgtcggcggccgtccggcctcgcaggcaggcggcctccgccgccccgttcctcnggagctccttcgtctccacgtcnccctcctcgtcctccgtctcccncgccnccatgtcctcngcggnctcggngtcnctcgccttctagtanacctcctcgttctccgtggaatcgaactttgctcaccgactgtttgggattgatgtcngtggaaggatattggnnatgaggtangggaanngcattcntaggttcaacaggccngaaanattangngaaagnactccntgcgtngggatgancagaca

SEQ ID NO: 85885 - DNA, 623 bp, Triticum aestivum
  unsure (1)..(623): unsure at all n locations
  Clone ID: PAT_TA_85885
atccaatccagtccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatctttgctggcaagcagcttgaggatggccgcacccttgctgactacaacatccagaaggagtccaccctccacctgggtgctcaggctccgtggtggcatgcagatttttgtgaagaccctcaccggcaagaccatcacccttgaggtcgagtcctcgggacactatcgacaacgtcaaggctaagattcaaggacaaggagggatccctccggaccagcagcgtctcatcttcgctggcaagcagctccaaggatggccgcaaccttgccngactacaacatccagaaggatcaacctccactggtgctcaaggctccgtggggggcatcanatttttgtgaagacctcaacgggnaagacatcaccctggaggttaatcccggacacatcgacaactcaaggngaaaatcangacaaggnggnn

SEQ ID NO: 85886 - DNA, 583 bp, Triticum aestivum
  unsure (1)..(583): unsure at all n locations
  Clone ID: PAT_TA_85886
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcntccactgatgatgttctgcttggcagatnaaagacgggatttgctgatggaaggacctgatctgtcngnatgtcgccatgggtgaagaacaatntgnccgttaaggaaatccgtggtggcaaattaacaactgtgcttgttcctactgcaaa

SEQ ID NO: 85887 - DNA, 645 bp, Triticum aestivum
  unsure (1)..(645): unsure at all n locations
  Clone ID: PAT_TA_85887
taggtttcccccggtgcnggnggcacntttaacaacnagcaaacctctccgatctcccatcccagcgcccccgctcctcccccgatggcccgtacaaagcanacggcgcgcaagtccaccggcggcaaggccccgtggaagcagctggcgaccaaggcggcgcgcaagtcggcccccgccaccggcggcgtgaagaagccgcaccgcttccgcccgggcaccgtcgcgctgcgcgagatncgcaagtaccaagaagagcacggagctgctcatccgcaagctccccttccaacgcctggtccgtgagatnncgcaggacttcaanaccgacctccgctttcaagagctccgccgtctctgccctgcaagganggcgccnaagcctacctcatcggcctcttcgaggacacaaacntctgcgccatccaagccaaagcgcgtcaccatcaatgcccaaggaatcanctcgcccgccgcatcngccggggaaccccccctanggcctcgcctgtcgttcaagtgttttaaattcncngttccgtcgnggttcaagtgtggggtcnttccnangtaaccgggctgtaactgggcctcaaggtctgcctaatcaatgaaaatatgggtnccaggatgagataaaaaaaa

SEQ ID NO: 85888 - DNA, 573 bp, Triticum aestivum
  unsure (1)..(573): unsure at all n locations
  Clone ID: PAT_TA_85888
aggcgaaaaaaaagaacaccacccccaatccacgaaccaccctccaccttccccgaactacccccaatcccacacctctcactctctcccgatcccccatggtgccgccgtggctgcctgcccaggatcccgctgcactgccgccgctccggcgcgacgctgccccgtggccgcttgcgcactccgcggaacgcgcgccggctgcttgcgtccgccgtctcttgcttcaccggcgctgcggtggagtgagcgctgccgtggcctcgggcgtggcttcctggtacttggagagcatgtcgagcagcaacatcttgtcggcatcgatgttgtcgaacgggagcagtggcggcgtggccggggctcggtggtgccaagtcgccgagtcggcggagctggtgggagaagcccggcgaggcnaggcnagggcnantgctgctgcagcaacagctgctcggtggtgttttggtcatggcatggcgggtcaagaaagttaacgaccccgttggtgagccgcgcctcctcgggngaacgcacaacactatccggngcaacctgcccaactctccaactcat

SEQ ID NO: 85889 - DNA, 572 bp, Triticum aestivum
  unsure (1)..(572): unsure at all n locations
  Clone ID: PAT_TA_85889
taaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccaagcatcaagtccatcaacatgggcaaggtctccggcgtgcccggcaagtgcggcgtcagcgtgcccttcccatcagcatgtcaacaactgcaacaatgtcaactagttcaatatataatccntcctaagttcatgcatggacgccctgcnttgagcttaatttcnacgttgatgagtctcatacaatgttgancactaaaaataaatgaaattgccgggtgtgtaattcattangtn

SEQ ID NO: 85890 - DNA, 202 bp, Triticum aestivum
  Clone ID: PAT_TA_85890
ctgcttcttgccgtatgagcgatagtgatcttaggatgtacttgtaatgcttttggtttcaggttgaagttatctcattatatatactccgcatattgtaattctcccttcttatttttgcacgatgcacatgcgcgtggtattctctcacggaacaaggaagaactaaaacaagagtacctttgatcttaaaaaaaaaaaa

SEQ ID NO: 85891 - DNA, 456 bp, Triticum aestivum
  Clone ID: PAT_TA_85891
atctccttcagctctctcgttcttcctgcagacaaggctaggttcggttttggtgggcttgacgctgcatgctttgggtactacttaaactgcttgctacaactgtgacaccttctcctcctagtcctcagtcaatggacactacatggctatagtgttcctgctattcaaattactctgaattcatatggtcgacagttcaaatttgtgcaattccatgtggcattcaaaagttttgctcagcgccgtgcgggacgctgcagagctgtcatggtgtccatgctgaggtgaggtccgaggcgctgctgccttctgcatgctcctacaattaatctatatacatttgtaaatgtgtgggaaacggggaaccacttccaagaaccaaaggaacacatgggagtggaccaaataaaagggattggggctaacacggcggattggtccaaaaaaaaaaaa

SEQ ID NO: 85892 - DNA, 617 bp, Triticum aestivum
  unsure (1)..(617): unsure at all n locations
  Clone ID: PAT_TA_85892
cgacgaacggaaccaacaaatcccccagccgatctcgtctccggtcgactccagctccccctcctccggtcctcccccaccgccccaagatgcagatctttgtgaagacattgacaggcaagaccatcacccttgaggtggagtcgtctgacaccattgacaacgtcaaggcaaaaatccaggacaaggagggcatccccccggaccagcagcgcctcatcttcgctggcaagcagctggaggacggcaggacccttgctgactacaacatccaagaaggagtccaccctccaccttgtcctccgccttcgggggaggcatgcagtctttgtcaagacctcactggcaagacaattacacttgangtggagtcctctgacaccatcgacaatgtcaangcgaaagntcaagacaaggagggcatccccccgggacaacancgcctcatctttgctggcaacaacttnaaggacggcaggaccctgctgactacaacatccagaaggatcaacctcaacntgtctccggcntcggggaggcatgaaatcttgtcaagacctcacggcaagacanaccctgagggggatcctcgggnacatcnaaactcaggggaaatn

SEQ ID NO: 85893 - DNA, 218 bp, Triticum aestivum
  unsure (1)..(218): unsure at all n locations
  Clone ID: PAT_TA_85893
ccgagaagagagagagagagaagcagcgagacgcgaatcagcggcggcgatggctctcccggcgtccggctccaccctctcccgcttcctctcctcccgccgcatccagcccacggacgtcaccgcctcgccacctgggggcgtcttcgccgggcaagcgccgncatctactncgtncaancaatccaacnggttaaagaanaaccttctttgagaaa

SEQ ID NO: 85894 - DNA, 268 bp, Triticum aestivum
  unsure (1)..(268): unsure at all n locations
  Clone ID: PAT_TA_85894
aacgtaccctcccccctcctctctcccttcaaccatccccccacccccaccccctacgatcgatccaagcttcctcctaccttcctctctccctctccaatctccatctccggccagagcctcgccacctacataagcaaaatccggaggcatctatctttaaagaagtanagcanaanagaatancanaggcggggagtgagganaggtatancanagganacgtgtatggagatggacgtggcngtgcctgtcatngngccgatcg

SEQ ID NO: 85895 - DNA, 577 bp, Triticum aestivum
  unsure (1)..(577): unsure at all n locations
  Clone ID: PAT_TA_85895
cccagatccactctcctctcgctccctctcccttcgctgcccgcgccctgagccgcatgaccatggccgtcccccactgaagccgcggccaccgaccgcccgtgccccgccgtcgagtccaggagctccttcgcgtcctactacgtcgcctacgtcgtctacgaggccggatccgcccggatcgcgcgtgcatcgacgccaccgtgtcgtcttcttcccatcgaccccgccactacctcgctgtcgtcctgctactccgacgcctccccgacctcatcgtccgtgctccgctaccccgagactgctgctggatgcccctgtggattcgactacgtcgacgacgaccttcttacctttcatcgggagcttccagatggtgggtccttgggagccagatgccaccgcaagatgggatgctactacgtngaagacggccgactccaatgagtattaaggaggccaaagttagaggcttgcctcttcgataagttccttttgtggcnacctcttaagnatctgttaacctaagtcgtaccagaatgcggttccgctgatctgttacaactcaacaagcctg

SEQ ID NO: 85896 - DNA, 561 bp, Triticum aestivum
  unsure (1)..(561): unsure at all n locations
  Clone ID: PAT_TA_85896
cctcccactgccagcctcagctcacccgaagcaaagccagctagcacgcagcgcgcgatggcggccgcgaccatggcgctctcctccccggcgatggccggcaccccggtgaaggcctccagggcggcgcccttcggcgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcggggctgtccgccgaccccgagaccttcgccaanaaccgggagctggaggtcatccactgccgctgggccatgctcggcgcgctcggctgcgtcttccccgaagctgctcgcccgcaacggcgtcaagttcggcgaggccgtctggttaaagggcggctccagatttcancganggcgggctcgactacctcggnaacccaagctggtgcaagcgcaagagcatcctcgcatctgggcctgcangtnggtgctcatggg

SEQ ID NO: 85897 - DNA, 377 bp, Triticum aestivum
  unsure (1)..(377): unsure at all n locations
  Clone ID: PAT_TA_85897
ctctctcttatctctctttactcccgatctgatccacgtcttgccggtgcccttgcnccgacntcgccggncaccanatcatcggatccacccagggcgccctgttcccgagctcctctcctccgcgctcgcgccctgnctggctggcttgctgctcggccaaagctcgctggnggaagccggcgaccaggccagccgcacctccccggctgctgctcggccggagctcgctggnggaatccggcgaccaggccagccacacntccncgtccncggtcccatcccngtcncctcggnngactangccatccgcacntcgccggncccgtctcctcgcgcgcctcgcnngncccgactctnctcgncgacgnccgtcc

SEQ ID NO: 85898 - DNA, 590 bp, Triticum aestivum
  unsure (1)..(590): unsure at all n locations
  Clone ID: PAT_TA_85898
cccagatacaccctccctggcgctagcacgcgttcccctttctccctcctcgcacgcaacctcctcgtctccagcgctctcgcctctgctccaccaccccgcgccgccacatcccacacgccgacgtcggcctcgccgcagaaaaccgcccgcaccaccggcgacggatccctcctccctcgaagccgcgagaagaggagccccacccggacgacttccccccgtcccccgtggatggttctgcttccattgagacgcccaggcatgacagatcttgctcgtcgtcagcccagggccgggtcggccggagcagtcggagaggagtggcggatgtgcgtccgcttagatgccgccggtcagagaaggcggggatgagcggattgcagcgagggaagcggctcggctcggactgtccatggcgctagcgcgatggctcgcctcctctttcggcatggctattgttttggtccgcgccgtttctgctcgacggacattgtcgtataggtgcagatgagggacaaccgctagcnacggttccgcaaggcaanctcancgccctctcggcgggctcaacaactttccgccgagct

SEQ ID NO: 85899 - DNA, 198 bp, Triticum aestivum
  Clone ID: PAT_TA_85899
gcgtgttctctgcatgatcaaggagtttgtgttcatcgtttttgatatagcttaccactcatgcggagtggtaaggagtttctgtgttcgagtgacaaacatttgtgttcctatgcaatgcatgggtgtgtgtgctccgtgtttggtctgtactcagtagtgatctaaatgctcttatatttctttaaaaaaaaaaaa

SEQ ID NO: 85900 - DNA, 326 bp, Triticum aestivum
  unsure (1)..(326): unsure at all n locations
  Clone ID: PAT_TA_85900
aganctcggngtccttcganaancanctctcgcaggaggccagcgaccccgaaaaangcccgcaaggtctgggagctcagcgagaaactcctcagnctcgcnatatctcncacacntccggctccgggnacgtcnagncaatgcatgcatctacggacgccgatgctgaacttgtcggcattttttaacgntggtaagtaacaattttacgtccttttnanaactcaattanccggganaaggcttnccaatttncgngaaantncatanatttcnctttttggagatgtataatttncggggnaaccatgnataatanaactgca

SEQ ID NO: 85901 - DNA, 585 bp, Triticum aestivum
  unsure (1)..(585): unsure at all n locations
  Clone ID: PAT_TA_85901
ccggaggccaatgaaatagaatatggtggagatgggacaattgtatctgatatgttttcactgctgtcgctgtgtggctcatatttgaacaaggagtcgaagcagaacagtaatcagaaatgcaaactgtccaatcctcatgcccttgtagtgcactgttgtcttgcattggcaacaatagcagcgtgtctaaagtcggaggggaaatcttcagcatcaattattttaacaagttcccacaagaaacagcggtcccggctttctgttcttgcgcacctctcttcagccgatgatacagtgaagagttgcctgcagccacactgtgcagctgcaacacttgcactgtcaacgcttatttcacttgaaaatggagggcaaaccagatcttccctatgtgaaactgcccttgctttgtttccccgtatggcaacactgcacacattgctgaagctttggctanctgatggaagtgaggaacttgcanatataatgccgggttactgaatcgtttggcctcnttaatgggagtatcgggcnttggnaacanatnaaatggggtggacaantggtgtcaacaaccnccat

SEQ ID NO: 85902 - DNA, 592 bp, Triticum aestivum
  unsure (1)..(592): unsure at all n locations
  Clone ID: PAT_TA_85902
tcgccaagcgcccggtctccgctctccacgtaacccttctcccctcccaacctccgcgtcgttgcaaacccaaatcctcctcccactccagccccccctcatcagatcacgcgagcagggggcaccggaaccggatcgggcgcggcggcggaggcgggcgacggcgatgatgcacggcgtgggcccgtcggacgacgccgcggcggcggcggcgctggagctgcaggatccggtggaaggaagcctgcggcgggaggcgcggaagctggagggggacctggacgtgaagctctcctccgtacgcgcgcctcgccgcgcgctcctcctccgcctccgcctcggcctcggctcgggggctccccaacgccgaccgctcctcctggaaatccacggagctcgagatcaagcgctgctcnacaagctgcaagactnaaacgacccatgaaccgctgcgccgcgcccgccgccccgcaacgcttcgtctcccaaaactcgcgcgcaacgcgaatctgcacnattcancaggattaagaggaccggggaactgactcatgaggancancgactgctanctcgtcgcgganatangant

SEQ ID NO: 85903 - DNA, 259 bp, Triticum aestivum
  Clone ID: PAT_TA_85903
ctgtcgctgagtgtagatatccggaccatgtggctgaagcgtaagatgaggagccttgtgtagagagagatagtagcaccgccgcggcgattctttttctcagtcaggagtaataacacttgaaataagtaatgcggtgtgtgctgtagatatccctagtcttcttctcattatgagttatgtgttgatgtgtatctagcaccgactaatctatttatggtaaatctataaatctgtattgggacccaaaaaaaaaaaa

SEQ ID NO: 85904 - DNA, 607 bp, Triticum aestivum
  unsure (1)..(607): unsure at all n locations
  Clone ID: PAT_TA_85904
cttggagtcgccggccggcgtgggcttctcctactccaacacgtccatggatctgtacacggcgggagacgccaagacagcactggatgcctacgcttttctggtgaactggctggagagattccctcagtacaagtacagggagttctacattgctggagagagctatgcagggcattatgttccccagctgggccaagctcatattcgaaaagaacaatggcactgccaatccaataattaacctccaaaggattgtggtggggaatgcggttacggatgactacaatgactatcttggcacatttgantactggtggancatggcctgatctcctgacaacacttaccacaattttgaaagaagnatgcntgtttgatccctcaagacaccttcccctgaaagtgtcaaagaactgaactggctaantcccgaagaagnaacattgaccctaatagccgtatacaaagcctgcaataactcaacctctctcaaacttggcctgggangacctatccntggntgtcaaancctatgaatccttcaccgaangatattcaatatatacacaatctgcagagttcagncgggttaacgcaacaaacg

SEQ ID NO: 85905 - DNA, 607 bp, Triticum aestivum
  unsure (1)..(607): unsure at all n locations
  Clone ID: PAT_TA_85905
ctccagtccaatctcgctcgcagtcacagagcccgcggcgacatgtccaccaccgccaccgcctacgccacatctacggcagatgacgaccgccgacaagcgctccaggcgttcgacgacaccaaggcgggcgtcaagggcctggtcgacgcgggcgtcaccgccgtccccgccatctttcaccacccgccggactccctccccctgtacgcgcctcctcagctacaccacgagcaccgcttcaccatcccggtcatcgacctcgccgacctcgggacgccgtcggggcgagcctccgtggtcagcgcggtgagggcagccgcggagacggttggcttcttccaggtggtgaaccatggcgtgccgggaggcggcatgtcngagatgctcgcggcggtgcggtgcttccacgaggaaccgcggacgccaaggcgccgttactacagcccgggacacgggcggcgcgtcaggtacacgagcaacttcgacctgttcaatcgccggcggcaactggcgcgaancgtgtacattgacatgaccaagaccgccggnggccgangagattcgccgggcctccaancgtctnccgnagtanancggtgggcgg

SEQ ID NO: 85906 - DNA, 585 bp, Triticum aestivum
  unsure (1)..(585): unsure at all n locations
  Clone ID: PAT_TA_85906
ggaagaggctcacctcgtcaacatcaggggaggaaaccggagggccgtgtggcacgtcgtgctcgcctgtggctggcaagggccacttcgtcgtgtacactaccgatggtgcgaggttcgaggtgccgcttgcgttccttggcacgaccgtcttcaacgagctcttgaggatgtcccaagaggagttcggcttcacaggcgttgatggtggcagaatcacgctgccctgtgacgcatcaatgatggagtatgccatgtgcttgctcaggagaaatgcgtcctcaagagatgggaggccgcattcctcaaacaccatggtgatgccatgccactatcatgcggagctacatctccggagttagccagcattatgggtgtctgcactccctggattaccatctacaagagatataggaaaatagattaaggaaaacacatgtgtgttaacatttgatttgatcttgctgggcaaaagaacaccaaaggaagatggaccgtagttagagacaatgttctttcaatggtatgcatatactttgttcaaagataaatattcattacggtttttngggcaaaaaaaaaaaa

SEQ ID NO: 85907 - DNA, 586 bp, Triticum aestivum
  unsure (1)..(586): unsure at all n locations
  Clone ID: PAT_TA_85907
gagagagaaggacgtgccgttggacgccggcagcttcgccttctcccaggtgggcgccgacttgggcgcgcagatcctcgactacatcaactccaccaagaatccgacggccgtgatcctcccaaccgaggacgtgaagctgttcaagcccgcgcccatggtggcgtccttctcagcgcgcggccctggtggtctcaccgaatccatcctcaagcctgatctaatggcgcccggggtgagcatcctcgccgctgccatgccgtccacagacaaggcggacgtcccggacggcaacaaggcctcggcattcgccatcaagtccggcacttccatggcctgcccgcacgtcgcaggcgccgccgccttcgtcaagtcgggccaccgggctggtccccgtccatgatcagttaactctcatgaccacagcgacnacgagaaaaacttgggcaaccggttgccatnaacaccggccggtggcgaccgggacacacatgggcgccggcnaaatagccgctgcgggcgctcaatcnggcctggtgtttgacacaccgcaaaggatactcaacttctcngcacaagggtanag

SEQ ID NO: 85908 - DNA, 629 bp, Triticum aestivum
  unsure (1)..(629): unsure at all n locations
  Clone ID: PAT_TA_85908
tcaatttatcattccattccaaacactccaaaaaaacatctttttttatgaatctatgatgaaaacagaaaaaaaaatataaactgaaattcctgttgtaatcttctctaaaaaaaattaaaaatcctattgccggataattctgatggtggaaacaaaactaagtataaaaagagagtagaactggacctcacttcccctgcgtccttctaatccaatccaaaacgtgacaacactcttcatgcccaaggaacaccttgttctctgaacgataggttttgagatccttgcttgtgtgcacacagctttcccttttcatttcaagtgattcaggcaagcaccattgcctcagagccgttgtaagcgtcacagataaactgaacgatttcttcaaaaaggctgtgacgcgtcaacccacnggtaaatcttttcgttgcggaaccaagtcatttgcctccctggagaattcccanacgtttggctgaaactgggcanggaactccaaagaaccctctgggggagctacgcctccgttctgtctgcaatgcaacangtactcaagggtttgcctgtaacaatagcacgggttgcagagttcaaatcgntgcaacccgatanaagaaaccagg

SEQ ID NO: 85909 - DNA, 608 bp, Triticum aestivum
  unsure (1)..(608): unsure at all n locations
  Clone ID: PAT_TA_85909
gccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaattcgccgacgagaattcgtccacaagcacaccaagcccgggatcctctccatggccaacgccgggcccaacaccaaacggctccaattcttcatctgcaacgtccctgcaantggctcgacggcaagcactggtcttcggcaagtctcnaaggcatggacgtctcaagaacatcgagaagtgggctcccaacggnactgctcaagcaggtctcatcgccgactgcggcanctcanattcgcccgcccgccggtcgccgtctctcant

SEQ ID NO: 85910 - DNA, 584 bp, Triticum aestivum
  unsure (1)..(584): unsure at all n locations
  Clone ID: PAT_TA_85910
gcgaaacaccaccgcaccccacaatcccacggctctccccggcgaagtagcagcggcatccatggcccccaaggcggagaagaagccggtggcggagaaggccgagaagacgacggcagccaagaagaccaaggccgagaagcggccgccggcgtccaaggagggcggcgagaagaaggggaagaagaagtccaagaagagcgtggagacgtacaagatctacatcttcaaggtgctgaagcaggtgcacccggacatcggcatctcctccaaggccatgtccatcatgaactccttcatcaacgacattttcgagaactcgccgggcgatcggccaagcttgcgaggtacaacaagaacccaccatcacgtcccgggagnccagactccgtccgcctcgtcctccccggcgaactcgccaagcatccgtctccgaaggcacaaggtgtcacaattaactcctcctangctaggatggtttctgtaatatcaactttcagacatgtctctgtaacttgtgttggttcgtgggaacacctgtttcatactcatgaatataatgngttcttggcaaaaaaaaaaaa

SEQ ID NO: 85911 - DNA, 603 bp, Triticum aestivum
  unsure (1)..(603): unsure at all n locations
  Clone ID: PAT_TA_85911
ctagcttcagctagccaccctcttccactccgggcattttcttgcatccacgacggcaatggccaccgctgatgtccagaacccgacggccgcgctgacggaggaggcgcccgcggtggagacgcccgtcgccgccgaggaggccacgaagacggaggaggtccccgcgccggcggaggccgaggtcgaggcgcttgtccccgtcgaggttgaggagaccaaggaggaggcgccggcagccgctgagacggaggagaccaaggagcccgagccagcagctgccgccgagccggaggccgaggcgcccaaagagccaagaggcgccagccgtcgtcgaggcaagagaccaaggaggccgtggctgaggcaaaccggcatcgtcgangaggtgaaggaggangcggcgcctgctgccgaaccaaaagtgccggccgtcgccgangaacaccggctgcagcggacgggcaccgctgccgcngcanangaaccggccgccgcngtggcaacgtcacgtttgagncccggcccccccgaagaaggctgctaagtcacgtcacgcggcgcctntnctcctactggnacgctnatctantcacaaggatt

SEQ ID NO: 85912 - DNA, 608 bp, Triticum aestivum
  unsure (1)..(608): unsure at all n locations
  Clone ID: PAT_TA_85912
cccagcctccactccacgcctcacctcgctccctcgccacgactctccgccagccaatgtcggctcccgcccacgcgatacgccgcacagcccgccccgtctcctcgtgagatcgccgcgccgctcctccctgctccctccgccacgcgccgcccgcccgctccctccaatcgcgcgccctcgcgcccgcatctcgcgcctcgccggtccgtggccccgacgttcctcgacgcctcccggcgcccttttccgcgcggaatccgagtgccccgtgcgcccttcgccgtccgcgggatccgcgaggccgcgagaggtaccaccgttcggggggcgcggacaatggcggcagcggcgccaccgctctgcgcgtggctcgtcgccgcgggcgcgcacgcggacttcggggcggacgagcaccgccagaccantgcctcgacgccggctccggngcgaagttcggctcgacgccggcccctcggggtgcggcgccgtgggtcgcgcgctctgggaatggcgtgtctgttgccttgcanctgaaaagggaattgtcnanaagaagaaactgatgttnacaagganatgtcgtaccgggatgggtgtatgaccng

SEQ ID NO: 85913 - DNA, 421 bp, Triticum aestivum
  unsure (1)..(421): unsure at all n locations
  Clone ID: PAT_TA_85913
gaagtgcaannaccttgtcancttntggnaantttccctgtgagtaaacttgtggcctacctgacntgatcatcctgaccattacgttcctcgtgttctccttggaggttcngtaagttgtctcaatacatatnggcctgtnganactgcaaaggaanttggntgatncaatcanatnaanctcaatatcacctggagacatcgtgnatgaagtgcacganggacnttccacaacanatgctcctcccatccggatgaacggngantttacttccatccattggttacacatacatgagcttacatccngaantaagcttacctgtcanttattatttcgtactacatgttgtccaaagcacatttgnangaatgttgtttttncatacantactaaaagctatatcagttgatnaaaaaa

SEQ ID NO: 85914 - DNA, 410 bp, Triticum aestivum
  unsure (1)..(410): unsure at all n locations
  Clone ID: PAT_TA_85914
cccacctttaagccgccccatcccccgctgcgctgagtcacttcctcangccacccgccgantgattgctcgatcgaggtgcggtgcgcggncatgatctctataggcgggtcctcgtcctcctcctcctccgccgccgccgcggngggggtccggatgggcggggccaancggngggggaaaccgggcggggccgccgcgccgggggccgcggggccgccgcanaccagntggcgcancggcacgcaggagcngntctactgccggcncctgctggacncgctgcgggncacgcggtcgggcgccgcctcggccgccgcanccgcgcngccgtcaaggcggncgcngantcngcgctggnnctcactgngcgcgngcagtctcnctggagcagnnccatcctgaatggc

SEQ ID NO: 85915 - DNA, 332 bp, Triticum aestivum
  unsure (1)..(332): unsure at all n locations
  Clone ID: PAT_TA_85915
gcccgatccacccccccccccccccccccgcgccccgcatctctctttctcnctctcnacancagtcgagcaaatctccggcgtangcncgagcatctcnacgacgggcctccttgatttcggnggcggtggaggattccngcacgcgcggcgaggnatccgtccttccatgacggcctgatgggcggagcgaggtggcacngcatccacgggcttcaccccnancggtggngtgagtcgangantcgggggctctaacatgangcgcggnccgctctcccctgaacggcggcantggnctctcgncggtggtatttaccngattttctcgc

SEQ ID NO: 85916 - DNA, 601 bp, Triticum aestivum
  unsure (1)..(601): unsure at all n locations
  Clone ID: PAT_TA_85916
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcanctgattgacataactgatgatggatatgtcagccttctcactgagagtggtaacactaaggatgacctgaagcttccactgatgatgttctggcttggcaagatnaagacnggatttgctgatggnaangacctgatcctgtccgtnatgtccgcatgggttgaanaacantntgcctgttgaaggaatcgtggtggaaataagcaactgtncgtggtgcctactgcanacttggaancantgt

SEQ ID NO: 85917 - DNA, 612 bp, Triticum aestivum
  unsure (1)..(612): unsure at all n locations
  Clone ID: PAT_TA_85917
ctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactggtgacgtcccccatgttgaccgccaagattatcagctgattgacataactgatgatggatatgtcagccttctcactgagagtggtaacactaaggatgacctgaagcttcccactgatgatgttctgcttggccagatnaagactgggatttgctgatggcaaggacctgatcctgtctgtgatgtccgccatgggtgaagaacaatntgcctgtgaangaaatccgtggtggcaantaacaactgtgcntggntgcnaactgcganaantggaaccaatgctctgggtgtttanaanaaa

SEQ ID NO: 85918 - DNA, 628 bp, Triticum aestivum
  unsure (1)..(628): unsure at all n locations
  Clone ID: PAT_TA_85918
atccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccaagaaggaatccacactccacctgggtgctcagactccgtggtggcatgcaagatcttcgtcaagaccctgaccggcaagaccatcaccctgggaggttgagtcctctgacaccatcgacaacgtcaaggccaagattcaggacaaggagggcattcccccggaccaagcagcgtctcatttttgctgggnaagcaactccaaggatggccgcacgctcgctgactacaacatccanaaggaatccacactccacctggtgctcanggtccgtggtggcatgcagatcttcgtcaagacctgaacgggnaagacatcacctggaggtcaatctctganacaacgacaactcaaggcaagatcaagacaaggaggnatcccaccggacca

SEQ ID NO: 85919 - DNA, 603 bp, Triticum aestivum
  unsure (1)..(603): unsure at all n locations
  Clone ID: PAT_TA_85919
cgccatattttccttgagaacattaaatcggcaccgactatagacagctcaaaccaacacgttactacttaatccagagtactcccattctcatcttttctgcgaattttgtttcctttgcattgcacattaattgctgcatgttcttgccactagaaatcaaacacgttgttacttgttaacaactcgtccgtttatccaatgaaaatgcaatcttaatcccaccaccattctcgattatcaatattagagtatatataaagaggaatgaattcatgtttccgcaagagatttacagtgctaatttgaatgcgaccattcgtatgattttatagcaatgacgcgtcgatcagttcgtgttgaacgccgagcatacgtccctgatctcgccggcgtcgccggtgatggcgccgatggtgcccatcttgatatggcgcccacaaagtcctgcgccgaagctggaggacccgcgccgangtangcgccgaccancgcgccggtggcgttgccnggctcgancgcccctcggaggcaatgggacaaggccncacggatttnccgaggatggagtcnccaatgttccctgntgcccggtcaacngga

SEQ ID NO: 85920 - DNA, 433 bp, Triticum aestivum
  unsure (1)..(433): unsure at all n locations
  Clone ID: PAT_TA_85920
cgtctccgcctcccctccagtccaccacgccatgcaaccgccgccgcccaccggcgacncgctcgcnggagtgcctccgcctcctggccgacctccccgccgcggccgcctcctccccggccttccgccgccactggccctccatctccgcctccgtctcctcgctctccgcctcgctctcccaccccgccttcccgccctccgcgccgctgctctcccccctcgcctccgccctcggggccctcctctccgtctgcggcggccctgccctcggncacctccacaccgtctcgctcctcncctcgtccgncgcctcgctctcccagctcgcngccgacnggcgcctgctcgtctcnncgtccnccgccgggggcgaangtggcngctccggacagnctgctcccacgccntncgtgctcnggctccgnccgta

SEQ ID NO: 85921 - DNA, 636 bp, Triticum aestivum
  unsure (1)..(636): unsure at all n locations
  Clone ID: PAT_TA_85921
aagagaatcaatcagcttaaatacattgtgtaatatgttactggaggaggaagacccaataaaccttattccaacaacaccaacatgtcctcgcctttgcccttgttctcctagcacgacatcgtggtcgatgatggctccagccgcaacatgacatcacctcagccaatgccacagtgtcatgtcatcagcgacaacggcttttccttcaacgttgcaggcttgtgctcattgcaaatccataatatagcaagcaattggaaacactgcatgaatagcttccaaatccataatttcaatgggaaaaaaaggggaacaaaaantacaaaattatccatctctacctaatgcaaggtgcacaggtactgcagggataatagattantgtaataaattgtacccccatgttataattgttcctgcatcaatttggataaacnaacggggttgcatggtgcgtcaataagancataatataggacacaatgacacacacaacaacacttaaatcacgacacataaaaatcaggggatatcatacaanaaaaatcaggggcataccggaactccagctcaataatcaggtgatacggaactcacagcgcatatcganncacgnccatccgccctgaacgg

SEQ ID NO: 85922 - DNA, 580 bp, Triticum aestivum
  unsure (1)..(580): unsure at all n locations
  Clone ID: PAT_TA_85922
cgcacgctccgatggcagccacggcggtgaccctgcccacctccgcgccgtcgcccttccccgtcgnccgccccctccgctcgccgctgcctccagctccgccgctcgccggccccccgccgcgccgtccgcgtcgccgcctccgccgcggcgaccgaggcgccgcccaagccgccgccggccaccccctccggcatcatcctcgtcgaccccgccgaggcccagaaggtgcaccgcctcaagaccgtctacgacaccaangtcatccccgtcatcaccgangagttcggctacaccaatgtccaccaaggtgcccaagcttgangaanattgtggtgaactgcnggctgggggtggatgcggggaacaacaaaggcctggaggccgccatnaangacctcgcctccatcaccggccaataccccgtcangaccaangccaagaatccgtcgccaacttcaagattcgcgcagggcaacacattggtannccgtcaagctccncggnaaggtgangtcaacttcttggnnagggcataaacttggggtccctaaggacatgggctcnatgttcaacccaa

SEQ ID NO: 85923 - DNA, 630 bp, Triticum aestivum
  unsure (1)..(630): unsure at all n locations
  Clone ID: PAT_TA_85923
agaccacgcgcccacagcctcagcctcaggtctccctccgcgcaccgccaccaccaccaagtacaaccaaatcccccgacaaaaccccatccactcctttatcagcgtttccctccctttcctcccctcccctcccctccatccatcctcagccgcctcttcgccggccggccatggcaaatgcctccctccagtccttcctcccccagcaccaccattctttccccagcagcacgacccacgacggctcccctcccgcgctcctcaagctcaccgccaacaccaccaccaacgccagcaacagcatttcattcaagtcttcggccagcagtcctcctcaagtgaccacaaccgccaatcgccggtccgactccggtcgccgccgccgcggngacaacctcgcggcccaacccctccctgggagtcctggggccagcanctgggcggagggggactactgggaagctgacgagacaaccggggcctctcatcgtcctcgcgggcgaggcgccnccgccnanggtantcttcttctcggaggtcagttatctcgtcnaggactccgcccgtggacgcgctctngtggagcaaacggggggaagttcggtaaaggtgaacgcggtttggana

SEQ ID NO: 85924 - DNA, 638 bp, Triticum aestivum
  unsure (1)..(638): unsure at all n locations
  Clone ID: PAT_TA_85924
gttttttttttttttttttagaacgaagactcaataagagcccgattttgaattaacaaagccatcaaccggccaggattacaagaacaccaactaacaaggaaagcaagaagagaaccaagcgactgatacaaggagcaaagcgaaacagactcataaaaggcaacaacgatagcaagaacacgccatgctgccgccaacaccctacaggacgacctacaccaaccggacaagctacggacttgagaggatgcaccaccgcgcaagcttcgtgatcgtagccaaactcgaagacagcactgacactcctctggaactgccactgcaaagggccctgccctcccatcctggntccnaaggatgccgcaccggcaagcgacagctcggttcacccctanaacccaagaggaagaccccaaagctgcacatgaagaaagaactaggagcaaacctggctactcagagcacacattccgaacacgttcttcgtccgcggttaaaccacaccgaaaggctanaactgtcggcanntccaacaacaagggnaanatcgatganccacgaangaaaagnattgaacgccgaccanntgntacctcacatcaaccanaaccgntntntgcgcccggnattccggg

SEQ ID NO: 85925 - DNA, 596 bp, Triticum aestivum
  unsure (1)..(596): unsure at all n locations
  Clone ID: PAT_TA_85925
ctcatctctctccctctcaccactcttctccacatccggccgtcgccgcggccaggccggcgtggcggcgcgccaccaacaccttccaccgccagccgcacctcacacgccaccagcaccacctgcatcgcccaacaccaccatcgcctccagccaccagtacccacctcccgcgcctcaactgctgctgcctctctttccctccactgcttgctgcttctccttcaacccctttgctgctgctctttcagtgctgctgctccccccctcatcacgttgctgctcctccttctccaactgctgctcctcttctccattcccctgcttctgcttcttcttcacgcccctgccgctcttctcttctccgccttgctgctgctccctccactctcttgctgctacttctctgaaccaaaatgttgctactcctctccctaagctgaactactgctgtccttcaacatctccaaggacgacccctacgttcaactcagcaaacaagctgctgcgtttccccctctctctctctaaatttctgtaattgatatgtgagaaacttgtaatatcagattcnaganactgcacctgataatgtt

SEQ ID NO: 85926 - DNA, 605 bp, Triticum aestivum
  unsure (1)..(605): unsure at all n locations
  Clone ID: PAT_TA_85926
cccagtagtccgtctccgtctcccagtctcccagtagtccgtctctgtctcccagtagtccgtctccgtctccatatctggtacgtatacctgcaagattgtgctgctcaaggttttctagtgattattctcatcctatattattcttattgcaagcccgaggtgtctcctcatcatctacaacaaaggatccccattgcccgccaccagcctgtagcagaggatccccactctgttgggcacaacacgaacacccaaaacagatcatcaagcatacacaaccagtgggaactgctacaaagcaccaagaagaaggcgaagcaaagagggaaagtcacagcagctcttcttggtgaggaaatgctcggtcctgcagaacaacgtgaaagcagaattaactacgtgctcntctgcggggtgcttcnggtgggtcttgctcctcnagcacttctgggaggatgctcaaatgggtctccatggntcaacatggacgtcaacatactcatgctcatcgcaaggctaacatggaaagtgctatggaacangaggtacacaaggtggagaaccaaagagtgatgttgttgttgttgctnacctttccacaa

SEQ ID NO: 85927 - DNA, 272 bp, Triticum aestivum
  Clone ID: PAT_TA_85927
ttcccattggatacatacactccagatatacactgtagattagatgagtatacttcagacgcagcaaacttgagtacactatactgaagcgcttctatggtttcctcttgcaacttgagtacactgtagatagatcatataaagaaaaaggaagtttttgtacattgaagcgctttccttggttgagtaggtttggggtcaatccccctgctgttatgacctgctgatgcatgatctaagaatccttgtagttctactctaaaaaaaaaaaa

SEQ ID NO: 85928 - DNA, 596 bp, Triticum aestivum
  unsure (1)..(596): unsure at all n locations
  Clone ID: PAT_TA_85928
cccagcttcattcagctcgccatagcttcccctgcgcactgtctgtaagatgcatcctacagcacgcgccatagtgccacactacctgctcctcctcttcgccaccttcttcttcctgctccgctccccgtcgcccgccgcggccgccggcgacgtcaccctcctcctggacaggctcaagcccgcgctgcagggcgccacccccaacgcccagctcgccacctgggaacgcctccacgccgctctgcctctggcgcggcctccgctgggtccacgcccgcgggccagccgctccgctgcgacaccgccgccgcgcgggccaacctctccgctcgccggagacccacctcctcctgtcctccatccgcctccccggccgccggcgctagccggccgcctcccgccgggagtcggcgtcttcccgtcctcgaatccatctactcgccgccaatcctctcggngcatccgctcgagctcggnaaccacggcgctgtcgagctggactcgccggcaacgcctgtcggnangctccgcctcatctggaactctgcgaacggctcccagctcgctcatggaaagctctacggaaggattcc

SEQ ID NO: 85929 - DNA, 629 bp, Triticum aestivum
  unsure (1)..(629): unsure at all n locations
  Clone ID: PAT_TA_85929
tgccaggcggcgtgcaagactggttctgcctgcgcgagaacctgcggcacagaaagatgctccggagagcgacatcgccgagggcgtcagcgtgcaggccgcatggacatgggatgccatctgagtaggcgctctgcattggtttcgaaactctctggattgtaatgcatgccagttattttatcggaaaaagatgagtatcggacatcacgaatatgtttcttatatgttaccctagatttccgttattaaagagtaaagataggagaaaacaaaaagaagtacgtcccactttgccagctcaagttgcaaaacctcatttgctgcatggaaaggccgacttgatgcaattgtagacatgcaccaccggggcaatggcaaggagagaggacttgccattaggacattattangacatttgtgggcctccgtttaattggtaatccaatcacctaatgtgctcctcaaccccaacccaacccaactatacntgnaatcctttaatcgtttgatgtctaaattaaaatcattagggggctccctattgtccaaangctcaaaaaaaaanaaaaanaaaaaaaaaccnagggggggccgtacaattcnccaaangagtcnatancccccng

SEQ ID NO: 85930 - DNA, 162 bp, Triticum aestivum
  Clone ID: PAT_TA_85930
gcgacccatcgtaccgcggctacgtcaacagcccgagggcgcagagcgtcgtcgccgcgtgcggcctccccaggcccaagtgctgatcgctgtcgtcgccgcacgcgctatatatatcgactccgcactgtgccatcgtgcatgatgccgggcaccgttaaa

SEQ ID NO: 85931 - DNA, 444 bp, Triticum aestivum
  unsure (1)..(444): unsure at all n locations
  Clone ID: PAT_TA_85931
agaaggctgaacgaggacatcccagacccggcgcgacgctggaggatcctctccgagttctgggcggagatgatgctgtacctagcgccctccgacaacgcccgggcgcatctggaggctctggcgacaggaggtgagttcatcacgcacctctgggcgctgctcacccacgccggcgtgctgcagcgagatcgtggcgctggcgggccacaggctgctgtctaatccatccatcgcttcaattcaatcagtgcacgcgcgcggcattgttaatttatttatccgtgtttatttccggccacggccatgcatctatctaatccatccatcgctttaattcaatcaagtgcacgcgcgcggcattgttaatttatttaaccgtgtttaattcccgggcacgggcatgcatctatctacacagtacatactgtnaaaaaaaaaaaa

SEQ ID NO: 85932 - DNA, 599 bp, Triticum aestivum
  unsure (1)..(599): unsure at all n locations
  Clone ID: PAT_TA_85932
ctcgtgcccttctctgcccggtccaggctcctcctcgtccctagctggtcaaccaccgccggttgatcccgcctcgccgtcgcctgagccgagtcctcgggccttccctcttggcctccagatccagcggccccgttccccttcgccctcgcacaccgccggcctggcgctgtcgccccagtcgacctgcgcgccccgtcccccgtcgccccagccggtcaccggccccgttccccgtcgcccaacccgccacggcccgtcttcaccaccggcgccaccgggcccgaccccgtcccccttcgccaccgcaggccactgggccccgacccgtcgccctcacggaccgccggcctgggcgccgtcgccccgtccccgttgtcccaaccggttgccgggcccgttccccgttcgcccgcacctccaatggccgtcttaacaacggcgcaacgggccggacccgtctccttcgcaacgcangcactgggcccggccgtcggccaacaatcctggccgaccggcctcangccgacaactcgggataggtggaactcgggcncggggaggttgacatcggggtcaaagttctnnttnctgaaccg

SEQ ID NO: 85933 - DNA, 559 bp, Triticum aestivum
  unsure (1)..(559): unsure at all n locations
  Clone ID: PAT_TA_85933
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgagccggcgcccaggaggccggccggcagaggcgagcacgaggatgaggaggagaacaagcatcatcatcaccatcaccaccaccagcgtatcantacactaccgccgcatcgctcgcgcgcgcgctaaataaaataaaacgtcatgtgttccttaantctgtacnctcgcgtgtagtgtcgacagtgtcctcctcatgcctcaattcaatgaatatatggcgcccaacttgaacgaaaaaaaaaaaa

SEQ ID NO: 85934 - DNA, 637 bp, Triticum aestivum
  unsure (1)..(637): unsure at all n locations
  Clone ID: PAT_TA_85934
accagaccgtccatccaccgccgccacgacggttccccatcgccgaaggccagcaaaacaggtcactatatccctgcggtcgtgaactagctccggtggctttgtacgaggagaagaggtcgtcccgccggcgtgatccaattcaacggaagcgacgccgccgcctcgtccaagcgcgacctcagctccacgccggcgcttggtcgcttccccgcgctctgcaagctcggggactgtttctctcctgtcccatcctcacctccccgattgggaaggatctaagagatttcaccaagccgcccttggagtcattacaatctacgtaggtatcatcgacctcctcttcaagtttggtctctcctcctacttcatgagctcatgtaatgatgtaaatggggattcctaactaatttttgatagactggaggatgtttgtgtcatcaagagtgcatccgaatttgtttgcatgagtttgacatcaaaaaggggatggtaagttgtgatggggaaaattacntgtcaaaggaatcactcatgtctgttgtattgagaaggagcatgaaattacaatcatggtaaataaacantcataaaaaaagtcaacatacaaggattaagaccgagacnccttcttatt

SEQ ID NO: 85935 - DNA, 496 bp, Triticum aestivum
  unsure (1)..(496): unsure at all n locations
  Clone ID: PAT_TA_85935
ttcgcttctcatcccccacgggcgacgggtgaaccctagcccgcctcccctcctccagcccccttcccctcnctctcccctcccgncgtcnccggngtgttccnctgggccggcctttccccgtgagcacngagggtggcgcaanggctcctganggcngnggtgcaactcggccggcggcggtccggcttggnggggtggttcctcggtgcagcggcacctccgttggttccggggcgatgtgctgttgcnggcgtagccggcggcgcccctcggcccatatatgggcccttcaagccccatctgggtccangcggnccggctgtttcntcnacggtggcgcagctccctgnaggtcaaagtggtgcggcagtggtctcccgggcggtancgggcaagtccattgngcgttctgcaacgccggacgcagggattcnccggctcggctgcgcnaatangggctttgtgttccntgacgtcgcgtccggtcggttgc

SEQ ID NO: 85936 - DNA, 689 bp, Triticum aestivum
  unsure (1)..(689): unsure at all n locations
  Clone ID: PAT_TA_85936
cccaacccaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctgggtgctccgcctccgcggcggcgccaagaagcgcaagaagaagacctacaccaagcccaagaagcaaaagcacaagcacaagaagtgaagtcgccgtcctccagttctacaaggtcgacgacgccaccggcaaggtgaccaggctcaagaaggagtgcccaacgcnactgcgggcgggcacttcatggcaacacttcgacgcacaatgngnagtnggctaactactctcaacagaagcttanagntcttgcattgtctctctttactacttcagatcaacnattgattgtccgttgcgttaactaacctagnctaagttcnaaanttacgcncngttaccatcngctaatttggccnagcanancaagnttacancagncntcaagctgtgttaaaaaggggcgncatc

SEQ ID NO: 85937 - DNA, 449 bp, Triticum aestivum
  unsure (1)..(449): unsure at all n locations
  Clone ID: PAT_TA_85937
gtctcctccctctcccatcccctctctcctccactcaccgtcgccgccgccgtccaatctccggcgagatcccctcccccgccggcagccatggcctccaccttcagcggcgacgagaccgcccccttcttcggcttcctcggcgccgccgccgccctcgtcttctcctgcatgggggcggcgtacgggacggcgaaagagcggggttgggggtggcgtcgatgggggtgatgcggccggagctggtgatgaagtccatcgtgcccgtcgtcatggccggggtgctcgggatctacggctcatcatcgccgtcatcatctcnaccgggatcaacccaaaggcaagcctactcctcntcgacggtacgcggactctcctccggnctcgcctgcgnctcggccggctcgccgccggcatgggatcggatcgtcggngacgccggngtaagg

SEQ ID NO: 85938 - DNA, 691 bp, Triticum aestivum
  unsure (1)..(691): unsure at all n locations
  Clone ID: PAT_TA_85938
cagcgctgggctcgtctcggtcggnctcgccaggaaantcctccaggtggcgccngcaggcacgcgcgtgntgatagtgtccacggagatcctctcgtcgcagtnctacntcngcacggagcgtgcgatgctgntgcccaactgcctctttcgcatgggcgccgcggtcatgatcctctccaactccccgagtgaggcgcggtttcgtctccgtcgtgtggtgcgcaccgtcaccgccgnacgggacgccgantaccgttgcgtgttccangaggaggacnacaaggggaacacacggcatccgcatctcccanggacctcgccaccaccgccggctacgcnctcanagaacagcatcgnggtttcgnggccnctcgncctgccggcnacggngcantcctcgtcacgctgtcgctgctcaaacggagctcctcananggcgcgccaaagtnaggtgtacgccggactccgcactgcgttcgngcaatctgcatcacncgggccggcgtggagtatcacgaggtnaagacggctcgtctctcaagacaactgaggctcccgngacntgacagtcggaaactcagaatngtctgncangnactacngaacagnccgttanatgtaaggngngtatcctcgnnccgngcgaatgtncggatctaagcgcggaaccaggcttgtatgtccgact

SEQ ID NO: 85939 - DNA, 688 bp, Triticum aestivum
  unsure (1)..(688): unsure at all n locations
  Clone ID: PAT_TA_85939
ttttttttcaactgttaattatacgtcgggtctgttaattaatctagtacacatgcatgtgcaagaatcagagggtgtttgtttccagggactttttgggactttttggtgtagggactagaaaaagtccctagcaaaccaaacatggtgggacttttttggaactttttgctaaaagtccttagaaacacctccttgagagtctttttcaaaaagtcccagaaactgaaaaaagtcctaggactagagaaacaaacaccacctcagaagaaaaacaaaggccgaaatgggtaagcaatattccacactaatcacctactgcctctctcatgcatctccgtatctctgcgcctctctgtacgtgtggtgtacatgtgcgtcgtatggacagatggacttctaccactcgggctcgcgcgctccggtgctcacagtcgccatgcacgcgcacgcaccacaaagggccgccggcgctcgatgatccgtcgtcgataggaggaaccttggcgcgggtgacgggcgaagagtaccgtgtgctgtggctgcggctcactgaccggtcaagacaagantcatgccctttccggcacacncccgagcgagaannncacgagaggaacanacggcggcgattttcanatntcggcgccaacntgaaaggtngaaggaggangtgnnaaccnacctc

SEQ ID NO: 85940 - DNA, 413 bp, Triticum aestivum
  unsure (1)..(413): unsure at all n locations
  Clone ID: PAT_TA_85940
ctatatctcgccctcctcctccccccctctcaccacccaccattcgnctacgctcttcgcttcctccgacgcngccttcccccggtcttctcgcttcagatcagttaacgtanatggatgacncagaangacattcacccccttgtctgcgacaatggaantggaatggnanggctggtttcngcngganacgatgntccaagtgcagttttccctangnattgttgnccgtcnacgctacactggtgttatgngtanggattgggnagaaggatgcttatggttggngatgangnccaatccangaggggtatcatgantttnaatacncattgngcacngaatcgtagnaactgggganncatgncgagattggatcanacgttncanaatgagctccgttagcaccgagg

SEQ ID NO: 85941 - DNA, 630 bp, Triticum aestivum
  unsure (1)..(630): unsure at all n locations
  Clone ID: PAT_TA_85941
gccatccaacatcttcttctccggcgggcagggcatcagaaaggacagccgccattagcgaagcttcgttcggcatggcgaggcaagccctgacgaacgggttcctcggcggcttcatgtacgtggggctggcgctggtgctcctcgcatacctccccgtcgccttcctctgccgcctcgtctacaggctgctgatcaggcccttcgccgccggcgaggacctccgcggcaaggtcgtgctcatcaccggcgcctcctccgggcatcggcgagcacctggcgtacgagtacgcgaggaaaaggcgcgtgcgtggcgctggtggnccggacggagatcncgctgcgcgccgtgggcaaagacggcgcgggaagctgggcgcgccggacacgctggtggtgccggngacatcacgactnggacaaggcaancgggcgtcaangagacctcgccacttcggnaattaataactggtggcaaccggcgttggtcaanntgcttctcaggagatacaagtgtcngccttcaanaactcaggntnaactctgggnggggtaccgactanttcggngcctactaagganccngganatctgnaacgctcgtgncgnagtccntgnccgtagnttaac

SEQ ID NO: 85942 - DNA, 649 bp, Triticum aestivum
  unsure (1)..(649): unsure at all n locations
  Clone ID: PAT_TA_85942
cccgtttattattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcggacggcaacggcaccatcgacttccccgattccctgaacctgatggcgaagaaagatgaaggacacggctccggaggaaggagtcaaggaggcgttccgcgtgtttgacaaggacaaaacggtcatctcggcggcggagctgcgccacgtgatgacaacctcggggagaactgacggacnagagtggacaaatatcggaagcgacgttgacgcacggcagtaatacangagtctcaggcatatggcaantagtgcangnanggtcctccacaaataacttaaattccccagtgattgaatgatcanaagacnccaaatttatttgcatcncggttttaaaagtnccgttggaatgcgtacttangntaccnganaacnattacngtcctttgtgga

SEQ ID NO: 85943 - DNA, 743 bp, Triticum aestivum
  unsure (1)..(743): unsure at all n locations
  Clone ID: PAT_TA_85943
ataaaatctctgttgattaataatttcttctctatgttgtgaggtaattatccctagaatttgttcttctgtaactaagtttaaaacgtcacaaaaaatggttgcaaaaacaatgagccagtttttttgtgctgatcagtgtccttggtggaggaattgtcctgttttttcaacttgattagtgtgcaaaaactttgatgtccaccagtggtgtatagtgcatcaaaatttggaaattccctatgctgacttggtaatgctggtgattttgtagcctcaaacattgtcaaacataatatttaatagtactaatgtacctgcaattaagcgagtaatatataacatacatatttaatttccaatagctggaatccttaacatctacaaaaaacacttgaatgtctggtgtcatccacgtgctaaacagcactccngttaatttggggtgataaatcacaagtgtaattgaaaacacataaacatgcacaatcatagtcacagggagattcaacattgatgaatggattgcantgncatcattnagaatcatanttgggacagccactgccnactggccttgtgaaantccgttctaattagaacntccacagaaggagaattnaccncnatatgtancagggaatttggtaattataccaatganttgcaacagccaattaggacatgntttgatacaggttttttcgtaccnggnaaattanngnccaattnctaccaagntt

SEQ ID NO: 85944 - DNA, 710 bp, Triticum aestivum
  unsure (1)..(710): unsure at all n locations
  Clone ID: PAT_TA_85944
gatctatgtagcagtgaaggaagggggcatgattgttttgcctgcaggaatgtatcatggattcacgttggacaatgacaactacatcaaaggcaagggcgtaaagcatctggggatagaatagaactagaaagacgaaatcatcagcgtataacaatgcccacctccttgctgatcaagctgttcgacctgtctaacatgatcaatttgtgttatagagactatgctccagttgtttgtagttgtgctccgaatagattccccctactttgtaatagataacacactttgctatagtaagtttgaaagaccggtgtttgtatgcagctgccctacacatactgggaaacaggagaatgaaagggtgtgaaactcgccgtcngacaccancggttgtgttcgccgccagcggcaacactcaacatccaacagtgcgatgaagacgacatctagagtacatacgcggagcactgtgaacttaggaacattgtattgggcaataggttagatcatagcacatgnacgcacagcacagcacagcatgtaacaacatcagtacatnntnacacatcagnatttcagcaatnaccatttcagtccaacaagganccatgcaattacctntatntcatantagatntcgattctaatgccacaccgattnaagccaccacatttaattnccnnaaactagaatnatcctagccaac

SEQ ID NO: 85945 - DNA, 635 bp, Triticum aestivum
  unsure (1)..(635): unsure at all n locations
  Clone ID: PAT_TA_85945
gagcactagcacacctccagccagcgccctcatccctccatctcccctaagcaaccacacgccgccggccaactccgcccgcccgtccggcgcccccgtccggcgcccgcccatccccgagcagcagcatgccgtgcccagctcccgcgaggccgtccgtccgccgccacgcccagcgcccgcgaggccgtctgtccgccgccacgcccagcgcccttctgcccatccgtccgccacctcgccagcgccacgtgaagctccacccctcgcgagctcgtcctcaccggccggccatgcgcactcgagatctccggtcgcgcccccgatcccgtccacaccccgagctcctcctctctgcctcgcnagctccgccgctagagcagccgggcgcttcaccggtcgagcaccggcatccccgagctcctagcgtgcctcccgcggcgtcggtcgagtcagtcctgagcgcggtggacggagttgncggtgagaaggcnggcggagtgcancaagatacgaacancggtnatgcancgtcgttgacgnggggnggcatncacgctgagagagaccaatgnttggctanntagggcttggtaatcaganactngaantattttcggnagttgatttccata

SEQ ID NO: 85946 - DNA, 207 bp, Triticum aestivum
  Clone ID: PAT_TA_85946
cgccgctacttcccacagatcggcatagaatcccagcaagattcaccacatcgtcatatcatagaggccaagaattcttgggaattagcgctccgccacccatccaatccatccatattttctatctatctctctcttcgccagtgcttctgttctgttcttgtgttgcggatatttgtcattgctgtcccgttcaaaaaaaaaaaa

SEQ ID NO: 85947 - DNA, 492 bp, Triticum aestivum
  unsure (1)..(492): unsure at all n locations
  Clone ID: PAT_TA_85947
cctgcccccgtcgaggttgaggcgaccaaggaggaggcaccggccgccgccgagacggaggaggccaaggaggccgagccagcagctgcggccgagacggaggccgaggcgcccaaagagccagccgtggtcgagacagagaccaaggaggccgtggcagaggcagagccggcagtcgtcgaggaggtgaaggaggaggcggcgcctgctgccgagccggaggtgccggccgtcgccgaggaagcaccggctgcagcggaggaggcacccgcggccgcggcagaggagccggncgacgccgtgggcancgtcagcgtgtgaagcgccggcgccgcggangaagaactggctgcctcaacgtcaacggnggcggcctntctcctactggnacggctnaanctcaagcantngattgagttgactgggntnctacttttacaacggtacccactaagtgtgagtggntggnntctatccccgggnccctnacgt

SEQ ID NO: 85948 - DNA, 635 bp, Triticum aestivum
  unsure (1)..(635): unsure at all n locations
  Clone ID: PAT_TA_85948
ttgtggagcctgagatccttgttgatggacctcatgacattgaccgctgtgcttacgtcaccgagatcgtccttgctgcctgctataaggccctcaacgaccagcatgtcctcctcgagggcactctcctgaagcccaacatggtcacccctggttctgactccaagaaggtggcccctgaggtgattgctgagtacaccgtccgcaccctccagaggaccgtccctgctgccgtccccgccattgtcttcctctctggtggacaagccgagaagaaggcgacctgaacctgaacgccatgaacaactccagaccaagaaccctgggaactgtcctctccttcnggcgtgcctccagcaagacacctcaaggctggtccggcaagacggagaacaagagaaaggcaaggcgggtcctggtgangtgcaaagcaatccgangcacctcgggactacaaggcaagcacctcgctaaggcgcctccaaaagctcacgnaaggacacagtatgattatcnccttcgtcttgnccgttggctccgctacatacaatgcattgttgttctancctaaaaccccgtacanacnttttaaaangaanttgntttaaactaaattctttgnttatnctaaacgg

SEQ ID NO: 85949 - DNA, 200 bp, Triticum aestivum
  unsure (1)..(200): unsure at all n locations
  Clone ID: PAT_TA_85949
gtatgacctacganaagaaaatggggtgnacacttgtactgaagactgatttggaatgtgcgaanccaggcatgctangtttcctctagttttgacaacattgattantggnaccttgtanactgcttatattgaacgatatttgtgcattgaaataacttactcagttcanaactgagcttacatgcaaaaaaaaaaaa

SEQ ID NO: 85950 - DNA, 302 bp, Triticum aestivum
  unsure (1)..(302): unsure at all n locations
  Clone ID: PAT_TA_85950
cccatccccatccgcatccccatctccgtctccgtccgtccacagaagcagcgtcgccacaggggatacacgaggcaccgcccccgcgcacgatatctgcttcgccgtcagggggatccgcgcgcctttgccggcctcctcctttctccctgtgccaccgtaaactaatcccgtttgggtggctgctgctgggtgggcggcggaatccgatcccgaagagcatcctgttccgggaacggaagtatgggttctttccgctgccgtccccccatccgtgatcttgggtnctttcttgggtgggg

SEQ ID NO: 85951 - DNA, 662 bp, Triticum aestivum
  unsure (1)..(662): unsure at all n locations
  Clone ID: PAT_TA_85951
ccacgctccgaccgaccatggcgcgcgccgccgtctccaccgcgccgctctcccgcctccactccccgacgccttccgtcccgtgccactctctgtcctcgcagctccgcattcaccagcagcgcaggccgctcaccgtcgcctcggcgctgccggaggtcgcggacctgcccgggctctccctgcccgccgtggcggccgcggcagccgcgctcgcggcggcggtgtccctctccgatccggagcgccggcgcaaggcgcaggcggaggcggtgggcggcggggacaaggaggcggtgcgcgcctacttcaactccacgggttcgagcgggtggcgccggatctacgacccgggcacggacgacgtgaaccgcgtgcagctggacatccgcgaagggcaccgcaaacggtggcggcactcttgccatgctgcgggacccccgacgtgccctcgccggngcacngtgtgcaacccgggtcggaacnggtcctgtcatccgctggctcgcgggggctcgtgctgctcgaaacncccgcatgtcccgagggcacggangcgtttgcgccggtatnccggttcgatgcncgttagtgcganttaaaccnagggcgtanactggggtcngctgcnacatnccgaggncaaaattngcatccccccc

SEQ ID NO: 85952 - DNA, 748 bp, Triticum aestivum
  unsure (1)..(748): unsure at all n locations
  Clone ID: PAT_TA_85952
gcaacctcccctcctcctcctcctcgagctccctcgttccctccactaccccgcacgcgccgccacacgccacgcaccaccaccaacccaagaagctccctctcctcttccttcttccttctctctcacaggcacgcacaagagtaggtgccgccggccggcatcgagattcgagaccagccatgtcggcgtcgcccgagttctactagccggcgccggcttctccccatgccgctcgccgcttgccccgcgcggagatgtcgccccaagagcggcggcggagcaggatagcaggaggagtgggacagcaagcaaggcgccgtntggaaggagcaatgctgccggacgccaacgggcaaggggagcgagctgaagcaagctccgcgacgtgcccgccggcgccgaagaagcgcgngggcgccgggcgcgccgtgccggaagcggtgttcgaagtggaggtgtnaacctgcggctggataactggagcgcctctttggcgccgacgcgccgccgccgccgccgagaagaggcaagctcagcgccgcaggggtgcgcgcacgcctcgcctcgcgggccancagagtantccacaagactncnttcccggggcanccttttggcnccgtgtgcccgaggactntnaaatttgaccgttttagggancggccagaaanaccataggattcngaccttcaggagtnanaataatnctttttnagggancctnctggaaggaaanagggattng

SEQ ID NO: 85953 - DNA, 245 bp, Triticum aestivum
  unsure (1)..(245): unsure at all n locations
  Clone ID: PAT_TA_85953
ggttatttgggatggtcattctgggagcatcggttggacagccactcaggcaatgtctgtcggtggagaagaacanggtgatgcctccaatgctccaagtncanctccanttcccgggctgggaaggcgttncccccgggcttccnaacantttccttggcaaaagttccccgattttaaccaatccaannccttacatgtncaaacccctcaacaaatcaaaggngtccaccacatattaatgt

SEQ ID NO: 85954 - DNA, 550 bp, Triticum aestivum
  unsure (1)..(550): unsure at all n locations
  Clone ID: PAT_TA_85954
gccgcttcttccacctcgcccgcagctgaaccacgtcgccatggccgatctcatcttcgtggccactgtcctccccgtcgcctgagactgcgccgggagcaccgcctcctccgtcttcgtcgactacttggacgcatcggagctcgggaccccctgcctcgcgcgaatcgagtcgttcccttccccgaatcgccgtcgccggaacgtcgtcctcatcctcctctccgactagcatcaccgagcctcgccgcccgtanccctgcatcgtatgacnatgggagccaaggagccaagaggctactgtcgaatgacgactactactactccggaaggtgcctactactacgtgcagccgttagcgacgacaaggagtcgtttangaggattccaggcaangangtatgcgcctccttcgatctgtatcactgttgtgcaaccttcttaaggcaaactggttaacttangtcgtatcagaaatggtgntccgctgactcnncatgatnanctctgnattcgagcctcnaggccatgntntaaatgtgctgtaaan

SEQ ID NO: 85955 - DNA, 238 bp, Triticum aestivum
  unsure (1)..(238): unsure at all n locations
  Clone ID: PAT_TA_85955
ggatcccanccncangaagtngntcctccatcanngnaatgaagatcacagcgcnacgctgctcaatcaactgctacaaatncgctgccgncgcacggcaaaggtggtgcncgtggagtgcatcntgcnggtgaanccgggggccacgcccaaggcgcacggggtgttccacgtcganatnattatgntctcgcaaaancccggcgggagggganaggtacnananggagttcgaagg

SEQ ID NO: 85956 - DNA, 391 bp, Triticum aestivum
  unsure (1)..(391): unsure at all n locations
  Clone ID: PAT_TA_85956
gccaaactcccaccccgctcgctctccctctgagctgtggcatagctgtcttcctctccccacctccacctccacctccaccccctcgtcctccctcctcctccgtccatccacaactcanttgctgccaaatcttancgctgcacccaacgcctccgttcggttccctggattcttctccggcgcccgcgaaaaatctgggtgatgagatgatgaggacngcgcggtgctcctcctcctctgccttttcgccttcgccgggaactngcggggcggagcgcggggccgcgggcgtatgggcgganggggtcaganaagacgcngccgtggaggtggacctgctngcggttcgctaacccgcgggtgcnggangcntangtcccgctgcaaa

SEQ ID NO: 85957 - DNA, 403 bp, Triticum aestivum
  unsure (1)..(403): unsure at all n locations
  Clone ID: PAT_TA_85957
gagagagagagaactagtctcgcgttttttttttttttttttttttggctcaagtggcctgtatgacacatatatattattancgggtcangntgctacatttgtgatnaaaatcaaatgttaaagaaatgggntatatacccaaggnaaccaaagnacaatactacttnaacgaagagggaaagggaanggaaaaatngtagcaaagttgncaccacatcanaccaaaaaactttaaggntggccaattctaacaaaaggatttaanagggaatcnccgaaatcccnttntgaanaaatnaaggggcgtatanagntattatccagggaattncncctaaatccctgaggggnggaaanaaggtntnaaaaccatgggaatttacgttgggcanncccccaa

SEQ ID NO: 85958 - DNA, 651 bp, Triticum aestivum
  unsure (1)..(651): unsure at all n locations
  Clone ID: PAT_TA_85958
ggccggagagctttcctcggaggagatggaccgcctgatggcggtggtgcacaacccgcgccagttcaaggtgccggactggttcctcaacaggaagaaggactacaaggacggcaggttctcccaggtcgtgtccaacgccgtggacatgaagctcagggatgaccttgagaggctcaagaagatcaggaaccatcgtggtctgcgtcactactggggcgtgcgtgtccgtgggtcagcacaccaagactaccggcaggagaggaaagactgttgggtgtctccaaagaagcgataagctgcttcacaacgatcccccatagttttctactactgtgttgggtccatttccaagaatcttaaggagtgtcttgtttagacgattacttggatgatgtttgccctanataatgtcttgtccggnactttaatatattgtatcttgaatcctcntgaactctttgagagttgttttgcaatggctttngcattnatgggtggggggnccggtaccaatcgcctatatgancgatagcggctantggccncgttaaactctgactggaaacctgggtaccaattaacgctganaaaccccttccantgggnanacaagccnactnccttcaaattgaactatgnatgaccctt

SEQ ID NO: 85959 - DNA, 256 bp, Triticum aestivum
  Clone ID: PAT_TA_85959
aatgcccaagtgaggttacacaacccgccagcttctgcatctccttcagggtctgtgggggggtcatgtcccctatcgccttgaccttctccgggttggcctcgacccctctatgtgacaccaagaagcccaacagcttgccggaagggaccctgaacacacacttctcggggttaagtcgaagatccaccttgcccaagctggcgaatgtctcctccagatcttctatcagagtcctggcctccgaagggggggg

SEQ ID NO: 85960 - DNA, 536 bp, Triticum aestivum
  unsure (1)..(536): unsure at all n locations
  Clone ID: PAT_TA_85960
gacatttcttttgaagctcacgataccgtcaacgcttccttctgaatggaacaaattttacatctgtgcgaacatctgtctatgccctctcatactactatattcttttagctcattcattccgttggatagccgaatagtatttcttctccctcaaatccgcttccccctctggtctgttgttcttctggttagcttttgtttggctctatcccacttccgctttgagaaagaatcaccaagaaacagngaacattgcaagtaccctcatatcgtttgtaatgagcgtcttcnggatctcaaccatgggccggagagctcctgaattgctggcagcaattgngggtattatggtctccctcaactatacttggcatgacagtcntggnatgggggaattctgtcggtgatcttgntgtgatgtggaatggcaagaacggnnaactaaatcgcattgcggcggtttgcnggccaaggtcaacatgcttgntgattangactgcctaanattcancgcangatgnttcaangccttg

SEQ ID NO: 85961 - DNA, 177 bp, Triticum aestivum
  unsure (1)..(177): unsure at all n locations
  Clone ID: PAT_TA_85961
cccacccacaagccctagctcccccgaacccatggntcncaccanntccagcaccccgccgccgccccccgtcctgggcgngcncgtcggntanncgccgggggcgtaccctcctccgncgggcgcccccgcggccgnctacncgccgtagctctacncgnacntcgggcgccgccg

SEQ ID NO: 85962 - DNA, 582 bp, Triticum aestivum
  unsure (1)..(582): unsure at all n locations
  Clone ID: PAT_TA_85962
gctaacacaaattataatatacaataacatatttcgacaaagtacaatgcaacatatacagtaaaaaggtacactctctcaatctctgcagccaaagatgcacacatcaattagtaaaccaacaaactaaggcacaaaaacagtagcttccaacaagaggttagtcttccgacgcgccgtgatcccatatgcctcggtcatatcaagcttctccggactcgcaccatcggggagcctccagtcgaagtgatagagaaggctcgcgagagcaatctccatgttgggacacaccaaacatcataccagggcacatccttcgaccggcgccaccagggaggaacctgaagtcggtaccaccgtagccacttctcgacctcgaacctctcgggcttgaactcgctcgcgtcggtccagctcttctcgnccctggcgatggccacacgtttgnaacacgtggggcccggaggnacgtcgtanccatgatttttctgtccgtganagctcgggaggacacggnaccggnggtgaacctaagncncctgattacanctgaggatgagtggcgtcatgtcgctcggaact

SEQ ID NO: 85963 - DNA, 546 bp, Triticum aestivum
  unsure (1)..(546): unsure at all n locations
  Clone ID: PAT_TA_85963
gtgaggcgtaccaagaaccctagcctccggatccatccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtgngacacatcgtcatcaaggcccgtccctgcaaggttgttgaggtctccacctccaaggactgggaaagcatggtcacgcaaagtgtcactttgntgccattgacatctttaatggnaagaagcttgangatatcgttccttcatccaaaactgtgacgtcccccatgttgnccgncaaagattatcagctgantgacatanctgatgatgatatgtcagccttctaactgagagtggcaacactanggatgacctgaagttccactgangatgtctgcttggcaagtnangactggnttctgntgcaaagacctgatctgctgtgatgnccgcaagggtaa

SEQ ID NO: 85964 - DNA, 623 bp, Triticum aestivum
  unsure (1)..(623): unsure at all n locations
  Clone ID: PAT_TA_85964
cgactagataggtagatacacacaagcggacaagccgtggaagcatggcttggagtttccactttgttcccttgctcctcctcctcctcctgctcccctccacttccgcagtggccacctccgggcacagcaccggcaacgccaccgcaagcctgaggccagggagggagccgctcaagcaccggaggatcagggctctcctcggcagactcaacaagccccccctcaagaccatcaagagccccgatggtgacttaatcgactgcgttccctcccacctacagcccgcgtttgaccacccaatgctcaagggacagaagctctggacccgccggagaggccaagaactacaactccaccattgccggagcggtggtggtgcaggcgtggatgcaccggcgaggcgtgccggaagggacggtggcgctgcngcggacgacggagaaagtcctgctaagagcagtcctcaggaggtacggnaggaaccgcangccggacaaccgccgtgattcacaagagtggcatgnnaganttggtatgtnatcaggaatatatgggcanagctagggtaantgtggcacaggtngngccaactggttanctgnaaagtnngtantcggtct

SEQ ID NO: 85965 - DNA, 339 bp, Triticum aestivum
  unsure (1)..(339): unsure at all n locations
  Clone ID: PAT_TA_85965
cttcacacattcttctccaatatgggtcctccaagttcacccgctcacaantcatgctntnaaaggcgctntngtgggcncggtcttncnccatgctggncctgccttccttggggcgttgtccgtcgctgggccaagnagaactaanantggtcctgcaccggngaagcggtgcaancaatgtnggcgcactggacggngatgtgcaaagtctccgttcccccaagtgnagncggtactggcgacgtncctanntgtgaagaatgccggtcccgccncnattcgcggctgtaggggcaaagtngaaagacggggggtgcaatgnnatgggnacgcgtg

SEQ ID NO: 85966 - DNA, 264 bp, Triticum aestivum
  unsure (1)..(264): unsure at all n locations
  Clone ID: PAT_TA_85966
ctccctcccccgcccgctccaatgccgccgcccatggngctctccgtctccgtctccgtctcctcctccgccgcggccttcgccccgcgccaccgcctccccgcgccccgtagcctcacccgcgccgcccgcgccttctccacgggctacgccgcgagcttctacggaggcgcggcgtccgcgacccgcacccgcngacgcgacgaggaggangtcagggaangaggacnggtcgtcgncgnncgttcngcaggatntcggctc

SEQ ID NO: 85967 - DNA, 434 bp, Triticum aestivum
  unsure (1)..(434): unsure at all n locations
  Clone ID: PAT_TA_85967
aggacggccgcacccttgccgactacaacatccagaaggagtccaccctccacctggtgctccgcctccgcggcggcgccaagaagcgcaagaagaagacctacaccaagcccaagaagcaaaagcacaagcacaagaaggtgaagctcgccgtcctccagttctacaaggtcgacgacgccaccggcaaggtcaccaggctcaggaaggagtgcccgaacgccgactgcggcgccggcaccttcatggccaaccacttcgaccgccactactgcggcaagtgcggctcacctacgtctacaaccaagaagcttagaggtggttgcgtttgctctgctcttttacctacctacctatcgagancgaatcatttaatgttccctttgtcgtttaaactgatccttgagtacatgttcctgaataaaaaaaaaaaa

SEQ ID NO: 85968 - DNA, 494 bp, Triticum aestivum
  unsure (1)..(494): unsure at all n locations
  Clone ID: PAT_TA_85968
gggacgtgtaccgcgacgaggtgtacgcggcgcggctgggcggcgccgccggcgcgttcgaccggtgcgccaccgacacgttcaagatcggcgggccctgcgggtacggcgtctgctacctctacctccgccgcgccggccgcaccgggtggacgcccgagtgggtgagggtgtacggaagcccaccgcccccagcgcgccctccaccttccgctacggcgacccgctccccaacaacgtctgggtacggcttcaaccgctgcccgcgcctcgcctcctccacctccacctcgtcgtcgtctccttcctctggcgctggtgctgcgcaagcgatgtagcatggtcggagcaagtcgtgcggtcgtgtatgtatatggttgtggatngagtacacatgtggattcattctgctgtcntgagtgatgccgcgtgcgcctgcaatatcccgatngagatgaaatgtatatggtacacantaaactctcggnttttgg

SEQ ID NO: 85969 - DNA, 727 bp, Triticum aestivum
  unsure (1)..(727): unsure at all n locations
  Clone ID: PAT_TA_85969
caaggaaccttcctagcctctccattagcctctaggagctctcctcgccctcccttgtcgccatggccgtcgcccctgacctcttaaatttggtcgaagccgagcctccccctcctttctgtcgctaccatagcactccccggaccacctcgatcctccccgtgccctagccccctcgccggagtcactctggccgcaagccncancgcctcncgaactgccgtccgccgcagcagcggncccgctcgagcccgacctccccaagatggatggatgctctggacgggtgcgtctcgggtcccctgagcgaagccggtatgctgcacggnccgggagacggcggagctgccgggaacggcaacggncgccggacaatcttcnatccgtcgggcgcgagcgaggaganacgaagccgagaaccctcctgcaactggcgcggcccgctcgttagccgacaagcccggcccgcctgcacgtattagtggaagcgtatcccnggatggtttcctttgggaagctatcttcctgtnggaataatcgtttccctcggaaaggnattctaaangttctgctacataagggctgttnaaaatttgnaatgcctanttacttaattttacnaatcaacaggaacagcaattttganttngcacttgacattaaagttnatnaagnattccttcnaaacctcgnnttttgatctcattnattcgagttnangncaatg

SEQ ID NO: 85970 - DNA, 670 bp, Triticum aestivum
  unsure (1)..(670): unsure at all n locations
  Clone ID: PAT_TA_85970
gagtgggaggaagacaagcacttccttcaggtgtctgccgcgccggtgttgggccgctatgctgacgaagattacaagaacgccaaggtgcaccgtggcttcctatccgtgtacacgtccagtgacaacaactccatgtacaacaagaccagcgccagagagcaggttctcgaggaggtagggaggctaatggaggagtacaaggacgaggtgaccagcatcaccgtcaccggccatagccttggagcgtcactcgccacctcaccgccatcgacctggtgggccaacgactcaacgtgcccctaactcgaagcaaccgccgtgccccgttacaacgatactgctggcgtgccccgaatcnggaacccaagttcaagtcgccttcgatcattcaactcctgcggcatccacgtgggnaaacgcaaaagactcgtgcacagaacctcctctgtgttgttaatgtgtacttgactgcncacagnaacatctaatnacacggccgtanctactgttcaaaaatacgaccacantctcagggggccgtaccaattnccnaagganctatagcncctatgnctctttaagtcnatggaaactggtacactannctagaaacccttcatggataaaggccacttcctcaatncacnagaagncccnnggatancgg

SEQ ID NO: 85971 - DNA, 156 bp, Triticum aestivum
  unsure (1)..(156): unsure at all n locations
  Clone ID: PAT_TA_85971
ccgcttccncctccncntcctcacgcncactcccgaaccgaagnctcaagagctcccantggnttccaccacgttctcctncgcnttctccatcctctctctcccctcctcctcaccatcaccctccgcatcggtcnccaggancctcaccgtcac

SEQ ID NO: 85972 - DNA, 486 bp, Triticum aestivum
  unsure (1)..(486): unsure at all n locations
  Clone ID: PAT_TA_85972
aagatactcctagtcgaaagttgtttcagtaacaatgataaaaaaaatatcttttccaacacaaattagaaaaaaactgctgagattcagatagctgactcacgtaggctgatggtcccggtgtctgccaaggtgttgttgagaagcagggcgatgatgttcgtgtcgttctgcttggtgtagtaggtggtgtagtggttgatacccacgaagtcgagtgtccccttaacgagcgcggactcctccgtcgtgaacctcggcagctctcccctactcgcttcctcatggtggtcgggtaatcgccgaagaagaaggggccgcgaacacccaactggactcctgcgccctcttgggcgcctcacatcaacagcggcatctgacatcggtcatacacacacgtcgaacgccatcccgagctgcccatctgcgccgcctggtactcctcctggncaattggggggtggctggtggaattgtgaaaaaaaa

SEQ ID NO: 85973 - DNA, 269 bp, Triticum aestivum
  unsure (1)..(269): unsure at all n locations
  Clone ID: PAT_TA_85973
gtgggggctttgggaaaggcgaaggacggaaacaaatgccagcctgtgctcgcttgcttgctttggcggtgatggatgggtgctctggtctggtctggtctaagtgtagcgtancgtccttccggtctgggcgtcctcctcntcgtctacctccgtctccgtntnactgtgcccaaggctccagctcgccgtcgccatggatgtgtntgcgtgctactactgccangtgaacgaatttgttcaaggntgttccaccttttttcaacaaa

SEQ ID NO: 85974 - DNA, 587 bp, Triticum aestivum
  unsure (1)..(587): unsure at all n locations
  Clone ID: PAT_TA_85974
aaagtccaaaccccgtcgcaaaaagtctgctctccccctcgcttctctcccatctctgccatcccctccgcttctccccttcgggcaaaaaaataatcgaaaacccctgactccgccgagcgaagcatcacctttccgccgctgctcgccgcacgccgccccgccgaccgagaccctcaaggcccggcccactctaacccgcccgccccgcaatggctgccgatngccggnccggcgtctgagggagcggggcgggtgcgctcggggggcaatccgggcggcgccatggacttccgggagcccggcangttggagcgggctctcgcncggtcggcagttctctngcggcgggntcgtctgcgtnatgtctccgcnattgggttcgcaaatanacgcttntgcaacttgattgcatnatggactaaangatcngagcttgggaatncgtttcttnagggnaagcttnagaatgaaaagggatcaaaaaggggntccccgagnttattnttttggaatgggaaatcatttgtgntgccnttanngtaaaagaaagtgtgtttnttaaaagangtnttttanaaggccca

SEQ ID NO: 85975 - DNA, 305 bp, Triticum aestivum
  Clone ID: PAT_TA_85975
ggggaacccccctcctcgctcggaggctcggaggctacacccagtgggtgagctggcgcgcacccactggaagcaagccgcgccggctgcagcccgaagccggctgtcagcaacagcatcagtcggcggacccccgcgtccgcgcctgacaccatcagtcggcggatccggcgtccgcgcccgacagcttcagtcggcggacccgcgtccacgcccggcaccctcgacgccatcgtctgcaccaaacaaccgcgaagaagccccgcccaacttttccaagttgcccaagaggtcggaggataacg

SEQ ID NO: 85976 - DNA, 474 bp, Triticum aestivum
  unsure (1)..(474): unsure at all n locations
  Clone ID: PAT_TA_85976
acangnggcactcacactacactcatccactcacaagctaatctancggggtanctcacntnagtccagtcgggatngggggtccnnggggcgcgggactggtgctggcgatggtgctcgcggcgatgctggtggcgccgccggcgacggtgcacgccatatcctgctccacggtgtacagcacgctgatgccgtgcctgcagtacgtgcagcagggcgggtcgccggnccggggctgctgtaccgggatccaaaacctgctgggccgagggcaacaaangcccgaccgccggaccatntgggggtgcctntaaaangttccaaagggggctccgggggggcctaaatnaccggggcgggnggctccctcnnaagtgaacgtgncctcccctanangttagnccaggtcactgaaactcctcactgaacnaatntnagcncctngccgtgttcngcgacgtanntctncctttt

SEQ ID NO: 85977 - DNA, 675 bp, Triticum aestivum
  unsure (1)..(675): unsure at all n locations
  Clone ID: PAT_TA_85977
gcgacgtcgatcggttggtcgccctgcatctcaagtaagcaaggagggagcttgctgccatcaagatcacctggttctgaggcatcatcttgtggaggactcatgttaagatcaatcccaaacatcattgcggcagtggagcacttgctcaggtaactgttcatgttccaataagaaagaacattctggtcaagttaaatcaagctaaatcaaagaggcacctgaaaatagtctctccacaagaattgtttgctagactgatggttattgcttcattggtatttgcttcattgggtattgcanaacaagtaggtagtgatgggctgcttgcttgagcctacacatgctgtcctttgttcagacttcangagtaaacaaaagagcaactgttaaaagcttggttcctttacaaatcctagataagtgggacagtggaatgacattgggaatcaagacatgtacacttaatttgcaatcaaggacatgtttgcaaaatgcatatgaatgtcaagctctatcaagttcggttaancagctcatttgaatcaattctgttatacacagcaattaattcccttaatcagantagaagacacagtntcatatcatanaacaagnggccggcaatctccgggtcaaaggaattngaggttaaatttgcctnncncgtgaacc

SEQ ID NO: 85978 - DNA, 471 bp, Triticum aestivum
  unsure (1)..(471): unsure at all n locations
  Clone ID: PAT_TA_85978
nttagaagananaagtcggaaaagatcatgactacagagtgagtannacagaccgntgccggcgcgtaatagacggcggtcaacagaccgaggtcgttgtcaccacnacacggcaaggngagcatggccccggnatcactgcgggacagagggtcatcanctccaacctcacccccgttcaagctttnctctccagcaccggagcgtccggagangacggcgatgcagaactcctcgtcntcctcgagcgncnccatgtgctcagacgtgagcgtgagctcgcntncatgccgcctctcnnatcncgacatgggacaacgacnngcctcntcgatctnttcgcgntgccgctccncgttgccatcgntttcccanccgantgtccgagncggcananacgatcagngggngctncccatcacgtncncanagatctnncaaggagggacgntttccattngnctaatngag

SEQ ID NO: 85979 - DNA, 354 bp, Triticum aestivum
  unsure (1)..(354): unsure at all n locations
  Clone ID: PAT_TA_85979
gcttcctgttcatacattctcccctcccggcgccgcctccagcctagggtttcctcccgccgtccgccgccatggctcgccgcagcggaggaggaaggtcttcccgccctgctccacgtgctgctccagtgagaaacccaacaagcgccaacccgtcaagctcctccaactgntaatacccagaatagcggtngngngatcaagagtggaattgggtcancattgctcaagggatggtttcgggtantggcantgccatggngcaaaagggctgttgangctgtgatgggtccccgcaacattaannatgnaatgttgtcggtnaagctgtgaaccaagantccaaagggaaat

SEQ ID NO: 85980 - DNA, 593 bp, Triticum aestivum
  unsure (1)..(593): unsure at all n locations
  Clone ID: PAT_TA_85980
cccaaaccttctcctccttctgaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgnctcgtccgggagatcgcccaggacttcaagaccgacctccgcttcaagagctccgccgtctccgccctgcaggaggccggccgnggctacctggtggggctcttcgaggacacaaactctgtgccatcaagccaagcggncacatcatgccaagggatcaagtcgacgcgcatccgtggcgaagggctaagtctagcgtcnccnctancaatgntccgcgnggaaattgctgctagtgtngtctgcaatgaggagnaggngctgantgtgaaactngggnagaaaantnntgaaatncggaatnttannggggncgtnccaatnacccnaagggct

SEQ ID NO: 85981 - DNA, 385 bp, Triticum aestivum
  Clone ID: PAT_TA_85981
tgacgcgcaagcgggggagcccgtgggtggccgacaacctcaacgccgcgcacctcgactactactacgccttcctcacgctgctcgccgccgccaactgcgtcgtcttcgccgtgcttgcccaccggtacaagtacagggccgagtccacggacaccatcgacgtcgacatggacgtgcaggcgcagcgcgaggccgccaagaagattcactccgagccaatggcttagttacacactttcttgtactgcacaatttactagtataacgtactgcaagattgcagctaaagattcactccgagccaatggcttagttaacttcttctgtagtactacagcacacacgtataaaacacgtacattatcagtaaaaaaaggggggg

SEQ ID NO: 85982 - DNA, 409 bp, Triticum aestivum
  unsure (1)..(409): unsure at all n locations
  Clone ID: PAT_TA_85982
cccgtgctgcgtttctcctcctcccccgctcctcccccattcgccgtccgcggttctctccaccgaacangctcacacatcangacaataaatagagcctcgtttgtttggggccaatcaaaccaaacaacaagttcatgtctgatctcgaccgnccaggttcnaactgcttttgatncgtttgctgaagcaaatgctgaggactccggcgctggcgttggntcaaagaactatgtgcatgtgcgtgtccagcagcgcaacggaagaaagagtctgannactgttcanggcttgaagacagattacagctacaanaagattctcaangatctcaaaanganttctgctgtaatgggnactgtagtccagngatcannactagncangtcagtccaacgccaagtgntca

SEQ ID NO: 85983 - DNA, 679 bp, Triticum aestivum
  unsure (1)..(679): unsure at all n locations
  Clone ID: PAT_TA_85983
gcaattcacgtgccatggccccagccgtgatggcatcgtccgccaccaccgtcgcgcccttccaggggctcaagtcgaccgccggcctccccgtcagccgccgctccggcagcgccggtctcagcagcgtcagcaatggcggaaggatcagatgcatgcaggtgtggccgattgagggcatcaagaagttcgagaccctgtcttacttgccacccctctccacggaggccctcctaaagcaggtcgactacctgatccgctccaagtgggtgccctgcctcgagttcancaaggttggcttcgtcttccgtgagcacaacagtcccccggctactacgacgtcgatactggacaatgtggaagctgcctatgttcgggtgnaccgacgcaacgcaagtgctcagcaagtggagaagtcaaagaaggantacctgatcctattccgcgtcatccgnttcnaaacatcgcaagtgcatgcgtaanctcatgcctnaaggcacangctgcaggaattggaaggctaaagtgaagttaagtacnatatcatcatgtagtcaattgtcgaactcgcttccgttactcctacaanctantaaattagaaagttgtagactcactagtcagagtgaaatnaatttnacgttctaaattttntgaatcngtntnttgaaaaaaaatc

SEQ ID NO: 85984 - DNA, 345 bp, Triticum aestivum
  unsure (1)..(345): unsure at all n locations
  Clone ID: PAT_TA_85984
gttcctctcctcttataggatgtcactaaattgaagctattctgaactaaatccaatccagtttaagttcataccaatagggatatatgaaaatgtactaagtactgtcccattatttcagtcatgcttaaactatcagaagtggagggcctatacaaagaccccacactcttagcaaaaggacaattaaaggagcacttgaccaaaactattggaagnttcantcactttagcaacccttggnnctgacaacnntnggcgggaacctcnttccggttccnatcaanaatacttggaaaaatgtgtcccgaattttaccngattttgcacngggatacnatccct

SEQ ID NO: 85985 - DNA, 491 bp, Triticum aestivum
  unsure (1)..(491): unsure at all n locations
  Clone ID: PAT_TA_85985
cctccgtccgctcgcagctcgaaccaaggagagaccgtcagccatgtccggccgcggcaagggaggcaaggggctcggcaagggcggcgccaagcgccaccggaaggtgctgcgcgacaacatccagggcatcaccaagccggcgatccggcgcctcgctcggaggggcggcgtgaagcgcatctccggcctcatctacgaggagacccgcggcgtgctcaagatcttcctcgaagaacgtcatccgcgacgccgtcacctacacggagcacgcccgccgcaagaccgtcaccgccatggacgtcgtctacgcgctcaaagcgccaaggccgcaccctctacggttcgggcggtangtcttcctcgcaacccactgcagtcccgaaattttgatgataccgcgacttgtgtagttcgctagtctctggtagttcgctattctctgtattcgtactgaatcgtgcacaaagttatccagttgttagaaacaa

SEQ ID NO: 85986 - DNA, 610 bp, Triticum aestivum
  unsure (1)..(610): unsure at all n locations
  Clone ID: PAT_TA_85986
tggaggtgatccactgccggtgggccatgctgggcgcgctcggctgcgtcttccccgagctgctcgcccgcaacggcgtcaagttcggcgaggccgtgtggttcaaggccggctcccagatcttcagcgagggcggcctcgactacctcggcaaccccagcctggtccacgcgcagagcatcctcgccatctgggcctgccaggtcgtgctcatgggcgccgtcgaggggtaccgcgtcgccggcggcccgctcggcgaagatcgtcgacccgctctaccccggcggcagcttcgaccccctgggncttgccgacgaccctgangcgttcgcggagctcaaggtgaaggagatnaagaacgggcgcctcgccatgttctccatgttcggctcttcgtgnaggcatcgtcacggnaagggccctcaagaactcgcgacaactctcgacccgtnanaaaacgctgggcttcgcaacaanttcggccggaagtaagtcnagtgttggtctgaaacnncgtnagtggtactaccataatgtgncatgatnatcantggttcgttgacanacatctatnaagacagttaangaaantgtgtanaaaaaaaaaaaa

SEQ ID NO: 85987 - DNA, 362 bp, Triticum aestivum
  Clone ID: PAT_TA_85987
ccagaactcgcagaagcactggcgctaccgtgtgcagccgctctcactcgtcgagaaggtttccagaaggtccaatttatctcagattgtctttccatcatatagaaagttaattctccaaccatggatcgatcaaccattgggctggttgctgacaccaagagcttggcggagagcttctggtctattgtttaagtcaatgtaaatcatttgtcgaatgttgcggcacatattgtagccccgtcccgtgagttttctagtgaatttatccttcatcatgtaaccctagattgtatccgtgagcactcagccttattcatcttaatcaataaagcgaggatataacccgcaaaaaaaagcaa

SEQ ID NO: 85988 - DNA, 651 bp, Triticum aestivum
  unsure (1)..(651): unsure at all n locations
  Clone ID: PAT_TA_85988
catccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagcttctaactgagagtggcaacactaangattcctgaagcttccacntgatgatgttctgctnggcaagtnaagactggatttctgatgnaaggccnatctgtcgtgatgtcgcatggggaagaaaantttcgcntgangaatccgtgtggaataagagttcctggtgncaactcgtnctggatcangctcngtgttggancnatcttgnataagttttgtggngaaagtngtcaantgggttttnacgangncagggggaga

SEQ ID NO: 85989 - DNA, 638 bp, Triticum aestivum
  unsure (1)..(638): unsure at all n locations
  Clone ID: PAT_TA_85989
ctcgtggcggccatcccccatcccccgcgggccccggtcggataagagcatcgccaggaccccctctcgaccactctgctaaccctagtgccccattcccctcgctcgcccattcccctctcagattctctcgcgcccgagacacaaccgcgaccacctcgtcgatcccgcgaccgtcgacctcccctcgtcgagccaaggcgtccaggagctgcgccaccttcccctgcttcaactacgagcatcggcccgagctaggaggccgcgtacactcgccatcgacgtcgtcttcgnccacggncgctgcatctcgcatcggattcgtcgtgtccangcaacccctaacttctaagtcgncaagagatcacgatgacgaagtcaaggagcagatgtcacaccgacaattactactacacaagggtgctactactactggaggncgccgacaaccaagagtagttaggagntccaggcaagaggcttactttcgatcggtgttgctttgtgcagcttctaaagcaaacttgtaaaataatcgtatagtattgtncttcctgatctgngtntcagctatnatcnttctcaggcatggttgatanaagctgatattattggtaaagggggccgtacancnctaa

SEQ ID NO: 85990 - DNA, 646 bp, Triticum aestivum
  unsure (1)..(646): unsure at all n locations
  Clone ID: PAT_TA_85990
ccttggtttcgtcgccgccagccccccggcgatctccgcgaccgcgacccgccgccgccgcagatctcgccgaggaagccgcgctcggtttccccgacccgtcgggacgtccgcgcctataaaacgcggccctccgctcccggctcgagctccccgaggccgaggcgctcttctcccngcccgccccgccccgcccataatggccgcgtgcacgtctcagcaggcgctcatctccgtcaaacctcggtgcgcttccgccagcttcggccccgacaggagggccggcagtgtgcgctttgtttcagcaacgagctgctgccccggcagccggaaactgggcttggtctgcgcgtcgaattcgcaatcttcggtgattgagccggtaagctaacgtccagccccgaaagcggaagaatcccaaaaaataagtgaggctgactgatattgattcggacggggaatcatttggacgagaaaatctgttacggntgctcatgtgccctgacccaanggttaatgagggattangnggtaaagatatcaatatccagttatgtatnacactcacataatcgtgtaaatacgcatntncaatataaatctctagagtcaatttggaaagananaaggcaacattgatagttca

SEQ ID NO: 85991 - DNA, 573 bp, Triticum aestivum
  unsure (1)..(573): unsure at all n locations
  Clone ID: PAT_TA_85991
ccaacaccggcgccatggcccgcaccaaacagacggcgaggaagtccaccggcggcaaggcgccgaggaagcagctggcgaccaaggccgcccgcaagtccgccccggccaccggcggcgtcaagaagccccaccgcttccgccccggcaccgtcgcgctccgcgagatccgcaagtaccagaagagcaccgagctgctcatccgcaagctccccttccagcgcctcgtccgggagatcgcccaggacttcaagacgacctccgcttcaagtcctccgccgtctccggccctgcangaggccgccgaggcctacctggtggggctgttcgaggacacaacctctgggcatcaacgccaaagcgcgtcacatcatcccaaggaatcaagtcgccgccgatccnggcaanagggctaagccgcatntgaatcatgcgtctcgtanntcttgttagaagtcgttnctatatgttcanaatgtnctgtgtgttcttgtaangnggtntgtttgctatcgatgtacttctgttgcanatcaanggaatgaaaagttggttcgttcnaaaaaaaaaaaa

SEQ ID NO: 85992 - DNA, 611 bp, Triticum aestivum
  unsure (1)..(611): unsure at all n locations
  Clone ID: PAT_TA_85992
tgaacattgaatatgaagcttcagacatgtttgatttgcacaatgttatcgtctctatccctctacccgcacttagggatgctccaagtgtaaagcagatagatggagaatggaggtatgactcaagaaactctgtgttggaatggtctgttatgcttattgatcaatccaaccgaagtggttccatggagttctctgttcccgctgctgatccatcgacattttttcccatctctgttggattttctgcatcaaatacatttagtaacgtgaaggttactgccatccttccattgcagggaggtagttcaaaatattcacagcaggttcggctgggtcactgttaactatcaagtggtctgatgtcgtttgttctggtcaagtgattgcgcatatctggagtatataggaatttttggnttttggtcatgaactcgttgagccgtttgagactttggntcaagaattcatgggatatagaggataaaaagctggatacggaaatcaattttgtccttaaattgtaaaaaatggtgnacnaacgcgtgtctcgtgccacaacagntatggaatattataactcnntcccagtttcgcgtaaaaaaaaaaaa

SEQ ID NO: 85993 - DNA, 204 bp, Triticum aestivum
  unsure (1)..(204): unsure at all n locations
  Clone ID: PAT_TA_85993
ctctgctctcgcctagtcgcctccccgtctctcccatcctcncaacccctctgaccgccgaaccctancgagcagatcgccgatggagcagggctggncgagctggttcggcgccggcgtcacctccgnnttcttcgcctcnctcgagcgctgctcctgcatcaanctctccaccgacgacgacgannatgaggaggaggccaa

SEQ ID NO: 85994 - DNA, 572 bp, Triticum aestivum
  unsure (1)..(572): unsure at all n locations
  Clone ID: PAT_TA_85994
gctcnttcctccccctctcannttcgctcgcgcccgagacanantcgccgccacctcgtcgatctcgcgggcgccaacctcccctcgtcgcgccaaggcgtcctggagctgcgccaccttcccctgnttcgactactagcatcggatcaagctaggatgccccgagcgctcgtcatcaggcgtcttccctgtgtccggtcgtcgnttcctcgtcccggatntcctccctcaagcgctcncccggtctcccgagcangtcatcgaggaccactacaccganaccgacaccgctgctacncagtatgactacggtgtttgatgacgcctctctcttgcnagagcaacatnnctttggagcccangagcantcctaccgtcgacgaagactactactacncngaaggtgccactacacgtgtccgctaccacgacaagagtanttaagaggtncaaggcagnagnatgcgcnccttcatntganccaatttgggcancctctaagnaaattgttaattagncngagcagnatgtgctcnctaancattagtcannctgantcaactcnaggccgg

SEQ ID NO: 85995 - DNA, 563 bp, Triticum aestivum
  unsure (1)..(563): unsure at all n locations
  Clone ID: PAT_TA_85995
gagtaaccggagccatgctatggaagaagaagcagaaacactgcctagtccagaagaagcagcttggtatatctgaagcctgtcagccttgtgatgtcgctcaaaaattactgcaatgagtacatcattgacattcataccgtgtgtgcgatggaacaaccaggctgcatcatcttctgaagaaacgacacttgtcatgctgttaactgaagaaatcgacacccagctggtatcttcatccaacgtatctgaagactggagatgtcgctatttgagttaccttttactgtctacttgctcacctgccttactttagcattaaagttaagattaccttcactgggttgtaatgggcaaaaaacccggatctatctcctcttcctttttcntttntccttttttgaaaaggagatctacctgagaaccctggagtcatctcctgtactggggtaaaanctagcgccgtttcccggctgggggtaacgcatatcaatcctgtaatcnctaaattcctgggacaatcccgaatactgtttanggatcgtagnggtaatttctnaaan

SEQ ID NO: 85996 - DNA, 602 bp, Triticum aestivum
  unsure (1)..(602): unsure at all n locations
  Clone ID: PAT_TA_85996
gcggaaccaacaaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccagcagcgtctcatcttcgctggcaagcagctggaggatggccgtaccctcgctgactacaacatccaagaaggagtccancctccaccttgtcctgcgtctgcgtggtggcatgcagatattccgtgaagaccctcactgggcaagacatcaaccctggagtcnagagctccgacaccaatngcaacgtcaagggcaagatcaaggacaaggagggcattcccccgggaccaacancgccttatcttgctggnaaagcaactggaggatggtcgaacctggccgactacaacatccaanaggngtcaacctcaactggngctgntctgcctggtggatcaattttcggaagacctcactgnangacattaccttnaggtnaaagtctgcccatntaattaaggggtagtca

SEQ ID NO: 85997 - DNA, 211 bp, Triticum aestivum
  unsure (1)..(211): unsure at all n locations
  Clone ID: PAT_TA_85997
gtcgattgtattgtctacatcctcaatgtcncanntcaaatcctctnacgtnttcngcganactgagccncttacgnagctcctcctttggngcagancntgagccatgaggnnctccccttcttctcctcatgctcnccgagatcctcaatctcgtcccattcgnaatcctcctcggncgctgttcgctgtctagacancatggngnana

SEQ ID NO: 85998 - DNA, 461 bp, Triticum aestivum
  unsure (1)..(461): unsure at all n locations
  Clone ID: PAT_TA_85998
tttttttacatttcagagatacatatcatataaataaactcttggtaccgtcatatcaaaagtcctttaaggtacacatcgggcaagatacaatatgcattagccgtgcataggaactgcgatttaagagaacttgtggttcagagatacagatcacacacataaatccttgctataaattcatacaactcttgtaatatcatgatagattattcgttaggggggcaggccacccttaacgctgtgcgacggtgcccttggtcagattcagggcccgctgatggagggactcgtggaggcaagcccaacacggatgctgtcgggcaatagttggacaagcacatcngcancctatggcccgggttggaatgcagncagggagacatgcccgatcaangtgccgccgcatgggcgtacnantcnggtgtcggcgtntaaagtgncaatgnggcnccccaaag

SEQ ID NO: 85999 - DNA, 520 bp, Triticum aestivum
  unsure (1)..(520): unsure at all n locations
  Clone ID: PAT_TA_85999
gaatacattaacaagttcagctgttcgataggttcaatccaatgctaaggtcaaccccatcaaatgatgcatagtgacccaaccgacaaaaaaaaactaggacaaaatatggtacatttataaatccatttaccccttacattcatgtgtggcaaatgcacaaaaagaaaacctcagccacctctgggaaacaaagtatcaagacctagagatcagagccgcccagttgatctagcatttcctgggcctgcgacacaaatgtggcctgcaagtcatggntgacaaggaaccgccgcgcgttccaaacnctaacacngattgggtcatcgcaaacctttcgaaaggaaaggcaacatcagcttaataaggtctanaanccgacntttgggccttaaaaccatttngtatacactgtanccctgaaattgccatcnaaggggacaaggggggccggtacaattccccnaaanggngcgtttacnccccaanggccgtctttaaacgcgggnngggaaacccg

SEQ ID NO: 86000 - DNA, 484 bp, Triticum aestivum
  unsure (1)..(484): unsure at all n locations
  Clone ID: PAT_TA_86000
atacctccacacctctcctctcctctagcctcgagatgccgagcccgagccacacctgctttcggcacgccgtcgccaaccggggcttctcggctggccgtctgccgaggctttcctccacggccaggcgtcgtcgtccactccgttggctcaagggcggacctcccaaggcggtgcgtccccctgatccacggtccggctctatcctccctgagctcgtctacaccgtcgtcatcctcccatcgcagtctttcttcgcagtccacctctcaaaacaccttcgcaaagtacaagcacgtctctaaggctgttcttgaccttgcaaagactttccctcgcaacgcgctcttcctcaacgcaacaancctctcntctctactcaacccgtcnaccctcctgaagctgatgtaacatgtaggagtanacttnagatgatgctgcatcgatgccaataagatanacgtaggttggtgcaaattggggt

SEQ ID NO: 86001 - DNA, 164 bp, Triticum aestivum
  unsure (1)..(164): unsure at all n locations
  Clone ID: PAT_TA_86001
agggcaaaccgttgcacctgctaataaggaggtctcaaaaggaaccaaagttcacctgtccattccgctttgacgaacttggtcnatgcnaacaattcgtnnatcgactantctggggggcnaaatctttcttgcgaanaatgggnatnaagtttccccgtcaa

SEQ ID NO: 86002 - DNA, 613 bp, Triticum aestivum
  unsure (1)..(613): unsure at all n locations
  Clone ID: PAT_TA_86002
gcggagcccctaacggcgcccctactgaaggtaattaccccctcttttctcctttgcagctcgtacattttgaatccctctctttgttcctgtagatccgtgaaaaaggaaaacgttaattagatctaatcaagacatgctccgacctgaatggttaaagaacaatcaagagctagagtcgatttctccctacctccattttccactctgagatcaaggggaaaacgtatgaatgtgtccatgggcattgacatcaatgctttccgtggggctacagagaattttatggattcctctgggcatctaagagtacagcaggactatctttcaagtgggtctgcatgtgaaaaaacagaacattttgtgttgttgagaactccacttaataaaaacatgacaaaagataatgttttccttgggagatcataaagaagaatgaaattggcacatactagcagacttcaagctattaattctactgtaaacgaagacatcactaatcaagtattgcgtcatggtggtggtcttcaaggcatccatgtacatanggntgcagcanatgtctgatcangccaaacaaattgaaacattagaggtagaacactaatgtcaa

SEQ ID NO: 86003 - DNA, 612 bp, Triticum aestivum
  unsure (1)..(612): unsure at all n locations
  Clone ID: PAT_TA_86003
agcaaacggaacggtcgtgaagctagcaatgatcaagaggtgatcctgaactcctacttacgtcaaacataacccaaagaccgtgttcacttcccggactccgccgaaaagagaccatcacggctacacacacggttgatgcgttttaattcagatctggtgtcaagttatctacaaccggacattaacaaattcccatctgcccataacagcaggcacggctttcgaaagtttaaaccctgcangggtgtcccgacttagcccatgataagtctcgcgatcaacgaaggatattccttctcccaaggaagacccgatnaagactccggaatccccggttaacaagacatttcgacaatggtaaaacaagacaacaaaccgcctgatcgcccgacatcccgataggaccgcacatatctcgttctcaagggaacaccggataatcaagtacgagtanacaacctcaagttacccgaggtggccccaggttgctcggttcggccaacatancaacatggccggggggcaaaaaantgcccccngggggccggaccaatcccaaagggnccataccgnccacggcgtcgttaactctacngaaaccnggtacca

SEQ ID NO: 86004 - DNA, 576 bp, Triticum aestivum
  unsure (1)..(576): unsure at all n locations
  Clone ID: PAT_TA_86004
tgatcaaaacatcaaggacatgttcatgtcaaagtactttcatactatcatcgttggttcaacatccacaactgcacaactttatagggagtgcatacatcctaagattgcacaacttgcggtcctcggatattctgacaactatgcgaatgtctacacttcaagaactacggtctaagtggctagcatatttcaatggatggtggatttaagattaccaaagtgttnaaacaatacaagaaggatgtactttgaatgccnagaaagtaatgaaacaatacccccgtgacgatcannnacaccgtgcactggcttcttccaacttgggacaatgatagttatgtgaaagacatgggatcaacccgagaaggaagatggttttttccnnattattntaggccnatggcccgatgattatacgatcttacctaattaagatacaatttacgatgattttngacgggctaaatacaatcacgcttgccaaccnggtaaganttcgtcaaacaaacttcantcataaatcaagacntcataaancantgcattccaggtgaaaaattttagaaaaaaaaa

SEQ ID NO: 86005 - DNA, 506 bp, Triticum aestivum
  unsure (1)..(506): unsure at all n locations
  Clone ID: PAT_TA_86005
acagggtgcctatttattctcctgtgccacaatctccatgtcgctaaatcgcctctgcttcctcctgttttttacttccaattatttgttgaacgaacaatgaacaagcaatttcctcatcccatgagtcctctgcttgcttcaaggctggacaaaccggcaacgagaagggcttcaatccgtcgtccgttccacacgattattcttccatgtcattcacatgaatcttatttctttctggatctatttgtcttccaggtttagccttttgccatctctttgtctttgcttttgcttgaacctgaactgggcctgtattccgaatgattgttgctttataataaanncggggggaaaaaccttttacaaaaaaagggggggcncggtacnaattctccctanatgagtcngattaccgcgctaatggcgggcgttttcacgtgcntgantgngaaaacctggngtaccaactaatcgctnnagaaatcnccttcgcanntgggtaa

SEQ ID NO: 86006 - DNA, 235 bp, Triticum aestivum
  unsure (1)..(235): unsure at all n locations
  Clone ID: PAT_TA_86006
agctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggtgancgtgnngtccgncgtcgcnccgtgnatgtcctacgcgagggncacgcgnctggcacantcngagggtgnnctgcnttgaggtg

SEQ ID NO: 86007 - DNA, 294 bp, Triticum aestivum
  unsure (1)..(294): unsure at all n locations
  Clone ID: PAT_TA_86007
gcgaaacaccaccgcaccccacaatcccacggctctccccggcgaagtagcagcggcatccatggcccccaaggcggagaagaagccggtggcggagaaggccgaganagacgacggcagccaagatagaccaaggccgagaagcggccgccggcgtccaaggagcggggtcagaagtaaggggnaganagnattccaagnagagctttggagncnttcaanatctacatcttcaagggtgctgntnnaggtggactcggacatnngnatctcctcnaangccangtccatcat

SEQ ID NO: 86008 - DNA, 587 bp, Triticum aestivum
  unsure (1)..(587): unsure at all n locations
  Clone ID: PAT_TA_86008
cccaaaccttctcctccttctgaacctcccggcgcatctccgactccatggcccgcaccaagcagacggcgaggaagtccaccggcggcaaggcgccgaggaagcagctggccaccaaggccgcccgcaagtccgccccggccaccggcggcgtcaagaagccccaccgcttccgccccggcaccgtcgcgctccgcgagatccgcaagtaccagaagagcaccgagctgctcatccgcaagtccccttccagcgcctcgtccgggagatcgcccaggacttcaagaccgacctccgcttccaagagtccgccgtctccgccctgnaggaggccgccgaggcctactgggtggggtcttcgaggaacaaactctgtgccatcnacgcnaagcgcgtcaccatcatgcccaaggacatccagtcgcacgccgcatccgtggcgaagngcctaanttacgcgtcgtcgnctaagcagatggttctngtggaaatgtgctgctagttttgttctgcatggngntgtangtgctgatngatgtacatttgcgtanagtattaatgaatgggcatcntaagggggcggacnn

SEQ ID NO: 86009 - DNA, 190 bp, Triticum aestivum
  unsure (1)..(190): unsure at all n locations
  Clone ID: PAT_TA_86009
gccccatgcccatccccttgactgctaccttagcctccggccatggcgcccgcgccggcgaccctgcaggccgctgccctgctgccatgttccgccgctgccgcacgccaagtcccgcgccgttgccatcgtcacgacctgcatcngtccctgacanngccccttcatcgatacanatanantcgcatgt

SEQ ID NO: 86010 - DNA, 488 bp, Triticum aestivum
  unsure (1)..(488): unsure at all n locations
  Clone ID: PAT_TA_86010
gacttaccactaccctgagccacagccggcaccccatcccatcccacccaccaactccccccagtcttgccgctcaccaccaccacagcaccacacctctcccctccggcggcacaccaaccacccccatccatggtggcgcacgccacaccgcgactaaatcccacccgcggacggcgcacctcataccaccgccctcccctatgccggatccgaggcggcccctcgtcgccctgccgacgcgcagtctgccacacgcctccacaccgccacgcgagttggagaggnaagaggatctcacgcttggatggggcgancngcagcacgtgtgctccggtnggaacccgctctgcctccctcctcgtacannggtggcgcgctngattcctgcgccncaacaccgggaatcnccctgcatcccggtgggnntcctcttactgtcggngtcgccgccctcgatctgacaagggagagtgatgtcccgnttg

SEQ ID NO: 86011 - DNA, 160 bp, Triticum aestivum
  unsure (1)..(160): unsure at all n locations
  Clone ID: PAT_TA_86011
ancgcgntctnctcatgcggcacgcanactttgncnccctctagatatagaatcaacacacctcntccacccatacctctacaagtcatnntatatgccngacctgtanattcctgatttnttctcanctcgatctccttttaatatncnttcnggggaa

SEQ ID NO: 86012 - DNA, 452 bp, Triticum aestivum
  unsure (1)..(452): unsure at all n locations
  Clone ID: PAT_TA_86012
caagaagtttgagaccctgtcttacttgccacccctctctacggaggccctcctaaagcaggtcgactacttgatccgctccaagtgggtaccctgcctcgatttcagcaaggttggctttgtcttccgtgagcacaacagctcccccgggtactacgacggtcgatactggacaatgtggaagctgcctatgttcgggtgcaccgnctccacacaggtgctcaacgaggtggaggaggttaagaaggagtaccctgacgcctatgtccgcgtcatcggnttcgacaacatgcggccangtgcaatgcgtcagcttcantgccttcaggcacaagttgcanggatntggnaaggctaaagtgcagtttnaataactgacancangtcatnttgttanattgttggaantctgcttccanagttaattctcgtncaacnagangnattattgg

SEQ ID NO: 86013 - DNA, 222 bp, Triticum aestivum
  unsure (1)..(222): unsure at all n locations
  Clone ID: PAT_TA_86013
tgactatttactcaacaccgccctcccccaattctcacctttcctctccctcggtcgtcgccttcgactcccgggaaatcgcctgacgcctcgtctcctagaaactcgacgcctccgtcagcatgccatgaatcccgagttataactacctcttcatagctgctgnatcattgcaaatntcnggcgttgngaangtcttgtnctngatgangangngtagcc

SEQ ID NO: 86014 - DNA, 357 bp, Triticum aestivum
  unsure (1)..(357): unsure at all n locations
  Clone ID: PAT_TA_86014
ctgctcccgtcctctcctcttctcttccccccgaagcagcagcgtccctcctctccgcccggatcgcgatggccgccgccgccgactccaagatcgacaacctccgcgacgccgtcgccaagctcggcgagatcagcgagaacgagaaggccggcttcatcagcctcgtctcgcgctacctcagcggcgaggnggagcaagatcgagnggngagcaagatccaagacccccacgntagntgacggantgccctacgacannctcacgcntcncccganagatnttnacgccatgngangatcngctcgacaagctcgnnntgctcaagtaancngganggcnagntaccacatgggc

SEQ ID NO: 86015 - DNA, 316 bp, Triticum aestivum
  Clone ID: PAT_TA_86015
catgctcctgcggtggcacgactgactccctccctccctccttccattccatggatggtgtttgaagcgaagatttctttttctgattctgaatctgtgatttgatcgtgctgtgccagaatggtgtcggccggcgaaggttgtacatacaaaagaggccagctaattatagaagtagaagtagcagcaaagcaatagggctaaggatatagcgttcgttgactcaccacatccaagtcccagcaagtgtgtcccattgtactcttccttgcatcactgaaagaatatactgggactgaaaagagaaaggaataaa

SEQ ID NO: 86016 - DNA, 454 bp, Triticum aestivum
  unsure (1)..(454): unsure at all n locations
  Clone ID: PAT_TA_86016
ctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgttggtggcatgcagatcttcgtcaagaccctgaccggcaagaccatcacctggagntttgagtcctctgacaccatcgacaacgtcaaggcaagatccaggacaaggagggattccccggaccagcangcgtctcatttttggctgggaaagcagtcgnaggatggncgnacnctcgctgactacaantcannaaggatccaaatccacttggggtcaagtcgntgg

SEQ ID NO: 86017 - DNA, 568 bp, Triticum aestivum
  unsure (1)..(568): unsure at all n locations
  Clone ID: PAT_TA_86017
cgtgctggagcggatcctgctggcccaggtcaccatgaagccccgggacgacgacatcatcctcgccacacagcccaaaagcggcaccacctggctcaaggccgtcgccttcgccatcaccaaccgaggccgctacggcttcggcgaccaccccctcctcacccagcaccctcagcacctcgtgccgagcatcgagctccacggcccgggtagggaccataccgacctcaacgcacttgcctctcctcggcttctctccacgcacattcccatgtcgctgctcccgccggagatgactccatccagcggccgtcgcgtcgtgtacctctgccgagacccaaggacacttcgtgtctcgggtggacttcgacaacaagatcttccacggntccgccatggagctagacaaagctatgacttgtctgccgggggtctcgccttacgggcttccgggagaaatatctggntacgggaagnaactngngacccggaaagnccttttgagtacaagagtnaaggaaatctgtggagcngcggaactccgggtctggctccgtaacagagagaa

SEQ ID NO: 86018 - DNA, 568 bp, Triticum aestivum
  unsure (1)..(568): unsure at all n locations
  Clone ID: PAT_TA_86018
tcgcgagccacgacctcttcctcctacgccgcggccggacccgacccgctctcctccgacgccgtctccctcctgcgatctcctctacgacgagcgacgccgcctgcctcatctcctggcaccagcagcgaccccgccgctcgccgtctccgagtcctgaatagcttgctgccggtaggggccattaaccagcttctgaggaaactattcagagccagtctgcttctattccacggttgtactaggctagggtgaacctccttctccggcgaccggcctccattccagcccctcgctaccagatacagcagatctacacaggtggagatccctgtttgtgtgcggtgcactgtacctggcggtcctccatagccatgggttatcactctagtttcactgatgatgatgggatcacaaaagctgtgggtgtccttngctcaactggaaaatcatataaagggccancccannctcagattaagataaagnggnatagngatgaagcgatnacttcttcggagcaaagtttctcaaaactcaagtcaaagcaacanaaagttgttantac

SEQ ID NO: 86019 - DNA, 599 bp, Triticum aestivum
  unsure (1)..(599): unsure at all n locations
  Clone ID: PAT_TA_86019
ctctgagccgagtccgatctgctgctctgctcctcctgaaaacagcccaaacaaggtaaacggcggcgctgcatcccttcctcttcctgcatgttgatcgctttcttctccgcctgtacgacttgttttttctcccctttgtttgctatgatatgaagatatgatccggcagcctttcctcgtcttatccatcccccatggtgttctttctcaagtagatcttctggtcaaactggtgccacaaactacgtctctcaaaaccagggtttatatgaaaaaaatttctttcttcgttatttatcttctgttaggaaatacagtactctgttccattacaagctggtctagaactctagttacaggctgccaaggatcatgagcataaactttgcttcagctgattggtatttgtagaattgtactctctagtgaccgatttctttggggacagtagaagctttatcaactcacagnnactggacaaagcctttcacacaattatgggaggttaatgcttttagaaacatacatgaggngtaaaattctcangggncantantttggtngcgtaantngttagaactaaatgantcgtaccg

SEQ ID NO: 86020 - DNA, 589 bp, Triticum aestivum
  unsure (1)..(589): unsure at all n locations
  Clone ID: PAT_TA_86020
cgaagccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaactccgcgcgctctgcaccggcgagaagggcgtcggcaagagcggcaagccgctgcactacaagggcagcgccttccaccgcgttgatccccgacttcatgtgccagggcggcgacttcaccaaggggcaacggcaccgggaggcgatccatctacggcgagaantcgcgaacgagaatttctccacaaacacacaagccgggntctctccatggcaacgccgggccaacacaaaggtccaattctcatctgaacgtccctgaattggtccacggaacantggcttcggcaagctcaaggatgactctaagaatcagagggggtccnanggacgtcaanaggtnncccatggggaattattgccncnccgttccttngancccgtttcctncgtcnattaaaaaatn

SEQ ID NO: 86021 - DNA, 623 bp, Triticum aestivum
  unsure (1)..(623): unsure at all n locations
  Clone ID: PAT_TA_86021
tttttttggaatggaacacattaaatgtatgaacatttttacatgtgtacttgctctaataaatcaatgtcataaaataattattgaattccttagataaagcatactccctccaaaagggattgttattcgggatggtcatagctgcgcaaccaagtcgcgagtatanaaatttgtggttgagggccacagagaatcgttgtccaagtcttctcctcacctgagagctggacccgtanacattgntgggcactctgcccaaatganctactcnaatgttctctggctcacattagttgacatgtcatccccattcccgagtccgtgtaaaagccancattttgtgtaaccacgtgcaacctcaaagtctaagcacccctgcaactgcgccaccantcatcattgtgggacgctctcaaagtgctcgntngtgcacttaatggggtgtccgcganttccaacactattgatgtcntgatcacacgcagcgtganccaatanactccatatncaatggctanggctgccnnccaatggcgatcccgttggnncgggcatgngatntaagtnncatgacaacncanaggactanccanctaaaaatccnctgtggcantgaannt

SEQ ID NO: 86022 - DNA, 599 bp, Triticum aestivum
  unsure (1)..(599): unsure at all n locations
  Clone ID: PAT_TA_86022
cctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactggagcccggcgcccaaggaagccggccggcagaggcganacgagntgaggagggagaaagcaagcatcatcatcacatcacaccaccagcgtatcagtacaactagcgccgcatcgctcgcgcgcgcgctaaatanataaaacgtcattgtccttaattctgtancctcgcgttatgtcgacantncctcctcatgctcaatccagtgaatatatggcgctcaacttgnaaaaaaaanaanaaaaaaaaatcaggggggccggacaatcgccanatgagctatancgncnatgg

SEQ ID NO: 86023 - DNA, 552 bp, Triticum aestivum
  unsure (1)..(552): unsure at all n locations
  Clone ID: PAT_TA_86023
ctcctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggaccgcgtgcggctgctcctgctgcagctgcaactggagccggcgcccaaggaggccggccggnaanaggcganacgagatgaggangganaancaagcatcaatcatcacatcacaacaaccaacgttcaagtacaataccgccgnatgngctccngcgcgcgctaataaaataaacgtaanggtccttantccgtancncnctgtangttgacaatgccncctaagctcaattcaaggnnaaangggccaantngaggtcaaaaaaaaaaaa

SEQ ID NO: 86024 - DNA, 183 bp, Triticum aestivum
  unsure (1)..(183): unsure at all n locations
  Clone ID: PAT_TA_86024
taacagtgccccgtttcttcagctcacacgccaagaccagacaccaccaccaccatcatcaccaccttttaaaagcctccctcgccacacagcagcgaagccagtccacgacgatcgagctatggcatgcgttaacatgtacaacccggacggcggcgcggtggcgttcggcngtgggcagcc

SEQ ID NO: 86025 - DNA, 183 bp, Triticum aestivum
  unsure (1)..(183): unsure at all n locations
  Clone ID: PAT_TA_86025
acttcttctccactctcctctgctcgataacctccgccctcccgccatgctctccgtcgccatgagcacccgccctgtggtctcccgccgcccgcacctcccagcgcgagctgctaactccaccccatcctcctcacctgctacagagactcgtggngccaggccgggggccgaggtgnggcg

SEQ ID NO: 86026 - DNA, 267 bp, Triticum aestivum
  unsure (1)..(267): unsure at all n locations
  Clone ID: PAT_TA_86026
cgatggcgaagccaggtgatgaagagcggcttggtgagctccaagccgcgggggctgtccggcgcctcactcaccaggaggccccgcttcgtcgtcaaggccgtcaagtctgacaaggggacgtaccaggnggtcnagcccatcaacggagacccgttcatcgncagcctggagacncccgncacctccagncccctcgtcgcntggnanctctccaacctcccagcgtatcgcaanggtcgtcannccgttcctccgctgaatcta

SEQ ID NO: 86027 - DNA, 157 bp, Triticum aestivum
  unsure (1)..(157): unsure at all n locations
  Clone ID: PAT_TA_86027
tgganatcggtggattgtcggggcaaatggattccagttccagggccgcgctcttctgcntcctggccgtcgcctcctccctcctgcancccgccagatctgacngagaggncaaccanntcntcaaggacatcanaagntacaganattcgntcaa

SEQ ID NO: 86028 - DNA, 152 bp, Triticum aestivum
  unsure (1)..(152): unsure at all n locations
  Clone ID: PAT_TA_86028
gagaactgaangaagtcatttccnagggtaaatgggcaagctggnccatgggcagntagcgatgcngatgaactgaaggtganaagaanagaccagtgcgancatcaggtttttccctttgatcagacgtangntgtgananaatgtttcat

SEQ ID NO: 86029 - DNA, 358 bp, Triticum aestivum
  unsure (1)..(358): unsure at all n locations
  Clone ID: PAT_TA_86029
cccaaaccttctcctccttctgaacctcccggcgcatctccgactccatggcccgcaccaagcagacggcgaggaagtccaccggcggcaaggcgccgagggaagcagctggccaccaaggccgcccgcaaagtccgccccggccaccggcggncgtcaagaagccccaccgcttccgccccggcacgttcgcgctccgcgagatccgcaagtaccagnaaggagcaccgagctgctcatccgcaagctccccttccagcgcctcgtccgggagaatcgcccaggacttcaaganngacctccgcttccagagctccgtntcgtctccgccctgcaaggaggcgcccgnaggctactg

SEQ ID NO: 86030 - DNA, 501 bp, Triticum aestivum
  unsure (1)..(501): unsure at all n locations
  Clone ID: PAT_TA_86030
gaaaaagcatcgtctcgtctcgtcacgtctaggaatcaacagccatgggcggcngcaacgcgcagaagtccaagatgacganggggatgaanctcgagaagntgaatggcggcaaggggagccagctcgaggccaacaagaaggccatgaacatccagtncaagatatgcatgnaagactttcatctgcaccacctctgaagcaaagtgcaaggagcatgccgaggcaaagcatccgaanagcgagctcgtccagtgnttccctcacctcaagcagtgatatctgttacactnagcaantataancatctanatcgccagcaactgtaangtgcctaccttttnaggtaatacaaccatctaactatctgaanggctgcanctgtgatngtnctaaagctcctttttnnngcttgcttntctncnacangggaattatcggctntccagcntgtaangcacgtnnggtganctcaatcggtgatcccttcgnaagtcttgg

SEQ ID NO: 86031 - DNA, 264 bp, Triticum aestivum
  unsure (1)..(264): unsure at all n locations
  Clone ID: PAT_TA_86031
attggtgtttgntccaactaaccctngagaagnacatcaattgtttgnnccgcctagaccacaacaggggantcggtcagatttctgagaganttggggtccaagtttctgacgtgaaagaatggctataatcctgggggaaanaatncgtcaanccattaccctngnngttaaccnccccnacggggaaanattccaanggggaaaaaacctnttccggnaantttttcnaaaaggntaaagggttaaaacgggggngtttaa

SEQ ID NO: 86032 - DNA, 341 bp, Triticum aestivum
  unsure (1)..(341): unsure at all n locations
  Clone ID: PAT_TA_86032
ataagccctccttccgcctccacctctcctcccacagctcgccgccgcctgacaccggggaccagcttctagtcatggctgtcctgctccgcaccaccacctgcgccaccgccaccaccgccggctcctcctcgaccctcctcgccacaaccttccgccgcggccgccgcctcctcccggcccgcgcttcgccgncgcgncgcgccttcactgcccgcgcctcggtcgagccgcctggnaggtctgcgccaaggnctccatcaccgtccccgaccgccttcggngactgncctttcagnnagngagttttgtntgacganatagggagnnaacntgcctta

SEQ ID NO: 86033 - DNA, 268 bp, Triticum aestivum
  unsure (1)..(268): unsure at all n locations
  Clone ID: PAT_TA_86033
gctcttcctccttctcatcccttcccgtccattccccacccccatccccatccccgccacctacctgcttcggcctcggcctcggcgagagcgccaacgccaagcccaccactcccaaaaccggagcacgcctccctcctcccgctaatcttgggnccgtccgtccgtccgtccgtccgaggcaggggtggcgccaggtccgcgatcgatcgcgacgganagtgccgatcggcgccgccgnagggtngagggcggggcggnttgggcg

SEQ ID NO: 86034 - DNA, 335 bp, Triticum aestivum
  unsure (1)..(335): unsure at all n locations
  Clone ID: PAT_TA_86034
gacgcgcttcctccaccgtctatattcttccccaaaaccggcgacattttgctccccttccaaaagtacacagcgcacaccaccacacctcgaagatctctccaaatcgttcgtccatggcgatgcaacagacaggggaccccaccgccaagctcccctccgcctcccccttcgccagcgccagccctcctcccncataccancaacancactacggcaccttctccncccggnncgncgccgcccgtcgctgcagctcgctnacgangncctccctganatggcgnaggtgctnagggggcatgtntgcnttcccgtgcantatccagcagtga

SEQ ID NO: 86035 - DNA, 262 bp, Triticum aestivum
  unsure (1)..(262): unsure at all n locations
  Clone ID: PAT_TA_86035
gtcatgtcaatgccccttcgcccacatttcatttttcccgagcaattttagtcaaatattcgacagggcaatcttgggctaaaacctagcgtaccctaagatacaaaacttctattctactgaaactagcaacttcataatacatatgtaattatacaatctcacaaacatgtccaacagataacaacttttttttagntgaacagatagctaaggactcatattatcaataacaaagggtagcatcacaagtgtgtgcttg

SEQ ID NO: 86036 - DNA, 491 bp, Triticum aestivum
  unsure (1)..(491): unsure at all n locations
  Clone ID: PAT_TA_86036
atgcatcagggtttattcttatttttctacacaaataagcttgtttagtttccgatacatataacccatatgaacttcaaaattcattaatatatatagagagctcatgatattgccagaatcttgaattgcagcttctagtaatcaaatgtacaaagatttgttcaggcggtgagcatttggatcttgtatgggggnttnngttcgcctgatttcatcatgtccccgattccgcaacagctggaactccaaatttgcaagcacctggacaatggttangtgacccttcaaggttacttcctgcaatggtccgaccacaagtttgccaacaaatgacttgtggctgacctttaccncaanaattttcccacatgcatgcacggncggccncggaaccatggtnggtttaaaagatacaacaagagtggatncaggtgnttgcnaataagcaaagcttaccattttaagaaccaagcggcgtcnnaaaagtc

SEQ ID NO: 86037 - DNA, 280 bp, Triticum aestivum
  unsure (1)..(280): unsure at all n locations
  Clone ID: PAT_TA_86037
gtgctccccgcctctcttctcccccgagaccccccccccccctcnctctgtgctcgtgctccctcttcctgctcttccttctgctcggcagccatggccancgcgctatgcngcggcggcagcggcagcgtggnggcgccgtgcngggacttgggcgccgcggnggcactcgccngagtctttgcngatgggcgncnggtatcgcgccaaaganctccttccccgccgggagggnggcgatagcggntagngcccntctcgctgtnagcntccantcagt

SEQ ID NO: 86038 - DNA, 337 bp, Triticum aestivum
  unsure (1)..(337): unsure at all n locations
  Clone ID: PAT_TA_86038
ttcctcgccgccgccgctccgtacccgctcgaagccaacccgaccatggcggacgtcgacgttgacacggaggtggccgcgggcgcgcagncgaagnaagaggacgttccgcaaagttcagctatcgcggngtggatctcgattnccctcctcgacatgtccaccggngaccttgtccagntgttccccnctcncgcccgcantnnagttcaaganttgtctcaaagaggaancccatggtgctcgtcaagangatgcncaaggcganaaaagacgctcctgntggtganaanctgaaccagtgaggnananatctccgtaacatgatattgnccct

SEQ ID NO: 86039 - DNA, 284 bp, Triticum aestivum
  unsure (1)..(284): unsure at all n locations
  Clone ID: PAT_TA_86039
ccacatcctcatcgtctccaacctcggcgaaaccctagcctagccccgccgaatcgcgagtccccccgaagncggngcaagccgagatgtcccgcaccggaccgatcgcccaggactgggagccggtggtcgtgcgcaagaagctgcccaacgccgccgccaagaaggacgagaaggccgtcaacgccgcccgccgcgccgntgnncgacatncgacatcgncaagaagcatnagtgctgnngacaaacaaaagntgttcanagnaccacatcgntcagnaaca

SEQ ID NO: 86040 - DNA, 247 bp, Triticum aestivum
  unsure (1)..(247): unsure at all n locations
  Clone ID: PAT_TA_86040
tttgtgaccaaccangccaactaangnccgttcnggcacgcngtgggacagcacgcactacagcctgcccgtgctcaaaaacnggaacgtcntcngcaatgttcngncgcgccggnagactacctccacgccatcgggnttctatgtcctccccttctaatttacaactncccatgtctgctatcagagattgagtcctggcatctaaaaaaaagtgtttncccccgcttttanactattaagcaac

SEQ ID NO: 86041 - DNA, 425 bp, Triticum aestivum
  unsure (1)..(425): unsure at all n locations
  Clone ID: PAT_TA_86041
tttatgangtaaantncnccgcagnnaatncatatntaacnccntagatncactcantttgctcgtatgtntccacttgcagaaanctctaaaacgacttataattnangaggatacactnaagattgtttcaaaatttcgctcggatgcatgaagagctaaacaataacttcaccacatatcgccttcttgcaagacatcaatcatgtcgtaaattctcttangatccattgattggaccttcttgtacaagaaatacggcggcatcaactgacccttcgcgnntanatttgaacgggncacaaacattgtgctggaactcnanatgaaacgctgtcatccgnagnaanccagctngtacagantggaatgcatgtccttcaatgtgttctcgncggaaaccaacatgaagnngttgccaggat

SEQ ID NO: 86042 - DNA, 400 bp, Triticum aestivum
  unsure (1)..(400): unsure at all n locations
  Clone ID: PAT_TA_86042
gcagcgccttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctggagntttgaagagctccgacaccatcgacaatgtcaaggccaagatccaggacaaggaagggcattcccccggaccagcagcgcctgatctttgctggcaagcagtgnaggantggntcgcaccctagncagactacaacatccagaaagggagtccacccttcaccttggtgctcctctcgntgntggtcagtaattgccctggcgtttgatccaaccttcacatggtgctccgtctcgtggtgg

SEQ ID NO: 86043 - DNA, 197 bp, Triticum aestivum
  unsure (1)..(197): unsure at all n locations
  Clone ID: PAT_TA_86043
ccactctctcaacccctcccccgaccgccgccgccaccgcctcgtgacttcccgaaccgtctcgccgcctacccccgccggccaccggtggccgaagcaggcgctggccggtaggccggaccgcctccaaccctaagcgcgcaccagcggaatcgccgcgactccgagtcngagnnccgggatcggannggggaacc

SEQ ID NO: 86044 - DNA, 488 bp, Triticum aestivum
  unsure (1)..(488): unsure at all n locations
  Clone ID: PAT_TA_86044
gccagtttagtcggctatccatacttgcctcaaaactactatgtaccaccaccagccttccagcaagcgtattcaagtaatggacctttccatcaatctgatggtggtgctgctgcagtgcctggatctgctatgaaatactcgatgccgcagtacaagagtagccttcctgtcacgagcccaccacaacattcatcagcagtctctgggttatggaggctttggaagctcaagtaatataccgaatttgggccaaaaccagagtgcctcccctgccacgactatgggnnttgaatgnaagctttaagttcacagttcaaagnaggccaatcactacatgggccctaagncagagcgacaactcacgatgntgggcttcatggagctgctgggtcaacnggctggttcagctgttccactgggnaacttttatggcttccaagggcagagcngcagnntggttccgtnaggggtgcaacagcctctca

SEQ ID NO: 86045 - DNA, 338 bp, Triticum aestivum
  unsure (1)..(338): unsure at all n locations
  Clone ID: PAT_TA_86045
gcgaggcgctggacctcgagctgcacctctagctattagcgtcgaccggccggctgctgaatttcatatagcacaggtgtcgtcgacggaaacattcagcaacaattgtaatcgtctgtgtcggcgatcgaacttgggtatcgccacgtccggctgctctccggtatatttgtgttcttgcttcatattgtaggcagctagctggatgnnggggtttcacccgtcaaatagtcactccgtgataaaatanttgttaatattcctcgttcatcaatccgaacggcatgtaataancggtcaatccgtaataatatcagtgtacctgggttgcttcccaa

SEQ ID NO: 86046 - DNA, 253 bp, Triticum aestivum
  unsure (1)..(253): unsure at all n locations
  Clone ID: PAT_TA_86046
ccangctgccacccccgctcgcctctcgctcccacctcccatggccgtcactctcaagcctcttgctcatccgcgtgcaggcatctctctagnttcnccctanagagatctcacagacgngntangcagcancaggaacccctccgggcntcctcccatgcaccaccaggnnccaagtcaggtctcnaatggnnggtctcaggatgaagttcgtcgnngtcgncgtcatggccgtgcgcnctcgtcgnctccg

SEQ ID NO: 86047 - DNA, 194 bp, Triticum aestivum
  unsure (1)..(194): unsure at all n locations
  Clone ID: PAT_TA_86047
cgcgcgctcacctcgcagtaancatgccgctgctagctccagcagctaaaaccctgttcccctcccggctcccgncttcgnctcgcctccacctccgccgcgccaccgccaccgctgccgncggaaggggngacggtgnggnggnagtgtcnagnggcgtccgggacgncggncagngtgncggagggtggtca

SEQ ID NO: 86048 - DNA, 461 bp, Triticum aestivum
  unsure (1)..(461): unsure at all n locations
  Clone ID: PAT_TA_86048
ataaactgcaggttacagctatcctatttgggacactaagctatacacttatcctagttttctattcagaatggcatagcttctctggtcatacaatattttgcttaaattagaatttttcctgcaagcaatacatttaatattttactatgcaaatcagtttcaatacaagggatagtacgttttcctatgcatctgccaaccaccacttctatctattttgtctaattaattttctttgggtatctctacaaggtttaccaaatcaggtgataaggtaaaaagaactcttcttgtatttcatagtccggcacttgagtttgcgatggnaaggactagnctggtcgactagnccntcggtcngtaacagnngggagangnanacataccatcatatgntttttccattaaatccttggggaaaggaatanagnttagctaatcatggtgntggnaagaag

SEQ ID NO: 86049 - DNA, 302 bp, Triticum aestivum
  unsure (1)..(302): unsure at all n locations
  Clone ID: PAT_TA_86049
ctgcttctgccccttctcttacatggttgctagttactcatgtgttaatttcttgttgagtccctttgtcgtttatttctgccaatgttagtattttagattctcaaataaaacaaaaataccaaaaagaaagttcataaaatctgaatctacctttgcttatctgcattttcattggngacaatattaggtggtttaaggttttattttctgctttcatcacccaatatcatgctacctagctttagacttggtgccatcgctgatcaccttggncnccangggagaanttcgacatcacg

SEQ ID NO: 86050 - DNA, 590 bp, Triticum aestivum
  unsure (1)..(590): unsure at all n locations
  Clone ID: PAT_TA_86050
gcgccatccagtaccaccagcgcgcctccacaacacccagcgccaccactctcaatctcctgctgctcctaaccttcttctttccccaatctcgttgctactcctaaccttccccgcgccacctgctgctgctcttctctgaaccccgtgctgtcgtccttcttctcttcctactgttactactacatctccaacgccccttgttgctgttgcctcaacctgctgggttcttcctctctgaatccctactgctgctgctcttcttccccatccgccaacctgctgctgctccttcttcctaatgcgccccctggctgcccttctctttagctgctgctcttagttcttctctggaatccccgtanggttggttggtccttcctccatgccccagttgcttctcctctttctcnaactcctggtgcnnctctcttctccttctctctctgaatttctgagtttngagactgnntccgtaanatcagatctaagagtactgctcctgtncaagtacttcacatcnatttagtgtcatacacncgtgatcgtancnagcaagggttgttaattgtaactgggtaccgaatagg

SEQ ID NO: 86051 - DNA, 195 bp, Triticum aestivum
  unsure (1)..(195): unsure at all n locations
  Clone ID: PAT_TA_86051
tttttttaaagaagcacacaccaatcaggaactcaanctctgcanaatantcttgctctgcacagtaactttgctgnaacagngtttanggntaaatggttggacctacagnactagntaancatagatanttttattcannactaantgaccctgggtggnttgaaatcngcanantgcactttaccggtgatt

SEQ ID NO: 86052 - DNA, 498 bp, Triticum aestivum
  unsure (1)..(498): unsure at all n locations
  Clone ID: PAT_TA_86052
tgctttgcagataagcatgaatgccccagttatggttgancttgagggcnaaactgatccncttgagattgcnatgaagganctgaaagnangnaggttccccttnannattaggcggnacttacctganggaagctacaaggactgggaattttgacgagctcattgtggaggctcgtggaagcgtcaggttggcgggggactaaagctggtaactgtttgaatggnaagatcctgtgctgcaacaaaactttccctagtantatatcaatgtttaanactgaactgctgtgacaaggttaannctacctacattggnnggctatgtccgccattgggttgngcacnacngtaacattgggngggtnccttantttgctttggcaatggcnggatgcantcagtttcgaattgaaactacccnacncttttgggnnngggggcaaganttctgnccattattangtcccatttaaaaggngaaaaaaccaggggggc

SEQ ID NO: 86053 - DNA, 593 bp, Triticum aestivum
  unsure (1)..(593): unsure at all n locations
  Clone ID: PAT_TA_86053
atccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaaggccggcgccatccgcaaggtngggacacatccgtcatcaaaggcccgtccctgcaaggttgtttgaggtctccacctccaaagactggggaaagcatggtcacgcaaaagtgtcacttttggttgccattgacatctttaatggaaagaanttngaggatatcgtccttcaacccacaactgtgactccccatgttgacgccaagattacagctgatngacataactgatgatggtatgtcagcttccaactganagtggacacaaaggatactgaanttccaatggagnatttctgcttggcagtnaagacggttnctgaaggaaagactgncctgtccgtnantccgcatgtgaaganaatntgnctttaaggaaacgnggnggaataacaatgnnctgtgctactgnanatggancaagcttcggggttganaaatnatg

SEQ ID NO: 86054 - DNA, 642 bp, Triticum aestivum
  unsure (1)..(642): unsure at all n locations
  Clone ID: PAT_TA_86054
ctcctctcccacacaagcangcaaggaaggttctcaggccgccgccgccgccacgatgagctcctcctcgaagctcttccagtccgcctgcaaggccgccaggtccttcctcgcctcctcctcngcccccgccgccgcctcctccgtcctcgcagacgggaggaacnccgcgntcgccancctcgcnaacctcggcaggaactccacnctcccagcgnatacgcccaccacctccacaccaacgcngcatcntcccagggctacgcatggatcgccgccattcncgccgnaagtctacatgctcnaaggatcaaggaggtgnacgccgccgagatggacgcacttcatcgccatcaagctgacggcgtccagagaggctcatttctgagataatgtcccnatttgagagaaaagntacaanttgttgcatcaantgggnntccaatcaaagcagttnccgagaagatacatggtccaaggaaagcttctcaatggatgtggactctaatcgggccgtgtgcaagatgggaagaaggggtncaagtnggagaacgangngcnggccacanttncaagacanaggtgnctgcgttttgagaaatacaggacatgncggaagaagcaatngncgtcacagngggn

SEQ ID NO: 86055 - DNA, 533 bp, Triticum aestivum
  unsure (1)..(533): unsure at all n locations
  Clone ID: PAT_TA_86055
gggaagacatcactctggaggttgagagctccgacaccatcgacaacgtcaaggncaagatccaggacaaggagggcattcccccggaccagcagcgcctgatctttgctggcaagcagctggaggatggccgtaccctcgcccgactacantatccagaaggagtccaccctccaccttgtgctgcgcctgcgtnggtggnatgcagtcttcgtgaagaccctcaccggcangaccatcacctggaggttgaaaagtcccgacacaatccgacaatgtcaaggcaagatccaggacaaggangggattccccccggacaagcaacgcctgatctttgctggcaagcagtggnggatgtcgacctcgcnaggctacaacatccagaaggngtcaacctccaactgggacccctctcngngggggtcangaatgcctgnctttnactcnggnttacctggcctccgggggggggnccctgtcntaataaanngtttccgtngggnaacaanngggtggtttnaatttnatcccg

SEQ ID NO: 86056 - DNA, 306 bp, Triticum aestivum
  unsure (1)..(306): unsure at all n locations
  Clone ID: PAT_TA_86056
atcggctcaggtaaactcctcatgtacaccgtcaggcatcagttctagtcgcgcccgaagcttccaatctcgccgctccacttagtttgccgaaacattgtcggcatgtgctccatccaaggtacgccatcgtccaattctatcatcagtttgaactttgaactaatgactaaatggnccggagttgccaagggctgaaagtcaagnaagattcaagcttacatctggaatcctttgtattgcctacaatgtataacttaaatcctgctaataaatttccnacaatgatgttccattggcttggtc

SEQ ID NO: 86057 - DNA, 353 bp, Triticum aestivum
  unsure (1)..(353): unsure at all n locations
  Clone ID: PAT_TA_86057
ctcgagtttttttttttttttttttttcaatcaaattgggtctctgacgcccttatttcaatcacacgaaagaagatacagtctttatcaaaataataaatgcatgaaatcagcgtgggtatggatttgatcattgcctcgagctgctgaagtgtcatcagtgcaggcaatcttgggcagattgtgccatccgtcttaanacttgggnaatgcgtgcttttgattttgcaagacgnatcctttggttgcctgctncttcaaaccctgaaacctcaaccttctgaaaagggcctcaatcctncccccngttgggggcctnaaccnattttnccaaaacaaaaaggtttcgcgag

SEQ ID NO: 86058 - DNA, 381 bp, Triticum aestivum
  unsure (1)..(381): unsure at all n locations
  Clone ID: PAT_TA_86058
tgaacttctataatagacctgagtcttttgtcttaaacacacacacgctcttcatgcaaaaacaatgatagttttcttggaactgtgctgtttcacaacgaagcacaatgatggatgaatcttcacaataacaaaaccgaaaaaatgtaactatagcatatactcctccttccaagtacgtacgttgttcaagatgcacacatacatacatcttgcttgtccgtatgcagtgcactgaagtaacaaaacactcacctttcattcccacggaccactccacacaccccaacaaaatatagccatcacatatggtcctgatgctgatgatgcatgcgactgtataactccttttctcctttggnaaagcaggttgttgcatac

SEQ ID NO: 86059 - DNA, 475 bp, Triticum aestivum
  unsure (1)..(475): unsure at all n locations
  Clone ID: PAT_TA_86059
gcgcctcctcctgtctcgtcctcgtcccccntcccccgtcccctcgtcngcgcccgatctaagtcaagatgagtcgtggcgggagtgctggaggtggtcaaagttctctgggttacctgtttggagatggtgancctgcaaagcctgctgcagcaccagctgcgaagccaagcacctgctgagaaaccagcactggcagctnccgatgtaancaagcagattcaagtggaantccaaggtagccgggncgaaaaancaactaaccgtgcaagattggcaagaacaacgggaaacttcccttacgggcccgttccttcaaccaaaggttcangcttgtnccgggcgggttggctccnnccttgggtanttgttggcgggaanttgttctctgtaaannganctgcgaataattggcntgtncccctgttacaagtggnggaaattgaantnntttggttaaannantttacaactg

SEQ ID NO: 86060 - DNA, 460 bp, Triticum aestivum
  unsure (1)..(460): unsure at all n locations
  Clone ID: PAT_TA_86060
cggcggccggggccagcagccagcagcgccgctcctccacctccccggcgcgcctccccacctccaggctccggccccacctcctcatatcccccctccctgccctctctacctctggcgagccgccgccgccgccgccgctccaagaggccgccgggatcctaccagtccgtcgcggtgacccgctgattgcttcagggatggcgacctcgaacgctgctgcgtgctctgaggcgggccctcctcggnttggccgcgctgcgattgggcaacgactgccaatgtgcaagccgttactgggatacaggcatctgaataatcggaatctaagtgttttcaacgagttctcaaaagcagctgaaggtgnngctnaagagtaatcctgaattccaagaatccatgaaggattcaagtgagaaattgggntggtaaagggaanatctaangtaagaactaagaa

SEQ ID NO: 86061 - DNA, 400 bp, Triticum aestivum
  unsure (1)..(400): unsure at all n locations
  Clone ID: PAT_TA_86061
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaagggcctcggcggcgctgtcgtgcgggcaggtgggactccaagctcncgccgtgcgttggcgtactacgggaaanggncgtcctcatttaagaaaggantgcttgctccggcgtgcaaggggctgaaccggctggcccgcagcagccggaccgcaangatagcgtgcaangtgcctcaagaacctcgccaacaagcatcaaagtccatcaacaangggaaaggtctccgncgtncccggnaagtgcgg

SEQ ID NO: 86062 - DNA, 288 bp, Triticum aestivum
  unsure (1)..(288): unsure at all n locations
  Clone ID: PAT_TA_86062
cacaaacgccggctctcccccgctccgtctccctcccccctcctcccccgctccgctccctccgccgccagatcccgtcgagcccccccgcgcccccgcgtcgaaagatgagggagtgcatctcgatccacatcgggcaggccggcatccaggtcggcaacgcgtgctgggaactttactgcctcgagcacggnatccancctgatggccagacnaacggcgacattaccatcgnangtggtgattgannccntcaacaccttcttcagtaagancggagcnggaaat

SEQ ID NO: 86063 - DNA, 235 bp, Triticum aestivum
  unsure (1)..(235): unsure at all n locations
  Clone ID: PAT_TA_86063
ntcncctctcnctcccacctcccaagccgncantcncaagnctcttgcncatccgcgtgnagcatctctctannttccncctagagagatctcanagtcgtataggcagcagnaggancccctcgggccctcctcgcagcaccaccangaacnaagtcangtcgccantggacggtctcaggatnaagttcgtcgccgtcgnngccatggncgccgcgctcgtcgcctccgcggc

SEQ ID NO: 86064 - DNA, 368 bp, Triticum aestivum
  Clone ID: PAT_TA_86064
tgaaaacccaatcatcatatataaggtggtttctttcatatacaggagcacaggtgagggcttgtcttctgacatgcatctctagttataagcagagcttacaaaaccgtatcttatttagtcaagctgctctgcaatatactcctaccttattactttctgccattccaaacatcaacttatatataggttacattaattcattcatactcacagctgcactgaactattgacttggagttaggatacatacagtatatatatattatggctatatgagtacctcaccttgtacatgcaagatatactagttcatcattctggggtgcaaggttttacacccccaaaagaatgtcactaactgctgg

SEQ ID NO: 86065 - DNA, 368 bp, Triticum aestivum
  unsure (1)..(368): unsure at all n locations
  Clone ID: PAT_TA_86065
agaccttcgaagcgaagcagaattcgacaaggctgaaaaagctagggagaagttggtacttgttctccaggacacatgcttgaactatcgagctatcgatctgcggacacctgcaaatcaagcaatcttctgcatccaatgccatgtttgaggaacaaattcaagggaatctttgttcttccggagaattttatcgggatccagcacagtccaagnttgattggngggccagtggaagntnggtgcacctgtattcatctggagtataatggcacctgcttggttagcacatctccccattatacagnagnatganactgtggngggntttgggcgcgtgcttaggntttggcctgtattttaagcaa

SEQ ID NO: 86066 - DNA, 280 bp, Triticum aestivum
  unsure (1)..(280): unsure at all n locations
  Clone ID: PAT_TA_86066
gcaccgcggatttaatttgctctatccactctctctcgtggactcgtccgtggtcctcttccccgccgtcttcctcctcctcnccctccccctccctaatccaatggctgctgcggcctcttcctcggcctcgccggttctcctcccgtccagggccgcgtggcgcgagctcgagggcctgtcttcccagcggcggnggcggtggcagggcgttcatcagaggtggcaacagcagggngncatgctgctgcagggctgccgctggcgtangcgcggctca

SEQ ID NO: 86067 - DNA, 612 bp, Triticum aestivum
  unsure (1)..(612): unsure at all n locations
  Clone ID: PAT_TA_86067
gcgattaacttcttcgagaagagaaagctagaccgagaagacacgttagaatttcataaccacacctttcccacttacccctcataaatttcgggacgagatttcttgtagtggaggagaattgtaacgcctggatatttaagctacaataaccctccactaatgttgccatgtcaccacgattactgttgctaatcctcacttggatccaaatcactattcaatttcaaattcaaattaaagccaaaattcaaaatttctcaaacatgaaaactaaaatgttcatttgtggcaaataactgtggttaactgtcatgttggaaaccaagtaatttataaagaattaaaatgcgctttgggtaaataaacagggattaaaataattaataaatgctttttaattggtaaaacccaaactaatttatttaagtgccaattaatggtgacatgggccaactattacacaatttanggctagngtatatttataaagcctaaaaaaggggnggccggtaccaatcgcctaaaggngcntatacgcggccaatggcgcgtttaaacgcggactggaaaacctgngtaccactacgctgaganncccttcgcactggg

SEQ ID NO: 86068 - DNA, 168 bp, Triticum aestivum
  Clone ID: PAT_TA_86068
gagagctcgagagagtgcgaccaaaatggcgatgagatgcgcgctgacctccctccccgcgcgcctccggtccccggcggtggtcgccagcgggacccggcgccttctgagtgacgggaagggggcgcgtgctcagcgaaggaggagcgcgccaaggagaacgtctac

SEQ ID NO: 86069 - DNA, 621 bp, Triticum aestivum
  unsure (1)..(621): unsure at all n locations
  Clone ID: PAT_TA_86069
ttgagtaacacagcaacaatatatatccagatcatggaaacaatactcttaatagcaactgttaagagaaagcaacagcagagaaggaacaaatctcgctagtacaacttcaggttatataggacattgtaaacatagcaggcaactttcctcctcaaacgaccagagccttacagtccattccatccttgcctaacaaaaatgcaacctaagacctggggcttctccttcttctccttgaagagagcgagaagcgacacaccagataccttggacaacttggaacctgacaccgggaatatctcccacggcatgaccttacgaccgaatccagcatcaanactcgntccgntctcctcgatgnaagtcaaggcaaccatcaatggggcacaaaggcagcgatctcctcccgttctcaacaagctggacacgagcacacttacggtggcagagttagngttggnggggggccgggtaccaattcgcctatagtgagcgtatacgcgcgtcatggcgncgtttcacgncgtgactgggaaaccngggttacaacttaacgcctgcagaaacccctttgcagcggggatnananggccgacgnttgcctccaaantggagcta

SEQ ID NO: 86070 - DNA, 549 bp, Triticum aestivum
  unsure (1)..(549): unsure at all n locations
  Clone ID: PAT_TA_86070
actagtctcgagtttttttttttttttttttcatggttgacctgaaatttgccatatactccgtacttctgagctcaccttgtcactgatacatacattttaccaaagctttgtgaaacttcacctctcatttgcttttgaaccaactattgtaacatttgccccatctcctactgactcttcatccatggtatacattatcaacacatacactgtgttacttttgccttctgtaaatattctttgggccttgtctgcctgttgaattgctgatcttttctttgaatgcccaccatcaaattcagtgggaacgacctgcttgatgtatgaaggccctggaaaagttcctcctttcctttgcgagtgatcgaagctctgggtaaccagtacgcgacatattcngccatcaaggatcatatgtcntgggctncttggggagctgnagtatcgatctngcngggntcattgcnactctgctcaaatgccaantgcatatcgagcgggtcatatcagggggggccggtaccaantcnccaaaggatcntatac

SEQ ID NO: 86071 - DNA, 323 bp, Triticum aestivum
  unsure (1)..(323): unsure at all n locations
  Clone ID: PAT_TA_86071
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtnggaaggccaccgnccggcgccggtccgccatggtcatgcccaccgcctcccacaagggggagctccggngggnttcgaagatggccggcgggtnaagaccggnnggctngcgactgcaccaacgtgcaangtgngggaccgcgtgnggnngctcctggtncanctgaat

SEQ ID NO: 86072 - DNA, 265 bp, Triticum aestivum
  unsure (1)..(265): unsure at all n locations
  Clone ID: PAT_TA_86072
ctgcgcctccacttccatcgcctcccaagatcgcagatctgctccggtgagaatccgtcgccatgtcttccagcgaggtcgcctgcacccttgccgccctcatcctccacgatgacgggatccccatcacttctgagaagatcgcgacggtggtgaaaggctgccggaatcaagnttgaaggcctactggcccgcgctcttcgccaagctcctggagaaagaaggacgtncgaatgacctcatcctttccgccggatctgtgagg

SEQ ID NO: 86073 - DNA, 500 bp, Triticum aestivum
  unsure (1)..(500): unsure at all n locations
  Clone ID: PAT_TA_86073
tttttttttttttggcacagctctaatcatgttttctctttcatgattgcaatcttgtacagaaaaataattcacatggagctaaatcttccaacgaagatatagcaccatacttttgtcagtcttctttctgaacatgatgtttgtaaatccagaaacaggaaacaaataaataatatatttctagagtacaacggtgaaaaaaatcacagccatatttatcacttgaccttgaaaatttccttacagagctaaccgtnaattaattatnaagaaggaaaaagaaaagctcaggcagcggcttatngnnttgataggctggccatcacagcatttcaagtggagaaaatatgtgtgctcaaagcctcaaactccgnngctatcactgcacaacatactangcgnnatactcattgangctggnttngggcccttccaggtggnagagnagtncgnaanccancaggttcggcattancncatttctnnggaacntcaag

SEQ ID NO: 86074 - DNA, 387 bp, Triticum aestivum
  unsure (1)..(387): unsure at all n locations
  Clone ID: PAT_TA_86074
acttggcctcgccgacgaccccgacaccgcagctgagctcaaggtcaaggagctcaagaacggccgcctcgccatgttctccatgttcggcttcttcgtgcaaggcatcgtcaacgggaaggggcccgntagaagaanctnctngaccacgtcgccgacccggtcaacaacaacgcgtggggccttccgccancaacttccgccccggnaagctaaatgtgttaagcatctgtccgtccatccggacgaagatatgcatgtgtactttactcctggggtnaacgtgtagctncacntacttttgtgtgtttatttgtaccatgatcnagcgagcgagatgactctcgcntggtgcncgcatgtgaatntatttagcacnngatgtac

SEQ ID NO: 86075 - DNA, 601 bp, Triticum aestivum
  unsure (1)..(601): unsure at all n locations
  Clone ID: PAT_TA_86075
cgagcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaaagcccgcacctgctgagaaaccagcaccggcagctgctgatgtagcagccaagattccagcttggcattccaggtagncgggcgaacaactattaccgtgcagattggccaagaacacgggcaacttccttaacggaccgtcctttcaacaaaggttcatgctgccctgncggnnggtccgtcccctgggctacttgtttggcggaaaagtgatgttaatgatgggggcctggttaatgaaacgaacgatgaattggcctgtnccccggtatcaggtggnnaaaatgaaatgtttggnttnagganttacactgggnggagtgacctgctgaaggtnattggtccaggtgactcctggntgaaacaantgcctaaacngngcttnaaacaacgnctcancnaaaantgggngcaaaaaaaagaanaaatccaggggccg

SEQ ID NO: 86076 - DNA, 430 bp, Triticum aestivum
  unsure (1)..(430): unsure at all n locations
  Clone ID: PAT_TA_86076
ctcctccgataatacaataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggttagactacctgatccgctccaagnggggtgccctgcctcgagtcagaaggttggttcgtcttccgtgagnacaacagtctcccggatatacgacngtcgatactggacatggtgnaagctgcctatgttcgggnngaacgangccaganaggtgtcacagggtgncanggaggtcaagaagg

SEQ ID NO: 86077 - DNA, 386 bp, Triticum aestivum
  unsure (1)..(386): unsure at all n locations
  Clone ID: PAT_TA_86077
tcaatctccatctccaaaccgtagcagcagcagcacccctccttgccgacgaccccccagccccgatggcccgcacgaagcagacggcgcgcaagtccaccggcggcaaggcaccgaggaagcagctggcgaccaaggcggcgcgcaagtccgccccggccaccggcggcgtgaagaagccccaccgcttccgcccggggcaccgtcgccctccgtgagatccgcaaagtaccagaaagagacgggagctgctcatccgcaagtccccttccaagcgcctcgtccgggagggtcgctcaaggacttcaaagaccgacctccggcttcaatcctcccgccgtctccgncctgcaggaagccgcccgaggntactcgnccnggctctt

SEQ ID NO: 86078 - DNA, 557 bp, Triticum aestivum
  unsure (1)..(557): unsure at all n locations
  Clone ID: PAT_TA_86078
ccgaagtctgaagaggacaagaaggggaagagcgcgcctgtagcccagggagaggaattctcattgctgaagaggcagctggaggccctgaacgatgagagcatcatgctgcggcacactgtggagggcctgcgtgctgagattggggtcaaccgagctatctcagttcccagcaaaggcgatgctcgaaggatgccggcattgtcgccgcctctgcagactactttccctgtgaaacctgatctccatggaaatggaaagggagcntggcggccggtttggaccgaatgatgcgagcgaggagctgaagnaaaggcactccgagccgnnngggaagttgagccatttactgcattaagtgcttgctgacattggcaagntctgcatttttacatataattttngatcttaatatgtagcccggtaggnatttgnaccttgagggggacaaacgacatctcatagggngatcaagaattccaaggtttcaagtcgtcntgttaggatatgcattantanaactttgtttcggccttgaactccggtanagaggtcaa

SEQ ID NO: 86079 - DNA, 548 bp, Triticum aestivum
  unsure (1)..(548): unsure at all n locations
  Clone ID: PAT_TA_86079
gcgacatgtccgcttcgtctacatcctctctccccgtcccggcggactggctgctacccctgatggcatatccactctgcggcgacgaggtagtgacagacgtcgcaaggagtgggaatcaggttgggcatcgtttctacaaatgcatccgttatgatgtccgcccatcatgcgaatgaattctgaaaacacccattcgaagctctcttcctgctcgtcgcgcatcaacactcctgccacgattgatactctagtagtgattgttaactccaacaagatagaccgaatggcatgtcgtccagatttgtactgtatgntggtggtcgaatgtgacaacgttcgncaaangaattgtactgcatcctgctggtcccattngccnaatggnattcttcacttgctatcttctncggngaagaacacannggggatccagggtcatccgcggatntcgggaaaactgnagggcttcgnaatanctcagctgtcangntatctccaaannntcctgaggcctttangaaggactttaacgncaagnantccaa

SEQ ID NO: 86080 - DNA, 460 bp, Triticum aestivum
  unsure (1)..(460): unsure at all n locations
  Clone ID: PAT_TA_86080
aaggtagggtttccagttgcaagccgcgccgccgccgccgccgccatgggacactcgaacgtctggaactcgcaccccaagaactacggccccggatccagggtttgccgtgtctgcggcaactccgcatggcctggatccgcaagtacgggctgatgtgctgcaggcagtgcttcccgcaagcaacgccaaggacatttggttcnacaaanacccgtttaagaatgggaacctccaaaaggaagcaaaggactaaggaaattacaaacgaactgtggtgcttccaccgaggctgatctttatccctataantatgttaatgaactactattatgttttgaaccctgggtgacaaacccgtgaaacatgtttacgactgctgttttacatgtgaaaccgataattccgttactgcctgcattatggttagaagttgctctgcacccttaatttttattaa

SEQ ID NO: 86081 - DNA, 478 bp, Triticum aestivum
  unsure (1)..(478): unsure at all n locations
  Clone ID: PAT_TA_86081
tgaagctcatgcagcccccaactgcaaggttttggttgttgccaacccagcaaacaccaatgctctcatcctgaaggagtttgctccatctatccctgagaagaacatcagttgtttgacccgcctaagaccacaacaagggcactccggtcnagatttcctgagagacttgggtgtccaaatttcctgaccgttgaaagaatgctattatctggggtaacactcctccaatccaattaccctggatgtttaaccacgccactggtgaaaacttcccaagtggagaagacctgtccgtgacttgttcaaagatggatgaatggttaaacgggattcattgccactgtccaacagcgtggggctgcatccaccaaagcgagaantctcccatgtctccccngctgccantcaacttgggattacatccgtgacnggttnctgggaaccgcccnaggaatttgttcccaaggggtgtgta

SEQ ID NO: 86082 - DNA, 584 bp, Triticum aestivum
  unsure (1)..(584): unsure at all n locations
  Clone ID: PAT_TA_86082
agctctcagctccttcccagctccacggtttccagcaagcaaaccgaagcactagatcctcgatggctcgcgtggcactggtcgccgtgttcgccgtgctcgcggcactggcggtggcggagatggcgtccggggcggtgacctgcggcgacgtgacgtccgccgtcgcgcccgtgcatgtcctacgccgagggggcaagcgtccggcaccctccgggggcgtgctggcagcggggttgaggacccctgaacgccaaggcnccacccccggcccgacccggaaagcggcgtgcaactggcctccaaaaacctggcggggtccgggcatcnanatggggtaacgccgccaacatccccccggcaaatgcgggtctccnctcctttccccatcaacaccaaaccaactgcaacacttcaataattatctaccacatatcatcacaccagctactaccantccgttcnacgttgctgtctccggcttgttcctggtttttccccaagtttcnactccacngttgcctttataaattngagcagttacggtcnaacanaataaataagttnactaagtttanaaaaaa

SEQ ID NO: 86083 - DNA, 287 bp, Triticum aestivum
  unsure (1)..(287): unsure at all n locations
  Clone ID: PAT_TA_86083
cttatcccaagcttagcatccccggtcncctcggtttctcctcctccccgaaccctcgctccatcactctctccctctcacactcnggcgngcgctcaactgaatctcgncgnaggagcantggcgtnngtgcatctgttcggccngaaaggtgtcgtcggtggcgatggcgaagccaggcgctgncggacgggctccgcatccacacttccgtcatctggcgcgtctgcgtngccgantgggcgtangctccagggttccgncgtcagggnngacatggacctgtc

SEQ ID NO: 86084 - DNA, 555 bp, Triticum aestivum
  unsure (1)..(555): unsure at all n locations
  Clone ID: PAT_TA_86084
agtcacagataaacgcatcgcgttgtatgcctccacagtagcaatggagatgggaaggtcgctatggctcgcgcttctggtccctgcgatcatggtgtccttctacggcgaaggctgccatggcggacgcccagacatcgacggcgggagggtccccgccgggacacgaacgtgctgtgcgtcagcaagtgcggacgttcccgacggtatgcaccacgccgcccgccggccgggcagcgatggcagtggtatcctcgccgtcgcctccgcgctcttgtgacnatcnaccactccaaccggccgtgccgcaccgcagccnaaagggaagggnaacccaagcggtactacacttcttcaacgcctgggaaccggccgggactgcccccttcnaangtcgttanacctangccccngggttnttcaacgncctgttaaagttgccccccgtnaagnccgggggaancattggncnantgggctggacaattacnggtangcttcaagtgtccttnataaagattcanncacgggaattgntntcgngcactaaaaaaa

SEQ ID NO: 86085 - DNA, 471 bp, Triticum aestivum
  unsure (1)..(471): unsure at all n locations
  Clone ID: PAT_TA_86085
cgantcaggagcagnacaattacangttaataacggtattcaaatctacagaagaannagtttgtcagtcaagaagcttccacctcttantnacaaggannnagaagctgnngccttgtcccnacagacagatgttcgntaaagagtgtgcatacataggctatggactgtcgctgttagtgctttcttgcgaccctttgctcatgcggtacgcggctatgcacattgttatgttaccgatcaccgttnnagcaccttgaatcgccacangtatctcgagagactctgaattgnanaagaaatgccaggtgcacgcgcacatcgctccancgagaagtggaaccattccccatgaagaggccttccagnccttcagnccgtgcnctccccgtnatcccagacnaacgccatcggcgtcacctttcnncgacgctngngacgtggacgnccagttggcaacnanacgcttcg

SEQ ID NO: 86086 - DNA, 379 bp, Triticum aestivum
  unsure (1)..(379): unsure at all n locations
  Clone ID: PAT_TA_86086
gagacgacgaaccccagcgaccagcagagcagcgcaaagtgagccatgctagcctcgccggcgctcgccggcgccacccactccttccnggccttcgtgtcgggnagccgcggntcaacctcccgtcngcctcngcgccctcgcactcgcccgcgcccggnngggccgccctgggcctcctccggcaaaaggcaaaggttccaaccccaangccgaccggcatcgcccgncaacaccnnctccggaaagaaggtgantggacaaaagngagccaaactgagcnttncccncccaaaacanatttttatcncnaggggattcnacgatacaaancatnatccnggttntgcctcaaanaangcacaagtcntttnaaaag

SEQ ID NO: 86087 - DNA, 245 bp, Triticum aestivum
  unsure (1)..(245): unsure at all n locations
  Clone ID: PAT_TA_86087
nntcctaactttccccnnccttcactnccctanttctcnaatcccacttccccagatcttccgtntcntnctttctccnatctccattctcgaatctttgcgcgcacctcatcgaacatgntacgctcatcatatgcggtgtngcncggcaagngcaggtgtcaaagatntcnacttcttccntgcgaggtggaacttnacaggctacatnancttanaaaganacacggacnttttccaacatg

SEQ ID NO: 86088 - DNA, 180 bp, Triticum aestivum
  unsure (1)..(180): unsure at all n locations
  Clone ID: PAT_TA_86088
cgcagacctctactcctcttctcccccagcccatccacccttntctccctcacnccacccacagcctgactcgcagnanacttacaangcncagcgacgcagaagcgagatctnanatggtnacggangctgacggcggcgaagtttgcggcagtangactggnactgtacgcagtcaaa

SEQ ID NO: 86089 - DNA, 631 bp, Triticum aestivum
  unsure (1)..(631): unsure at all n locations
  Clone ID: PAT_TA_86089
gcatcgtcgtgttagccagagcaagaaggggtggcagccattcgcctttgccctcttcctggtgaatataaaccaaagaggactggttctgttgagtagcctaggtgaccgggcgctcttccttagcaaagaccgatgcctatgtgtctccgccacgaaactcccttctatcagcagcaattccatctactcctccgctgcccaattcgacctgggtgtaagtgtatctcctaaagcaagcgggacatccgagcgggacacaaacgttatgncctccatacatgactgaggaanggtttcnggcctcctgtgcngcctcaancctggctggatcatctggacgacatatgnccacatttttgaggggccaaaggactaatgttcaatgagtacaatgtanacttccnccttggnaggaaggttnagaaaattacttacagncggtgaatcaantcaagtgtgtgtgnaagagagaatgggaagttgactcaaagaaaagactgggaatacangaccanactgcctanacgggaacgtcaatcggggnaccagaatgtatacagagannttcgccagatgaaatgagataaacctgggactgcaacancanttcccaaagcccaaaaggctg

SEQ ID NO: 86090 - DNA, 559 bp, Triticum aestivum
  unsure (1)..(559): unsure at all n locations
  Clone ID: PAT_TA_86090
tttgaccgttaatctttaanttatatttanatatatatttcaaggatacatcangnccttcacaaaaagaanaanaanaaaagctgctgcgatgctcagtcctcgtcnacaaagatagnctcttgcttgaagagtcccccaaacacgggcctcacctccttcttgnggagccggctgcattgntgcctgcttcaccttctgcgccancgcgcttcacgacggccctctgcggtgccagttcttggcttgggctggcctctcaccgtggcgatnttgggtcttgggatcctcctccgtccgactccgcgaaatcgctccctacngntgcaagtgtgtgctgaacttgtcccaaggagaatcaatgttaacttnagcccttggtccnggtaaaagtncccagcgagcctncgcctcgttnacggctnccccggccncttnggagnggggnccttcncttcggtttnanttagggnggttcttcgnnacaaaatcccctgggaggcaggctcctcntgggccnntttncagaantctggaaccttggggccggacaattccc

SEQ ID NO: 86091 - DNA, 630 bp, Triticum aestivum
  unsure (1)..(630): unsure at all n locations
  Clone ID: PAT_TA_86091
cgccaacccaagccgagggcgagggggaaggccaagcccaagccgaaggcgaaggccagtcccgactccctctccgccgcctcgtcgccgtccgccagcgccgggtctccctcttcctctcccgtcaaagtcggccgcggcttcctctcgcccgcctcgctggtgaccaaatcccccctctccgcggcgngccatgtccacgcnggctccgtgtccaccgtccggcgacctganggggcctccgccgcctccaacctcnattcgctcaaatgccngcctccnacncgctccaactcccantccnagatctccaaagcgcatcacnagtnaaagctgnctttcaaatggcggaanggangcggtttnannagattagaagatttttnacaaatatccccaagaaagccgacgacatnaaagnatcntncaanaattgctgacaaatgncaatctcttcctctcgtntgtgaaagggacctncccttaattggaaatccttncnaaagtannatggtnccaattggtaaaaatccaattacccggtnacaaanattntgcaancncgaattggaatncntccaantaactggttgggattctgnncatgataaaaaanccaaatttataaaa

SEQ ID NO: 86092 - DNA, 493 bp, Triticum aestivum
  unsure (1)..(493): unsure at all n locations
  Clone ID: PAT_TA_86092
cgccgaccaccgccccaccggccgcttctgcaacggccggatccccaccgacttcatcgcctccaagctggggctcaaagcaagctcctcccggcctacctgcaagcaagtcccccgaacctcaaccacccaacgacctggctcaaccggcgtcaagttcgcctcccgggcggggaccgggtaacgacccgctcaaccgcgcaactcgcctccgtcatctccaatgaagggacnantcccgaatttccaatgagtaaaaaggcaaagncccnggcccctgggctggggacgcggtctctcggaaatctccccnaaaggancttcccggntttttcccnggnaangaaaaanttgggaaaactatttaanaagngcnccgaagtccnatcnaaanccaatagntcctcatcgtntcnaagccggcttcctcnaaaggtgtctcncngggggcaagcaatggcanatnaatgccccatcgnggnttcctccaaag

SEQ ID NO: 86093 - DNA, 300 bp, Triticum aestivum
  unsure (1)..(300): unsure at all n locations
  Clone ID: PAT_TA_86093
cgccgaccacgggcggagtgaagaagccccaccgctacaggccgggcaccgtggccctccgggagatccgcaagtaccagaagagcacggagctgctgatccgcaagctgcccttccagcgcctgggtccgcgaagattcgcgcaaggacttcnaagacggacctccgcttccaatcccacgcccgtgctggcctccnaggaaggccgcccgaggctactccgttggatccttccaaggacaccaaccttgtgcnccatccaacgccnaancgcncaccatcatccccaaagacatccca

SEQ ID NO: 86094 - DNA, 618 bp, Triticum aestivum
  unsure (1)..(618): unsure at all n locations
  Clone ID: PAT_TA_86094
gagacaatcccccagacgaggcgacaccggaccgagaagaggcggacggcggcgatgggcggcggcggcggcacgacgtacaagggctacaccatcccccacaacaagcgctgggcacaccatccgccggcaagggctcctgcgccaccatgtgggttttgggttttccnacaagggctaaacangacggcgctgtgctccttggggtatgcctcatcccttggggatggcatgatgatcaatgcgcatggtccatggcatgcacacgagcaagaggtncatcgtcctcatcgcctccccatttgactcnaancctnaaagtngctgacaaaaacctgaccancccatgttttcnacgcaancccccggcnaatnaaaacanccacaactaccattttcaccccngttgttggcaanaattttttttttcanaaaacggttngtaagtattttggttnggactggggtccctgggaangttccgnatnactnttttccaatggnanacccangttnccccncccgnaaatcncgaaanaattaccgtcgtnnccattnaanatccnacctacgtttaaaggggccggacaatcccaagggnttaccccccaggctttt

SEQ ID NO: 86095 - DNA, 611 bp, Triticum aestivum
  unsure (1)..(611): unsure at all n locations
  Clone ID: PAT_TA_86095
cgatctggcgcggtggctcccgttgacgccgtgtgcccccggaacctctcatgcatcctctcagccacacggcccaccaacaccatggccctctcgtcaccatctcttccaccccatccccatcttctccgatgccgacctcggcaagcatgccggcgacacatctccctgccccctcctctgcgcattaagtcccaagcgcccaaatctccaanaccccctcctcctcgnccatctcctccacccctgtcccgtctcctgccgctggaccngccgccggtatgtgttgnttcccttgggcggcggcnttccgcatatcctcctcctccttccccactgtcactgaancccccatgttgaggtgctagcttggngtcgntnccaacctcaaccctcncacncgtgccnctccaaatcatttttttgttaccaagattcattcgtgcgtcaagtcnaanctccaaaacaatctgcagatngaatcaaatataanaatgggtagcantggatcagtgctgacanactaagacaaagctgtcagcaatcggggcaaaatantngggaatntaaccaaatgtttaanagtcagaacnntaaaagggnaattttng

SEQ ID NO: 86096 - DNA, 573 bp, Triticum aestivum
  unsure (1)..(573): unsure at all n locations
  Clone ID: PAT_TA_86096
ctccctctttgcttcgctcgctgcttcttctcttgtttccttttctcctctctatccaactcccactctgccacccataaattccagccaccaccattgaattgagtcgattgcgcagaattcttgcagctgatcgcgccggaagctccgcatccgtacgagatagtgtgtgtgcctagataacacgtacatatacatgggctgcatgggctgggcgcgcccgggcgccaaggaggtccgctagcgaantngcgcaaccgtggacnaaggcatgccttgactcctcgacggtgctgggtctccggggtgccatcaagggaccaaagcagggntttgctcccttccnggcgttncgnaaggaatacgccgccgccgctgccgtcnaagagccggagaatggcttnccgcagcgntntgcatttggtaattccctggaggantttcctttgtggggaaatgnttcctgcaaaanccaaaggaaagttaatgtacgtgtctgacacatgggggacattaagatagtcaagagcatangatgcctaaattnatanaggcacccaataggnaaantca

SEQ ID NO: 86097 - DNA, 637 bp, Triticum aestivum
  unsure (1)..(637): unsure at all n locations
  Clone ID: PAT_TA_86097
gcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctgggcgccatccgcaagggtggacacatccgtcatcaaaggcccgtccctgcaaggttgtttgaggctccacctcccaaagactggggaagcatgggtcacgccaaagtgtcacttttgttgcatttgacatcttttaaatggnaaagaanttngaggataccttccctttcatcccnacaactgtgactccccccatgtttgaccgccnaagattncaactggattggacataactggatgatggtatgtcanccttcncnatgagantggnnacactaaggatgacctganttcccactggagatntccgcttggcaatttaanacggtttnccgnagggaaggctgnccttccgtgattccgccaggtgnaagaantttccntgaangaanngtggtggaagtaacactgtcgtggtgctactgcanacttgaacangcttcggtgttgataaataatggataaganactgttgtaaaatttgtcaatttg

SEQ ID NO: 86098 - DNA, 408 bp, Triticum aestivum
  unsure (1)..(408): unsure at all n locations
  Clone ID: PAT_TA_86098
catcgggagccccctctccatactctccccagatgacccgccggagacggtgaagatgaggctgaagcagtgggcgcaggtggtggcgctgtccatgcgcagccgctcctgaaccaaccagccatcaacaactccgtggtacgccaacgtgaaagctataccgaatcaagaggagggacaaccagcgacgcaagaagaaaagatcatccctccctggtccgagatcgaagaagcaaccaatggatgagcaagcaagcaacgagaagagtctataggtgcctccggcgtttggcanccgcttccaactggtcctggacgcacttggctactatacttacctgctctactaaccatttccnncaattttaccgttganattcnaaaccatatccgttnaaaaaaaaaaaa

SEQ ID NO: 86099 - DNA, 648 bp, Triticum aestivum
  unsure (1)..(648): unsure at all n locations
  Clone ID: PAT_TA_86099
cccaagtcataaacccaagtcggactcgccttcctcctcccccaactactcctcctcgcctccgcgcatcgcaccgcaccgggggtcacctgaggtagatcacatacacaatgggtgaaaggctgttggctgtgcttaaccggcagtgagggtgtcaaagggcaccacttcctcaaccaaggaagggagattggcccgaccaccgttacgggaaagttcaactgggctccaaaggaaagggtccaacgttccaagtgcacntccttggggtgacaccaccaatgggtggatgtcnaactgggccaacttttaaccccgcttggcaatgtncnatggggacccgnnaagatgaacccgccagctggngatctttggaaatgttacantggnccgatggnttgccnaatcaatgttactgacggcnaaccccctttactnggncaatcnatngttggccttctgttgcctccatgggganctgatgnctgggaaggtggcattacttanaaganatggaacctgggccgtntgctgcggaacacgggtcaagntaatgcaantcgcgcaagtctaaatnggaacnttaatganttnanccatcaaagcnaanttttgncttnggcattcaganccangncccatttaaag

SEQ ID NO: 86100 - DNA, 626 bp, Triticum aestivum
  unsure (1)..(626): unsure at all n locations
  Clone ID: PAT_TA_86100
acgcatccccactttatctttgcgcgcctgaacccggccgtccctaacctcccgcaggacgccgtcccgacgacctcgcggtcgttattagcatccgaccaacgcgcttaacgcgcaagtggtggtggtggtgaaggcgtacactgaccgaaggcaccgttctccatggccccgaccgtcgcctccccccagcnacggcgccncccctcgccgttngcgancactccgggaaaggcgcncgtccctttcgntccggtcccccgcgctgnccgccgctgcccgctccgcncccaacggcancccgctcgctcccttcnnntaaaagtccccnagacgttggtgtcaaatngcgcccgttacccngcgcnccgctggcccgacacgccgactttaaagntctttcaacngtttgaacagatgggacaantggagaaanacgccgggacagctccgtttccgcangtcggantngacccgcggatatncggatcgaaagtcccgtggtcagtccatgagccttgaatggtnacggtggttgctnaaaactgtntagccaaagaaggttctccaagcagaatttagttacangtancataccctnaagggcccattaacnantccaaggg

SEQ ID NO: 86101 - DNA, 525 bp, Triticum aestivum
  unsure (1)..(525): unsure at all n locations
  Clone ID: PAT_TA_86101
ccaagaagggcagcctgggcaccatcgcgcccatcgccatcggcttcatcgtgggcgccaacatcctgttgggccggcgccttctccggcgcgtccatgaaccccgccgtctccttcggccccgccctcgtcagctgggagtgggggtaccagtgggtgtactgggttncggccccctcaatcggcggcggctcgccggcgtcatcnacgagtgtcttnatctccngcacccacgagcagtcccnaccaccggactactggagcaagcgagttcagcgcagcaagctggttgcttggcctggnaanccgccgcctgcctgccgtccgtccgtgngatcnagatcgctcnctccttcccttgccatcacatganccgttattttcttcctgggccattatttggnggtgattccnnggnctgttaacgttgggacacatgtcatttgcttcnngtaaacggtgattccccttcccgcccgatattcaagttgagttgnntaaaaaaaaggggggccggtaccaatc

SEQ ID NO: 86102 - DNA, 386 bp, Triticum aestivum
  unsure (1)..(386): unsure at all n locations
  Clone ID: PAT_TA_86102
gcgcaccgccgccgagcccccgacgccgatgacgctgctgcacgcgcgcggcaagaccaccgcggcgcagcacgtggcggcgcggcacctcgaccacacgttcgagaagtccgtggcctccagctcccgtcgtggcggcgtcgccgctgctccgatgcgtcccggggcatcgcccngagccgtcgcgtccccggactcgcccgccgctccctcttcngcttcaacggcggnggccgtccantnctccgctcttcccgcgcgttttcacttcgcccctnttccgttttcccatggntacgcgcctgcgcttanccttggccgttngaactttccccgagcgccgggnnggagttcnaagttcttgcatntcaattcgtnccgttctc

SEQ ID NO: 86103 - DNA, 542 bp, Triticum aestivum
  unsure (1)..(542): unsure at all n locations
  Clone ID: PAT_TA_86103
ctcgagcagctgcaagccctctagccgtacgccatggcgcacgccgccgccgcagccgccgtgccgctgcgccgcccgctcctcctcttcctccggcccgcccgcctcctctccttcgtcgcgccccgctcgtcgtccgtccgcgcctacagggccnccctcncgccccctcgcccccctcccctccgaacgacgaaggacccggaacgaacggcgaacggcgcgcccaagccgcaacgaagaagaagcgggaaggccgccgcgcccgtggaagtggggcatgggagtcgccaantctcccctccccagttaaagcgcatcgtcagggccgcgtcgctggagcgccaggtggtggacntctaatgctgggtgaagaattcgggccgatgncgcaaaaggaaggagaaggaattcaattacatngggaaccgccacgttcgccggtttccccgtaaagtcnaaacgggggtccctttangttcngattaangtttagggactggacccaaaaatnnttggtaaggtaagtagnggcatnccta

SEQ ID NO: 86104 - DNA, 659 bp, Triticum aestivum
  unsure (1)..(659): unsure at all n locations
  Clone ID: PAT_TA_86104
gctatatacctacatagcacagccatggcccccaccgtgatggcctcgtcggccacctccgtcgctcctttccaggggctcaagtccaccgccggcctccccgtcagccgccgctccaacggcgctagcctccggcagcgtcaagcaacggtggaaggatnnaggtgcatgcaggtgttggccatccgaagggcatcnaagaantccgagccctgtcctacctgccaccgctcnanacgggaggcctccctccaagcaagtccgactacctggatccgtcccnaaatgggngccttgcctccngagttnanaaggttgggtcancttcccgtggagacaacgatccccctgggtactacgatggccggtactgggacatgttggaactgctatgttccggtggaaccgacccacacaggggtnaacgagtggnaaangccaagaagganacctggngcgtactccngannacgggttcnnnaaatcgcaanngnatgctcaantcaacgctttaaacaacgggcncaaggatccggaaaggctaaanagtaatcacacgggcanattaaatgcattnggtttgcaancgaattgcttggtttcctccattacnttctgntgncnaaaanggtngccagtnancaaattccnaaaagcct

SEQ ID NO: 86105 - DNA, 499 bp, Triticum aestivum
  unsure (1)..(499): unsure at all n locations
  Clone ID: PAT_TA_86105
tcgagttttttttttttttttttttgaatgacactgtgaatgttttttcttaacacagtacagacgcaagggttcatacatacacgcatacaatcacccctatgaacacacacaagcacaccttatctctatgagcatcttcaacaaactgagctggcatatcatcttaagattacgaatcactgtaccgctccgtccgtccgacggggaataaatgacactcctgaatggtttgaatgtcctggtggaaaccgagcatttttccttggtgaatttgaaatttgnccgtatattttttagcaaagaaaatgctcccggcccacctttgacnattggtgtccaaccacactaccaccatgccgacggttacaaacgaagaantanacactantatgtcaaccggacggcgnatgttagctgccaacggaacctttcagggaaggacggatccgggctcaanacgcanacttgacanctnccaaccgacggncaagntgca

SEQ ID NO: 86106 - DNA, 311 bp, Triticum aestivum
  unsure (1)..(311): unsure at all n locations
  Clone ID: PAT_TA_86106
cgcagcggcacctgctccaagcaggtcgtcatcgccgactgcggccagctctagatccgcccgcccgccggtcgccgtcgtcgtcatcgccccgtgtgtcccgtgtcgtgtcgtcntcnaaataagagagtcgtgtgtcgtgtcttcccctggcccncccgatgagattccgttggttgggtnagaagggtttaagtnggtcttttgggccgctggattttgcncccggcggccttgggtnactccccggggnccgctgcnacctaaccgttntgaangagatgaanccccgctnaaaaaaaagggggggc

SEQ ID NO: 86107 - DNA, 475 bp, Triticum aestivum
  unsure (1)..(475): unsure at all n locations
  Clone ID: PAT_TA_86107
aaacaaccctagccctcgcagccgcagcggcgcgcacccctctccctccttcctgaagacagcgccgccgtcggccagagcacaggatggcgaccgtccccgctcccgcagccgagaccgcggcctccaccgcgcgcacggtgaaaggatgtcaacccccacgattccgtcaaaggcctactcccgcgcacctcnaancntcccggcaagatggganttcccagagtgggtttgacatttgtccaagactgccaaggttcnaaggagcttncactttcctgatgctgactgggtactacatcaaggtgcctccnatggaaggaaatttaccttgaggcaggatccggatttggcgtttccagaagatttacngtggccttcaagagacgttcangccnacgactttttgcnagacattgggcnttccccggnaatctccaaagagtncanaaatggatcatgagttcacccaagg

SEQ ID NO: 86108 - DNA, 409 bp, Triticum aestivum
  unsure (1)..(409): unsure at all n locations
  Clone ID: PAT_TA_86108
tctcctccttcctcctcgtcctcaangcnangaaactcctnatctcaaccgtcngcccgttnaaggaaggaggcattnggcnanggggaaaantttgctgaagcaaganggaggacaaggcggggntcaaacttctngcncttgntaatggcgccttngncaacaatgctgccctccncctcctgtccgccggccgncccgggcaaagcgtgcgtcctnctccccgtgctaactgacctgacctgactcaatggtgcggtttgtngggancctcccattnnggnggcgcttgnaagnaagnaaantggtggngctgttggnagcgtttgtttngtttggtgcctattttccggacggagcctttttngcggaaanatacccaattttttggcgantccatttggnctgt

SEQ ID NO: 86109 - DNA, 410 bp, Triticum aestivum
  unsure (1)..(410): unsure at all n locations
  Clone ID: PAT_TA_86109
ccagcccaacaccggcgcggcgcacgccagctacgccttcaactcctactggcagcagttcaggaagaccggggctacgtgctacttcaacaacctcgcagagcagaccatcaaggacccaagccacggatcctgcaagttcagcagttcacagggctgattggatccacacaaggaggaggacggcgagggtggtgtattatgatcctactggatgttccccaaacctttgcgatgttacnagtgatagctgaccncccntttgccnttttcccntggngggttaagccgctgtcatttccttgtttcnaatcattcaantactgtacnccatccattggacatttnaatgatacatccngatcttatttaccacgggtcctcnctaccctnncaatttgggaacgaac

SEQ ID NO: 86110 - DNA, 508 bp, Triticum aestivum
  unsure (1)..(508): unsure at all n locations
  Clone ID: PAT_TA_86110
ctcgaccgccgccgccgccccctctgctgttgaccacgccctccaccaccacccctttggttgacctgtgtgaccccatcgggatctatggcggcggtgcttggatcttggcgtcgcctccctcgatacgcctctgatgtgcgaggtcgtcgtcgcctccctccattccgacaccaccactnagaactgggtccgatgatcccancccctccactcttcctttacggtccaccacgccgaacgagataggcggatcccccaccaacggttcctcccctaccaaacggcgagcgtggtgtcccatctcctactatggctgggtacatatttcctccaaatncnccttgggngggaacccgatgcaagggctattagtgaaagattggggactggtcctacagngttgtttgttcaaagatccctggtgtccntgatttgnnaaggtttcaaccaaggnaaantattacaactgacaaaggtacacatctaggagatttnnatggaggaa

SEQ ID NO: 86111 - DNA, 543 bp, Triticum aestivum
  unsure (1)..(543): unsure at all n locations
  Clone ID: PAT_TA_86111
atcagaagagtcttgcatggatctatcatgtgatgtgacactggaataattggcctggagttcaccggcgtgaccgagcgcagtgcaacggagcagttcaacacgtgtttgcacatgactgccatggaagaggatcttgctggaacgctgccgtttcttcaagttgggatttgtcaacattcctataaccttggattgccgctgaacataatggggattctacacattatcctgctgactttgctccacaggantccttcccccatttccccctttggatgccttttccttcccngaatgggaaaattanctcctttaaaantccaccatggttttgggtgttaagnagactgggttnanggttatatttttatgcccccaaccaatgtgtgtgctaatganatnaaggtacnaagagaagggtccnaaaaggcngcaatcctaacgncaaaacaatgagcacaatactaacattggggacctggtaccacgagacaatttgcgctgantgggttatcantgtgcgaatagtctcagaaaaaa

SEQ ID NO: 86112 - DNA, 403 bp, Triticum aestivum
  unsure (1)..(403): unsure at all n locations
  Clone ID: PAT_TA_86112
gtgaanccttcctctccgtcgncctttgccccctgttacntgnacnttgtgattangttaangccgcnttggcnancgctttcgcngtcctttcctcaaacctcnattgttnagcnacttcccnangccctgccgccacctcaaaatgcttnaattattgggcncctccaagccttggagtgtacgtttggtgcgggcgtggcggttagnaccagccaagtttttggtgtntccaaattctcccgtgagccgttacnaccaagagattcttgggagaaatggtttccgcccgactttggtccgacgccttcggttccccctngccgcggcgacgaacgggccgatggcgggtctcccccgacgtccncctgcccgtntccgcnctcctgcctggagcngaatc

SEQ ID NO: 86113 - DNA, 385 bp, Triticum aestivum
  unsure (1)..(385): unsure at all n locations
  Clone ID: PAT_TA_86113
cccagctcggtttttgggccattctaagccaccatgcctgcctccatcgccttcggtcggttcgatgactccttcagcttggcctctttcaaggcctacatcgccgagttcatctccaccctcatcttccgtcttccgcccggcgtcnggctctgccatccgcctactccaaaggtgagccgcggcgcgccgcttggaccacccggctgattccccgttggcgattctgncaacggntcncggctgtcctcgccgtccgccgtccggcgccnaacatctcccgggnggcatgttgacctgccgtcacttntcggctcccccttcnggcgcaagnttacatccctcaacnggaccttctacgggnttgccaancctccnggggcat

SEQ ID NO: 86114 - DNA, 582 bp, Triticum aestivum
  unsure (1)..(582): unsure at all n locations
  Clone ID: PAT_TA_86114
atataatttattttttggnaattaaatcaagggtcaaaggtagaccaaaaatacaatagggccaaaaatacaatatagggctaataaaccnagacaaaggtagttaacaattggaacttgaacttgagcaccttcatcttcatccaatttgtagagtatcgcgcctnccnacacttaattgggcaccgnngctcccttggnancctcctttncccgaaaggcgggacagaaaaggcctccccaaccccggttggggccttgaaggtgatctttggagggggtcccctttgtcgatgtacatnccccagaggtnatccagatgagaccccttgccctttaccccggcnagccttcancttgcgccctccacnaagcncactcaatggggtacaactntcccattngcttnagtgtcnttnacgctcntnttgggnaaccaaacgagccgtngncgttttacccancncattcgcaacggaacaancaacggatgtggccggcaacaatcacggctttcgcgaaagacggccgtgaaactcgaactcctcnaccccantgctggcacccacgatgancancaac

SEQ ID NO: 86115 - DNA, 265 bp, Triticum aestivum
  unsure (1)..(265): unsure at all n locations
  Clone ID: PAT_TA_86115
cttttcttcgtgtctttactcttgcagatcgcagatccgctccggtgagaatccgtcgccatgtcttccagcgaggtcgcctgcacccttgccgccctcatcctccacgatgacgggatccccatcacttctgagaagatcgcgacggtggtgaaaggctgccgggaatcaagtttgaagcctaactggncccgcgtcctccgccaantcccttggagaaagangagcgtccgaatgactcaacctttcccnccgatctgtgagg

SEQ ID NO: 86116 - DNA, 593 bp, Triticum aestivum
  unsure (1)..(593): unsure at all n locations
  Clone ID: PAT_TA_86116
aaaaccctaacctgcgccgccgcgctcacagcaaccaagcacaccgccgcagccaccatggcagccgttctcacccgcccgacgccgggcaccgtccagtgcttcggccggaagaagaccgccgtcgccgtggcctactgcaaacccgggcgcggcctcatcaaggtcaacggcgcccccatcgactcaatccgccccgagatgctccncctgaaggcttcctagccgttcttctcgccggangcccgtttaaaggacatccgacatgcgtatcccgctcccgcggcggagggaaagacgagcagttttatcccacccgccaagcacgcgaanctctcctcgcctactaccagaantactcngacgaagcggcnagaagagtgnaggaatnttcngcngtacacngantcctccttnccaccggcccgctgcacccaaganttgcgncnccgtcccccgctttcaaaatcctacgtttactccgnaantctgttgggtanggggggggctancctnccngcaacancactttacgcnaaaattgtttttgacaangattggnngattcaaaanggnttttcaaaaaaaaaaaa

SEQ ID NO: 86117 - DNA, 337 bp, Triticum aestivum
  unsure (1)..(337): unsure at all n locations
  Clone ID: PAT_TA_86117
cacaatctcatccgccctcgccctcgccctccattaccaatcttccgtcgcctccccttccttcaaccatcatcttcgcctataaacctctcaccacccaagaaccgacgtaggccgggcgctcaaacgaagaagaaccgacgagtttcttcaatgtccgagccccacgcacgtcccgcaaggcctccnacctccgccgcatgaaaggccaagctgcagggcgttctccggcaccgcctcctcctccgtcaaccggctcgccgccttcctcctccctatcttcggccggaacntcttctcctcctcctccccgtggtcctttgggccgctnccccgg

SEQ ID NO: 86118 - DNA, 268 bp, Triticum aestivum
  unsure (1)..(268): unsure at all n locations
  Clone ID: PAT_TA_86118
ggtgagtgtgcctggcggcggctgctgcagcggcgtgcgtggccttaacgcggccgctgccacccccgccgaccgcaagaccacctgcacctgtctnaagcagaaggcgagcggcangggcggcatcaaagcccaactcgtcgccggcaccccggcaatgcggcgtcaacacccctaacgccaccancaaagaaccgatgntcccaaggtgctttaagcgtgaaccggaccatttnncnagtgcatggtgagagcgaaataaccgtgg

SEQ ID NO: 86119 - DNA, 285 bp, Triticum aestivum
  unsure (1)..(285): unsure at all n locations
  Clone ID: PAT_TA_86119
cctcgccgctctcccttccttccgctctcatcccctccccctcccgtcgccanggccgtctcnacctcnacctcnangctccnactcctcttcctcaaccgctcnaccgcaagcccgaacccctcggcgctctccttcgcctcctccctccgcgcgtccccgctgcgctcccgcgcctcccgcctcccgccgcccgcnagccggagaccctccgccgacgacctgncctcccgacacnccccggtttggggagggtccgggaattcccgatccgttctcgattga

SEQ ID NO: 86120 - DNA, 418 bp, Triticum aestivum
  unsure (1)..(418): unsure at all n locations
  Clone ID: PAT_TA_86120
tttttttttttttttttttgactaacatatgcttgctgcttcgctgacaatacgctgatttgttacatcatgtttcctacaagcatgatgggaagaaacaaaaaactcctcctgccttcttccagcaggaaggttcaagaagtgaagcaagataagctaatggctgaaaccaagactgggcatttcaaatgttgctgtcaaaccttcctcttgaatttgggtaaggtggggaccctcccnacaccttancttcccctttcaaaangagatacacaanaaggactaaagtacaaaaataaggaaggccaactgctgcacccttttgggaaggttttttcccggaattccnantttaaccacaaangctggcgcgacttttccctggggnaccccttngattgggagacnagngatcttc

SEQ ID NO: 86121 - DNA, 525 bp, Triticum aestivum
  unsure (1)..(525): unsure at all n locations
  Clone ID: PAT_TA_86121
ttgcgctgaaagttcatcaagcaactatgaagggcaccaagctcgcggcgatcctgatcctccaggccgtcctggtcatgggagtcctctcgcacgtcaacgccgacttcttccccaagtgctgcaacaactgcaggtccttctcggggggtccgacgtctgcgacgacgcccaccccaagtgtcccaagggctgctcggcgtgccgcgtgggtgtcgacgagccccgaaatgtggcgctgcgccggatatgaaatccaccgttcgacggcacctgcggtgggaccctgcaagaatactgattcgggttcaatgccggatatgatatgttcccgcctaaaatttaataaaactcngacgagatgacaggtcacctgcctagctgtgtgttgtgacaacaaatattttacaattattccttcttcnccctgttttccccccnaaaaaattgggttcttgtgttaactaccggaannccncgtgaanaaactgtntgatgtctggcgcaatatgtaaaaaaaaaaaa

SEQ ID NO: 86122 - DNA, 163 bp, Triticum aestivum
  Clone ID: PAT_TA_86122
tttttttatagtaaatgatttcatatagcacaattctccaccctcaaattagacaatgccttgtatgtactacatttgagctactaattgtgttggaaacacaaacgtggggggggcccgggtacccaattccgccctataagtgagccgtattacgccgcgc

SEQ ID NO: 86123 - DNA, 372 bp, Triticum aestivum
  unsure (1)..(372): unsure at all n locations
  Clone ID: PAT_TA_86123
ccctcaccgccgccgccgccactgcgccgctgccgccgccgagatgggtcgcgtgatccgcgctcagcgtaagggtgcgggctccgtcttcaagtcccacacccaccaccgcaagggccccgcccggttcaaggtcgctccgacttccggcgagcgcaacggggtacctcaaagggcgtcctcaccgatgtcatccaacgaccccgggcgttggtgcgccgctttgcaaaggtgactttccgcnacccgtttaangttnaaanaccaaaaggactcttcttccccncccaanggtatntanaccggcaatttngtcaaanggnggacncnggaaacctctcngttggnaatttctcccnntccgccctttcc

SEQ ID NO: 86124 - DNA, 387 bp, Triticum aestivum
  unsure (1)..(387): unsure at all n locations
  Clone ID: PAT_TA_86124
ccaaaatccccaactgcaggcaccactggctccggcgcaatttcaaagcctcctccgctctcgagagatgtgaaggccgccgatctaccgggttagtgccgagccgcctctcatccctccgccgtcgccccacaactgccgatcgtaccacgttaggtaaatccgaggtctgcgatgtgacctagttatctataggactgccaccccntttgancatccactttcctaactgatcctaataagcgaagtcctcctgnccctcccaacgtgccaanagatccccgaccctntatgtttgccatacctggcaagganaacantngantattccattcccaaagagtgaagaatttcaagggaaagnatggtccnccaacgggagttaat

SEQ ID NO: 86125 - DNA, 548 bp, Triticum aestivum
  unsure (1)..(548): unsure at all n locations
  Clone ID: PAT_TA_86125
gctaaacaagcagcgagcaatggcgtccacctcctgcttcctccaccaagtccaccgcgcgcctggccgcctcggcgcgccctgcgcccgccgtcgggcgcacccagcttttcgtctgcaaaggcgcagaagaatgacgaggctgcatctgacgctgccgtcgtcaccagccggcgcgccgcgctgtccctcctcgccggtgccgccgccatcgccgtcaagtctcccccgccgccgccgcctacgggngaaagcaccaacgtgtttcngcaaggcgaagaaagaacacgctttcttggcgttaagcgggaaggggttcaaactgatgattcccggcaagttngaccccaacaaagagcgtgattcccttggnaagtntccctacgaagaaattnngacgcaacaaaanctccgttatatcaacccatacaagaaacancacgatangtccctgaggattctcccaagtngntctctcgcaaaatctacggggaanacnctcgaggtggtcatcaaccttgnaaggaanttttgaaatngcccgtggg

SEQ ID NO: 86126 - DNA, 547 bp, Triticum aestivum
  unsure (1)..(547): unsure at all n locations
  Clone ID: PAT_TA_86126
ccacgatccaccccacgaccttcccccgatccttccgcggcctcctcccggcgcgccgccctcgctcccgcctccttctgacgtgccgccaccctgccttctccgccgcgccgccgccccctccccccgctggcaccttccccacctgcgtccaccttctttcgccacccgcgtcgaccgccctgcccccgaaaccggtcgccgcgccgcctctggccctggaacgggccgctgcgccgcctccgcccgcggattnggcagcgcgccgtcgccaaggctctgggatcccgcccgccgcctcctacggcgcgaggcatccctcaactccgtcgcgcaaccgccgccgtctggtctggatttgccgaagctcctccccgggnatgcacttctcctccaacccgacacgggnacaactgggcgccgaactaaatncgccgcccggtgctcaaggcgtntgctccaaacggtggtcgcatcaaccggtcaaggtgcgccaatgccggcataccacaagtttctccaatcaaantaancacgtgggaaatcc

SEQ ID NO: 86127 - DNA, 610 bp, Triticum aestivum
  unsure (1)..(610): unsure at all n locations
  Clone ID: PAT_TA_86127
gagaactagtctcgagttttttttttttttttttaaaaataaacaagatgcttctaaactgaaagatgctatgtacaaccgtgtctaaaatgaatttcctgggctagacaaacttgctccaaaaagaatcaactaaacaaacaccaaatataagaatcaatcgccgtcgccaacgccaagccattcccggaatccagcgaggattgcaccttccacaatgggacaacgatatcaaattgatcaccaagaactacaaaccagagaactgatgccggactgctgggtttcccttctcaattgctgacttccttggncangcttcaacttctccaangacaaattcaanacgccaagttttccaccccctgcatgtgaacgtcctaagattcaatgnggaattcncaaacctcaagtaannntgggggggggcccgtaccaatcgcccnanatgancgattaccggctnacggcctcgtttaaaantcnggacgggaaacctgggtaccaantaacnctgagaancccttccaanngggtaaacaaaggccgacgntgcctccanattccaccnaaggaatggaccccntcggataaccggggtgnngtacca

SEQ ID NO: 86128 - DNA, 460 bp, Triticum aestivum
  unsure (1)..(460): unsure at all n locations
  Clone ID: PAT_TA_86128
cgcctacgccctctgccgccgcagccgcagccatgggcgcgtacaagttcgtgtcggagctatggaggaggaagcagtccgacgtgatgaggttcgtgcaacgcgtgcgttgctgggagtacagacagcaagcccgccatccgtcccgcatcaccaaggcccaccccgccccgacaagggcacgcctctcccggttcaaaggccaagcaagggtatttggccnaccgtacccttgttagacttggtggcaagaagccccaatgcccaagggtattgtttaatggaaacccnanacaaggtattacccacttnattccccagngaaaagagccttttccgnaggaaaacttggcnnagtttggtgcttcngttaccaancccaacgggttaanggggacccactanattnttttngggaacctngtnaatttgcaaaaagtttccnaatgnccaaggtaaa

SEQ ID NO: 86129 - DNA, 582 bp, Triticum aestivum
  unsure (1)..(582): unsure at all n locations
  Clone ID: PAT_TA_86129
gacacactatcctcagcatatgatcttgatttaaagcagctaggtccataattacacttgattaattcactacgctattgttttgcagttaatgacccctttgtcatgaaagcatgggcgaagacatacccagataacaagcatgtgaagttccttgctgatggagcggcagcatacacaaaagcacttggtcttgagcttgatcttaagtgagaaaggattgggtctccgttcgaggcggtttgctctccttgctgacgacctcaaaggtcaccgtcgcaaactcgangaangtggccaattcaacaatctccgggtgccgaaggagattctcaaaggcactggaaggacttcaacgcttcgggatcgcagcgatnaccaaaacttgtgtcatacnatgtaatttgnacttgtccgccaaactgcntgggaataaatgtccatgtgcattctcaagtncttaagtgtggncaagtgactcaaantttcaatcanatggtggttcgtgcaaacatccgaaatgtnaaggaaatgggtngtggaattggtgatnacatactgtaatacangaaaaaaaaaaaa

SEQ ID NO: 86130 - DNA, 588 bp, Triticum aestivum
  unsure (1)..(588): unsure at all n locations
  Clone ID: PAT_TA_86130
agcccactcgtagagagcacgcgcaccggacacgcacgaagtctcctcgaccaagcgaagcaatggcgaccaccgcgatggcgctctccccctccgtccttcggccgggaaggcggtgaaaggacctgccgtccgtccggcgctcttccggngaaaggcgcgcgtcaccatgcgcaaagaccgccggccaaagccaagcccggtgttcgtcccggnancccgttggtacggttcccgaccgcntgctctacttccggcccgtctcccnggcgaccccccgacttactcaccggtgattcccccggcgactacgggtgggaacgncggctgtttggccaccccgaactttngccaaaaccggacttggggtatcnatgccggtgggcagctggnctctnnggtgcttttccccnactgtcgcccgaanggtnaattcggtagcctttgtnaaaggccggtccaattnagnagggggntgatactggaaccaactctcaagcnaaaatcttcattggccncaantgtntatggcccttaggtangctccggggccctcgnaattncaccntnacggggattcaccctggc

SEQ ID NO: 86131 - DNA, 602 bp, Triticum aestivum
  unsure (1)..(602): unsure at all n locations
  Clone ID: PAT_TA_86131
caaagctataaaaaattatctacattatctttacaacaaaaatgcttaactgtgtatttatggaattgtacaaaatttatttacatattcatcatagcaaaaatgtgtcattgattatgcacattacataggtgaattaatctccaaatttggatgccaatggattattcacccaaatgaagcatgtggaatcaagaataaccaaaaaaatcacaaactcgcttctgtcccataatataagacgtttttggcattgtgtactgccagaaaacgtcatatattatcgaacagagggagcataatggaaccatatctggatcatttatgtctcttaacttcctcgggttgctattggggtgatttttttaaggattttccttcacaacaatagctataatagatttgttacaacaaaatatcaaatgatcatgttgtgattgtcgcaaactaactacaaagaaaacggacaagaacttcatatatattaaccgtatgaaatgtggaaatancataatcaacactggtaanatatcacaattgacaggactcatataactacccggcctctccgtctcggaaggacgcgaacccnaggggccgtc

SEQ ID NO: 86132 - DNA, 278 bp, Triticum aestivum
  unsure (1)..(278): unsure at all n locations
  Clone ID: PAT_TA_86132
aagtcaaggtctgcaacacttttgtacaggggggcaattcttgcaactagaagattaggggggacggaggtacagagagggaaatcaactagttttagcagtaaaagaagttcatggccagaaattctgggaacaacaccttttttaccttccctgttttcaactggggggaaacttgcccagctacaccattctccttgcccacattccttccagatttattgcctggatncagcatggaagaatggcaagacacattttttttnaaaaaaaaaaaa

SEQ ID NO: 86133 - DNA, 441 bp, Triticum aestivum
  unsure (1)..(441): unsure at all n locations
  Clone ID: PAT_TA_86133
gcccgcggccgcgccgatcaccgctcccgtcactcccgcccccgtcactgcccccgccgcagctccaccaactcccgctcccaagcccaaggccaaggcccctgctgcagcaccacccgccaaggccaccgcccccgctccagcagcgctccctcccaccgtcgaagcacccgcggcagcgcgccaacgtcgtcccccgaggtgctgccgccgcgccggcccgctgaccaagccgaccgacnccccnntcccggcgccgtccaaagaagaangtccgtccaaggacaagaagaaagaaaaggcgccgggccgccccggttcgccgcgccccgttnaagcnaagcgttgggccacangnctttngcgcgnnggtccccggcccaacgggatccaacgcgncnanacggcacgcccgggaaaggacaccggatggcggggctt

SEQ ID NO: 86134 - DNA, 558 bp, Triticum aestivum
  unsure (1)..(558): unsure at all n locations
  Clone ID: PAT_TA_86134
cctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatnaaggtgcatgcaggtgttggcccatccaagggcatcaagaattncgagaccctgtcctacctgcaaccgctcaacacggaggcctccctcaaagaagtcgactacctgattccgtccaaaatggggtgccttgcctccaattnaacaangttgggttcatcttcccgttgnnanaacgcatcccctgggtaatnacatggccggtactggacaatttggaactgcctatttcggtgaacgnacgcacaaagtgntnaacangtggaagagnccaaaangggtacctgaccntagtccngataancggttnnaaaaatcccaagngatgnttagttaacncttaancaanggntgnaggtccgaaggctaaaatnatcacagggcaaat

SEQ ID NO: 86135 - DNA, 423 bp, Triticum aestivum
  unsure (1)..(423): unsure at all n locations
  Clone ID: PAT_TA_86135
tgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcattttggtcaactctggacattgctttggggtttccttctccatttatctttccttatttgttccctaaagaatatgtgtatgtcccatgttcatgttnccaacatggctccnaagaaacatgctccgtatgtnaaatgctatcngtggntatgtttatgcacggacgcataatatntncaatattcaactatatacttttaatgggtaacca

SEQ ID NO: 86136 - DNA, 645 bp, Triticum aestivum
  unsure (1)..(645): unsure at all n locations
  Clone ID: PAT_TA_86136
gccctctgccgccgcagccgcagccatgggcgcgtacaagttcgtgtcggagctatggaggaggaagcagtccgacgtgatgaggttcgtgcaagcgcgtgcgttgctgggagtacaggcagcagcccgccatcgtccgcatcaccaaggcccacccgccccgacagggcacgccgtctccgcttcaaaggccaaacagggtatgtgatctaccgtaccgtgttagacgtngtggcaagaagcgccaatgcccaaagggtattgtttaatggcaagcccaanaccaaggtattaccaactccaantccaanaggaacaagagcctttgctgaagaaaaagcttggcgcaagttntgtggcttccttcctcaatccctacgggtgaatgangatcccacctacaaatatttnaggcaccttgttgatgttctcanaacgctgtccnaacgntcaaaggtnaactgggtctgcaanctgtgcaaaacacntnanctctggccactcncaggaaaaaattcntgnctcntgnaaggtcacncacacanaanagcccaagngaccncttaaaggaacaaantntcctcgcgnaccttancttnnggtattctgtgaacnnccaangggntttccctaatttnacttttg

SEQ ID NO: 86137 - DNA, 319 bp, Triticum aestivum
  Clone ID: PAT_TA_86137
cttacttgaccatcctggcgtggtgcctgttactacagctcaggtgtatattatccccggtccccacaatgcttacctgaaggatggaaaatgttaacagttggcgtttgatctcttcaaatctaccatgtgaaatcaacacactccatcatctcatgtttgtctactcttgcctccacccttacctcgtagggggaaggaactccgcaagcacatccggcgcaacctgttactccaaatgcagtcaaaagacacagcaagaatgtcaaactgtgtttggatgctgccatcaaggtatgatcaagctcccaacaagcaa

SEQ ID NO: 86138 - DNA, 327 bp, Triticum aestivum
  unsure (1)..(327): unsure at all n locations
  Clone ID: PAT_TA_86138
gctaatcaagctctcagctccttcccagctccacggtttccagcaagcaaagccgaagcactagattctccattggtncccttgnaatngtccgcgttttccccgttntcccnggaattgccgttgccgnnantggttcgggggcgntaacttgcgngaantnactttcgcctntcgccctttaaattnctaancgacaggggaaagngtttggacactcncggntgtnttttaaaaggggtnttgagccccntaaanccaaggggttacacccgggggacnaccnaagnggnggtntanaaactgccnaaaaaaacttgggggggt

SEQ ID NO: 86139 - DNA, 631 bp, Triticum aestivum
  unsure (1)..(631): unsure at all n locations
  Clone ID: PAT_TA_86139
gtaagctctcatatttccattttgccaaagctcctctgaacggcgtaaatttaggcagtgaatatcgatccagttgtagtgctagttttgatattaaaagagttcagaagagatcagtaggtaaactgtgaacatcagatatttgtgattgggaggccacgggatcacaaactatagctgggaaaataaactgcagtattgctctttccatctaattcaagagtttgatatgtgaacctgctgaacatatttcctggatggaagaaatttaaaataactcctanggtttaaagcgacctgtcaatttcttgggttnaccgttccnngcatccaatatgaacgcccctaataaactttcnggntgttaaaatcacncttgttgnttttatgcaagattaaacnattttggaancaatgtccccntcccttgaaaanatgggaaaaggaatacngacttcanccntnaaggtnaggccaagntgaacaacccctgatnttgacnaaaaaaatgtgcatcngatacacccaagggttangcctgaaaacatcantcanttataggaaacnacggtgggacncctaatttggtgtcaatggggatattatacccccgtcnaaaatttcttgggaa

SEQ ID NO: 86140 - DNA, 278 bp, Triticum aestivum
  unsure (1)..(278): unsure at all n locations
  Clone ID: PAT_TA_86140
gaaaaccctagcccgtcgcgccgccgccgccgccgccgccgcaaaatcttaaacccgcacgcacctccccctgccccgacctcgccgtcggcgtcctcagccatggcgttcaccgcccgcatgaaggacctcatgaggaagtacggcaaggtggccctcggcgtccacgtctccgtctccgtcgcctccgtctccggcctctacgtcgccatcaacaacaacgtcgacgtcgacgccatcttccgcaagatcgacaannggcccccggcaccgccgcg

SEQ ID NO: 86141 - DNA, 587 bp, Triticum aestivum
  unsure (1)..(587): unsure at all n locations
  Clone ID: PAT_TA_86141
cgcgccttcaccatcacctcgcgcgccctactagacgcggtggtctggtgcctcgcgcgacctctccctccagccggcgcgcctctccctgctgtttccccaacttcttcttccctttgctgctcctccacctctcctcgtcccccaaactgcttgctgcttctccttctatgaacccttgctgctgctgccgcttcttcttgcgccctttgctgctgctgctcctcttcttggcgtccctgctgattcctctccttcccctcaactgctgctcctccttctctccnaaaactggctgctgctccctctcctcnacatccctggctgctgcatcttctttcttcccttggaacccctaactactggctgctggtccctctccccaacgaacctgctgctgtccttctctcccttggctctcccaantcttctcntgaactaaaatgctgctgcttctctcctctccttactccttgcaaatttcngaaaactgctagtgaatttgngtaantcaagattgtgccttganatgctaagtnatatcagattgantgtactncaatccncngttgcncgttaagtactga

SEQ ID NO: 86142 - DNA, 619 bp, Triticum aestivum
  unsure (1)..(619): unsure at all n locations
  Clone ID: PAT_TA_86142
gcccatgagatgtgagccggtgatggccgccgcatcgaggcgtgcggcgtgcccatgccgacgaagatcggcgccccgaaccccgaccccaaccagtggagaccggcgccccatgccgccatcctcgaccctccgtcaagtcgctccactgccggcgacacggccgtccgccgccggtgacgaccgccgacgaagggcgcgccggtgcgccccctgaccgatgaagattngacacccccgagccaaaggcccaagcagtttgagactgggcgccccgcgctgccatccctggagccccgttnagttgctccaaccgcccggcgacacagccgtccaanaaccggtgtccccttgccccgnatgactgggttcaacaactgcanccatcaacatcatcaanaccnctccttaatctttcctcggtcgctgcctattcctcttnattcttaaatccactgaagagaattnanatnggggacagtgaaggaaanaaagtcatggtggtgcgaaatgattgttgcaatcatatcatggctgtgtgctgtgctatacttggtatanaanggtgctgngcctccnttttgcatgaatgtngtctttaatnctacttcgnaaaata

SEQ ID NO: 86143 - DNA, 578 bp, Triticum aestivum
  unsure (1)..(578): unsure at all n locations
  Clone ID: PAT_TA_86143
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaaattccgcgcgctgtgcaccgggaaaaaggggtccggaaaaagcggaanccnntgaactacaaagggaaggctttcaacgggntgttccccaattcaatntgccaagggcggaantnaacccgggggaancggaaccggggnantcanttaagggnaaatttcccccaacaaaaattntcaaaaggcaacangccggtntttcccatggcaacnngggccaaacaaggtcccattttnancggacntcctgattgtcaangnacactngcttccggaagctcanggnatgctntcaaaaananaaggggtcccanggactgtcaacagtgtatccntgngcagttatngccgccgtcccttgcgctntnccgccctntccttcngcncattaaanaancgttcgt

SEQ ID NO: 86144 - DNA, 541 bp, Triticum aestivum
  unsure (1)..(541): unsure at all n locations
  Clone ID: PAT_TA_86144
ccggaaggagcggagccgccgagccgggaagagccaccaccccatcccatcgcccgcctccgcttccgaagggtcagagatggcggaccgagctaaccacccgtctgtcatgcagaagtttggtgggacagttccaccttgcctccaagcttctctganggtgttccgtgctccgcaacatctgcccttcctgtgccatcctatganaggcgcttcaacaacaagcagtacatnactccaagacttttggacaatttcccaacatgttcacctcncccaatgttttgcaaatgcaccccttgagaagaaagtgtcaaaganttngcattgatttccncaaanggaagagtgtcaactgcatttccaaaactgntgaatcccattnacntgttaactgctntccaaaaccagatnaatnttnaagngggaagnctcttagcanaaaaggnatngggantgntntggcnacatcaagggnaaaggttggncatntganaggnaaacgntaagtcancgtncttcaaatagggttnantttgtt

SEQ ID NO: 86145 - DNA, 447 bp, Triticum aestivum
  unsure (1)..(447): unsure at all n locations
  Clone ID: PAT_TA_86145
cccacccccagctccggccgccggcgatggccgtctccgacctcctccccctccccttccccgtcccgccgtacgcgctccacgtcgccgcgtcgctggccctcgcggccgccgcgcacttcctccacgtcccgtccctcctcctctacgccgtccacacctacatccacccggacgccgtgccctccacggggccccgcgccgtcctccgcccgcccggtcccgcccctccctccggcaagcgcggcgcggccggcccccggctccgacggtccgcgcagtctaccgcctgcgcctctccacgccanctcgcctcccgcccgacttngccggttccaactctccctgtcctccngtcgcgcnttggcccccgngtcctcctcnggcgcccgctcccgggggcccgctcgngcggtctccngtcgctctcttgtnngtctcgcaagt

SEQ ID NO: 86146 - DNA, 498 bp, Triticum aestivum
  unsure (1)..(498): unsure at all n locations
  Clone ID: PAT_TA_86146
ccccctcacaccccaccccaccacaccctcgaatcaccaccaccagcagcacccatggcacccaaggcggcggagaagaagccggtggccacggccgagaagacgacggcggggaagaagcccaaggcggagaagcgggcgccggcgtccaaggaggccggcggcgaggggaagacgaggggcaggaagaagggcagcaaggccaagaagagcgttggagacgtacaagatctacatcttccaaggtgcttgaagcagggcacccaagaacgtngggatctcctccnaagccatgtncatccatgaatcctttcatcaaacgacatcttccnagaactcccccggggagtccngccaactcgccccgctacaacaaagaanccaaccatcaacttcccgggaaattcnaaactcctgtncgctcctcctcccccgggggantccccnaanacgcttctcccnaggnaacnaaggctttacaaattaactctccctaaa

SEQ ID NO: 86147 - DNA, 603 bp, Triticum aestivum
  unsure (1)..(603): unsure at all n locations
  Clone ID: PAT_TA_86147
gcctaatcccctcacccccgcgtcggccatcgactccagctgctcccttctcctctcgatgggctgctgcgccgccagcacccaacctccgctcctgcgacgaccgcgccgccctgcccgtcttactccggccatgtccacatcgcccaagcctcgcctgcatcccgtcgctcctcgcgcctccggttccgtctccgacgttccgacgacccaatcacctgcgctccttcctcctctgccaccatgacgcgccgcgtcaccgggtcctccccagcacgcgccttggtccctggcagcgtcgcccctttctgtccgttgtccngctggtatcccgaccgcacctccttttgacaagccggacaacttgtccccaaggggaccctctgnacaacggcttnaactcgatccggcccaagcacttcttctgcngctcnangacccttaacggcaactcacgagagtcaacccctgntggccttgcctgtngcctctgtgctgcaagancggaacaaggagcaagaagcctcgggttcgcaatncaaacgnagataatggngtnatcataanacnaaagtaggganantttggcctcgannnaaacaa

SEQ ID NO: 86148 - DNA, 414 bp, Triticum aestivum
  unsure (1)..(414): unsure at all n locations
  Clone ID: PAT_TA_86148
ctgctgagaaaccagcaccggcagctgctgatgtagccaagcagattccagctggcattccaggtagccgggcgaacaactattaccgtgcagatggccagaacacgggcaacttccttacggaccgtccttcaaccaaggttcatgctgctcctggcggtggctcgtccctggggctacttggtttgggcggaaantgatgttaatgatgggtgcctgcttaaatgaacgagcgatgaatggcctgtactcctgttatccatgttggtgaaaactggaagtgtttggtttttagcatttacacctgcgtcnatgtaccctgtccgtangtcattgtgtcccaagctactccctgctttgnagcaacttgccctaaaactgtcctttnaaaactatcgtcttcatctccaaann

SEQ ID NO: 86149 - DNA, 515 bp, Triticum aestivum
  unsure (1)..(515): unsure at all n locations
  Clone ID: PAT_TA_86149
ctagatctcagatcgaggccaccaccaagcccctcgaccacctcctccttccttcaccggctcagctccctctggcgcgcgccgctccacctgagctccagaagcacacaacgagcctcgctactgctgccaccacgaccgtcatcgcgccgccaccgtcatctccaattctccagcggtgggcaaacactcccctgcgactgggtgccaccaccctctgcctcacctccatcatgcttngaggacaatgacggcatgggctgccgtcgacccntccccgggccctccgtctcgctccgtgtnggggcgcaccttgcgcatggacatcggtccaagcaaaccgcctcgccancggggaacgccggtgccctcgccgaaanatctgatgggggctaaacttgtcccatggcaatggtgcccctttgatcatttctancccntttacatcngntcattgtaaccncacccaaangctgcaatntgcnaacaatcctcttctctcnaaaaaaaaaaaa

SEQ ID NO: 86150 - DNA, 407 bp, Triticum aestivum
  unsure (1)..(407): unsure at all n locations
  Clone ID: PAT_TA_86150
ggcggacgaggtaagaagcagcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctccgtcaagctctaccgtttcctggtgaggaaggaccaagagcaatttcaacgccgttatcctcaagagtctttcatgaccaagacaaccgcccgcgttctccatgngcgctctcatnttgnaagggaaaaagggaggggaaaaacattctgtggttgttggtanatcacaatacatcggttcaagagcccacaataagttacgccctagttaaaaancagcaaggcaagtttcatcctgtgggaag

SEQ ID NO: 86151 - DNA, 645 bp, Triticum aestivum
  unsure (1)..(645): unsure at all n locations
  Clone ID: PAT_TA_86151
tctactctccctctaatggatggagatcaagatcaagggcactttcaagcctttcatctacccaaagatcctcctatcttgttccctttcatgatcgacaacccagtggagcatcaagggcaaggctatggagaccagcactcgaggcagcaatttttgggtgaatctaatcagcattcaatgatcacatgatgatgagcggaggatctgcggactctttgccacatgctccccgttccggacctaccatccaaaagcatcngcagtgacatgatccagaattctcatacattcctatgatttccaaancacacatgccggcaatggtttnactaccaattgggatccggccaaacgccantnaaaataaggntnaatgaaaaaggcccaacaatgnttaaccaaggagggacancnagaaaccaagganaaggcacaacacacaangngattaaaccacaactgcacacccaagggtgttacaaatgttccaaaacgnaacactccaataccccntgtggaggatggcctgtggcccaaatccttgaaccatcggatacccaaaggaggtcncgcncatgntcacggggcatgccgcacacatgggggntcgctcatgngtttngnggnttagaacacccaaag

SEQ ID NO: 86152 - DNA, 598 bp, Triticum aestivum
  unsure (1)..(598): unsure at all n locations
  Clone ID: PAT_TA_86152
ggggaaaggcgtcttcgtactcgcctctctccgcgcatcctagccttcgccctcctccttccccatttcgccagcggcgcagcccaccaaccacccccacccgccgccatgagggagtgcatctcgatccacatcggccaggccggcatccaggtcgggaacgcgtgctgggagctctactgcctcgagcatggcattcaagcctgatggccagatgcccggtgacaagaccgttgggggaggtgatgatgctttcaacaccttcttcagcgagactgggtgctgggaagcatgtcccccgtgctgtccttgtagatctcgaacccactgtgattgatgangtgaggactggtgcttaacgccaactcttcaacctgagcaacttacaatggcaaaggaggatcaancaacacttcgccgtggncattacacaatggcaangaatggttatcgtgcctgacgtntaggaacttcaaacaacgcatggctcaaggatcctgnntaacctttgagtggactgtcggcttggtcctcctgaacctccntnacatgaaaatcaacttgttagggncacccagtccactcgttttacaaaatn

SEQ ID NO: 86153 - DNA, 413 bp, Triticum aestivum
  Clone ID: PAT_TA_86153
tgagtattggccggggtgaaaacctgctctttcttcggacagaccggcggcggcgtagctcgttcccttcttgaaggcgtcgtcgcggctctcattgtctgtcgtgtggctccgggggaaaccttgatcctcggatcaggcggtggcgacgctgccgtgtcgtacccttcctgaaggcaccgtcttggagcccacagttcgtcgtatgcggctgcatctcttcgtggtggcgtgttcactgggtggagtcccgggtgctcgagtagtgctaggggcgtgttgctgcgctcaacgcctatgtatcccgccttgggtgtgtgcatgtgttgtggtgggccgcgtctgtacctggatgttgttggtcattgctttaacctataaagcgggcgaaacttttccgtaaaaaaaaaaaa

SEQ ID NO: 86154 - DNA, 499 bp, Triticum aestivum
  unsure (1)..(499): unsure at all n locations
  Clone ID: PAT_TA_86154
cggcaacgcactaaccatccatgcccgtctcactccactagcgcgcgccttcacatctccaccgagaagcagagcattcgccgccagcaccatggcgagtccggctgccgtgtccgccgtcgctgtggccctggcgctgctggtggcgtcagcggacgcgtggctgcacgaggagttcgacacggagggcaacgtgcgggccggctacgacgcgcgggggcagcaggtggcgtcgatcgtcctccgaccggnagtccggcggcgccttccgctcccggcgcagctacctctaagggcagttcagcgtccagatcaagctcgtccccggcaactccgccggcaccgtcgcctccttcnactgtcgtcggggcgacgggcccaggcagacaagattgacatggattcatngncaacagcacnggtcaaccgttgggntcacacaancgtttgggcaacggcnacggaaaaaggnccacattncactcngttcaaccgggcg

SEQ ID NO: 86155 - DNA, 397 bp, Triticum aestivum
  unsure (1)..(397): unsure at all n locations
  Clone ID: PAT_TA_86155
ccgactaagacacacagcgaggagaaaaagggttnaaccgggtnnaangggaaatttaaagggtttccccccncgtttttgctcccntgcttgctgctgctttcctcgtcgcctcggccgaagaaactcaggccaagaaggaggagcccacggccgacgtgcangactactaccgttgcggcggcggctacccgggccntggttatcccgggcgcggntcccggaggagggtactacccntaccctgnccccggagnaggcggttacccggggccccggnggcggcggttantnccggtggggcttctgcggccgcggttaananggggnttccntttnttcccccccccaaaaattccggnnccaattttccccnntngggggggnnnccacaatt

SEQ ID NO: 86156 - DNA, 383 bp, Triticum aestivum
  unsure (1)..(383): unsure at all n locations
  Clone ID: PAT_TA_86156
aaggcagggaatcaagagaagcaccacctgataatcatcatatctgcgctgcttggagtatccttgctgcttgcagtttccctctgttgctacgtgctgacacgcaaagccaacaagaaaaactcaccaccagaagatgaccttaccaaggcgcccccgcccgcgcacaagctgcagaagtcaagacgcgccgtcngtgcgaatcgccaccgagacctgcaatcccttcaaattatgcaactcnaaanaaggcaacnagaatttttgaaaanagattgnccctgaagtttccggaaaangttccaatgggaaactgccgnccggagggaaaattccgggtaaaggggcccaacaanaanccnttcaaagggaaaacnnttccc

SEQ ID NO: 86157 - DNA, 648 bp, Triticum aestivum
  unsure (1)..(648): unsure at all n locations
  Clone ID: PAT_TA_86157
cgcagctccattcccctcccactcgacaccactcccccactctcccttttcatcgccggattagaagacggccggccgaatcatggcgtcgcgcggcggaggcgggccggagcggctggggcgggagctgggcctcgaggacacctgcgtccacgcgcacgagatgaggccagcgagcggggccgggcgctaggtcaacgcccaccccgtgctggaggttnggggacgccggcgggcaagcgangcaagggaagccggaccctttcggcggcgagcacgggacgacgacaacttggaaattccgganagaagggcggtttanncaattcccggcnggccgccaangggccggtttttcccgccaacttaatctgaatgcncggccgccccggaggcganaacggaatcctgcnggncgggcccttcnanggggaaagttctttcgccatttcgtccgatgccaaccgccggaagnnaggaccaatctgcnccgnaaacctccaaagggaacggtctcccgccnactntccnatcaaggccccngaggtccgcatccgngcaaggatggntnncaacaaangacatagctccatggaanggaaatctanatttccgcgttgatcctattaaaanctccgaaattaattt

SEQ ID NO: 86158 - DNA, 637 bp, Triticum aestivum
  unsure (1)..(637): unsure at all n locations
  Clone ID: PAT_TA_86158
tatctttcatggctttcttgtgttcctcagaagatttatctctatttcgacaatgtccactgctgaagctgtttgagcgtagataaccccattctcctgtggcatcctccccctcatcatcatcacatggagcaccatcatggtcatcctcttcatcctcggcttctggaggtagccaaagtgagctattgttttcaaaatccacaagttcattttcctagcacttccatgccatacaacgaagaagatcgagcattgcactcctcaacattaacaatgatatgatcaccatcctaatccattccctcaagaattggactaaggttgctgtatctttcctgggtgatgcaaganctttancaacatcatggcaaataacttgatgattatcaaaacacataggccattggnccaacaaaattttggnaggnggngtacttccgaatcaanacggaattgtgtatcctcaacttnacaacatcctaataancanaattgaaggttagngaatgtcaaaaancgatgtcaaggnccatcggtcacaaanatntgaatcagaaacacaactccgaatncctcgtgcacgagtatncaatnagtaactgatcataaaacatggcntgnactgtgnccccgg

SEQ ID NO: 86159 - DNA, 632 bp, Triticum aestivum
  unsure (1)..(632): unsure at all n locations
  Clone ID: PAT_TA_86159
gatatgtgctttcggttaagagaacgggatgacagagagaagacaaagcaccaacaatcctatgccatcttaatactccctccattcctaaatatagtgcgtataagctttttagagatattccgcaatgcagtgcgtatctccctccccaagcgattttggacgaaactaccctcccaccaaaccaaacagccagcgccccagcccaccgcttcgctcgcctctctctcttccttatcccttcgtctcgcggcttttcccacctgcctcgccaccgatctgccacctctgttgctgatccctacctccattgcgacaacacagtagatcgagttgcttctaangcaagagggccgaggtgggacggacgaagtgctgcacaaatcggcaagcgggagtccaacgccgcgggcgtagtacgccgcacggagggcgactccaacactgaactcaatggcacagacaagtcaacaancacaggactcantgtgagcacgcgcacgcgacataacgggcaaacatgtctcacaacggggggcaatacggcacanccgttcanactganctgccacgttcggaaaacanaatcatgggggggaaaatcgtacactaacaaccgcctgtcggttnng

SEQ ID NO: 86160 - DNA, 630 bp, Triticum aestivum
  unsure (1)..(630): unsure at all n locations
  Clone ID: PAT_TA_86160
cccacgcccagcccctttcccctccaatttccatagtcgcggcaccctccctccttccgcacgaaccctagcaattgccatccgccaccctcgctcctcccagccgcctccatgctcgcttcctcctcctccatcctcccatgctggtctccccctcccgcatctcattcatctcgttggatccaacgcgaggcgatcttctgcggcggcgaccccatggatccgtccctgagaagatgagaatgagagagagagaggaaagaggaaagggaggtccagcggcggagggaagaagggnacttctgccccttcctcttcccgcgtcgccgccgaggatgacgacggcctgatcaaagaggtacacaanggatccgaaagaagacatgaacacaattgcttgcctgtaatggaggaggtaaggnnaccattctgtgcnccttaattggcaattnatggaaaggttgatgnaacaanggttcaatccaacanngtanctgtcaaggtcngtcccgttgactgtcgccgttcctttccctcngnggcctcctacaanacatacaggaagaggccgcctttctaaagngtcacgtggatcttggtgataacaacacagaggataacggtcgttnt

SEQ ID NO: 86161 - DNA, 591 bp, Triticum aestivum
  unsure (1)..(591): unsure at all n locations
  Clone ID: PAT_TA_86161
ccgccgacccgtcgccgctcaccaccaccgtcgtcaccgtcctccgcgtccgccgcctcggcccgcaccgcttccacgcccacgaccagaaccgcctccagatccgccgccccgccgagcccctccccgccgttggcacccccgagcgcgacgccgacgccgacgccgcctcctccttccaggagcgcgccaaggacatcctccgtcgtcgtctccgggcctgctcttccggtttcggctgcggcncctcaccgccgctccatgtactcgtctggtcctctcgcttcaaccgggccgccggccctacgaagagtctacaggacnacacaanangaaactttccganaagggccgagacccaagaaggcggtactcatatcaacgggcnangactcncgccgcgccgtagannatagatnggctnccttcttcggaagaaaagnccgttgataataatgatgtggnnantatacaaatatngactatgaaatgtcgctgtcacgttccaagtggtgtgtgggagaaatttaaaagnatccacgtctaaaaaatgcatcnatcaaatntttttnctcttnatgattttttttt

SEQ ID NO: 86162 - DNA, 288 bp, Triticum aestivum
  unsure (1)..(288): unsure at all n locations
  Clone ID: PAT_TA_86162
tagcggcgtccatggtcatcacttccgcctccgcggcggccagcgccgtgccgccgcctcccgcgaaaacaaaatccgggaccctagctacagcaccatctctcacggccacaagaaggcacctcctcctggcttccaccgcatccgcactccccacgnccgccgcctccgccgcagcctctcgattcaccgagatccctactccggcggcgtgaaggcctagagtccgggaaggttcaagcaagtccattcnaacggaacaagttnnattcaacacatggaagnctg

SEQ ID NO: 86163 - DNA, 633 bp, Triticum aestivum
  unsure (1)..(633): unsure at all n locations
  Clone ID: PAT_TA_86163
tcccagttctgttcctcggccattctagccaccatgccgggctccatcgccttcggtcgcttcgatgactccttcagcttggcctctttcaaggcctacatcgctgagttcatctccaccctcatcttcgtcttcgccggcgtcggctctgccatcgcctacactaaggtgagcggcggcgcgccccttgacccatccgggctgattgccgtggcgatatgccacgggttcgggctgttcgtcgcggtcgccatcggcgccaacatctccggcggcacgtgaaccctgcgtcaccttcggcctcgccctcgggnggcaaattacatcctcaccggaatcttcaattgggttgcccanctctcngtgcaatcgtcgggcttcctcgtcnaattttgaaccgggnttgggnaccctanaaacggttttccggattggcncttttagggctcctgatgaaataatcgtnacttcgggtntctaaacgtttaagcaacgccnccaaccaagaaggtcctcgggacatcgcccatcgcatcgnttacgtngggcaaaacccgtgccggccntctcggggtcaagaacctgaagctcttggccccgttcaagggaattacaaaattggttaangggggn

SEQ ID NO: 86164 - DNA, 606 bp, Triticum aestivum
  unsure (1)..(606): unsure at all n locations
  Clone ID: PAT_TA_86164
ctctcgtctccttctccaccaccggtcgccgccgcggccaggccggcgtggcggcgcgccaccgcgccatcaccagcatccgccagcacacaccgtccatccatccagccaccagcgccaccgcatcaccaccgcgcctccgcgacctcgctgctccacatcatccatccatccaccactccgtcttcgccgccatcaccttgcgcgctccacttcgtcgccgcgcctggcgcgtccgaccagacgggcgtctggttccccgcgccacctgctgctgctctctccctctccactgctcctcccctcgtctccacttcctccgtttctcttcttcttctccanaaacctgctgctcttcttcttctctcaacgctcctgctgcttcttctccttgcatccctttgctgctgttgctcaactgcggttctcttttcacgcaattgcgntcttcttgcgccnagctccgcttctccttttcgaatccccaacgcgttgcggtcctcgctnactcggtgttattntcttcctnctcgctnnctccggcttanggtatctcncntanctcgcgtactttntttncctngaatccnnattcgcaanaacgtt

SEQ ID NO: 86165 - DNA, 627 bp, Triticum aestivum
  unsure (1)..(627): unsure at all n locations
  Clone ID: PAT_TA_86165
ttttttttggagaagaacatttgtaaccttttataactctttttacaaatcaatgtaaaaaagcttatgttagggtcgaagtttgtaggaataagacagggagacacacatgatacatctcctgttaagagaaagaaactatacagaatcaaaggaatgaaggacttcctccaaaacaagtctagtctgcttgcccaagggcttctcctcagtatcagagtaggctacattgagcagatagagctttctagaagcaacaaacgctgccgagaagatccgcttcatccctcccctgggtgctatccaatgagtactcgatttcgtatactgtcaggccatcgcgacctgatctctctccggtagaaatcacctctgcggatttggtactttcctttcctctctgcctgtagaacctgtccgcgacgaactgcggtgtgccgaaaccgtcagcgangagaggcaacagggtgacgacgacccatgttgtaccccctccctctgctgaaacangccgtgcgccgccttcacttggcatgaggcgctnaggaggtgancctggccggnctgtcgnccaatcaggcgtgngctcttnccccgaatcgctccttcgatcgngcacgggattcg

SEQ ID NO: 86166 - DNA, 573 bp, Triticum aestivum
  unsure (1)..(573): unsure at all n locations
  Clone ID: PAT_TA_86166
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcagcacggaggccctccttaagcagtcgactacctgattcgctccaagtgggtgccttgcctcgantcaacaagttggttcatcttccgtgagcacaacgcatcccctgggtactacgatggccggtactggacaatgtggnaactgcctatttcggatcaccgacgcaccaggtgtnaacaagtggaggaggcaagaaggatacctgaccctagtcgcatcatcggtncacaatctcaagtgatgctcaantaacgctaagcacggctcaagatcggaagctaaantatacaagcatttaatcatcnttncancgatgntngttccccaata

SEQ ID NO: 86167 - DNA, 546 bp, Triticum aestivum
  unsure (1)..(546): unsure at all n locations
  Clone ID: PAT_TA_86167
cctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggnaccgcttgcggctgctcctgctgnactgcaactgaaccngggcccaaagaaggccggccggnaaaggcgacacaaggattaggaggacaaacaagcaanacatcacaacaattaacaacaaccancgtttcacaacaaaccgccgnatgcgctcccgggcgccncgctgataaaataaacaccntcgtttccnaatttgtagcccttcnctgtgttgacaatatgtcttctctgctcactcaaggaatanatgngctcacttnnaaaaaaaaaaaa

SEQ ID NO: 86168 - DNA, 678 bp, Triticum aestivum
  unsure (1)..(678): unsure at all n locations
  Clone ID: PAT_TA_86168
tccgacagtccctccgccgccggagctcctccgccacccccgccgttatcgccggtcccctgccgccctcttccccgcacgagcccgccctacctctctgcactctcctcctcgcggccccgtccatccttctcctaggctccccaatcctgattcctgattcctgtaaaagcgggagaaggggagagcagcgaacccgtcactcccgtcttccccgccgcggcggcgcgccgtcaccgcttctcccagcaaccttcacccacactcctccccagacctccacaaccctatccttcatcgtattctccacaaatcctcccaatcgaagctgcttattgccgtcacaccgccgccattgtttgtatccatcctcccctagcatggtggctctacgtgcantggaggcgccgccgcacacatggcggcgcatagaataaaggccctcggnaaggaatggcgcancgcantctcccatgcgtgcgggataaggancttccgctgaggctcctgtaacgcctcggtgttcaaggaatgcgctctcgcntttntcgngnccacgggggaattgttanataaggaatacgaggatggagngctaagnggangcgaatntaagcccggngtaaantngaaggccctaaaantncacttagaacaatgagccttgggntatntcan

SEQ ID NO: 86169 - DNA, 326 bp, Triticum aestivum
  unsure (1)..(326): unsure at all n locations
  Clone ID: PAT_TA_86169
gcctggctctcccctcgctctcgctcgggtcatccatctcgtccatccacctcctcttcctcactcactcacacgaacgagcagaccagaccagcaccaactccctttctgcctttctctttcactgctcaccatttcccgtcgccctcctccctccttcgcctcatcctctgccgcggctagcctagctgctgcgcgcacctttgcagaaagagagaaaggagggaaccccacccgaacccagcccgacgccaccaccaaaaacgcacaaaagcagagggacatcagattangtcngncgatngagcgcgcgggaangaaccctg

SEQ ID NO: 86170 - DNA, 642 bp, Triticum aestivum
  unsure (1)..(642): unsure at all n locations
  Clone ID: PAT_TA_86170
gtcgtcgcctcctcctaaaccactctccctatccccgtgtccagaagctaccccccggctccaatggcggcgaaggaaccgatgcgcgtgctcgtcaccggcgccgcagggcaaatcggatatgctcttgttcccatgattgccaggggagttatgcttggtgcagaccagcctgttattctgcatatgctggatattgaatttgctgctgaagctcttaaaggcgtcaagatggagtttgattcgatgccgcatttccacttctcaaagggagtttgttgcaacaactgatgtttgtccangcctgcactgggtgtgaatgttgcggttatggttggtggttcccccaangaaggaaggaatggaaaaggaaggatgttatgacgaaaatgtttccaatcctaacaaactcaaanatctgctccttggaactcaatgcagcccccaactcaagttttggtttttccaaccaacaacacaatgnctcaacccnnaagatttgcncatctanccctgagaagaaacntttgttnacccccctaaacacaacaggnanccgncaaattcggaaagactgngtcaagttctgacntgaanaatcaatatcnggtaacatctcantngtacctgaagttacacccn

SEQ ID NO: 86171 - DNA, 334 bp, Triticum aestivum
  unsure (1)..(334): unsure at all n locations
  Clone ID: PAT_TA_86171
gagctccgcacctagccaccaacagccagcggcgaacgtccccactcccccccacccccacacccatcgccgccggcgacgtcccctgcaccggcgccatgctccgcctccgaagctgcatcctcacccatctcccctcttcgcccgccacccatcccgtcccctatctacaccgcctcctctccgccgccgcgcccgccgtctccccaaggcccccgattcgccgtngaaggactacctcgtcgacacctgcggcctcacccgagcgcaggccctcaaaggcctccaccaagctctcccacctcaaacccccacctaccccttaagtttgttt

SEQ ID NO: 86172 - DNA, 242 bp, Triticum aestivum
  Clone ID: PAT_TA_86172
taaccgggtaaaaacctctttatattctcagacaataattccatgacaaaagaatggtgctcgccaaacacaacacaatgtacccctactacttactctcttgcacaaaagaattgaataatgaattaatgtagaatccacacgcacacaagtctcatcttccccctccaaagggcctcataacttatcatcactttcttcatcacttcttggcgagggcgctcttggccttgtgggggggg

SEQ ID NO: 86173 - DNA, 511 bp, Triticum aestivum
  unsure (1)..(511): unsure at all n locations
  Clone ID: PAT_TA_86173
cagcaaggccaagaagggcgtggagacgtacaagatctacatcttcaaggtgctgaagcaggtgcaccccgacatcggcatctcctccaaggccatgtccatcatgaactccttcatcaacgacatcttcgagaagctcgccggcgagtcggccaagctcgcgaggtacaacaagaagcccaccatcacctccagggagatccagacctccgtccgcctccgtcctccccggggagtcgccaagcacgccgtctccgagggcaccaaggccgtcaccaantcacctcctcctagactggacggcgtgcattgggttctgcatctgcatctgtactgttgactcctgcttatctatctatcccgcaagtatgggtagcattagtaacacctgtgctggggtgattgccaacgctttgttggcccgttgggtgttaagaactgaattgctgctttggnatacggatgaanctactagaatgaattatcttttaaccttctgaaaaaaaaaaaa

SEQ ID NO: 86174 - DNA, 646 bp, Triticum aestivum
  unsure (1)..(646): unsure at all n locations
  Clone ID: PAT_TA_86174
ctcctctcctctcctcaccgggtcacgagagccgagccagcctctgcatgtaggagccgcaatcatcatcataagtagtaacattcctcctccgaactcacaacgcccatcccaagagcctgcaacacttctatatctgcacctgcatccatccacacaccgctgcctcttcttcttctctggtctccgaaccttctcctgcttttgctatctccgacagggtgccgctgccgcacggtgagcgtgcgtgaggcctgctgtgggcggtgaatgtgcggcggccgtctcgtttgggccggcgtttgatcggtttggaagcgtcgggggatgccggcggcgaggagggtgctcaacgtcttggncgacgacatgccggagttcgaccgccgccagatgggctgcatggccggcatattcagatnttcgaccgccagcggatgctcacgcgcgtccgccggcgccggcgctggcgggcggcagcgcagcagaagagatgccgcangcgtatcacanaaananacaatgtcagnnagactaanacccaaaatatctggngaaaaccacaaagatgncaganatactccataatcanaaagctctgtctcctagccgccttcgcattaggagaatancagagggnnctnat

SEQ ID NO: 86175 - DNA, 388 bp, Triticum aestivum
  unsure (1)..(388): unsure at all n locations
  Clone ID: PAT_TA_86175
ttttttttttttttaaggaaaaacgattataaaacataaggagaggtttacatctcatcatagggaaaaactatgatatcagattacatattaattccagtaacaacaaactaaacaacttcagcaaacactggcttacagtactaaaacgttcttcccctactaccatggtttcctggcattcctcagtagtaatacaaatttgaatgccgaatatgccaacaaagttncacgactnaacaaacaanttcgttgcctaatgacnaaatcctcannttccttgaacccgaaantgaatccctngcaaaaggagncannctccaatttgataagntccctaaaggcnatccnccccctggttggncnttggtaacngnccttgggaatg

SEQ ID NO: 86176 - DNA, 638 bp, Triticum aestivum
  unsure (1)..(638): unsure at all n locations
  Clone ID: PAT_TA_86176
ccgtcgtgccctccgtgagctcctcttctgcacccctggtgccctccagtacctcagcggcgtgatcctgtttgaggagaccctgtaccagagcaccaagggtggcaagcccttcgtcgacatcctcaaggcgggcaatgtcctccctggcatcaaggtggacaagggtaccattgagcttgctggaaccaacggtgagaccaccacccaaggctttgatgaccttggcaagcgctgcgccaagtactatgaagctgggtgcccgcttcnccaagtggcgtgcatccctcaagattcggcgccaaccgaaccatcgcagtctccanccgaccaagaacctcaaggtctggtccgctatccatcaaccggcaaagaaaatggccnggtgccaattgtggacctgaaatcctngttgatggactcaaagantttaccgctgtgcttacttnaccanntttccttgcggccngcaaaaggccncaaagacaacanttcnctccanggatccccgaanccaaaaggcanccngttntgaaccaaaaaggggcccgaaggattcngtnaacttcgaacccaaaggactcccnggggttccccaatnttncccggggaaaacngggggggnctactaccaanaa

SEQ ID NO: 86177 - DNA, 594 bp, Triticum aestivum
  unsure (1)..(594): unsure at all n locations
  Clone ID: PAT_TA_86177
ttgtcttcctctccccttccccctcccgccgccgccgccttcctccgccggggctggttcagctactaaccgcggccggggggaggagaaaggccgcctcttgtccggccanctttcngctggttcagcccacgcgggagccggattgagagatggagtcggccgccngtggcgggctgggcagcatgnnanccgtgcttgncatcctccaagtggtggggcttcaacgtcaccgtcatcatcatcaacaagtggatcttccanaagctggatttcaanttccncctganggtntcctgcgtccacttcatatnctcctcgatangggcttacgtcacattanntgctcaaagcnaaccgctnattcaagtcagcccnaagacgatggaaaaagatttcccaantaatcttntttgaataanatntgctnggaattnaacctnngataattcggtctcnttaanaaaanataaacttaaccctgnaaacaaantatcttaatgnttggttnnacaagantttntgagaaaagggttgngnnccataatgggaaaaatttaactaannaanactaattaaagttttntttntntt

SEQ ID NO: 86178 - DNA, 599 bp, Triticum aestivum
  unsure (1)..(599): unsure at all n locations
  Clone ID: PAT_TA_86178
gtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaagtgatcaacgaggtggaggagtcaagaaggagtaccctgacgcgtatgtcgcatcatcngattcacaacatcgtcagtgaatgctaactnatcgcctnaagcaacgggctcaagatcggaaggctaaacagtcaccacacagcattaaaatgcatncanttttaatcgaatncn

SEQ ID NO: 86179 - DNA, 538 bp, Triticum aestivum
  unsure (1)..(538): unsure at all n locations
  Clone ID: PAT_TA_86179
ataaaacactttttaaccatcagattcaggctctttcatccctatcatgccatttctttttttcttttcccttgcaaatcatgcgagcatgaacaggggcgcaagcgccatggacgaacgacagaacctgcccgctggctcgccgcctctctccactgctcgaattcaccgtcgtcgcacgccctcctcatctcgtcgtggttccagcatcacccttgccggatgcagctctgtcaaacgtgggtttcaagcaattcgcgccgcacaacatatacatcttagttaaaaagaactctggtggtcagttgtagcaaaaccaaaaactggttccagcaaaaaaaatacagtagttcgagcaactagaaaaccactaaatcgcctgaagcaaaaaaattccttggatcaagcaaaaattaactacgggtccagcaaanaaaatgatgcagctccccancgcgttgttcaatcgacggttcaacaaaaaattgcangttgtacaaatcaacacatgtcagcaaaatactctaccccgcgcctc

SEQ ID NO: 86180 - DNA, 611 bp, Triticum aestivum
  unsure (1)..(611): unsure at all n locations
  Clone ID: PAT_TA_86180
cgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaagcttccactgatgatgttctgctgggcagattaagacggatttgctgatggaaggactgatctgtcgtatgtccgcaagggtgaagaacantntgcgcttgaaggaatcgtggtggnaataacaactttcntggtgcctactgcanacttggaacaatgctcnggggttgnanancaaataaggataagan

SEQ ID NO: 86181 - DNA, 614 bp, Triticum aestivum
  unsure (1)..(614): unsure at all n locations
  Clone ID: PAT_TA_86181
ctcatagctcggcctctatactttgagcagcagcagtcattcatcactgatcaccagcacagccgcgcatccaccgctgctagcaaggtcgagcaagcagcacagagatggctgctgccttctcctccaacggtcggtgccccgggtttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggtcttgcgtacgatatctccgacgaccagcaggacatcaccaagagggaagggcatcgtggactccctcttccaagcgcccactggcgacggcaccacgangccgtcctcaagctcatacgagtacgtcagccaaggactcaagaagtacgacttcgacaacacatgggangctctacatcgctcctgcttcatggacaagcntgttgtcatctctcaagaactcatgacctgccaacatcaaattcatcancttggtactgggagnaaggtcaaggaaatcctcagntgagcttgctcncaagatggataaccatca

SEQ ID NO: 86182 - DNA, 595 bp, Triticum aestivum
  unsure (1)..(595): unsure at all n locations
  Clone ID: PAT_TA_86182
agaaaccctagcagatcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaagtcgtggagaaggaagagagtgatgatgacatgggcttcagtctgttcgactaagttgtgggcatcttgtgtctgaagtatcatccntggcaaganactagatcaatgatgtttanccntaattanctgattgtaaacgctggnaagacatgtttgatagtaatcaaccctggtgcnggtnattacggggaacatacttcaancaatttgggcttanaantttgaantcncaa

SEQ ID NO: 86183 - DNA, 485 bp, Triticum aestivum
  unsure (1)..(485): unsure at all n locations
  Clone ID: PAT_TA_86183
cccccaagtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgacgggaaagcgtcactggactcaaggaagggctccacggcttcaagttgcacgctcttggtgacaccaccaacggtgcatgtcaactggaccacacttnaaaccctgctggtcatgtcatgggggaaccanaagatgaaatccgccatgctggtgatcttggaatgtgaaactggagcggatggtgttgctaacataatgttacngactgcaanatccccttaanggacaaantcaattgttggccttctgtgtctcaacggtaccctgatntnttggaaggtggcatgag

SEQ ID NO: 86184 - DNA, 627 bp, Triticum aestivum
  unsure (1)..(627): unsure at all n locations
  Clone ID: PAT_TA_86184
tttttttttagaaaataagtgcgtcatggtttttaatttttgtaacaatgtaaccgagagacgccacacatattacgaaaatcgattgtacaggtcctgcgatctctctcacatcagcatagaatcaaggaaccagcaggcggcaaaaactctgtcgtgctgctctgtttctccagcgccagacacttccgcatatgctttttcgagtgccagccagggtaatgataattctacaaaagcccaagccgttgtttctagctgtgcaccttgaagcaactcaatcgtgggaacagttggatcaggtcgtcccggctcctcctcttaataccagtacagccatttacatccagagtcgtgagactatttgggcaagattttgacaaagcctccaggcaagcatcaattactccaaagtatcccgaataaacttagtagttcaagggaccgacaaccttgtgcgatagctacacccaacatcagtaacacgtaccacaagataaattgngatagtcaaactccgcactngaaaacgcaagacgtcgcagttagtctgggcccantaggtcaaaaatncaagtggnnaatatcaattttgggggccgnacaatcgccaaangatctatacng

SEQ ID NO: 86185 - DNA, 609 bp, Triticum aestivum
  unsure (1)..(609): unsure at all n locations
  Clone ID: PAT_TA_86185
agccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgtggtggcatgcaagatcttcgtcaagaccctgaccggcaagaccatcaacctggaggttgagtcctctgacancatcgacaacgtcaagggcaagatcaagacaaggagggcatcccccggaccaacagcgtctcaattttgctggcaaagcaactcgaggatggcgcacgctcgctgactacaacatcagaaggatcanactccactggtgctnagntccttgtggatcanttttctcaagacctgacggnaagacancaaccngagncnatctctgaacatcanaantcanggcaagntcaggcaaggaggatccacgncanaagtcnacttntg

SEQ ID NO: 86186 - DNA, 571 bp, Triticum aestivum
  unsure (1)..(571): unsure at all n locations
  Clone ID: PAT_TA_86186
tccctctcccatcccctctctctcctccacccgacgtcgccgtcgccgtccaatctccggcgagatcccctcccccgccggcagccatggcctccaccttcagcggcgacgagaccgcccccttcttcggcttccttggcgccgccgcggccctcgtcttctcctgcatgggggcggcgtacgggacggcgaagagcggggtgggggtggcgtcgatnggggtgatgcggccggagctggtgatgaagtccatcgtgcccgtggtcatggcgggggtgctcgggatctacggcctcatcatcgccgtcatcatctccaacgggatnaacccaaggcaagccctacttcctcttcgacggctacgcgcaactctctccgggctcgcctgcggctcgcgggctcgccgccgnatggcatcggatctcgggacccgngtcanggcaaccgcacaacccaantttgtcggatatctaacctacttncgaacctgccttangctancgcggataaccctctncgtcggcaatccgtccacaaaaaaacattgaacaagggaactggcanatttttt

SEQ ID NO: 86187 - DNA, 183 bp, Triticum aestivum
  Clone ID: PAT_TA_86187
ttttttttgatttggccttcttcttgtaaatatttattttatttttgagaacgcgacacgtgaactatatagctttaaagacttggttgatcaaatgggccaattgaccatgaaccaagcgactgtaattaaacacttaacgtaatacttatacaaattaaagtttgcattaaaaaaaaaaaa

SEQ ID NO: 86188 - DNA, 551 bp, Triticum aestivum
  unsure (1)..(551): unsure at all n locations
  Clone ID: PAT_TA_86188
ggcgcgaggcgatatgagcacgggccgctggttgttcttggttcatccaatccccaatccttcatctcttcctcctcccctgtttgtcgccatgcccacccggctgaagctaagatgtgccttgctctctgattcctctccttccctgctcgccgccagggcggcccctctgctcgccgccatagccgcccacctccatagttcctcccccctccccgatccctcattctcccatgacctgggaggcgccctgaacaaggaccgccctcgccatggctgaacggtgtaacacatctcatcttgggantcctgtttngatgtacattggtgattccgtgaantntaatttggggacattacaaagtgcaagatatactgaattttaaccttttccttttcctgaatccnagccctgttttgctttcctttggggaattttaacatttaattaaggaatgtactcctgatctanaacggtgcnatagcgttaaatagtaactgaagcaatattctggtgacagaataaactttgtgaacngaaaaaaaaaaaa

SEQ ID NO: 86189 - DNA, 606 bp, Triticum aestivum
  unsure (1)..(606): unsure at all n locations
  Clone ID: PAT_TA_86189
gcggacatttcaaatcatcgtcttgcaaggcatagtcggctccttgccatggactgctgtcgttttcttcacaatgtggtttgagctaattggtttcgataacaaaagctcggcggggttaaacagcctatttgccatcggctgcgcgagtggatcatttcttggtggagtaatcgcagaccgtgtgtcaagacgctacccggattcaggtcgcatcatgtgtgctcagttcaagtgccttcatgggcatccctttcacatggatcctcctcacggtcatcccgcagtcagttgactactgggtacagctatgctgtcacgctgttcctgaatgggctcaacataagctgggtgcgccaactgcgcgaacaanccgatgttcgcagangtggtccctcccaagcaacgcacatgatctacgcgttcgaccgcgcgttcgagggtccttctctcctggtgctcccgctgtcgcatggtgacgagaaggctacggtacaacgcgaagacgtgaaccngcggacggtcgttgaagggnaangccctaanaaggcgttnacatatatngtcattggccgtcgccgtttaaccgcntatcgtaaactacgn

SEQ ID NO: 86190 - DNA, 589 bp, Triticum aestivum
  unsure (1)..(589): unsure at all n locations
  Clone ID: PAT_TA_86190
cctctccctctcgcgcttctcctctggacctcgtgcccgagttgccgtcgacacgccaccgccgttcccatggccggagccgtccccgacccacgaggatatgctctagagcttcgtcggccttgtctgcatctcctacaacctccggttcaagctgaagccctccacaacctcgccatctgggtcgtcttccccgccacggccacggtgccatcgccgtcgatntccaccaccggcgctccccgcggttccganactccacgactccctcacaacccccgagactgatgtttgtccctgtgatttgactacatcgacgacaccttcttcccttttcaacggttttccaaattgtggacccaagattcnaacccactttcnacgatgatgntactacatgaggggcctactatacttgggagccgccnacacaagagtattaggagtcccaagaagaggcttctttccattnntgttnttttgngcaacttctaaagnaaatntcaataagtcgtancaaaatgttctcanngatctgtgtatcagtaatatcaacccaggcctgnttaaaaantgntattaaaaaaaa

SEQ ID NO: 86191 - DNA, 526 bp, Triticum aestivum
  unsure (1)..(526): unsure at all n locations
  Clone ID: PAT_TA_86191
tgaccagtgacgctccattcgtcgatctcaccggcttcttctcgggccgactggcgatggccggcaatggagctaccacccggaggctgctcaccctgtttccgctccacgtgaccctcatcttccttctcggcgccaacggggcggacgctgcgacttccttcagcttcgccaacgagtgctcgcacccggtgtgggtgggcgtgctcagcggcgccacctcgccgcagtgccccgcaccggttctacctccgccccgggcggactcctccgctccgccgcccgtcctccggcgcctggccggaactctgggcgcgcaccggtgcgcccgttcaacgaaggaaccggcgcctcgcctgcgccaccgcgatgcngcagcgngactcgcctgcnacgcgcggccgcccgccctnaagctccggaataacctcgccgccccggtcnggggctcnatttanaagtaactcgtcaaggtttaactgccgtnaanatgcgccnccaaggagntcaagcggggnttccggca

SEQ ID NO: 86192 - DNA, 604 bp, Triticum aestivum
  unsure (1)..(604): unsure at all n locations
  Clone ID: PAT_TA_86192
gtcattcccatcgttatctcctccccacgcccacgcccacaccaccacaccacaatccctctgctttcctccgtcccagcgagcaacgaccgtgctccggcccgcgccgccgtgccccttctcgacccacggggctaaccgcagctccccctgcctcctgtagacctggcactgcctccaatgccacccatgcgtcgccggtcctcgggacgaagctctgctgccacatcgcccccatccaccgatggatccgacctcccacgccacctcccacacggtcgtcgatgatccaagtaatgtggaagcatgacggcgacgagctgtcactacagtctggcacgggctgagattcccgggatgaagggcggcgaccaagcaaggacaatccggcgantcttcacaaatcatttgttcctcgttttttccctccgaaaattcttccttgtttttctctctgaaatgttcncttcctccattttcaatggaggtcctggatccttttangagaaaatgttcggnaatctctcaaatatttatcccttttccccaaaantccgggctttttttgnnaaaataattggggtaaacgtttttangganatta

SEQ ID NO: 86193 - DNA, 569 bp, Triticum aestivum
  unsure (1)..(569): unsure at all n locations
  Clone ID: PAT_TA_86193
ccggatcgccgcctccccaccggtgacgtttgccgtcaatcgcgaatccggcgccagccgttacatcgctcgtccgcccgcacagcctcgccatggatcgcgcgcgccacaagagctcgcccagctccgagcgcttcctcggcgcattcctcccccgcgccggccgccggcgaccagcccgcctcggcggcttccgagtcgacgaagacaactcttccgtcggggtcggtttccccgagcggcgcagccgccgcgcgngcccgccctgccatgtctccgttcgggcggcaacctanccccgcttcgcgcgccggggggggatctccnaggcttccccgaggcttngctttttgcgcccctttgttctccgctcgaattcccgctntccgggatgcctttcgganattccgcaatccccgcccgggccanccnggataaatccgnatcccccgtaantcccgtacccgtcnggaccctntaantctatgacgatagagagacacaaaatcncgccacaatgggcctccggccgatccatanacttcgtctgagntgaganccaaggagac

SEQ ID NO: 86194 - DNA, 620 bp, Triticum aestivum
  unsure (1)..(620): unsure at all n locations
  Clone ID: PAT_TA_86194
gctgagttcatctccaccctcatcttcgtcttcgccggcgtcggctctgccatcgcctacactaaggtgagcggcggcgcgccccttgacccatccgggctgattgccgtggcgatatgccacgggttcgggctgttccgtcgcggtcgccatcggcgccaacatctccggcggccacgttaaccctgccgtcacctttcggctccgcccttcggcggcagattaccatcctcaaccggatcttctattgggttgccaactcctccngtgccatcgtccgggcttcctcgtccaatttctgcaccggcgttgnaaccctananacggntttccggngttgggcccttttanggctcctnatggaaattaacctcactttnggtcgtcnaaacgtnttaccnacgccgccgacccaaanaggttcctnnggacaatgccccaatcgcaacggttaatcgtcgggcnaatctccttgccggcctttccnggggtcaataacctgaagtcttngccccctttcaangggatnacaanacngnttatgggcggccctaacgngtggctcccggttcacgtactttatnngagacaantcgtnccgaaaatanacacangaaatn

SEQ ID NO: 86195 - DNA, 602 bp, Triticum aestivum
  unsure (1)..(602): unsure at all n locations
  Clone ID: PAT_TA_86195
cctggagaggaggtcctcccgtcgccggcgaggcgacagatgagatgagcctctccgccaccttccgggtcgccaaaattccccgcaccaccctccctccaaagtcttgcaaggccaccccctcctcggtatcggcctcctccgcccccgcgtccggagatccaccgcccaaggccgccaagaagaaaaaggaggcggcgccgtggtgcgtctacctcatctcctcctcccgggccctccgtacatacgtcggcgtcacgactgattccctcggngcttngagacaacataatggcgaatttaaaggtgggtgccaaanctcttctggctggaaggcatggatctcncatgccttttcnaaggtttaacnaacagaatgaacatgcaantttgatccaaatggaagaantntccaagaaatacacggaaaggatnacctggatgatcattttgcacaccggaatggatnacaaatnaacttttnggttnaacactcaaataaatggancaactgagcttccaatttgagtaaatttacatcagaanacataatncaatgnagttttgnagntttctcangtttaaagtcagctgntatacta

SEQ ID NO: 86196 - DNA, 649 bp, Triticum aestivum
  unsure (1)..(649): unsure at all n locations
  Clone ID: PAT_TA_86196
gggatcccgatcccatctactctccacgcgcgctgctctcctctcccctgcagcctctctctcgggccatggcgcctgctcctcatctctccttcctcgccctgcaccgcatcgccagggagagtaactccccagcacacgcgcccccctctcttccattcgcccccgctccagtccctcgttgtcgcctctccacctctacgccccgccgactcggccttgccagcctcaccgagacaccgccaccgctcnagcctgagggcctgcctccgtctccagtgggttaccaagcgagcgacatcaccagagctccactcccaaggaccaccttgagtcctcagcgccacacctcgccgccgttagcgccgacaagcgccggctcnactcctcctgnncgtgctttcttttaaccctacttttgtcgtgcgagaactnaggacacnacggnncaatcctatcnanacccttcgggcacgcttgctgtcttgcctggcaaacgtnccgtggattcgcaatncacaacgacaagacacacgatgccgaanaatacgaangaaccaagactacaganaattgtggacaagagtcacacnanttgtgcaatnnacttgaaggaattcctnatgngataaagngtgccaattacatg

SEQ ID NO: 86197 - DNA, 566 bp, Triticum aestivum
  unsure (1)..(566): unsure at all n locations
  Clone ID: PAT_TA_86197
ttcgagcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagatccagctgggcattccaggtaaccgggcgaacaactattaccgtgcagtggcaaaacacgggacttccttacggacgtncttcaacaaagttaatgctgctcctggcggtggtcctccctggggtacttgtttggcggaangatttnatgatggggcctgcttaatgaacgacgatgatnggctgnacnccgttaccaagtnggtgaaacggaatgtttggttnaacatttacaactgctcnattacccgccgnaagntnattgttccaacngactccgctnggaacaactngctaaaactgtccttaaacaactctcancnaaactgggggcnaataaaaaaaaaaaa

SEQ ID NO: 86198 - DNA, 589 bp, Triticum aestivum
  unsure (1)..(589): unsure at all n locations
  Clone ID: PAT_TA_86198
gcactagttaaacaaatacctgtcgtgctaatgactaacccccgcggccttcttcctcccagctcgttgaattcatcgccatgagtgcttccccacttctgcaccaccatcgccatagtatcatcctgtactcccatccagcttcctcatcaaacgagacctgagagaggcaaaagaacagagggctagtcaggatggtggaagcggtggggcttttccaagggaagaggcgcctccgccgccacggggatgcgcggcgccccggaggaggtgcagatgggggagacattcatcttctctgaaaccatcaaggattcatggacgcttcggccgcaactggtattctgcagcggatattttgaactaacctacatgcaagaagacggnaacaagcgtggtgantaactgaaggatacctgtgaaggcctcgtcacacggttacacctaggnccataccttcaaanctccaacttgttggcaaaggtcgacaagtggccnaacnactgcggnctccgcncaacagagaatcaacgaacaacatcatgacagagaagctgaccacatcntgtgtacgccaaatacaaagnga

SEQ ID NO: 86199 - DNA, 573 bp, Triticum aestivum
  unsure (1)..(573): unsure at all n locations
  Clone ID: PAT_TA_86199
ccaaagcgtaaagaaaaagtgagacctcatctctttcagctaagctcgcaatggagctcccatggggtgccctgctgctggcgctgctctccgtctcctcctcctccgccgtcgccacgctcgccgtcacgcctccccctccggcccctgcccgtgctcctgcccccgtcancgcccctgcncccgcccatgcacctcctcaagctcangaagctgaangtctgctgatcaacggcaacttcganacggagccnaggaatgtgaacangaacctcatcgtggggcggcactcnctgccggggtggacnctgcggggccacntcgantacgtctcggcggggccgcanccgggcngcatgttcttcacggtgccncacggngtncacncgctccgcctcggnaccacacgtcngagtccaaaactgtccgtncgaccngntcgntctaancnctnacttgccgcaccgcactgntccaagantaggcntgccatcacctgttccgtcatctcngcncggcgantcacttcganctctaaaggccagacgcgaactggctgggtttncnctccct

SEQ ID NO: 86200 - DNA, 506 bp, Triticum aestivum
  unsure (1)..(506): unsure at all n locations
  Clone ID: PAT_TA_86200
ctgaggttgtctgggagggcgaagctcctgcaagtgacaaggcagagaaaaatgttaccaatactgatgccactaacaggccaactcttccaagcaagccacagccagcagctaacactgacaggaacaatgctccaagtaaaacagcaggcggcaagaaacctgccaaggctgcccccaagcaaggaaagaacataatgtcattcttcaagaaggtataataagcccccgtaaccttccatctgataatgaagccattgattgagcaaacggtctctttccaagcacccgttgcagctgaactggctacacctgaatatcacctcggacaaggacctgttcaccaagcagctgtacgttgtagctttctttcacgcaagctgttacatttgtgttgtactccattagttagtaatggtttgttcttcccgattcaagaacacaagacgagctaaaacgcgcttgctgcgtggtccgtaggancccgctgagttaaaaaaaaaaaa

SEQ ID NO: 86201 - DNA, 554 bp, Triticum aestivum
  unsure (1)..(554): unsure at all n locations
  Clone ID: PAT_TA_86201
accacttcgagcgcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactgggcagctgccgatgtaaccaagcagatccaactggattccaagttanccgggcgaacaactactaccgtngcaagatggccaagaacacgggnaantccttaacggaccgtccttcaaaccaaggttaangctgctccccggnggtnggtcctccctgggtacttgtttgggcggaaattttcccgttnaagatgctgccaataattggccngnancccggtaancaatgtgggnaaaacggaanttttggttcananatttaaaacggnntcaattaccngtcgtaggtcatggttcaagctgactccgctgggaaccaactgccaaaacgtncttcaaaaaaaaaaaa

SEQ ID NO: 86202 - DNA, 587 bp, Triticum aestivum
  unsure (1)..(587): unsure at all n locations
  Clone ID: PAT_TA_86202
actcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagtcccggcggnttcgagatggccggcggggaaaccggcggctgcgactgcaccaacgtgcaattgcggaccgcgtnncggctgtcctgctgcaactgcaactgagcccggngcccaagnaggccggccggnaaangcaacacaagatnangaagggngaaancaanatcatcataacatcaacaacaaccaaggtttcaattacaactancgccgcatgcgctcnncgcncgcgctnaataaataaacnncaaggtttccttaatcttgtacccncccctgtatgtcgacaatgtccncnatgctcaactcaatggaatatatgngccaacttgacgatcaaaaaaaaggggggccgtaccaantccctaagtagtctata

SEQ ID NO: 86203 - DNA, 632 bp, Triticum aestivum
  unsure (1)..(632): unsure at all n locations
  Clone ID: PAT_TA_86203
ccaagatgcattcatcgtcgatgaaagaatacaacttcacgtgttctgtaaaggaagaaatcctgatgtgtgaagttgaagtggaggatgttgctaaagtccaggaacaaccacttctgatggtagagaaggtggaaaaagtgagaactgcacttgctgatctatttgcagccgaaacattctcaccaagtgatacaggggagaagagtcaccaagaagactgtcattattgctgggggcatccacttcaaaacctacattgtgcatgaaaaagacacataaaaagaagccaataaagccaatgccagntccgctggaaggctacgagaaattaatcgancctgaagaagatgctggggaagaagatcacccaagagcagctcaatggacttataatgcagagnactcctcctgcttggngcctaagtccccggacaatttgtttcctctaaccnggttatgttacattccatgggttcctanatgctccggaggccggtccctttgctccagagaactccaacacaactactacgtcgccgacaatttcantgcccanccgcgccgttcgccgcaatgcgaaaanaccgcgtcaaatantcaacccanagtctatgtgataangttntcng

SEQ ID NO: 86204 - DNA, 607 bp, Triticum aestivum
  unsure (1)..(607): unsure at all n locations
  Clone ID: PAT_TA_86204
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagtccggcgggttccgagatggccggcggggagaccggcggctgcgactgcaccacgttcaagtgcggaccgcctgcggctgtcctgctgcaactgcaactgagcccggcgcccaaggaggcccggccggcaaaggcgacacnagatnaggaagggagaagcaanatcatcatcacatcacaacaaccaangtatcaattacaataaccgccgcatgcgctcgcgcgcgcgctaaataaataaacntcagtgtccttattcntacccncncntgtatgttcnacaattcctcctaaagccncactctaatgatatatgggctcaacttgaacatctgtccngtctcaaaaaaaacggtcncgtaccaattgtataacgggctcacgcgccgntnctaga

SEQ ID NO: 86205 - DNA, 602 bp, Triticum aestivum
  unsure (1)..(602): unsure at all n locations
  Clone ID: PAT_TA_86205
ccgcttcctcctcctcttcctcccgctcactcccgaaccgaagcctcaagagctcccaatggcttccaccacgttctcctccgccttctccatcctctctctcccctcctcctcaccatccccctccgcatcggcccccaggaccctccccgtcgccaaccgccgccgccgcgccgtcgccgtcgcctccaccgccactgatccccgaaggtccttggagtccggcgacgccattgccgggtcacccttgaggaggtccgcaaccttgtccgaccatctccaaaacgtcttggcnctctgccgctcctttcgtcccgctgccgcggtccgcggtcccgccgcggcggcggccgaaggagcaccggtccgagaaacggattcntgtgggcatcgaganggccaacaacgcgcgtatccaacatcaaggtttncncgaatggacaactgggcgctaaagagcaaggttttacgagggctcccaaagaactcaangagnaattanaaggacaggccangaggcaagaacacncaaggatcgggcaaggttcaaacgtgaaaaagtatcaaggtcctttcccataatttaagttaaacaaccttng

SEQ ID NO: 86206 - DNA, 422 bp, Triticum aestivum
  unsure (1)..(422): unsure at all n locations
  Clone ID: PAT_TA_86206
ncccanatctccatgttcgtggcgggtacattaactcccttcccttgantgtctccttcgcttcaaccagncaaatcatgcacgangaatctgcactgtgttggtangtgccattgagtgtccttgtcgcttggatcatggngattcananggatctcganttcaagcngcnacagacnggntctctctncatctcggtgctantgacggtcttcancctccaggtaaaaatcatcattcantcatcattcaganaaacantcgtcggtgagggaattttaaccacataaacnaangaaaggaagtcgatttccaattgagacaaaanggatttcctaaactacatgttgtganttggttgcgatnttgctgtctngctgccaagaaaatacacgatnanntcctttacacccagggggggg

SEQ ID NO: 86207 - DNA, 560 bp, Triticum aestivum
  unsure (1)..(560): unsure at all n locations
  Clone ID: PAT_TA_86207
cgccaatgctctgctctacttcagtctaccaacactaccacgaactgactgcagcaaggttctcgtgtctctcaagcgggactcggttctgcccccggttccattaaatttcgcccaaatccaccggaagcagtcaacacggatgggtcgaaactcaagatccagtggcagggagaccgtcgtccatgtcgccagctccgatcaggtgctagctttgcatgtatcaaattttgctcctttaatttctttgaagcgggtgcggtgcggccttgcgggagcaaccgacctgccggccagcgggtcatctcgtcgtctccgatgtcttccgtgcctgatgtgctcccgtaaagtgtaggtcacctgaatttcttctaagcggttctattgccaagttcatttccatggtgacggacgtcgttggcaataagtgaacaatgttgaacactttttccctgaaatcctgctccctgggcactaaccagatggaaaacggactgttccgtggtggattgccgggtcatcaaaaatcnaatgaatcnttttcnctcaaaaaaaaaaaa

SEQ ID NO: 86208 - DNA, 581 bp, Triticum aestivum
  unsure (1)..(581): unsure at all n locations
  Clone ID: PAT_TA_86208
ggcagccctatcgggcgccggcgccccttccgccgccacccctgcctcgccgccaggaccgcccctccctcgccggctcgccgcccgcgcagccgcgcaaccgccccaccccgcgtcgccaactcgccactcccgcatcctaccgtcccgcgcgacctctgctggcgcctggggggagggtacgccgccgcctggttcaactcctacctccctgctccagtacagcgccgaccagacctccctccgcttgaccagtccaggtgcagccaaccaggatgaccaggacgcccggcggttacctccaaacctccctccgctccagtctccagatcaggacgctcggccgacgctgcctttgggtgcatgacttctgtgacttgcatcgtatcttgggtgctanctgttgtgcgtgtctgacttctgttgcctgcactngtactggtcgctaacatcttcgccaatcaatangnattacgatgatcttgtgcntacaattgtatgttgggtgttctatagaataatattnacaacacatgaacaacttctttcaagttcagcnatacanacgggcacaaattgtg

SEQ ID NO: 86209 - DNA, 476 bp, Triticum aestivum
  unsure (1)..(476): unsure at all n locations
  Clone ID: PAT_TA_86209
gagaggaaactagagaaaccaaaacatgtggttcattaattccacataaaaatgtcaaaatacaaaattaaattgggcacatgaaacatactgataataatgatatgtttcatggagggaagccggagcctccccctcggctaatctgtaaactgcttttgtcaatcagaaattcagaatgatatgtttcatcgtttgttttggtaatgatgatctgtggtaggcataatgctgctgataaacataggtgttcttccgcaccaaactgtgagatagcgcatcagaactttagtttgataatcaccgaactaaaccgactgagctttctgcaagtttaatcctccaaagcacatgtaatgctggctttcttccgccaaattaacgaccagtagtaaaggtgagcatcacccgccgccgttgaagacgcgggtcaatgggaaactaactcctcatcgcatcgatatacaagaacgaan

SEQ ID NO: 86210 - DNA, 631 bp, Triticum aestivum
  unsure (1)..(631): unsure at all n locations
  Clone ID: PAT_TA_86210
gtttccgcccgctacccacccctaaatcctcccgactcgccattgtcccgacctcccccgcggccttatcctattcctattcgccccgccgccatggaggccgtgcgcgcgtcggcggcctgggtggccagccgctcctcccacgtcaaggtcgacatgctagagattgagaaggccgtggataaaattcagggaaatgttccaaaagttgagtgggattttgaaggaattcattactttgacaatggaccgctcactgtgcagtacctcttcgtcttgggacgcactgaactttgcttctggccagnagggacnttgacctaatgacaatttggcttccnggaccaagttagcattaagagaaagataatcaacacttgatgcagtngtctgaagaattatactggaccgcaacttcaagaacgctgaatgggcacgccactgcaatngaggaggaagatccgcttctcaanaggtgggccggactgaaaaacttggnacaggtgcaactgtaatcgcggaatcgcncacncgatgaacgatacntccttccggttcggacancacttaaggaacagtttcgaaacaaccaaaatctgcgattggngttagggaaaaaggattaaacatc

SEQ ID NO: 86211 - DNA, 568 bp, Triticum aestivum
  unsure (1)..(568): unsure at all n locations
  Clone ID: PAT_TA_86211
tttttttttttcaaaacttcactcttttcattaccttcttgtccaatgtcatgtatgcatatagtccagctaattacaaaatgtattacaaagtcacgaaataatggccttacaagaaacagggaaagaccaagaacatagatacaatcgaagtaaagaaagttgtaacatgccaaccaagactacaatatatactgaaaagcctataattggcatgtcatccaaatcaggacataaatttatgtgagatttaaaacacctgaaatcagtccctcccaccccacaccgacaacgagtctcgaaaccagcatgcttatgtgttgttgagatggaaacacacatctctagactgacctacttattagttattgtccttgaagcctgtaaggaggggtcttcttctcatccacttgttcaaccttttctgtgcctctcnactctccgtcaattagttctaaggggaccanaacaaaatggtgtctgaaggcgttcccaaacaancacccaataccnttgcccaagatgagaaaaacaagacacacaagtggacacnctagtataagaccga

SEQ ID NO: 86212 - DNA, 309 bp, Triticum aestivum
  unsure (1)..(309): unsure at all n locations
  Clone ID: PAT_TA_86212
atccagcccagctcctctccccacgatctcctcgccaccgcccccacccacgccgtccggttccggcaagcaccggccgcgcgcaacgctcccccaagcgcgcccctccctcccccacaccctgatccagcaatatcccttcctcctctcatcgaccgcttcagcttcgacgacgacggcgccgctatccgcgtcctctccgacgccgacccggccgcgccgcggcagcagcatcccaggggcgncaanatctgtcgcgcgctcgcgctttcgtcgccgacgcgcggcccggggactcctcttcttcaa

SEQ ID NO: 86213 - DNA, 249 bp, Triticum aestivum
  unsure (1)..(249): unsure at all n locations
  Clone ID: PAT_TA_86213
ncctctccnctcctcaatccactctccttccctcaaacatctctcccctattcanaaatttntgcnctngtctcaccatcnacntcgtcccganatncacttcttccanggcgttgatgnaataaatgtcgaccatcgtcgccngcaatgtntccgacgcgacgtacagttgataggaagaccgancgatgtggtnntngtacagtcggcctccctgagatgatggcgtacagcggcagcaaagagcta

SEQ ID NO: 86214 - DNA, 618 bp, Triticum aestivum
  unsure (1)..(618): unsure at all n locations
  Clone ID: PAT_TA_86214
ccccctcttccccccatctccacctctccctctctgtcgttctggaggaagggccgacgcgccctccgccgtccaccacgcgccaccgcggccatcgacctcccctcgacactccgccctgaccaggagctccgggacgctcctccgcttcttcttcgccaactagcacaagccgggacgccacatcgacgccgccctcgccaatcccctccgctggcgtccgcctctgcctcaccgtcgattcgccgccatccgccgctcggtttgcccatcgtcgacaagtccggcaacccgacccctccaagatctttgaccccgaaattgccgctgatccgctgtgattgactaagtngaagaagacccttcttcttgtctgagcaacaaatgtgtaccctggagcaanaacaacgttgacggtacacaactgganacgccgacgacaagattattnngagnctaagcaagaggctgcccttcatnnttgatttgngcaccttaaggacctgcnaantagnggnccaaaatgtgctcgcgacctggtcaantttcnacccaggctgcttaaanaactgatantgntggnaaaaaaaaancnggggcgnacantcccaatggttt

SEQ ID NO: 86215 - DNA, 459 bp, Triticum aestivum
  unsure (1)..(459): unsure at all n locations
  Clone ID: PAT_TA_86215
tggccaccaccgccgccgccgctctctcctgctcctgctcccggtctccctccccttcctccacgctcctcctccggcgaaccgtctcagacttccaccgccgacctgcccatgccggcgtccgccgaccccgcctcgcccccttgcacgtggtggatgactccaaggaggtggagacgaggtcggagacagacaggctggtggacggcctgaacttcggggagctgtgcaacgacttcgagtgcataagcaccccntacgtggagtccacggccaggcantngccagggacatcctcgagatccgccaaggacaaccgcgccctcaagctgctacccgtcgccgtnaaataaaggatctcanaggtatttgtggggcgttaaaaatanaaggngcattgtggataacggngccctgaaaaactagggtgncaaaaaatttaatgcancaaaaacactc

SEQ ID NO: 86216 - DNA, 272 bp, Triticum aestivum
  unsure (1)..(272): unsure at all n locations
  Clone ID: PAT_TA_86216
gacgaaccntntctcatcaagngttcccntgcntgtaattangtgtgatcatncaangctgtnacggatgttaaatttttctcctttccgccngngtgcgtttgatgcnaactcntgcgtgctggtgcacntgtaatgnacgatctanatttcttttcttttctgtntngatatctcctgnatatgaacgtcgattgtgtngttcaacatatntcttgaaaacatctnaatgttgccccntatctgttgacaagatcnaantctcaancanc

SEQ ID NO: 86217 - DNA, 614 bp, Triticum aestivum
  unsure (1)..(614): unsure at all n locations
  Clone ID: PAT_TA_86217
ctccaatcccccctttccctcccctccatggccacactccagcacgctctcctcactccgtccccgctctgctgctgctcgcacgccctcctccacccaaggtccaggaagatatctccgaggttcccggatggggccttctccatggcgaagccgttcttgcggcgcgagtctcggagaggggcggcaccttggcgtggaaatggcgggcgggcggcgcttggcgtggccggggccgggaaaggcccttcttttggcggcgggcggcggcagggttcgaccggccgcggcgggtcnntngggaactcccttngtcgccttcgttggctaactcgttgttaacggcaattccggtggntgntccaagccatcnctcccttctggtcctcaangnacttctgcctatgtggnccttgggnggccanattctttgcacaaagnaataacttaaaatgatttnccaatgtgggaaaattccggtatcaaaaactttnaaaatgggcanaatcntctaatganaactttcgtnaggngaaatttaaaatgtactttacgangaccaaagaaaagctcatatntcactgtataanacttgtngaattattagnatagan

SEQ ID NO: 86218 - DNA, 631 bp, Triticum aestivum
  unsure (1)..(631): unsure at all n locations
  Clone ID: PAT_TA_86218
gaagcgaagcctcgagagctcccaatggcttccaccacgttctcctccgccttctccatcctctctctcccctcttcctcaccatccccctccgcctcggcccccaggaccctccccgtcgccaaccgccgccgccgcgccgtcgccgtcgcctccaccgtcactgagtccccgaaggtccttgagctcggcgacgccattggccgggtcacccttngaggaggtccgcaaccttggtccgaccatctccaaagaacgtcttggcgtctctgccgctccttnnntcccgctgccgcggtccgcggtccccgccgcggcggcggccgangaggaccggtccgagaaacggatttcgactgggcatcgaggaagtgccancacgcgcgtacccaacatcaaggtntgcccgactgacaaactggcgctnaaggagcaagttttatcnagggtcccaaagantcaaagagcatttanaaggacaagccaagaggcaanaacaatccaggatcgngcaagngtcaaaacgnanacaagtaacaggnccttttccaatanatttangttnaaaaactttgacccctaattcgggngtttttnaaaaanagncgcnggattttttaaaaaaaaaaaa

SEQ ID NO: 86219 - DNA, 615 bp, Triticum aestivum
  unsure (1)..(615): unsure at all n locations
  Clone ID: PAT_TA_86219
ctgcaggataataggctgatctttaacaagaatggcgcaatctactctgcgaacctcagttcaacttcttggtccttctatgataaatcaggttctcttctatcacagctcatcatagcgcagaagggtgatgccaacaccacattagctgctgtcctcggtgaggatgggtcgattgccttctatatgctgcagagtgggaatggcaagactaatctgccaaccccaatcccacaggactccgtgtgacacgccaacccactgtaaaccgtactctatttgcaataatggggacaggatgccaatgccttcancctcgggtcttctccaaactgtgacctggtctcaatatcaccttgttagtcaaaagagcgtttcaaactggntcaaactggacantgganttgntataccngtacaattcactcactgtgcctaagacaaacatcacaagttgcaanatactntcaagggaaatgctcaagnncncctgttttcaacaaaaaaagnaatgctcatttgncaaatgggaactncacaaaaagnnaagtaaacaatttcacctcacaaggactacattgtcagnaactggatgattnantgaacnacatatat

SEQ ID NO: 86220 - DNA, 452 bp, Triticum aestivum
  unsure (1)..(452): unsure at all n locations
  Clone ID: PAT_TA_86220
gccggctctcccccgctccgtctccctcccccctcctcccccgctccgctccctccgccgccagatcccgtcgagcccccccgcgcccccgcgtcgaagatgagggagtgcatctcgatccacatcgggcaggccggcatccaggtcggcaacgcgtgctgggaactttactgcctcgagcacggcatccagcctgatggccagacgaacggcgacaagaccatcggaggtggtgatgacgccttcaacaccttcttcancgagaccgggagccggcaagtactnccccgcgcggtcttcgtcnactcnaccaccgtgattgacgaagtccgcacaacgcctacggcagtcttcaacccgacactcatcaacggnaggaggaccggcaaaatttgccgtggcactacaaatcngaagaattgtggtttctcctggacgcatccgcaactggc

SEQ ID NO: 86221 - DNA, 307 bp, Triticum aestivum
  unsure (1)..(307): unsure at all n locations
  Clone ID: PAT_TA_86221
gaggttgcggcggacatgtactgccgtagcggggcgccccgtcggncggcttccctgcttttgatnaagacctccgaccttctcagttggcttgcgctcctctggtctgatntgtggncatgtgggcggngtgtngancagngccnggggaaactcttgtcatcgacngaggccacaacattngacggcaccattttcttgagtgtcnngnccctccttgngaggncttntccgaagcccctcccactgngccaccttgcatcctngtggnnaaagnctcgttcccncttntnctgactgccgtgga

SEQ ID NO: 86222 - DNA, 528 bp, Triticum aestivum
  unsure (1)..(528): unsure at all n locations
  Clone ID: PAT_TA_86222
gcgggcaatccactcaccatcgccgaaccttctcagcacgaagctcaccgggaagccgcccaaaatccccaggagctcacggccagcgcctcctcctactacaaatctacccgccaaatccactccccaacccaatccatgcagcagcagctgagcaagcggcaatttagagggcttataaatacgaancntctccgccggtgccaaatcagtcatggcggcanccggagcggaccactggtctaccaacagcaggcgcaaggcggcgggcgacggtgtattctctttcatgtcctcctattctccccacggggaagcaanttcgaagcctccaacccgggtcaactttttcngccggctcngggcaagccgcccgctgaacggtgatttcccgccgacccgcgccgcatttgaatctcccatactcttcaacangngcgtttgccggccgtcccgccgtntctccgtnccggcctttgncgttnctgattnnacacgcngtacgcaaagacnccatcggngacggcc

SEQ ID NO: 86223 - DNA, 581 bp, Triticum aestivum
  unsure (1)..(581): unsure at all n locations
  Clone ID: PAT_TA_86223
gcatccgcaaccccctcacatcccacaccaagccccacgctcgaaccaccaccaccaccagcacccatggcacccaaggcagcggagaagaagccggtggccacggccgagaagaccaccgcggggaagaagcccaaggcggagaagcgggcgccggcgaccaaggaggccggcggcgaggggaagacgaggggcaggaagaagggcagcaagccaagaagggcgtttgagacttcaagatttacatcttcaangtgtcaaacaagtncaccccggacattcggatctcctcccaaggcatttcatcatgaantccttncatcaacaaatcttncnagaactccccccggcgatcccgccaacttgcccgctncaacaagacccacatcacttcccggagattncaacttcgttcgctctcctcccccgggantnnccaacacgcctnttccnaaggcacnaggcgtcacattnactcatcctaagtntcttgttttcaataatttattgcggagntccttnctttcggatnntngatttacatcccgtaaaatgtgctctgtgttctanaatatgngttc

SEQ ID NO: 86224 - DNA, 506 bp, Triticum aestivum
  unsure (1)..(506): unsure at all n locations
  Clone ID: PAT_TA_86224
ccagcaggcaaaccatggcgctctccgtctcctccctcgcatcggccttctcccacctctccctcccctccacctcgnntccccacccnccccctctcctccgcctccccaccacccgccgcgccgctcgcctcgtcctcttcgcctccggggccgangccgccgagccggtcctcgaggcggaggcgcctgccgccgacgacggccccgangaggtgctcgcggttgatgtcgatgaggacgcgctctccgggctggcgctgcncaagtacgtgaagcagnggctgcccgggggattcnccgcncaacggatcancgccacgggccgcnngnagatggcgtccgcccgcgtnttgctcnangaaggancgggaaaggtcttcatcaacttccgngacgccanggagtatttgcnancgantcccattnggtggngtattgcaagatncctngtgancnaggtttgngaanaactannagtcttttnaatttaagaagtgcttaag

SEQ ID NO: 86225 - DNA, 579 bp, Triticum aestivum
  unsure (1)..(579): unsure at all n locations
  Clone ID: PAT_TA_86225
gagagaactagtctcgagttttttttttttttttttaagatctaagggcatgtacaatggttgataaagccattctatcttaaaacttacatgtaatttagatatgacaataagtacaagcctacaatgggttatctcttagtcttatcttcaataattagctatttctaaaaactgatcagacatattatgcttagagatcatctcttaaataagagaaggtaatttttttcttatgatttctctttgctccaccttangatttatcctatgtggacatcacgcacatgcaccctaaacagccggtggatccattattttccctgaattattgcgcatgctgtgggaagatggggtaccagtcaagtacgcttgatgtttaacctcatctttattactgtcaagcccatgccagccntcaccacccctcaacggattngggaatgtnaacacttcccacggtaacctccgtccnacacagttgtcccgttgactaccngctccccgacccagtanacgcgccgcgcgagtctcaactcanaacgcccgccactcgtnaagcccgctcacatcgctagc

SEQ ID NO: 86226 - DNA, 615 bp, Triticum aestivum
  unsure (1)..(615): unsure at all n locations
  Clone ID: PAT_TA_86226
ttgtccttccccgtcccattccctccgcttcccagtccgcagcagttccgcaccgacaccctcaccctccccaaagccctaaccgctcgcccgctccgccgccatgaggtccaaggccaacgggagacaccgcgttcaaggcctccggcaagaacaagacggccaccggcggcgtcgccaagccgaagcgcgcccccacccccttcttccgccttcctgggctgattcaggccacagtacatggagaagacccccgaggcaaagggcgtccgcggccgtcaccaaaggcggctggggagaaagtggngcaagatgttccggatggagggagaaagcaaattatggcggcaagaagcagagccccaacaaagcaaggcggttgaacaagaaggagagcaccactcccaagaagaccaagactnacgctggacgaagaagnttctgacttttaggatgatnaggaggatnaagagttaatagtagatganggaaacacaacggtgcaaatcaactttgctgcttaanggttaaattgcattccattcccggttatntatgttatttaggagatnttaatcctancctggctgtggatcggaaatctngttgaaaaaa

SEQ ID NO: 86227 - DNA, 493 bp, Triticum aestivum
  unsure (1)..(493): unsure at all n locations
  Clone ID: PAT_TA_86227
ggtctttaagatagatgcagcagaaatcccactgccccaagaaagaacaacttcttcccttcttcctcctcgtcctccaagccaagccaagaaactcctcgtctctccaccctccgtccgtgaaggaaggaggcaatcgggtatggggaagatgtgctgcagccaggaggaggacgaggcggggttcaacctgctgccgctggtgatggccgccttcgtcatcatgctgctgttccgtccgtctgctcgccgcagccccggcgcaggcgctgcgtcctccgtccccgtgctactgacctgacctgggcatcaatggcggtgcngtggtggggaanctccgaccacgattcggcggtccggaaggcangcaatngtctgtngtggtagctttggttggtgtccnaatttccngacgatgctgttgggtggnaagaataacncattctgctgaatcnatnggactgttaaanttaaaaaaaanaaaaaaaaaaaa

SEQ ID NO: 86228 - DNA, 607 bp, Triticum aestivum
  unsure (1)..(607): unsure at all n locations
  Clone ID: PAT_TA_86228
catctctcaacccaacaagcatccatccatccatccatcgccaagcagtgcgcctgcccgcagctagtaagctcccaccggaccaacaaagccagccagccaacaatggcccgcgccgctgtcttcatcgtcgccctcctcctggtcgccgtcgcggtggcgccattcgccgacgccaagggcaagaaggccaaggccgagaagaaggccgaagcgccggcgccctccgccagcgcgcccgccgacgcgcccgccgctgactccccagcctccggaccctccgctgcggatgcaccgggagccagcagtccagcactccgatgattgatgaccatccatccgcccggacccggacagagtngtctagaacattcttaatccgatgattgatccgtcggggngatgatgaaccggggtctccctttcccgttggnaataatgcatgcgtgctgattcanatttcacgattgccgatcaanttttcttctttcttttaagacattttctttcanggaatattcnccgttaatttgttgannnaaattgccntcttgcaagtctgtcttgttaactgcnnaaaaaaggttgtccactcaaaaaaaaaaaa

SEQ ID NO: 86229 - DNA, 644 bp, Triticum aestivum
  unsure (1)..(644): unsure at all n locations
  Clone ID: PAT_TA_86229
gtcgccttccacctctcgcgctcgcctcacatctttccgccactccccccctccttctactccactcctggcccggccgcgctctccatgccctccccgtgaagcaagcacatcctttcgcctcccctattagaccccctagctcagttccgcantggagaaggagaggaagcaggggttcttcgccgctctgaaggaggaggtggtgcgggggctgtcgccggcgaggtcccgcgggaagaccccggccaggagcgcgtcgccggcaagaatgctgatcccgcgccgtcgcaaggcgccgccgccgccgccggagaagcagatggagcagcagcagtacctgccggagcagcttatagcgcgctctggcaacctccggccgggcggcgaagtgctcnagccgctcaatganggcccgacgccgaccgctcccgccggngactcntcggagaggatcccggcggcgggagggttcgggacnggtccgcggcaactgacgccactcgttcaatgnttcggctctcgccggccgggggtcancggtcttcgggatcgaactcgctctctcgggtatggcgcccgtcggcattctcaactgcgancgtgcctcttcatagggaccatgatcttcngaataatctgaa

SEQ ID NO: 86230 - DNA, 590 bp, Triticum aestivum
  unsure (1)..(590): unsure at all n locations
  Clone ID: PAT_TA_86230
gccactcgcaccacagtcatccactcacaagctaagctagcggcgcagtagctcacttcagtccagtcggcatggcggctccgaggggcgcggcagtggtgctggcgatggtgctcgcggccatggtggtggcgccgccggcgacggtgcacgcggccatatcctgctccacggtgtacagcacgctgatgccgtgcctgcatacgtgcagcaggccggttcgccggcccggggctgctgcaccggcatccaagaacctgctggcggaggccaacaacagccccgaccgccgcacatctgcggctgcctccaaaacttcgccaacggcgcctccggcggccctacatnanccggcgccgccggctcccctcaaatggaactcgcctcccctaaaagttagcccaaggtncactgnancgntcaatgaacaatnnacncttggccttttccnactactctgccnncnaagatccattccggananaatgcgcacnatncnaactnacnagcttggggcatcgttcntcacnancccgttgntnnggcaggtngttaanaaccaggtntgccggttgnggnccaanaaaaat

SEQ ID NO: 86231 - DNA, 474 bp, Triticum aestivum
  unsure (1)..(474): unsure at all n locations
  Clone ID: PAT_TA_86231
ccattccttccttccttctctgctcttggccttcttcctccttccccaaggcgagaatccgcggcggattgacccgatttcgatcccgtctccagatttcctccacctccagacacccaccgcaatccgctccccctcaacgtgcgcgcccgcgcaatcccactcgcccccatccttattaattccccttcccttccccacctctaaacctcctcctcctcctcttcctccccggcctccgtccccgtccccgtcccgcaccgccgccgcattgctccngccgcggcgtcnattctagancttaangggcgtctgcattccggtgttttccgttcgatccgntcgggcgtccgattccgagaagaaagtngggtggcgggacggtgctgggggancgcccgatccggagattcaacgcttcaacccgggaanccaantcacgtcgtctgctcatctcacatcctcgtgctccgc

SEQ ID NO: 86232 - DNA, 294 bp, Triticum aestivum
  Clone ID: PAT_TA_86232
actattacacagtcaaggtgaccgggaaggaatctgtggagaagttcatatgccctcacaaggaagctgcaccacacctcactgaagattatgagaaaggtgaagtgccgactagattcaagatttgcctaaaccaagactggtctcggaggactgtaactttaaacccctctttccaatgaaatgaaacgcaagcccctttgcattttctccgaaaaaaaaggaaaatttgctaactgcatatggcaagaacaaatttcactctccgttattaggtattcaaaaaaggggggg

SEQ ID NO: 86233 - DNA, 395 bp, Triticum aestivum
  unsure (1)..(395): unsure at all n locations
  Clone ID: PAT_TA_86233
accgatnccttantanaccaaccancancagctcttgggtcacctctcctctccctgctcctcnatctatctatctctangtttcttgatcnaccggtctagtctantctttantgtggccatggcgaaggtgnacccgaacttggccgtgccgtctctggggatggcggccgcagcngcggcccgcgangatganccggtgacactgacggtgtggcncaagtcnctgctcttcaactgccgggggttcacggtgtncgacnccagcggtaaactggtgtaccgcgtggacatctacncgtccgactcncgagccnaggtgngtgctcatggacgcgcngggcnccccgtgctcaaccntcngcnccanggaaggcatcagcctcatgggcgac

SEQ ID NO: 86234 - DNA, 391 bp, Triticum aestivum
  unsure (1)..(391): unsure at all n locations
  Clone ID: PAT_TA_86234
gacaggctgaggagcctcgggggccggatacaggagatggtcggcgacgtggcgtcgcacgtcgagcgcgcgcggtgcgtgatgacgtggagggacccccgcgccacgaccatgtacctgctcgtctgcttgtgccttgccgtgggtcacgttccgtcgcgccgttccaggcggtgggcgctgctgtccgggttctacctgatgcgccacccgagcctcccggaagangctgcccgacctncccggcaacttctttccggcgcctgccctgcaaggttggattgcctgctttngactaagacanttttgggtttgggtgctgctgtactgctgttacttgatgttaacccaagaattttattcccttgccgtaatggtaatttccttttaa

SEQ ID NO: 86235 - DNA, 368 bp, Triticum aestivum
  unsure (1)..(368): unsure at all n locations
  Clone ID: PAT_TA_86235
actgaaatctatactagcttatgcacatggccgtgtgatgtctcagcaccagatgctcacaaaaaggacaggcagcgtgttcatcctaataatcaatcaatgtcagcatgtacatagtctacaaacacgaaatgcttctgccggtccgtagaaggcgttaggccagagcggcactgatnaagagcaagcggcgccaagcaatatcctgaactgaacatccgcagggatcccggcgggtcgcaccgaacacaaccntngcccccaatgaaacttctggnaaatcctggangctttttcctcctcctgangacaanatttaaagcgtgtgctgcncctatctgtcaaacatctcncccttttaaaggacc

SEQ ID NO: 86236 - DNA, 220 bp, Triticum aestivum
  unsure (1)..(220): unsure at all n locations
  Clone ID: PAT_TA_86236
cctagctcactctcgccagcactagctagctancttagccggnagcaatggcntccaggacctcggcggcgtgcctgctggcgctgctggtggccagcacgttcctggccggcgacgcgtgcancagctgcaagcaancaaccccatccnacgntgncgccgtcccggatctntccancgcctgncatccccacgccatgctcgccattgncgtcatcgc

SEQ ID NO: 86237 - DNA, 258 bp, Triticum aestivum
  unsure (1)..(258): unsure at all n locations
  Clone ID: PAT_TA_86237
gccacccccgcncgcctctccctcccacctcccaatnccgccactcncangcctcttgctcatcngcgtngcagcatctctcnagcttccctctaggagagatctcacagttcgaataagcagcatgcntngaacccctccggtcctcctcncagnaccacaanaaaagangncaagtcnccantggccggtntcaggatgaagttagtcgccgtcgtngccatggangcngcnctcgtcntttcngntgccgncgcc

SEQ ID NO: 86238 - DNA, 422 bp, Triticum aestivum
  unsure (1)..(422): unsure at all n locations
  Clone ID: PAT_TA_86238
gaacccccgcttcagctcgcccactccccatcgccgtcgggtcgcctcctaccctcgcaccaccaccccgcctcctaccccgctccgccaccctgtctccttccccagcgtcgccgcgccgccgccttgctcctaacccccgcacctttcgccccgcctccttccctagcgccgcnnggcccngcctcctaccccgcctccttcncccacgccgccacgacgcctccttcccccgcgtcgtcgccgccgggatccactctagccttctcctangagcccgcnaccagatccatccatggggagggctgggggtgaccacgcttggtcaggccggtctaccgccgncgncgccgtnanggttggcnagctcacgccggctctncggngtcacagaatcggtangtgggtttanangtggggtt

SEQ ID NO: 86239 - DNA, 332 bp, Triticum aestivum
  unsure (1)..(332): unsure at all n locations
  Clone ID: PAT_TA_86239
tcggaggccatccccacccgatcccgacgaccatccatccatccaccccccatggaccacgccccgcgccacggcgtcccgccgtcctcctcctcctcctcctccggcgcggccgccgcggcgccgccggcgacctcgccggagttctcgctgccgccgagccgcctcccgctggaggacatcctcttctgcgtcgacgtggacgccgaggcgcgctccgagatgaaggtcgncgccgcgtcggcgttcccccgcctcctccggctccaccggtctccncnggnccgggcgcgctcatggatccggcgggngcccncccgccccgcggcgcc

SEQ ID NO: 86240 - DNA, 619 bp, Triticum aestivum
  unsure (1)..(619): unsure at all n locations
  Clone ID: PAT_TA_86240
gtcaacgagtttggccctctttgtggtaactacttcttcttttattcggagtatccaatggaaagtgggtctctatcatttagaagtttgcaccaacccatactcttcctctatatcgaatgactggttatgtgtgatgcctcggtggattaggatatgaaattgatgctaaaggtaaccaatctcaccttttgcatatttcctgttaaaacaaaattgaaccatatcctgaatctgcacctattatgttgattgctaattttcttcatgaccctatcatggtttggattgttgtggcttccaagcaattatataacaggagcaaggtttcgtagcatggcccgtgacctcttccatttgctttggacgaatgatgttatataacctttttgtttgacatttggaagtcgtctctgccctttcccttaattgtgaattgccttatgtttgcatgtatatctccattgaaacactctgttcgctgctgctgctcatcttagatataaatacgcatagacanactaatgggtcccaaattaattcagttaagatggnggaatcaatctttcaaacatattagtcgttaccngataacaananatcnataaagagtaatntg

SEQ ID NO: 86241 - DNA, 630 bp, Triticum aestivum
  unsure (1)..(630): unsure at all n locations
  Clone ID: PAT_TA_86241
cacctttcccttccagcaaactcacgcaaccccacccgaagctcccaaccccacccgaagcggccgccatggcccccaaggcagacaagaagccggccgccgagaacaaggtggagaaggcggcggagaagaccccggcgggcaagaagcccaaggcagagaagcggctgccggcgggcaagacggcgtccaaggaggccggcggcgaggcgaagacgaggggccggaagaagggcagcaaggccaagaagggcgtggagacttacaagatctacatcttcaaggtgctgaagcaggtccaccccgacatcggcatctcctccaaggccatgtccatcatgaactccttcatcaacgacatcttcgagaagctcgccggcgagtccgccaagctcgcccgttacaacaagaagccacatcactcccgggagattcagactccgtcgctcgtctccccggcgagtcgcaaacangcctctcgaaggaacaaggcctgacaaatnanatctcctanatgacctgcgtncntgttaactgctgtggcncgancgcttantactnaagtanggnagatggnctcgttgcaaccttttgnnattgtgtggaataattcgtcaatganttatgtca

SEQ ID NO: 86242 - DNA, 633 bp, Triticum aestivum
  unsure (1)..(633): unsure at all n locations
  Clone ID: PAT_TA_86242
ccagccgaaacctcgatatcggtcgatgcaaatgatatctagaacttactaatggctttgtagaagttaagcattaaaatccctcaaaagtaattcatccgcactggttatttgttccaagcaaagatcatttatgttctttaatttctttgtactgtatgccaattttctgattagctgatggttgttcatatcattgccacctggacaagcacttcttgaaggctacttacaatgggtgcacctttcactagttttgcatagcggctgcaaaaaacctcagacctgttctctatgcaaacaaacctggaatacactaggagaagtactgcttcaaagctcagatttgttatatcgangttgggctgtggcggcacacatctttggncaaaacttangangggcaatatgcttgcgttaagttcaaggggcttgtggtcacactcntgacaagctagttcnagttgctaaacatcttccctgggttgaattacnnatgnatttatttgtataataatatcacgacgagtaagataaatatcatcaaaggatacacagtntaataagaatatntggaaggggaataaataagggaaggaagggattaatcccttatcgaacnataagaatana

SEQ ID NO: 86243 - DNA, 642 bp, Triticum aestivum
  unsure (1)..(642): unsure at all n locations
  Clone ID: PAT_TA_86243
agagaactagtctcgagtttttttttttttttttttagaacaacacataatagaatctggatagctttagatcacaaccaaaacaggaaaaacattctcagttcaacctaggactcgaacagtttacagaaaatggtgttcagtatgtctgcaaacatgacatggacgcaacatctaagaaaatccaacaagtaacatgcagcagctcttcagcctaagctgtggcacccttgcccttcttcttctggagcttcctcatgtagaactccagctccttgccctccaggatgtacccatcagctctgccacactgtccagggcgagacgaaatgcaagccagcagccttccaacgctgaactgctcctcaatgtgagagtccaatgtacgtccctgctggcgcttctcaagcttcctccggacaatgttgctctccttgcttcctccgtggcaacancaacaacctcaaactcctgtccctcaacaanatccttcctggnanctgcacaactttcttctccnacgattcncnccaaatgagcagnacactgttgaaaggggacacaantgccaaggatctgnaaggncgagtcccaaaancnttgttgcaatgtaacaaccagaanggcttgggtaaaccaaac

SEQ ID NO: 86244 - DNA, 505 bp, Triticum aestivum
  unsure (1)..(505): unsure at all n locations
  Clone ID: PAT_TA_86244
gcagctcggaccgcaagatagcgtgcaggtgcctcaagagcctcgccaccagcatcaagtccatcaacatgggcaaggtctccggcgtgcccggcaagtgcggcgtcagtgtgcccttccccatcagcatgtccaccaactgcgacactgtcaactagttcaatatataatccttccgacgtgcatgcaaggacgcgcttgtgtggagcttaatgtctacgttgatggagtgctcatacgatattgagctactaaaaataaaataaaagctgcctgcgtacggcacgaagctctgctgcatgtgtatttcagtactatgtctttgtctgcacgttgcacacacactgtgtgcatacagtatatttttacgcgacatgcatgcacgcgttcgtatgcgtgagtgaacgtcaactccttgctgtactctanccgatgtgtactgtcatgtgtatgactactgttcagnaattaatgaatataattatttctaattaaaaaaaaaaaa

SEQ ID NO: 86245 - DNA, 575 bp, Triticum aestivum
  unsure (1)..(575): unsure at all n locations
  Clone ID: PAT_TA_86245
agcagatttctctcattatgtatcatttcctatgatatagaatcttacattgagctgtacaaacttctaccaattcgaccaaaaaaattcagattttcagtagctaaactacgtacaaagagcaaattgatgggcgagtcccatcgatgcatcttggccatggcagtgcccagcaatggagctcaagaatgctctctcgacctcctcggaggcgtctcttctgactaggcacaagacatactctataaccgtggcatcgcagggcagcgtgatcctgcctccctcgctgctcgcgaagccaaactcctccccagccatcctcangagttcgacgaagacgtctgccgaggtacgccagcgggaactcnaacggcacccgttcggnagagtanacacacaatgggccttgtcagcaacgtnctgcaacactcactggcttgcngcaacaagcccngntgcnaccttctcngcaattcttggcaactganaagctcttggtggnnaaggttaatgattttcctgacactnaantccttattcgaantctaaggttgttaagggggccggacaattcc

SEQ ID NO: 86246 - DNA, 572 bp, Triticum aestivum
  unsure (1)..(572): unsure at all n locations
  Clone ID: PAT_TA_86246
ctcctatccatttctcctctcgctctgcctcctccaactaatctccctcgccattgccacgcttcgttggttcctcttcccttctctccccgcgcgcgcgtgctcacgtgagatcgttgatggggaagaaaggtctggtggtggtgaccagcatcctcgccgtgctgacggtcgtgtttggagtcatcagcgcggttctcttggcgctgaaacatcatcaagatgaccatggcgagttctctacgtaccggcgatcaccggcgatgccatgcggtgtggtggcagccatcttggcgtcgatgacgcagattcttgccancgtggccatctgctgctgtggggcgtggcggatgactaagggggccangcgcatcgccgcggtgggcttcttcataactcatgggtcntcgcgatcatagcaattgtnctanttctggcagggccatgttangatttgaagntctgcaaagaaactgntggaatctaagatgtcgagggtncaatttgtgacncnactttttnntctgtagcccgccttaattgccaaacgccantcgganaggcncacaacc

SEQ ID NO: 86247 - DNA, 521 bp, Triticum aestivum
  unsure (1)..(521): unsure at all n locations
  Clone ID: PAT_TA_86247
cctcacagcatcctctcantccttagcttccttccctcgccaccacccacagccaaggagaatgtcttgctgcggcggcaactgcgggtgcggcgccggctgcaagtgcggcaacggctgcggngggtgcaagatgttccccgacgtggangccaccgccggcgcggncgccatggncatgcccaccgcctcccacaaggggagctcctgcgggttcgagatggncggcggggagaccggnggctgcgactgcaccacctgcaagtgcggnaccgcgtgcggctgctcntgctgcanctgcaactgatccggcgcccaanaggccggtcggcgaggngaagcacgangatgangaggacaagcangcanagcaacatcaccagttcacaacanccaagctacantatcacaaccgctgnatgaagnancgcccgcgacgggcgctaaataaaataaagcacgtccgtgtcctaattctgaatgccngtgttgttcacaatgtcttctncggctcantttaa

SEQ ID NO: 86248 - DNA, 515 bp, Triticum aestivum
  unsure (1)..(515): unsure at all n locations
  Clone ID: PAT_TA_86248
accgtcgaaccaccaccaagcctcccctgcagctcctccccaagcctctccccgcagcatcagtcccggccgccccctaaccaccaccttccccgcattgcgtccggcctccactccttctttcctggccagccaccggccaaccgtggcaccccactactcgatcccgtcgctcgttgatgaggagggccggatccaggcgctgcggacccgcacgatgccccgccacaggaagcgcctccacctacctatgccgagagaggcaagatgcgaaggctaccacgggagggctggcccctgcggcggatgcgaactaccacgaagatggatcggagcanccccgcctcccggcgtcgagattgtgaggcccgggcactacgcgccgggcccgccatgaatcaagtgtccttgtactgttgctcaagccaaggnacgtcatcgctgccgcanatgcggnaccaattaggagccgaaacgcatgtctcttggaatctccgaatccggggggcnccgaa

SEQ ID NO: 86249 - DNA, 561 bp, Triticum aestivum
  unsure (1)..(561): unsure at all n locations
  Clone ID: PAT_TA_86249
tgctcttacctctcctcctcctggtccacacgtccgtcccccgtaatatctctcctccctctcccatcccctctctctcctccacccgacgtcgccgtcgccgtccaatctccggcgagatcccctcccccgccggcagccatggcctccaccttcagcggcgacgagaccgcccccttcttcggcttccttggcgccgccgcggccctcgtcttctcctgcatgggggcggcgtacgggacggcgaagagcggggtgggggtggcgtcgatgggggtgatgcggccggagctggtgatgaagtccatcgtgcccgtggtcatggcgggggtgctcgggatctacggnctcatcatcgccgtcatcatctccaccgggatcaacccaagggccaagcctacttctcntcgacggctacgcgcactctctccggcctcgcctgcgggctcgcggggctcgccgccggcatggcatcggcatcgtcngcacgccggcgtanggcaaagcgcagaagccaagctgtcgncggaatgatctancctaacttgcgaaaccttcctg

SEQ ID NO: 86250 - DNA, 546 bp, Triticum aestivum
  unsure (1)..(546): unsure at all n locations
  Clone ID: PAT_TA_86250
gagtctcaagaccaaccaagccctgtgtccgtactggacccggatggaccgtttctctgtgataataataggaggctactgtactcaactgaaaatttcatcaccgcatccccacaaatcgtgtccaggtctccacttatcggatcattttcaagatccttgtcatgggaagagcccccatcggaagtcatgtcgccaaattctttgagactagcaaggcttttctccaaggctgatgacgaccaagactcgttgacgattatccaagaagctagtctcctcagctggcatggatagaaaaagttgcgtattagccaagccctcttgacctgaagttgcttgagaagttgtcggatnaccaagcagtggagataagtcgagggaaangcggtcgaaagagagnttctcttgatgccaatcaacgaagcgctcaangngctcanttggcancggnaattgtccgcntaccaaggggtcggaaagtcgtcccaacgcaaagntacgatgatgatccnccngtaatccgcggccgatnaanttggnggg

SEQ ID NO: 86251 - DNA, 514 bp, Triticum aestivum
  unsure (1)..(514): unsure at all n locations
  Clone ID: PAT_TA_86251
gaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactggtgctgggaagcacgtcccccgtgctgtcttcgtagatntcaagcccactgtgattgatgaggtgaggactggcgcntacggccagctcttcaaccctgagcaagcttacattggcaaggaggatgcagccaaaacttcncccgtgggcattaaacaattggnaagganattgtttattccggcctaaattgttcaaggaactttaaaanaatngcaatggtcnganggattcnttttta

SEQ ID NO: 86252 - DNA, 274 bp, Triticum aestivum
  Clone ID: PAT_TA_86252
tttttttttgacttgggcaatggtactagtgccgggtaggaatatattcccaccactggtaatatatacatgagtggctcgcaagtgcatccactcaccacttacgtgtgctacttatagtcgttcttcattcgccattggtgttgtgttctccccgtcgtgcatgactccatttcattgaaaggaaaccaattggtcacacgatcatacccccaaaaggaacatcccttacaggtaccattggaaaattaaaagaacggtcaaaaaaaaaaaa

SEQ ID NO: 86253 - DNA, 516 bp, Triticum aestivum
  unsure (1)..(516): unsure at all n locations
  Clone ID: PAT_TA_86253
ccccccctcggcttataaggcagcctccctggaaccctagctcgccctcgtacgatccactctctttccccatcgagccgcctcctccttggnacagaatcgagtgcgggggctcgcgcggtggccgcgccatcgttgttgttgccgcggcctatgagttccccggcgcttctggagttgtccaggaggacctccaccctcaacttcatctttcccgagcaacgattcgagctgggacngcccgtgcgctcgccatcgacctcgtcttcaacgcgtatatcaccgccatctcancgtcgatccgcactgctccgaccaccccgggcctcgcngtcagctccttcggcccccgtgacgttggagtccaggagccaagacgccactgtcgatgatgactgctactactcgggaagtgcctactactacntgcaagccgctgacgacnacannagtagtttaggaggatccaagcaagaagcctcgcctcttcatcgtacccaanttggctagcttctt

SEQ ID NO: 86254 - DNA, 672 bp, Triticum aestivum
  unsure (1)..(672): unsure at all n locations
  Clone ID: PAT_TA_86254
ttatattgtgggagggagtaggcctataaacattgaaatcatgatggctgccagattacgacataaatataaggacatttataaaattgacagctcacacatgatgtttcataacctcaagttttgccagctgtgggctgttagggaagtgatgcatcaccactacttattaatcctaatgaaaaagactagagtaagaaaattgataaataaatattaaaattaagccagcacaaagtatggtcctatccatcatgttctgggcacataatatttgatggataaggataatattactccgaaaaagaaatgcaccaatttcttaagataatttttgggtgcatcacttatattttcaatttcaattcatttgacccatagatgggttaagctaaatgtatggaattgattggtatacaatggcatttaatttttaccaaattatatcttgtactgacatcagtgctactacccaaggattttgttgtanataattgtggganaacgtanattcaaatggttggagacatcttcgcacacgcactattggctccccacaactgaatcggaacaatggtacttctgncggtgaatggggcttgccacaacaatgcannngttacatataaactttgcccaanacanattcactcantttagttcangacaact

SEQ ID NO: 86255 - DNA, 551 bp, Triticum aestivum
  unsure (1)..(551): unsure at all n locations
  Clone ID: PAT_TA_86255
aaattccaatcctccatgaaattcctccctcttttttcctttgactccacgccggcgagcaagccactccggttagccagcaccaccccttgaaccttccccttagtcccccacgatccatggtcacagacggtgggtctctggaactggcgatgtgctgtgctgcaagggggcaggttcccttgctggaaccatcaccgtgctggtagctctacggccgccgtgctggaatccggccacacccgtgctgggaatcggtgaaagaaaattgctgggaatcggctattctatttgttacaaccggatgattcaagacgttgcatccatggtgggtgggaggtattttttgccgggaacccccaagctgattgctgggaaccggtactaatttgctggtncggacaaantttttgttgccaccgtcancnacaccatgtgtttttggttggaaccgtanatgtttcctgccatcggtgattgatccctgnacgtcattnttaaaatttttttttttttctntttttttttatgaatgncatctaattcactaa

SEQ ID NO: 86256 - DNA, 507 bp, Triticum aestivum
  unsure (1)..(507): unsure at all n locations
  Clone ID: PAT_TA_86256
ccccacggcctcacacgtcaccgcatcccagtcccccgagtccgtcgacagcgactgccccgtcgccggagaaaatgacgtcgaccctggtcgccgccacctcccgccctctccaccttcccgcctccctccgttccctctcctcgccgcctcctgtggcccgccctggcggcggcggccgccgccgccgcgcggtcctgcgctgcgcctcggtgtccgagatcgcgcccgccgtgtccgccgcctacggcgccctcctcgtgggcggtggcgcgttcncatatgcgcggtcgggggantaaagntccatccttggnaggggcctccggatntgcgctcaagggcctcacatattatctgatgcagttttcggangacaaaggcactangtgatgctgtnngatttgggtctgcctttcngtttgcctnanngtttggtanaagttntanaataccgtaaactgggcancngggcttcttanccccccgangtgccggtgatcttta

SEQ ID NO: 86257 - DNA, 469 bp, Triticum aestivum
  unsure (1)..(469): unsure at all n locations
  Clone ID: PAT_TA_86257
ggcacccggacggccggaaactgagctgcaganatggcgtcgtcggattctccgccgccggggaagccccctctgccgtggcgggtgcgcctgctcgtgggcgcagcctcattcctacactccgcgtccctccgcgccgacggnaccgtcaaccgctccctcctctccctgttcgaacgcaccgtccctcctagctccgcgcccgatgccgccggcgtttcgtccaccgaccacgccgtcctcagccacctccgcgtncgcctgttcnttccagcgcccgccgctancggcagccagagccagctgccagtggttgtatatttccacggnggnggttcgtttncaatccnttggccnacggccagttcnacctctttncgccgcntcgcagggtntancnggccgtcntcccctccgtggactatcgctngcgccgatcacgttcccttnntctanaaccaccggacgc

SEQ ID NO: 86258 - DNA, 669 bp, Triticum aestivum
  unsure (1)..(669): unsure at all n locations
  Clone ID: PAT_TA_86258
aaacataaacatataaggattctcacaaacagagcagaggagcagctgaactaattacatataacatcctaatccagtagtgtccaacaaacttatgactggctcaaaacaaagctcgcacatactctaagataggctttgctacgaaagttctctgatctaaagccttcccaatatcccctgttcctcacatggcgtccctcatctggtcaagggcacctgggtcaaccaacatagcacattagcagatcgcacgtgctcaagagtttcaaatccagccatttccacccaactcccctgcctgcagtatagaaatttctgtaggcataatgggatggcattatcccagccattctttcagaaattcttccgaaccgcattgactcaagtaggagcacgaatcgccaaaaaacgtagccaagaacaaccacatttgacatcagcatcagcagacagcaccgcggcgtgccatatccacaaacctcccatcggagctgcggagcccggtggaaaaggaccggtgcttctggccggcagggatccagacgacgactcgcgccgcacaattagcanccggnaggcgtgnngtaccgagaattcangccataatgggnactctggcagggaaccccaggggatcgccggnnttnaaggaangacaatcccccn

SEQ ID NO: 86259 - DNA, 239 bp, Triticum aestivum
  unsure (1)..(239): unsure at all n locations
  Clone ID: PAT_TA_86259
ccgagttcctcttcagcacgacaccgccgccgcacgaaccccgcaaggatcgcgcccgatctccctgacccctccgcgattcggtccatctcaaactgcaacgtgatctctacgaatccctcatccgattccccgaaacgctgctccgagtttgccctccggaatccgagcgcgacgaccccgctaatcgcagccgcctgaagctactcccggcgacaaatccnggccgccccatgcaa

SEQ ID NO: 86260 - DNA, 531 bp, Triticum aestivum
  unsure (1)..(531): unsure at all n locations
  Clone ID: PAT_TA_86260
caaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacacgaaggatgacctgaagcttcccactgatgatgttctgcttgggccagatcaagactgggatttgctgatgggcaaggacctgatcctgtctgtgatgtccgccatgggtgaagaacagtctgcgctgtgaaggaaaccggtggtgggaagtaagcactgtgcgtggttgcctacctgcgatacttggtatctaatgcttccggggtgtttggagatacacatacataggcatcaagatatctgttggggtgaaacaatttgatccaaatttgtgtgttttttacaccgaatgccnangtgctgctaatacttgttatc

SEQ ID NO: 86261 - DNA, 169 bp, Triticum aestivum
  Clone ID: PAT_TA_86261
cctagatgcagccttcgaaactttgtttttgttggacgcgctcgtaaacagcaacggatttacttgacttttatttattattgtttgcatatttgtgaagtggtttatttcgtcagttctcctagagactgactttaccaagattttttacgaacttaaaaaaaaaaaa

SEQ ID NO: 86262 - DNA, 687 bp, Triticum aestivum
  unsure (1)..(687): unsure at all n locations
  Clone ID: PAT_TA_86262
ccactccgcagcccctgctccaatggcgctgtgccggacggcgcccgccaactcctcctgcttccacccccgcgccgtcgccagctcgccctcctctctcagcgtgggcaccaaggtcttcgtcgggttgaaggcccagaccaggctcggctcgtccgagtcgtcgtgcccgaatgtcaacgcccggttctacaccgccgtcaaccggagggtctctctagggttgtcaaacaagagggctaccaagggcacgtatttccatgatgcctgtccggcaccccacgggtaccgttacaagaacacctgggtgaaggaacctggcaatgggcttgacatatgggaatgctttatatccgtgaacggttatcttcattgggggacactattgatgaaagantcaataaccaaattactgggcaacatgctgtatcttgacagtgttgatgacacaaaagaagatcctctatacatcaatggtccaagangagatctacacatgcatggcgtttatatacatgctaagcctaaagatcaattggactcantgctgggctttgantaacttggaagattcantctnanctgtcaaagggttcagtacggnagccncttcctgttaattatcactctgacantcaggcagctatatttaaacagtaacaattaccatcanatnctttngagtna

SEQ ID NO: 86263 - DNA, 637 bp, Triticum aestivum
  unsure (1)..(637): unsure at all n locations
  Clone ID: PAT_TA_86263
ggtgacgacttcaccgtcctcaacctctccagcagccccaggaggctaccaaggttggtggtgttcaagggcgacaacaacctctacttgagcggggtgacgatcagtggccgcaactacctgcagttctcagcgcgcgaccccggcgaccccacggtggcgcacgagataacctaccccggcagcaacaacagaatgcacctgcgcaacatccaccacaacatgatgtgggggtttcgcagcatcgattcagagtgggtcttggccaacatcgcccctactcangcgggggggtcaactccatgttccaggccgtggattcaaggactacttcgccctcaacaatcctcctccggggtcacacgctacctcanaaggaggacgagtggcggcatcacaaactgcctcaacggcggtccacgagcaagggcatcacgccgaccncggttaggtggaggaccctcctgacgggaatctacaantcaatacagctgaacaattcaggnttacgaaacaggtataacatggcacacggcgcgtcatgacactcaagngaaataaaagtatccctacagatcnattacactggancncctcagtaacnggaaatcagtccaccggttcaantcgctggncn

SEQ ID NO: 86264 - DNA, 572 bp, Triticum aestivum
  unsure (1)..(572): unsure at all n locations
  Clone ID: PAT_TA_86264
caccacgccaccaccgatcgcatcgcgagttcgcgaccatggacgacgttgtcaccgacgcgccgccgccgtcccgcttctcccccgacgacctcgacaacttcgccgcacccctgccgcagcccacccccatcctcgtcgtctccccaaaccctaagccccgccccgcggctcctcgtcgtcctatctcccccacctccctcgccctcctcccctccccgccgcctcctctccacgcctccctcctcctcccagacctccgacttcggggtcatgcggcgcgtggcggcggagctcggcgtcgatctgaaggccgcggccagggtctccggccgggccgggttgggcgcgctgtatacttaagatgatatcccttcnacttctctgtgctcatggttcgtcttgtttggttgtgctattgagaagagaagttnagagaaaatccaaagatgtatcanggattcagtattcaacaatgtttgttcgggnatttgcnacaggattatggnacaaantaacttacnatgaattcggtgggcatcatgttttagttgttaatgtttcatgctgnt

SEQ ID NO: 86265 - DNA, 587 bp, Triticum aestivum
  unsure (1)..(587): unsure at all n locations
  Clone ID: PAT_TA_86265
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcaacgctttcaacgcgtgatcccccgacttcaagtnccaagggcgggcgatttcaaccgggggcaaccggaaccgggcggngattccatctaacngggaaaanttccccngaccaaaantncgtccancaaagcacaacaaaccccgggttttcccccaatggcnaacgccggggnccaacacnaagggtcccaattntttcaatctggaacgttccctgcaantggntccancggaaacaattgccttcngcaaggcctccangnatgganttcttcaagaaatccaaaaggnggtcccccanggactngtcaacaggggncatcanganngggcaacttaatntc

SEQ ID NO: 86266 - DNA, 600 bp, Triticum aestivum
  unsure (1)..(600): unsure at all n locations
  Clone ID: PAT_TA_86266
ctcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcaagcgagactgggggctgggaagcactcccccgtgctgtcttccgtagatttcgagcccactgtgattgatgangtgaaggactggcgcttaacgccaagtccttccaaccctgagcagcttatcaattggcaaggaggatgctgccaacaacttcgcccgtgggcatttacaccattgggcaaggaattgttgatccgtgccttgaccgtatcaagaacttttcaaacaactgcacgggctcccangatccttgtcttnaacgctnttggaggtngaatggtccnggcttggtccttcngcgggagncncctgttgacatggaagaatcaaacttgggtcaanngttccacn

SEQ ID NO: 86267 - DNA, 269 bp, Triticum aestivum
  Clone ID: PAT_TA_86267
cgcggagggctcgtccacgtcctcgtcgctggccaggctcccggtgctgctcaccggcatctgcagcggcggcgcggggtaggcaggggcagcaccccgcaattaacacccctcccgaggggcgtttacgccgcgtacgtgaaagcggactgaatgcagcatgattcttttcttcaccccacggaacggattccctctgccgcttcatttctccttccctccgttattaaataataatattttgttgttgcccttggaaaaaaaaaaaa

SEQ ID NO: 86268 - DNA, 587 bp, Triticum aestivum
  unsure (1)..(587): unsure at all n locations
  Clone ID: PAT_TA_86268
acagagcagagcggataaactcagagggagatcatcaccaaccgaccatgtcgtgctgcggaggcaactgcggatgcggatccggctgcaagtgcggcaacggctgcggagggtaatttatcatctccaatttcctcctgatcctgcgttcgatctctcgatctttagccttctttctcaaccttttctttaaatctctcctcgatccatcttgttgtgccgcctaacgacatgcacgtccatcgatctcctcttctccttaacaactactccctataaattaaagagatgcgcatgaacaacctgtttgtctgtcgatttcctgggagagatttacaggatccttggttaatcccgattggataatgattgtccttgtgcatgcaagtgcaagatgttncccggaaatggacgaaggggtgaacacaactcccaaaccctcatcatgggcgtggcccctccaanggcacccgtcgttcnangccgccgcccaaaacggaggatcaaatncggcccaacnntcctgcaacccgtgacctgaaatgatcaccaatcaagaaagggaaccaaggcgggctgatnaaggn

SEQ ID NO: 86269 - DNA, 574 bp, Triticum aestivum
  unsure (1)..(574): unsure at all n locations
  Clone ID: PAT_TA_86269
atctgtttaagaaggattgttgtacatcaggtacagcctcttatagcttctatttgtcatctagatgtttaagatgtttggtctgatgatctcccttcacatttgcttgtttaaacaaacaggaattaaagtttacggaatgcgagaaaaataaatgcataactggatctgtgattcggtgattttttgaatgtgaaggtgcattcttacaaatttctgctcatgttagttagcccctgggctgcattatacagacaacatatttaagatacttttggattataaagatctccggacatgatcatatggtatttcaactttttgggatttgcatataatgctgacaccacatgggactcctgaaggaagttgtgctaaacngctaactttccctgcttttcccacttgggtgttcaatggatggaggaggtataaccngtcccttaaaagcgagcaanccaaaacaaaaccaagaggtacccgacaacacggacgacgctacccatccacttanaccngagggaacacaaaggatccaccngnacagantaaaagtctcaacgtccggganaag

SEQ ID NO: 86270 - DNA, 569 bp, Triticum aestivum
  unsure (1)..(569): unsure at all n locations
  Clone ID: PAT_TA_86270
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcaagcaaggagtgctgctccggcgtgcangggctgaacggcctggcccgcagcagcccggaccgcaagatagcgtgcaagtgcctcaaagagcctccgccaacaagcatcaaatccatcaacatgggcaangtctccggcgtgcccggcaatncggcgtcagcgtgcccttccccatcaacatgtcaacaaactgcaacaatgtcaactagtcaatatatatccttccnactncatgcatggaccntttcttgactnattccnacttnatggatgccaanacaagttgactacnaaaataaataattcccgnggtttattaatatgtgtcaat

SEQ ID NO: 86271 - DNA, 576 bp, Triticum aestivum
  unsure (1)..(576): unsure at all n locations
  Clone ID: PAT_TA_86271
gaagccaaaggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccaaggcggcgactttaaccaaggggcaacggcaccgggaggcgagtccatctacggcgagaattcgccgacgagaattccgtccacaagcacacaaanccggggattctctccnatggcaaacgccgggccnaacacaaacggtccaattcttaatctgnacgttccctgcaatnggttccaaggnaacacttngtcttccggnaagcctncnanggatggactctcnanaaatccanaagggggtcccnnnacggaactgtcaaacaagtctcatcccnatgnggcantn

SEQ ID NO: 86272 - DNA, 631 bp, Triticum aestivum
  unsure (1)..(631): unsure at all n locations
  Clone ID: PAT_TA_86272
gggaggtacaaataattgtcaagtttttcattcgagaagttataagttgcattttcccggagtcttcagaagcttcacaactttcatgcgaacacacgaagttaaatattttttggtggcccatagtggggcactagcatttaaccagtagatggaaatatatgctagctatgctaggagtgtcccaaccatcacagtaacagcctggccttgaatttttatcctctgatttgcagcgttaaactctagatatagcgttccatccttttagatacttngaaaagctgtaatttcctgttccccagcttngcgaacccaatatggtgctacggcacaatgtgcactggccacaaaccgggcctcanctacccccatttgggggagaagaaacgtgagaagaatcataaccgtttaagnggtgcctgtcccgggacaaaaactctgcacaacttctaantgttccaagttagggacacccaanactctcnctgagaaatccacaatgaatctcggtgaccccccgtnaccnanaagggncgctncgganaggngcacctntcagggggncnatcacaaaaacccgtgggaacnccccnaaggttcccctggtttaccggagaatnanaggacn

SEQ ID NO: 86273 - DNA, 668 bp, Triticum aestivum
  unsure (1)..(668): unsure at all n locations
  Clone ID: PAT_TA_86273
tttttttttcgtttcttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgagcaagattcgcgccccttcgtaacgaacctgtncaacanggntttctaaagncaatncaatnantggctngaacaangtgnanttttccccanggtgtncnaaagncccnccaaccaaatttntatacaanaacctccccaaagantttcggccaaagctnganatgnccaaacatgggatacaccctgtganctanccgggtacacccggganaggnaaccatactcggggtgnaaaanaaacaccgagacatttttttttnaaaaacaccncgncaaanaatcancaacccaagnttttcggntcccttnaattaccaaaanggtccgggnanaacgnttgggngccccctngnaanaggcactatgaanntgcgcggncctnnatttacgccaaanaacaaaccaaaaaggtcgttccagnaaccaacctgacgctcccgaggtganggccnaagttaagtaacattaacaacngggccaccaggtnan

SEQ ID NO: 86274 - DNA, 515 bp, Triticum aestivum
  unsure (1)..(515): unsure at all n locations
  Clone ID: PAT_TA_86274
gctacttctcctcttgctcgttgaccagcggcgactgtctcgtccccttccgccccgtgctcgtactccacctccggtagcagatccggcgcagctacccacccacactgcgcccgaccacctctcgagctacgcctcctccgttcgacttcgccgccgcaccactggggcgacttactctccccgagctcccgccgcaccaccctgtgctgagtactgtagtccccctcccgccgcagatccggcacatccatccatttccggccgcggatccggctgcagccacccaccaccggctcgacttcgccgccgctccactgcagcaccgcgtcgctccgaatcacttggttacttcttgcctccctcattcaacaagcgactccgctcctcatctcccgcggnacaacccgtatcatatccgctcccctcccgctgcagttcggangtccgtcnactcggcgcggttcaacgnagnaccaccatcttgccccgacactctcaattagctcaatgtt

SEQ ID NO: 86275 - DNA, 438 bp, Triticum aestivum
  unsure (1)..(438): unsure at all n locations
  Clone ID: PAT_TA_86275
ccgcaaccccgctccaaaccctactcctccccgggccgccgccgccggcggcattgccgccgtgcgcgccgactgtgacaaggccctcgcgtacctccagcgcggaaacccgtccaaggcgctgcggctgctgagggacgccgtcgcgcgccacggcgaggggtcgccgctcctcctccgcgcgcagggcaccgtgcactcccgcgctgccgcccccctcaacgaccccgccgcccgcgcgcgccaccaccgagccgcgctccangccgcccggcgcgccgtggagctcgcgccggactccctcgagctcnctcacttccacgctctgctcctctacgangccgcctcnggtaaccgcgactacnangacgtcatcgccgantgcgatcgcngtctccgcatctaggtgcctccggancgggaacccactgcctcaag

SEQ ID NO: 86276 - DNA, 634 bp, Triticum aestivum
  unsure (1)..(634): unsure at all n locations
  Clone ID: PAT_TA_86276
gctccgcacgttggccgcgaagaaaaccctaggcctggcgctcggcggcgccaggggcgtggccacgttcacgctccccgacctcccctacgactacggcgcgctggagccggccgtctccggcgagatcatgcgcctgcaccaccagaagcaccacgccacctacgtcgccaactacaacaaggcgctcgagcagctccgacgccgccgtcgccaagggggacgcgtccgccgtcgtccacctccagagcgccatcaattcaacggcggcggtcatgttaaccattcancttctggaagaactcaacctatcaatgagggtggtggtgagcacctcatggcaaactttgctggggccattngatgagattttgggtccnattgagaaattnataaagaagatgaatgcaaagggtgctgctttaaaagatctggatggtgtggnttgctttgggtaaagagcaaangttcaatttgaatancctaatcaggactcttttgacaaaggnaaactgancttgttggaatnatntcgggacagctacactgaatnaaaactnggcggctacnacaantcggaagggnnactgaatntctgaaaatttaaatgcttctattncgantaaaanatctt

SEQ ID NO: 86277 - DNA, 633 bp, Triticum aestivum
  unsure (1)..(633): unsure at all n locations
  Clone ID: PAT_TA_86277
agccacagccacagacgcgcgaagcgatatcatcacgagtgagcgtctaggcgggcatccatggcacagtcgatgctcatgtccggcgtcaacggcgtggcctccggcaggagcctgctgcaggcggcccggccgtcgtcggcgtccacgcccttctcgcggctcgcgctctcctcctcctcgtcggcggcagcgtactacaagcacatgccgtccctctccgtccggaccatggccctgttcggcaagaagaccaaggccgcgccggccaagaagtccgttgcccccaagcccaagaccgaggacggtatcttcggaactccggcgggatcggttcaacaaaggagaacgactcttcntcggcgtgttgcatgattggttcgccgcatcgatcttgggaaaagcatcaccggnaagggatcctgtcccaactgaacctntagacggatcccatttacgangnggaccctctctcttctcancctcttaacctctccgtgcatccgcgcctcggaacgcggaagtctcaacaacaaccacaacggctcanaagcctnatncccggaaaggntcgtccgctcgttacaggaggcctntcgntacatcaanacttttggcggtgccacngattct

SEQ ID NO: 86278 - DNA, 557 bp, Triticum aestivum
  unsure (1)..(557): unsure at all n locations
  Clone ID: PAT_TA_86278
agatcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctgggtagggagaatttgctgcggtccatctgggtgggtggtggtgtggctgtttcagctgctgcccctgctgctgggangtgctgctgcccctgcagctgagtcaaagaaagaagagaagnccntggagaaggaagagagtgatgaatgacatgggttcatccgttcnactaanttgtggggcacctgtgtcctgaantactacccttgggcaaagaaactagatccatgatttttacctttattaactgattgttaaacgctggnaaanatttttganagtaatcaaccctggttgctggttgattacggggaacatacttgc

SEQ ID NO: 86279 - DNA, 615 bp, Triticum aestivum
  unsure (1)..(615): unsure at all n locations
  Clone ID: PAT_TA_86279
caagaagggcagcctgggcaccatcgcgcccatcgccatcggcttcatcgtgggcgccaacatcctggtgggcggcgccttctccggcgcgtccatgaaccccgccgtctccttcggccccgccctcgtcagctgggagtgggggtaccaagtgggtgtactgggtccggccccctcatcggcggcggcctcgccggcgtcatctacgagctgctcttcatctcccgcacccacgagcagtccccaccaccgactactgagcaagcgagtcagcgcagccagcctgcttgcttgcgttcaanccgccgcctgcctgcccgtccgtccgtgtgatctatgatcgcgtctctccttcctttgcatcaccatgatcctttaatttgcttcctgggccatcattttgttgtgattccttgactgttaaacggggggccngtaccaattcgcctaaatgancctattcgccctcacggcctcgtttanaactcctnacgggaaacctgcgttaccaaattaacncctgcagaaatcccntngcaatgggtaaaacaaaggcncacgntgccttcaaanttnaactatgnaatggaaccccttacgcataaccgngngttg

SEQ ID NO: 86280 - DNA, 537 bp, Triticum aestivum
  unsure (1)..(537): unsure at all n locations
  Clone ID: PAT_TA_86280
tttttttttttttttttttttaagagcaaaacctcagttgcacatatatttcctccttatgtttatgcacagcgccaaatggcatcaagtttcagcatctcagactcaatcctataacattttgagcttttcatcggtcaacatacatgtttacaagacaaggacacatagcataaccaatcaggacacagttcactcatgcacttctagactaagaaacaaccatttaaaatctcgcgcatcgcacagagtctacaactaacaagactcatgatgattgccctagcttcccaccactcgtatcggtagcccgcatcgtcatatatatccggcaaaattcgttcgancaagcangtagtagtctcaaacccttgnaggtaatccaggagcaccacgatggtctagagaaggaacattgctgccgcnacaacccctccatcaacgccgcctatttgccgaaagggaaccacgcttcatcgtcaatttaggccttgacttcncttgggatnaatngtttgcatcctgggtgaaattccc

SEQ ID NO: 86281 - DNA, 408 bp, Triticum aestivum
  unsure (1)..(408): unsure at all n locations
  Clone ID: PAT_TA_86281
ccccggcggtgagtgatccagctgcgaattcttcaattgtggcagggagcgatctcgtcgtaaaacccgcctccctggtgacaaagcccgcttctttaaccacatcaacaagcacccccgaagtggacaaaaagcggtcatcgggtgctatcagtgacaaggacgttgggataactgcaaataaaccaaggccgcctgcttgcgatgtttccaagcaaatcaactaatctagaaggcttttattcccctgaggcaaaggagctccgtgtattaattgagcaacaccaaaatattcttgctaagagaaaacactctgctcgaagaagctcaaatccctccgactaataacatctcaacaccaacctttgttctcccgccccggnatagcaacaaagtacatctcaatag

SEQ ID NO: 86282 - DNA, 371 bp, Triticum aestivum
  unsure (1)..(371): unsure at all n locations
  Clone ID: PAT_TA_86282
ccgccaggagcctcggcgccgcagtcatctacaacaagaaggccgcatgggacaaccactggatcttctgggtcggcccgttggtgggagcgctggcggcggcggcgtaccaccagtacatcctccgggcggcggccatcaaggcgctcggctcctttcggagcaaccggagcaactganccggncggncaataatttaatgcaacggtnaaccaacgcgctaactaacgtgttggcaataatgcatgctcctcctcgtgtcgttcaatgtcctctctgtgcatgcatgtnagtnaganaaagaccaccatggatngctgttttcanttgctcntcaattattaatccttgtcaacgttaaaaaaaaaaaa

SEQ ID NO: 86283 - DNA, 197 bp, Triticum aestivum
  unsure (1)..(197): unsure at all n locations
  Clone ID: PAT_TA_86283
taaattggnaatttnaaaatcctngatcgacttcaagatgaaggtcagccatttgaaacgtgacgtggcttggagtgagaaaaccagataactctactcaantgntttaatancgtntagttcnataatatataaatagtacttccncngtccnataatatangagtatttttgacacnagtgtanntcacacgaga

SEQ ID NO: 86284 - DNA, 256 bp, Triticum aestivum
  unsure (1)..(256): unsure at all n locations
  Clone ID: PAT_TA_86284
aactcctctcaaagccttgctcccgcttnccctcnangcgccgccgncgccgnctncgaancccctccaagccaaactctcaaacnantggggggcanaccccgaaattttttcccaanaaaccnaaggttttttncaacaacacaaaagggcgccaaaggngaccaaggncggcnaangagggtaaanacntntttcnggaaaaatnttgggccttgggtttcaaaancccaagggaaaccanttgaanggaccc

SEQ ID NO: 86285 - DNA, 157 bp, Triticum aestivum
  unsure (1)..(157): unsure at all n locations
  Clone ID: PAT_TA_86285
gcaagccggggctaccnggtagtagctccacactggcantcaatgcgcgaaaacgctcctttcaancgccgggttgcnagcaagcaaacaacaaccaattnaaagttgnaagggctctccaaaaactcttcncaatnaanaaattccccaaaaaaac

SEQ ID NO: 86286 - DNA, 602 bp, Triticum aestivum
  unsure (1)..(602): unsure at all n locations
  Clone ID: PAT_TA_86286
cccaatcccccaaatctcctcaacttcccggcgcatctccgacgacatggcccgcaccaagcagacggcgaggaagtccaccggcggcaaggcgccgaggaagcagctggccaccaaggccgcccgcaagtccgccccggccaccggcggcgtcaagaagcccaccgcttccgccccggcaccgtcgcgtccgcgagattccgcaantaccagaaagagaccgagtgtcatccgcagntcccttnccacgcctcctccgcgantttgcccaaganttcaagacgactccggttccaatcctccggcgtnttccgccctggcaagaggccgcccaanctaatttgtggggtcttccnaggaacaacttcctgcgcatccaagccaangctnacatcatgcccaaggaatcaactngcccgccgaatccgttgcaaaaggcctaggccaatctnncccnttatgtttaggcaacttacttgtcnaccttggaatntagctgcnattttgtcntcatcctggattaattgtcgattgattnacttctgcgtntantacnaaataaatttgntacttcaaaaaaaaagggggccgnccattcccan

SEQ ID NO: 86287 - DNA, 332 bp, Triticum aestivum
  unsure (1)..(332): unsure at all n locations
  Clone ID: PAT_TA_86287
gcctgtcaaantgcctcagcctgatgggattattggccctgacccttacnacttcaantttgatcggcncggggngcgtgtccaaatttccaaaatccccctgggtttataaaggnacngtgatnnatgaancaaattgtcccaaaggagaccacaatatgagcattnatccatccccgcganaatnanaaaggnatttatttacgtgctaantacctgacaaaaaaggatgcatgggctgggaacttnntaactanctccaaaatccgaaagacaccaaaaaacgatttcccaaaaaaancccaaaggtttaaaaatccccgggtcnaatc

SEQ ID NO: 86288 - DNA, 436 bp, Triticum aestivum
  unsure (1)..(436): unsure at all n locations
  Clone ID: PAT_TA_86288
tgacgatgtcgtcgccggcgtccacccacctcctccgccccgcgcccgcggcgcccctgctccctcgccgcgcctccgtgcagctctcccgcgtcgccggcggagctgcgccaaggagcaagagacggancggncgcttgcggttgtcccncgggcaacgcgaagttggccaaggcgcccggggccccgcctaaaacaacgagtccctnanctaaaanttaaggccaagggnacatggaggaaaagggctnttccaaaanattaaccnaagccctncaaggggatggattgggttnantgacttggaaggtgtttaatcaaaaaagggatcnnaaatttttttttaaanaaagggggaaaaaaantcnaaattancgggggtnccctnaaaacntngtggaaancnatcaaggantttgttttaaanntgaaaacc

SEQ ID NO: 86289 - DNA, 505 bp, Triticum aestivum
  unsure (1)..(505): unsure at all n locations
  Clone ID: PAT_TA_86289
cccgttccccacctcccccttcccgtcgggccgtagccaccgcaccgcccccgatggcctcctccgctgccggcgccggcaagtcactgatccagacattccgcaagttcttcaagaagccgtgggagatcaccggcccgtngctcctcgcccgagtaacgcaacgcggtnccgggtgcgctcnaatnacgtnaaaactngccgggcaaccttcgaaggaatncttaagggcnttaatccaaacttcgnacccgnaaaccntntnagaaatnattttanacccgcgaaatgccnccnaaanggcccgcnttnggncaaactctcctccnaaanccctnttnaagcgctaaatggccgcnaagnatttcgaccccgcnaaggattcccgtccccaagtnaattcngctgtcnantaaacnaattcgggggggggtaaacaagtgntcangtcttgtggnnaactgnaaaaaaantgaccaattaattcgnttccttaaagccttcc

SEQ ID NO: 86290 - DNA, 239 bp, Triticum aestivum
  unsure (1)..(239): unsure at all n locations
  Clone ID: PAT_TA_86290
gcgaactcctcccatcctggtctccaagcaatgggccaacggcnacctccccgctcctctncctttccttccctcttcgggcttcctccccttcccccttccggggnaaccggnntttcctttttcccttcngggncctttccccaaaaaggcccccctttttttaaacttccnaagccnggtnttttcccaanngggtgggttttggaancccccggggttnnncccgggaaagtttt

SEQ ID NO: 86291 - DNA, 383 bp, Triticum aestivum
  unsure (1)..(383): unsure at all n locations
  Clone ID: PAT_TA_86291
ttttttttaaaacgttaaatttcncaagnncaaaaaattaaatttctccangtcgcaataaaatgttcttctcacaattaagnacatcgaacacaagaatctagaaacaaccccaaaactaacgaagcgaaccagaaaagagagttaatatncaaagggcggcttttggggccccccggaaaaaaacaaggtttcttaancancaaaaangggttccttgggatntccccggaaggtnttgggcccccaaaaggtncnacctttaaaaaactntgcagantttatcaatantaagaccccgtnngggtaaaaaacncccccttnnanaaaaaaaggntggnaaaaaaanaaacccccccattaanaaagggncnggacccccc

SEQ ID NO: 86292 - DNA, 591 bp, Triticum aestivum
  unsure (1)..(591): unsure at all n locations
  Clone ID: PAT_TA_86292
ctctccccgccccnctcgncaacgccgtcaccctcccnagcttcgccttcctcctcaccnaaatcattggnattggcttcgncaccgtcntcaaaacgatccatggacccgtcttcgtcgccctctgcagctccagctcggtcacggncgtggtcttcatcggnggcattgtccttgttttctttcatggattcgaccgtggacccttctctatccacatctgtagctttgtcaccttccttganccgtcttcatggacctctctgggtactgctaanccttcgatcctctncccactatcgtcgccctctgcttcctcccngtcatcgtcacngtccaagaantctccaaagaagaagtctccaaanagcacgatcaatgtgatgtcaagtggatgaactcaaaccatagagtataacanacantttaagggnaacacntaaacatcttcgaacattacacaaatcaagggatggccccaaaanattcnaaaggtatcaanaaacngggnacananaaaagctccaaagagnaagataacgctacaccaagacaatccgangnggaaaaactccaggnatattggccann

SEQ ID NO: 86293 - DNA, 269 bp, Triticum aestivum
  unsure (1)..(269): unsure at all n locations
  Clone ID: PAT_TA_86293
tgancctgccctccacctcaccgtcgcccttccccgtcgccgccccctccgcgcgccgctgcctccaagctccancgctcnccggccccccgccgcgccgtccgcgtcgccgcctcngccgcgaaccgaaggcgcccnccaaanccgccngtccggccaaccccctccnggnttnatccctcgttcnanccccgccnaaggccaanaaaggtngaacngncttaaaaaaacgtttnaagaataaccaatggtnatccccgtnaataacc

SEQ ID NO: 86294 - DNA, 201 bp, Triticum aestivum
  unsure (1)..(201): unsure at all n locations
  Clone ID: PAT_TA_86294
catggctccaccgcgtttaatttactgctttactaagttctactgtttccctaataaataaattanttttactggctgctgctgcttccattggtaanttgtgggccaatttgttgcnacaaganctgtgatctggtacccctgnggggacctctngtactttgtcggaannattgaaatgnatgctnaaancaatatata

SEQ ID NO: 86295 - DNA, 611 bp, Triticum aestivum
  unsure (1)..(611): unsure at all n locations
  Clone ID: PAT_TA_86295
atgccccgatcccctttctcctttccttgttctctccgttcactccaaaattatagacactaaatcaggtcgggcttgtacctctggtaattcttaatctcccaccagtttgctctgctgatttgcgccttgagcctactagtcctcagctgcaggcatccccacagctagtgcggcaacatggtgaccgtctttggacggctgggtttgggctccgtacgcctcctctgtgtcttcggcttgtaagcggcgatggaccgtggatgtatcgcagggccccgatagcagtccaatggaggaggcgagttcttgatctccacggtgtcctccgctgtcagcatccatgttaggggattcttgggtcctggtntcgactccgcacaaccagcatgggatcacttttgtaangangaatttgggcgtttcttcctcnaacaagcaaccaaacttcgtccttgttccactcccaggaacccgaantctcctctcctccanaaggggaanagcttcactaaaggcccctttncctttcaagncaaagtaaattttctaactttcgngnggacatgtcnaaaagaataaaattttaaaangggggcgnacaatcccta

SEQ ID NO: 86296 - DNA, 364 bp, Triticum aestivum
  unsure (1)..(364): unsure at all n locations
  Clone ID: PAT_TA_86296
cgacgttgaggatggcaaggtcgtcaggcaccaggactggtgggacaagaagcctctcaagaacagggagacggtgagcttcccgttgttgggacggctggcgcagacgagccgccggggagccatgctgctcactcatgttctcatgggcttcggcaaagaccccaccccatgatttagtcgctatgatttggtttcattctactccgaataccctatctaggtggttggaggtttgggatccatttccatagacaaaaaaacaaaagtnaaaatagatatatgtgtacccaaaatattgtaatgccattttatcatgatgtatttgagaaaaaatcacaagaagagaaanaaaaaaaaaaaa

SEQ ID NO: 86297 - DNA, 584 bp, Triticum aestivum
  unsure (1)..(584): unsure at all n locations
  Clone ID: PAT_TA_86297
cccagctccgccagacgccgaaatggcgaccaccaccaccaccctcttctccctcgccccgctccgcctcacccaccgccgactccttgcccccgcccccggcacggcctcccgcttccggacgctcgccgcgaagaaggcggccgcctccaccgtctccgggtccggcggggggcgccggggagcgggctgctctcggtgctccgaccgggcgtcaccgacgaggaggattaccgccgcgcgcgcgcccantncacgcaagcgtttngaggcggaggggtacccatcgagggatttccgtnggccgggaacgaactgctcaccttccgtccctcaaagttncctttcgaatccggcgcggccgtcttcgccttcgccaanaaactctttatanaccangccactcnacaatcggngcttccaagtttatacaaccgcggctctacatttnaacctccaactattttactccttganaagatattttagggatctcaatcancctnnatgatnaatnactgnaatgaatggtgcnctgactgganaaatataataccaanacttttcagacattaanacatang

SEQ ID NO: 86298 - DNA, 323 bp, Triticum aestivum
  unsure (1)..(323): unsure at all n locations
  Clone ID: PAT_TA_86298
cacctctctccccccacgactcctcacaagccaagccaacaaccaacggaacgggcatgaaaagctctctcctcctcctcatcctgtagtagactcgactgtgggcagccagcctccctcctcttagattcgataccttncctcccctcnggcccaaccccagccccaaccccaccgcgaaagagagagagagaaagaaaggctgcggccgtcgcagtccaatcgattgccccaccgcccggccgcgccgcgctttcccgcctcccaagccgaatcccgatggtccactccgttgaccgctccgccatcggagcgccgcccac

SEQ ID NO: 86299 - DNA, 614 bp, Triticum aestivum
  unsure (1)..(614): unsure at all n locations
  Clone ID: PAT_TA_86299
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaactccgcgcgctgtgcaccggcgagaagggcgtccggcaagagcggcaagcccgctgcactacaagggcangctttccaccgcgtgattccccgacttcaatgtgccaanggcgggacttnaaccccnggggcaacggaacccggcggcgatccatctaacggcaagatttcccnnacaaaattttgtccacaanacacaanccggnttctctccnatggcnaacgcgggccaanacaangtcccatttttnatctgnacttccccctgnatttgtccaacgganacntnccttcngnaagtcctccaaggatggacttcttcnaaanatcaaaagngggnccccaangggactgcncaacaagtgtcancccnacggggcaatntaatngccggcgnggtcncnttccntttttnccccccntttccctttgtccaatna

SEQ ID NO: 86300 - DNA, 551 bp, Triticum aestivum
  unsure (1)..(551): unsure at all n locations
  Clone ID: PAT_TA_86300
gtcacccgatgagagccgcggccacatccacagccttctccctcctctcgccctcccgcctccggacctccgctcccaccaccaccagcctcccctaccgccgtcgtccccgcatcgccgccatggccaccgccgccgcctccttccgcccggaggccgcgcgctcgccccccgccgtcgagcccccggccccgccgctctccaagttcaaggtgggcgctgtgccagtctcggtgacggcggacaagctccgcaaatcgcgcgcgccgcgccgccatcgancccgccgcggccgacggcgccaagtccntgtcctccccgggaatatggaacggccatattcaaatgaantttccngatatgctgaggaattnaggttggtgggatcagtccttcattttcaatgatgtcngagttctccagttggcaatancttgttggnggttcatatcaaaagtctgggaacanttgtacaataatctgctcttgtcaaatggaagttaagggaantanaanggcaactttgaaatgatatcaagaaaaatanatcc

SEQ ID NO: 86301 - DNA, 521 bp, Triticum aestivum
  unsure (1)..(521): unsure at all n locations
  Clone ID: PAT_TA_86301
ctcgccccctcttgccccgtggtccccaaccgccgtccgccgccgcagaggggagaggcggccgccgcccaccgccgcagcaccgccggccccgtcgcccccgccgggtttgatcccatggcgtccaagaggatcctcaaggagctcaaggacctgcagaaggaccctcccacctcatgcagcgcaagtctgtaggtnaggaattttcaatgggaagcatatcatngganccttcgacanccnttaacgtngctattttttgggaaattattttccaaacngttaccctttaaccccccaaaggncttttcgcacaagggtttcacccaaaatntaaaagaaacggacattnccttgaatnnccaaggaaaaatggancccgttttacanataaaaggctgngtnanctgttctttttnaaggcccaaccnatatttctggngcccaattccanattttaaacngtnnggcaattttatcaagggggtctgggnnaaaataccatggtaaactgacggcac

SEQ ID NO: 86302 - DNA, 495 bp, Triticum aestivum
  unsure (1)..(495): unsure at all n locations
  Clone ID: PAT_TA_86302
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtccccatgttgaccgccaagattatcaactgantgacataactgatgatggtatgtcagccttctcactgagagtggtaacactaaggatnactgaagctcccactgatatgttctgcttggcaagttaagacggattgctgatggaaggactgatccgtcgtgann

SEQ ID NO: 86303 - DNA, 471 bp, Triticum aestivum
  unsure (1)..(471): unsure at all n locations
  Clone ID: PAT_TA_86303
cctagcgccaccactttctcctccccttccctcccctgacccgccgccgccggaggcgtcggcagacgaagcttggctgtctccgggcatggagacggcggggcgtctttctatctggcgggaggcggcggggttgcttctccggctagcgcgtgtggaggtggtggcggcgacacatgttgctccgccatggcgccatgcggcgcacggccgtgctcgaggccgtggtgcacaacgccggtgcgcgcgccgttggccactggatggggcggatgccccccgcgtggtctgctggatntcgcgccggcggggcggttgccgtggtggagcatggggcgccggcacnactgtgctaagggctgtggcatgctgcactggtgtgtcgggtncgccnctgacttgggcggcggctcccaaatggccgctggtgctggcgggtctccgctttctttctccanctgatccgagang

SEQ ID NO: 86304 - DNA, 530 bp, Triticum aestivum
  unsure (1)..(530): unsure at all n locations
  Clone ID: PAT_TA_86304
gaagaacctagtctcgagttttttttttttttttttgactgtaagttctggtatttgagaagttgcttttcaaaattttcatacagaatcattaccctacataactaagtaggtacgatgaaccaggtcaatcgtttctggacagtatctctctctgtatggaggaactacattgcatactccttatgaagaagagatcagagatcatacttgacttcctaataactaatgcatgcactgcactgactgggatgatgagcctaagtagacaacaccccagttaatcancccttcggccaatccaatgggactgggagattcagcatcaaaccatctcggaatgttcnactacatcatcccgcgacgacccgagacgataacncttgnctgcagcacggattanttaaccctggagctacnaactgccacttgggaccccctgcggnggaaggaccgcggcccccaggtgggcgggaangcngggcaaccctgngcaactntgggnctggaccggngacactnaangatgg

SEQ ID NO: 86305 - DNA, 381 bp, Triticum aestivum
  unsure (1)..(381): unsure at all n locations
  Clone ID: PAT_TA_86305
tgcaaatatacagctctaagtgttgcaaatatacagcactgcggctgctgcatcaaaaatctggcggctctaaccgggcatgcacctccgctgccttctatgctgtttgagttcagtccgtagatgtcctcggattcccttccggacatgcacctccgctgccttctatgcattttcagttcaagtactaaaccgatgcaccttcagagttcaggctagctagtgttcagttcagtacaaagtattgtggtcagagtttgggcacattccggctaacgaatgtacaganttttgcacgtccattggtctttggtcctacaaattgggtgttttgtaatttacctgacaagaaaatatnattnccangttaaaaaaaaaaaa

SEQ ID NO: 86306 - DNA, 522 bp, Triticum aestivum
  unsure (1)..(522): unsure at all n locations
  Clone ID: PAT_TA_86306
cacactcttcccggccggcatggctgctctctcgccagctctcctcatctccatccttgtggtcctcgtcgccactgccaccacagcccaatgccgccctcagaaagaccacggccacgccgccaagaccgccttttgcccaatagccaccgtccacgccatctgcagcaccaccccacacccggcgtcgtgcctcgcgtcggccgccgtgcacctcgacgccgccacggcccatctcctggcgtcgtccatcaacgcccccctcctcccggcgagatcctctcngtcgcgtcgctcctccgcggcgcgtctnggcgttccttccttctccccgtctctccttcaaagtntnngccgtcgtcctcgaanaacgcgctccngngcggcgcgcgcaaggattgcttcagctcaagaagcnacgctgggtcctctngngtccgctttgctgttgcgtccccgggaaggctccctnggtgggcgngaatttnnggcgngtcaaaaaaaggcactgctcganggctg

SEQ ID NO: 86307 - DNA, 283 bp, Triticum aestivum
  Clone ID: PAT_TA_86307
ttacaacatgcagacagctcaaaactcatcataggaattcagagtacatgtttttgtcccctgttgacagggacatagatcactaccagcttaatttacataaccattctgctctagcctaccacatttgactcgcatcaacaccgcaccaagcctttcagtaccactacacaaaatctcaaaggggccaaggagctcaatcagggcgtgggttttacgactcgcttatttcaacccgtatgtattatgagccaagtgaccaggttgtaaaaaccgggggggg

SEQ ID NO: 86308 - DNA, 480 bp, Triticum aestivum
  unsure (1)..(480): unsure at all n locations
  Clone ID: PAT_TA_86308
cccaatctcctcccgcactcaacctcaaccccaatccccacctaccccaaccccatggcgcccaaggcggagaagaagcccgcggcgaagaagcccgcggaggaggagcccgcggcggagaaggccgagaaggcgcccgccgggaagaagcccaaggccgagaagcgtctcccgtcggcgggcaagacctcggccaaggacggcgacaagaagtccaagaagaagagcaagaagagcgtggagacgtacaagatctacatcttcaaggtgctcaagcaggtgcaccccgacattggcatctcctccaaggccatgtcatcatgaactccttcatcaacgacatcttcgagaagctcgccggggaagccgccaagctcgcgcgctacaacaagaagccaacatcactccgcgagttaanactcgtccgctctcctcccngggaagtccaaacangcgtctcnanggcacaaggcgtcacaa

SEQ ID NO: 86309 - DNA, 181 bp, Triticum aestivum
  unsure (1)..(181): unsure at all n locations
  Clone ID: PAT_TA_86309
actagctagccggcaagcaatggcgtccaaggaccttctcggnggcgtncctgctggcgctgctggtggncaacaacgttcctcnccggggaatncctngnggaactngaancaacaaaccccgncgncggncttcccaancccgnccccaacaanngcgtttaanaagccgttcccaact

SEQ ID NO: 86310 - DNA, 346 bp, Triticum aestivum
  unsure (1)..(346): unsure at all n locations
  Clone ID: PAT_TA_86310
ccttgctgctgctcctccacttctcaactcgaaccagctgctcctcctccttcccttgcctcttcccaactgctgctgctcctcccctcgtcccttttgctgctgctcttctctaatattcctgccgctgctcccttgcctatctccctctgctgctcgttgcttcccccttctctgaacccatgaaccttgttgctgcacttctctgaatctgaacttgttgctctctctctctctctctcaacttattgcaaactttagaagtgtaatgttcagaactgttgtaatgtttccgggttgtggtnatatcaagatttgactaagtgcaagaactggttatttggtc

SEQ ID NO: 86311 - DNA, 495 bp, Triticum aestivum
  unsure (1)..(495): unsure at all n locations
  Clone ID: PAT_TA_86311
cgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttccactgatatgttctgcttggcaaatnaagactggattgctgatggaaggactgatccgtcgtatgtcgca

SEQ ID NO: 86312 - DNA, 298 bp, Triticum aestivum
  unsure (1)..(298): unsure at all n locations
  Clone ID: PAT_TA_86312
gaggcttctgagttttgactcgtttgtgtttccaacacaatatacatattttttagaaggaagacgtaaggagcgtccggctttaaattacatcaaacggagtttaaaaagcagagtagcgtatagcaacaccaaagcagagtagctgcgagccgtgactgaagcgccgccaaagcaacatgcaaattttacgcagcagttgcaggctccagagatcngttctttctgaaaaantctctgtaaaaaaattgtnccaananatgtacgcntcaatttatttccatatcananttctcta

SEQ ID NO: 86313 - DNA, 360 bp, Triticum aestivum
  Clone ID: PAT_TA_86313
gaccccgtcgcctcctctgcttcgcccgtgcctaccgccggccggccacggccaggtcgcctcgcctcctctcgctctcactccggccctctctctgtccctgtcgcttgactgaattttccctgccatggccctgcagttcctccccgcctcggagctcccttgcaccgccggacccgcttccattggcctccgtttggcacgccgccgccgggatctgctcgccgcctcgctgacccgtccccaagccaacggtgccctcaacgggagggcaacaacgccatcgcagtcccgctgccgcctgcttccctttgtcaaaaaacgaacgaagcgctcgcccaaggtgcgttgaacccgggg

SEQ ID NO: 86314 - DNA, 371 bp, Triticum aestivum
  unsure (1)..(371): unsure at all n locations
  Clone ID: PAT_TA_86314
tttttttttggcacagcaactgattgttattcatctcaagattgatacagatttcacaagcaaacgagttcattattcccaaaccgacagcactctaggatccagatcaacctgaatccccccatcagaggctcgcggccgccggagcgtcgacgacgaagtccagcaccatgacctcgtcgagcatgggcctgagggcggccttggcctcctccaccttgccgtcgccctccacggcgtccagctcctcgacgctgccgaacacggncaccatcccgaactggtaccccttggcccgcgcgggggaaaaattctccccgaaagctgaccttggaagccgctgggctcgccggcgtccnttnggggggggg

SEQ ID NO: 86315 - DNA, 210 bp, Triticum aestivum
  Clone ID: PAT_TA_86315
gtttcctccttgactccacggtttatgtttatttcttttaggttagtttgttgattgctgggtcttttaacatcatatgctatacatgctttgtgtaatggcattttaacgcattcttgttctcattaacctcatgcttgtactgtcagtctcaatggtatccccttgaagtaatgaaattcctgtgattgtgattctaaaaaaaaaaaa

SEQ ID NO: 86316 - DNA, 341 bp, Triticum aestivum
  unsure (1)..(341): unsure at all n locations
  Clone ID: PAT_TA_86316
ggaatgcaagagctcccggcgcacctcgcgccctctcctcctccccgccattgttgtcgtgctcgcattcttcgtcgcgcaatgcggagcgagggtgctgacggtggacgagctgctggaccagtactccgagtccgaccaccactccgcctctccgcctccgggctcccccggctgcgccccggagccggaagcgtcgccgccgcccgtcatcccggcgccctccttcgcctactctcggcccccgccgcccatgcagttctactcccctccgcccccggaggtcgtgcccagcccgcctgaagattacgccaaagcccgcctgaagatngttgnccccc

SEQ ID NO: 86317 - DNA, 351 bp, Triticum aestivum
  unsure (1)..(351): unsure at all n locations
  Clone ID: PAT_TA_86317
ttttttttttttcaaggtttattttactttttcccaggacacagcggttgcgtgttgctgaccgaatcgtagacacatctcgcaaatacaatttcgtttccaccctgaacttcaacacgtgtcaagccattatttgctttgacgcanactctcttanaccgtctcaccagatatgcattcacatcaattggcgaaccggatgatgttggnctgctcnaantgctcggcnacggccctgtangtggcctgcctggggtggacggntcccaaaanattacttggacggggtcccccanntcgggaacatatcggtncaaaaggggncccatccccaaagaaccccggggggnn

SEQ ID NO: 86318 - DNA, 539 bp, Triticum aestivum
  unsure (1)..(539): unsure at all n locations
  Clone ID: PAT_TA_86318
aatcaaacactttcacaaccttatttccaagttaccagtttcacaatccatccatctccttcagcaagcgtcgccgcctaaactagtcattccaagcactacgagtaccaggcccaccgcccgcgcgcaccacctcgtcccgaaatggcttcttcccgcacaccaagcaggcagcttgacgacatgtcatggcggccctactcgcgcacgcgcgcgcgcacgcacggacggtcccgagcccgcactgaccggtaggggggtacatcgatgatcacaacaggtgcgccgggcacgacacgtactgcatgaactcgtcgtcgcggagcagcgccgccatcgtgtcgggggcgaagcacacctcgatgtcaacgctgccgtcccggagcggccgggaacccgacatcttgccgtcgaactgttggcgcgcccgctgcgcacgcaaggggcggcccaaccgaagtcgttgcctcgtaatcggaaccggtggagctgccatcgtcacaacgngcgtcnggttgccaacggaaacacgggcgcnc

SEQ ID NO: 86319 - DNA, 532 bp, Triticum aestivum
  unsure (1)..(532): unsure at all n locations
  Clone ID: PAT_TA_86319
acctcgtctccgcgaaggccaagctcaggcagcacgtcaccctccgccgcatcgtcctcgtcgccgccgcatccgccgcggccttcattctcctcctcaccgtccgcaccctctccgcctcgcacgccagatcaccgggcgccgcctcgtccaccacctccccgcccgaggccgtacggcgcaacacgcagcagcaacagcagggcgggtgcgcgaagctgcctgggcccgtcgccgaggcgctggttcactacgcgaccgccaacgcgacgctgccgcagacggcggccgaggtcgcgatgaccgcgcgcttgctggcgcagcgcgctccgtgcaacctcctggtgttcggcggtcttggcccgacagcgcgctctgggcgggctcaacacggcggacgcaacgccttctcgagggggggcccggtaccaantcgcctatagtgatctataccgcgctactggcgtcgtttanaagtcntactgggaaaacctggcgttaccaattatcgcctgcagaatccctttncagn

SEQ ID NO: 86320 - DNA, 526 bp, Triticum aestivum
  unsure (1)..(526): unsure at all n locations
  Clone ID: PAT_TA_86320
ccggtgtgcaggggctgaacggcctggcccgcagcagcccggaccgcaagatagcgtgcaggtgcctcaagagcctcgccaccagcatcaagtccatcaacatggacaaggtctccggcgtgcccggcaagtgcggcgtcagcgtgcccttccccatcagcatgtccaccaactgcaacaatgtcaactagttcaatatataacccttccgacgtgcatgcaaggacgcgcttgtgtggagcttaatgtctacgttgatggagtgctcatacgatactgagctactaaataataaaatgaagttgcttgcgtgtgttatttcaagtactgtgtcactgtgtgtctgtgtccatgtctgtaccttgcgcacacactgtgtgtgcatatatattatgcacatgtatgcatgcgtccgtatgcgtgagtgaactgtcaatctttgctgtacncaatgtaccnatgtgtactntgattgctgactactngtcangcattaatgaatataattatttctaaaaaaaaaaaa

SEQ ID NO: 86321 - DNA, 505 bp, Triticum aestivum
  unsure (1)..(505): unsure at all n locations
  Clone ID: PAT_TA_86321
ggagcatctccgtgccattccccgatgctccgccgtcgcccatctccatcttccaaatgatgctgcccgctcgcgcgcctgctccactgccatagccgcccgccgcgccatccctgattccttgccgtgtcgtttcgcccgtcagatggaccctgggtccgaggtctcgttcgagttcgtgccggtgatccggcagtacaggagcggccgcgtcgagcgcctgctccccgtggacgccgtcccgccctccgtcgacgccgccaccggagtcgcctccagggacgtcgtcttcgacccggccaacggcgtgtgggcccgcctctacctccccgcgcgccctcccgacggcgcgggcgacaggctcccatcatggtgtactcaacggcggcggctcgtcggcggctcggccgcggacgcaccgagcacgcgttcctcaacgcctgtgcgcccgcgcgcgcgtctcgggtgtcgtcagtacgcctgcgccggacacccgtccggctng

SEQ ID NO: 86322 - DNA, 515 bp, Triticum aestivum
  unsure (1)..(515): unsure at all n locations
  Clone ID: PAT_TA_86322
gcagttcgtagactctgatagccgatttagagtacaagatcgaaacgattttgagactgcttggtctgtgtccaaaccaatccaatccagtccaataattgttgaaatccaaaccagaccagattacattacggctccagaccatttaaaccaatccaaaacaacccactaggaaaaccaaactaaagcttaagtttgagcccaaactattcccaggcttaagtacatctaatgctccaggtatcccaaaaggttgactgttgttgatattgctaaaatctcagtgcaattgtcttgtactggcagagctcaaacataagcctgatgaattctgggcagtgtgacttgcttgaaatacctacataatgtagttgcctatgaacagctttccaacatttactttcagtattccttcttacactcccactgacttacagctttctgatcaatgcagtttacgacatcacgattgcatacaacatcggtcccgacgttcatggacaactgtacgnanc

SEQ ID NO: 86323 - DNA, 531 bp, Triticum aestivum
  unsure (1)..(531): unsure at all n locations
  Clone ID: PAT_TA_86323
gtgcctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcaacaanggtgggttcatcttccgtgagcacaacgcatcccctgggtactacgatggccggtactgggacaatgtggaagctgcctatgttcgggtgcancgacgccacacaagtgatcaacaagtggaagagtcaagaaggagtacctgacgcgtacgtcgcatcatcggatcacaacatcgcaagtgcatgctcagctcatcgcctcaaccacggg

SEQ ID NO: 86324 - DNA, 506 bp, Triticum aestivum
  unsure (1)..(506): unsure at all n locations
  Clone ID: PAT_TA_86324
cagagtaggactagcttcagctagccagcctctgccactccggtcattttcttgcatccacgacggcaatggccaccgctgatgtccagaacccgacggccgcgctgacggaggaggcgcccgcggtggagacgcccgtcgccgccgaggaggttgccaagacagaggaggtccccgcgccggcggaggccgaagtcgaggcgcctgcccccgtcgaggttgaggcgaccaaggaggaggcaccggccgccgccgagacggaggaggccaaggaggccgagccagcagctgcggccgagacggaggccgangcgcccaaagagccaaccgtggtccagacagagaccaaggangccgtggcagangcagagccggcagtctcgangagtgaangaggaggcngcgcctgtgccaaccggaagtgccggccgtcccgaggaacaacggcncaacggaggangnaccccggcgcggaaaaganccggcnacccgtggcaacgcanctt

SEQ ID NO: 86325 - DNA, 523 bp, Triticum aestivum
  Clone ID: PAT_TA_86325
cctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagcacgtcccccgtgctgtcttcgtagatctcgagcccactgtgattgatgaggtgaggactggcgcttaacgccaagctcttccaacctgagcagcttatcagtggcaaggaggatgctgccaacaacttcgcccgtggtcattacaccattggcaaggagattgttgatcgtgccttgacgtatcaagaagcttcagacaactgcactggtctcaaggatccttgtctcaacgctgttggagtggactggtctggcctg

SEQ ID NO: 86326 - DNA, 524 bp, Triticum aestivum
  unsure (1)..(524): unsure at all n locations
  Clone ID: PAT_TA_86326
ttaggaaaaactggaatcacttccaaagtccgtgaataattttgccccataatagaaccaaaattacaattcagaaataatactcataattttcaaccaagatagtctatttattcagagaagtcgaccgttctcagtacttgtagttgcatatttgtctttatcaatcctgctgtaatgaatttttcttgtcttcccacatcgcaatcctctcatgcgccttctccacctcgtgttgccagtcagtcctgaatgtcacccataacaggatgagtgtttgtagtagtgttccgccgattaccatgccactccaaaccccctttgcgcccaaaccaagatagaaaccaaggaataagccaagtgggatgccaacgaaatagtagcacccaacatcacgtacgccacaaacacctgccaaccgcacccacggcacacaagaaagcacgggttgaacgccattgaggatgagggtgatggcaagcancgggcaaagnccgacacgcgtcgcaacatttgcactgtga

SEQ ID NO: 86327 - DNA, 541 bp, Triticum aestivum
  unsure (1)..(541): unsure at all n locations
  Clone ID: PAT_TA_86327
ttcagagacgagcaaaatgctggatcagacattatctcagtcatggcagcagtaggccaacagtatcgcgcattcaacacgaactgtattaaccacatgaactcctagggcagataaactcaccagctctaatctctggcattttactaacagacattgcatagacactatctagttctgttggactcttatcattatcttgaattcttaattagctaaaatagacatcctaactattctacttcatcctgggacatgagcatcctgctaattctcctacaaaatcctgctgctgggacatcctgattcccgcaccaaagacactcctgtgttcaaaagacgggttcactcaaacctatcaaaaccggcaaattccaaacacatagcagcgcagtctagtatccaantanaggccgccagttagtcaacattatgacttgcataacagtaaccctgcaagtgacgcaaatgctcngttgcctgccccttgccaaaacacaagtataataattcaagattattttgggccgttgcaantcnc

SEQ ID NO: 86328 - DNA, 522 bp, Triticum aestivum
  unsure (1)..(522): unsure at all n locations
  Clone ID: PAT_TA_86328
ctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtgggtgctgctgcgctgaagagaagaaagnaagagaaaaaggaggaagccaaggaaagaaagcgatgatgacatgggttaacttgtttgactaagcattcaatccaactctcccgtggatctgctaagctaaagattactanctaaagtgctttaggtgaattttgcggattgataagtaatcgttgagactaaatacntgcaatgatactcaaacactt

SEQ ID NO: 86329 - DNA, 278 bp, Triticum aestivum
  unsure (1)..(278): unsure at all n locations
  Clone ID: PAT_TA_86329
ttttttttttggaatggacgtggaaaagtacacttctatatatgctgttgtatgatcacaaatcgttagttttgtcggaacaaatagccaagaaacccccaattacaaaataaataaaaaagaatatgaagagcttgagagcgaagagaggaaggaaagaaaagaagacttctccgacgagctttgtcacgaacacataacgtggcagcgtaagccaatggcggcccgtgttgcatccgctctcacgacccgtctatccaanggggggggccccggta

SEQ ID NO: 86330 - DNA, 529 bp, Triticum aestivum
  unsure (1)..(529): unsure at all n locations
  Clone ID: PAT_TA_86330
gtggccgccgcctctcccgcacgatcctgtccccaccctctcttatccccttcaccctccagaccaagagcgcccaccctcccgcttctccccgaccgtacggccgcacctcaccgcgctccctgccccgctatgcataccacactagccggcagcatcacctccatccacaacaagagctagctagctagcnaacacgacgcgcattcgccgcttggctagggatgtcgtcgtgcctcgcgccgcagttcaagtggcccccttccacccgagcggcggtgccgagggagcccggcgccggcggctgcgcggcaggcgggagctgccggccagggagggtccaagtgcgcgctgtcctccgcggncgtccgtcnaagcgggagcgcatggagtccttaaccgccggagcgaagcgcctggcctacggcggagccgtcgacgtcgggctcctcctcttcggataacacaactcccggggggcttcngggaagcgcttctcaacaanaggcntggtgacgcgcggcgcngn

SEQ ID NO: 86331 - DNA, 523 bp, Triticum aestivum
  unsure (1)..(523): unsure at all n locations
  Clone ID: PAT_TA_86331
ctccacgactcacccaccccgcgccccagccacccacgacctctcctctcctctctccctcgatggccataccggcggccggcggccgtagcaccttcccctcctgcggggcaccatcttctgcccctggtcagaactgcagcctcgccggcgtcccctgccccttgtctctcctcctcgaaccccaaagatctggtggaaggaggcatgtggcctgggtgcgacaggaaggctggccgagctttctaccatggctaccgagctcaagtggctgggacggcctcggtgccgaaaataactgaaggagcaagtgcacttcaccaatagacaaccgtcaactgaaaaagaacaggaggacatggccgaatttggggtggctgctgctgttgatccaaattttggganccngggtaactgctccttgaattttgggatttggnataactccnaccggattttgattgggtactgcgttgacgaattngggtgggtgctgttgatcaagattaaacttgggattggg

SEQ ID NO: 86332 - DNA, 445 bp, Triticum aestivum
  Clone ID: PAT_TA_86332
aaaactttaagagtatatatatatctttaacagagggactggtagtctacaactttacagagtacatattgctgtagcaagctctcgttctcaaatttgtcctgtctctctctatttttttttccttttttttcgacgcttgcatctaattctttttccgtcacggtcactagcacgctgccccttttgcgcgcaccacgccgtcgttgccggcgagcatcagatacttgtccttcctggtgagcatggtgcactcgtacccgagcgacgccgccatcagccgctgcacgcggttggccacgtccgtgctcgcggcgccgccgtccctgacgggcgccgtgtcgaccctgccgaggaactccaccgtgtagcacatcctggggttggcaaggtagtagagcgcgtccaaggacttcagccgcccgccgtggtgccatggaacatg

SEQ ID NO: 86333 - DNA, 477 bp, Triticum aestivum
  Clone ID: PAT_TA_86333
ttcacctaccctggctctcaaagcggccaccattgccaccatgcttgccatggtgatccttccatccgtggggcgctccccgtcgctgggccaagaagaacgagtaacaaccctggcaccagcatcgggtccagcgcaggcgatgcggtgcagcgagtgcggcccacactgcacagagatgtgcagagtctccgttcccccaaagtgccgcaagtactgcaacgttcccagctgtgaggactgccggtccgccgccatcgccaagtgcagggccggctgcaccactgggagctgcaactgcgatggtgaggcaacccggtcgtgctacggctcttgctccggcagttcttcgtgtgcggactgcatgaggctaactagtgagcagtgcacgagtgactgcaacggcaagtgcgccaccacctgtacaacaaaatcaaggatggcaaatagtgttggctgggcctcttggtatgtatc

SEQ ID NO: 86334 - DNA, 258 bp, Triticum aestivum
  unsure (1)..(258): unsure at all n locations
  Clone ID: PAT_TA_86334
gagcggcggcgcnagcccanganccgcaccaccgaancgctccgccactccgaccaccaccaaactaccagtacccgcctcctcctccctcgccatgccggnacctcgcctcgcccacctccgccgcctactctcgctcnactctccgcctccncacccgctcgcccctagncctgccngccccctccnccnatccttcatcctcncccgcgcnatggcnggcgccgcanaggnaggtgctgngacggggtcggcngc

SEQ ID NO: 86335 - DNA, 453 bp, Triticum aestivum
  unsure (1)..(453): unsure at all n locations
  Clone ID: PAT_TA_86335
gttttttttttttttttttattttgattatcatgcactcggtatgttcccaaacaagaattagtgaacgtatcaacaacacggggccaagatgaatgtaagagtaccggtaacaagctggttcatccatcacgtgattaaatccactgcagtgttcactacctggatgcaagcgcaacaagcttacaatggccgttgctttccaagacaaaattatatcagtaactagagccaccactgcacatgcttcgctctatttacatcatcgcatgacgcatcatgacgtaaattctttgctggccgtagtcatgaaaagattcaacgcatccaaaatcccctttcgagttccgggttaagaacacaaactcctgactcaatgggatnntccaacaaatccaacctnggggccattaaaangaacaagggccttggggcaaacaagaaatttaaaacc

SEQ ID NO: 86336 - DNA, 515 bp, Triticum aestivum
  unsure (1)..(515): unsure at all n locations
  Clone ID: PAT_TA_86336
gttccctccccgccgaggcactgccacggacagcgacgcccctcctctcctccccttcctcccctcgtgccatcttcttctcgctccacactcgtgactgactcactgagctgagctgagcactcctacccgagctgagctgagcctgagcgcacgcgacgacgcagggagctgttacgcgcccgatttaatgccctgctgaatgcggagcagtttctctccactgcctttgctttcttgcttcagctgccccggcattcaatgccctcgtatccccctcgcttgacccgactcctcctcctacgctagctagccaagtgtgtgtgcgcgtgtgcgtgtgctccgccgggcgctggattgggtggatagattggtanagggaggagagaggaggatgaactacctccggagccggagcctgaagcgntcctgtcaatcggccgcggagcaacccgacgaggatgctcntcaggccaaccccgcgccgccgcgccggtggcgtggtccgccnacaa

SEQ ID NO: 86337 - DNA, 514 bp, Triticum aestivum
  unsure (1)..(514): unsure at all n locations
  Clone ID: PAT_TA_86337
aggccccagtgccatatttcattgattgatgagagaggaaaaaagtatatagtaagggaagtggcagttaaagcgagattacaatctgcccggatttcatttggggcagcgtcctatagttgaagaccaaacatgtaatagaaataatggtggctcgaatatcctgtccagatggtgaatctcggccgctaaccaacaccttgcttcacccatgatacgactgattgggcgtgcaccgagtgttgttgaagatgcgggcattgcattccttccacaacatctatgcaacaaggcaaatggtcatcttcctatgcaccggtgccggcagtgcctgggagctatcatgtccatgatgctttgagggatcggcactgggtgggtcaacgttgtcgccatccgtagcatggagaacgggtgtcccagcttgttgttaatgcaattccaaacctctaccgagaagggcaatctgccaacaagtgaacaaccgttttcgnatcntcaacaaacaanaatt

SEQ ID NO: 86338 - DNA, 514 bp, Triticum aestivum
  unsure (1)..(514): unsure at all n locations
  Clone ID: PAT_TA_86338
gacagctgcagcgagcccaatccaaatcccacgagattcgcgcgacgccgaatacctcgttccaatccgtggagaccaagtgacgcctcttgtttctctcgtccgattcccacaatcgccgctcgagatccgccctgatttcgtgcttgttggcctcgagaagatccgccgcagagccaaactccggcgagtgaatcggccatctccggtgatcccatcgactgtctcaactctgcttcttcatatacgcgttgttgccccactccttgtcagccctcctgccatggcgaccctacctgtcggtgaatcggcccgtctctcgccaggccggcacccagcgcggccctgcaagtgaaggcccggccagctgcacaactacataagcctcgcagcaagaagagacaacatcaatggattacngngaacccgngggggtactccttcccttctcggtctcccnacttgttcctcgtccggaacaatcanagtatnaacttgtccaaacantagaatg

SEQ ID NO: 86339 - DNA, 453 bp, Triticum aestivum
  Clone ID: PAT_TA_86339
ctgctccgctactgataacccactccgcccacccagggcacgtactcaagctttttcccggcagccctccgttccagtgcgatggctgcaggcagtacagcgacgacgagcgctggtaccggtgcgagccatgcgactacgaccttcatgtatgctgtgcgctcctcaggacctacctcacgcatcctctctttccgggccgcattttcgccttccgccacaggcctcccagcgttccgggttacagctgcagatcctgcgacggctgcggagacttggtgctcggcttcgtgtaccacaacgccgagcgccagctcgacctccacccgcagtgtgcctcccttgcgacggtcctcaccggggaggaaggcgtgttcatcctctcggaggaggcgcctgtccgtggtaactgcgggctgtgcgggcaagggaagaacgggcgccgtggaagtt

SEQ ID NO: 86340 - DNA, 443 bp, Triticum aestivum
  Clone ID: PAT_TA_86340
gccgccgccgccaccccgcctcctcccggcccgtcgcgccgccaacccacccggaccccatccgccacagccaaacccaaattccgcaacatcgccgttcttctcctcctccgccgccgccatgagtcgcaaaaacgcctcctcgtccacctcagccgccgccacgagccgcaagaacgccccctcgtcctcctcggccgcgggcgccgccagcaagaaggaaaaacctctctccgtgtcggccatgctagcctcgatggacggcacggcgcccaaatccaagcccgccaaggcggcgcccaagcccaagccctccaaggcgcccgcgtcgtcgtacatgggcggcatcgacctgcccccgtcggacgacgaggaggacgaggccgacgtcgccgccgtcgccgccaagcccaagccgtctcgcgcaacgtcgactcaacgcc

SEQ ID NO: 86341 - DNA, 508 bp, Triticum aestivum
  unsure (1)..(508): unsure at all n locations
  Clone ID: PAT_TA_86341
aattgttggattgaacacaaagcataataacttgatcttacatggtggttttcatctggttgtataccagagacaagaaataatacaaatcaagttcaaattgttttcccccacaaaaaaaaggaactaggatacaacataatttatatatatatatatatgatacaacagtacatggtggcgcattgtgctcctgccatgactcgaccatggcatggtgaaggccaataaacattgcatcatctttgctgcaactgagccatctctatggattctagctccagctgctcctaaactgtacatagcctaccgatctagagtgtaaccctgattgacataggggaattctcatgaatccccgtttatcatccgggagtgatacggaccntgtttanttccacaattgtcgactggtcctggatgagtggntgtttcatggctcgccgtcaattgacanatgctcgatncaatcgcctcccctcaattaaacttgatactgcagcctgag

SEQ ID NO: 86342 - DNA, 305 bp, Triticum aestivum
  unsure (1)..(305): unsure at all n locations
  Clone ID: PAT_TA_86342
agcaaagttgccggcggctgtgaatcagtgtgcgatccatcgctttcttccccacccacacccacaccccaaccccagatcagatccccctcctcctccccctcccctgcccagctgacagcgaccagtcatccgttcagtgacactccctcccaccgccaccgtcgccgtccgccggccgccatgggctcctcccaccgccacctgatgcgcctgctcgacgaccccttcttccccttgcccccaccaccgcccacctcctccctctcctcctcctgccccttcctcctcccccannaccatcc

SEQ ID NO: 86343 - DNA, 505 bp, Triticum aestivum
  unsure (1)..(505): unsure at all n locations
  Clone ID: PAT_TA_86343
ttttttttgaaccctctataagtagtgatatttataagcaattgatcgccagtgtcgatcactaaacaagcaccaaccagaaactccctctattttcctgatctctatttttcatgtgagccatattgaacctctacatctctatttcaacatgaattacattttatgggatgcggagctcgattcaactgcttcatagaaccggatgctttggaaactaaggaaatgcccacactccgaaaggagctgggatattcgtgaagtgctgtccaaggtcttgtaattccggcggccatgaactaaagacatggccggcttcaggngccccanatctgaactggngactggcgtcaaagctgatttancctggnaaagggaatcangtttcaaaacanaaataaagatgacaccngaaaacagttaaaccanataaacagactaaacaaggacctagggtgtatagaagttttanaaccacngtaaaaccccaccacaanaatacgaa

SEQ ID NO: 86344 - DNA, 489 bp, Triticum aestivum
  unsure (1)..(489): unsure at all n locations
  Clone ID: PAT_TA_86344
ttcgtactcgcctctctccgcgcaaccgagccttccgcccacctcctccccatttcgccagcggcgcacccaccaaccacccccacccgccgccatgagggagtgcatctcgatncacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggggctgggaagaactcccccgtgctgtcttcgtaantntcgagcccactgtgattgataaggtnaggantggggcttacggcaagttcttcaaccctgaagaattaacaattggnaaggaggntgctgcnanaanttcccccgtggcattaaacaattggaaaggganttgttnancntgcttgactttcaagganntttcanaaattgaacggncccaaggatcc

SEQ ID NO: 86345 - DNA, 508 bp, Triticum aestivum
  unsure (1)..(508): unsure at all n locations
  Clone ID: PAT_TA_86345
gttccaccttgcctccagcttctctgagggtgttcgtgctcgcaacatctgcccttctgtgccatcctatgagaggcgcttcaccacaagctgctacatgactcagaaccttggcatcagtgtccccatgatgtcatcttctccattgtttgccaatgcaccacctggagaagaaaggtgtcaagaactttgcaattgacttcctcatgggaaggagtgtccgctgcatttccaannactgctgcaactcctattnagcgttttaagctgcttatccaagaaccaaggatgaaatnatnaaaggctggnaggccctcttaancaaaacaagggattgggnnacngcttttggcccnaccatcaaggatgaaggttttggccaattttgnaaaggaaanatgntaattaaccttaatttccaaccnaggtttnaattttcaatccaggttnttttcaaaggnnttcatttcaagaaggcaaggatgttacgggaattgtcngntggaac

SEQ ID NO: 86346 - DNA, 490 bp, Triticum aestivum
  unsure (1)..(490): unsure at all n locations
  Clone ID: PAT_TA_86346
atggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacctgccaccgctcagcacggangcctcctcaagcagtccgactacctggatccgctccaaatggggtgccttgcctccgattcagcaagttgggttcatcttccgtntagcacaacgcatcccctgggtactacgatggccggtactgggacatgttgaaactgcctatttccgggngcaccggacccanacangtgattaacaagtggnaagagtcaagaaggatacctgaccctactccgcacaatcggttccnaaacatcgcaagtgnatgggtaanttaangccttaanccacggg

SEQ ID NO: 86347 - DNA, 467 bp, Triticum aestivum
  unsure (1)..(467): unsure at all n locations
  Clone ID: PAT_TA_86347
gcgccacgccaccgtccgcccgctagctcttcgtcaggtccgtccgtccgcccgtcgtccacgcccacgactccgcgccacatgccggccgtcagccggttcaacgcccccgccggcccggcgcccancatatagccccgcccacgccatcccaccactcgtgccgacctccgaccgattttcctcggccgctccgcttcgagctcagatcagctggtttaaccgccatggggtgcggcttctcgtcgggggcgtcnggcggcgggggcgggctgcggccgttcgcgggggtgcgggtgatccacaccaacngntacgtggaggacttcccgccggcgagggcggggcgcccgtcatcgtcgccgcgcgccacggntcctcgcctcntcctgccgctacgtgctgtgctcgtcggcgcaactgctgcancnnggccgcgcgctgttccggncggacaactnctgcac

SEQ ID NO: 86348 - DNA, 466 bp, Triticum aestivum
  unsure (1)..(466): unsure at all n locations
  Clone ID: PAT_TA_86348
gtcaaatctgtttcatgtgatgacggaggtggttatagagtccaagaggaagatggttcagaagaaatttatgacaaggtcatacttgggattcatgcaccagctgctctgaaagtactaggtgctgaagctacacatgaggaattgagaattcttggtgcttttcagtatgtctgcagtgatgcatacctccactgcgataaaanttgatgccacaaaatttatcctggatggagcgcctggaactttctgggggaaacaaagcanggatatgtttgttacctactaactaaacctgatcaagacattgaatctgctaagacttccttgggacgatnaatcaactcgtgttccggatnaatgtacacttaaatgngtgtgagaatcctgtncctccggtggttccgtnaagnaccnatgacttgttnntcaagggaaaananganatgtccgtgggganacaaag

SEQ ID NO: 86349 - DNA, 484 bp, Triticum aestivum
  unsure (1)..(484): unsure at all n locations
  Clone ID: PAT_TA_86349
gtttgcttttgctgtaattgcgcgatacaactctctgggaggctgtcagcatgcaagttgctcaaattctacaccagggatctgtacattgcccaagttgtaacaagcaacaagcagaacactgttcagttgcaaatgcatctgaaagttgattgacatttcattctgcttcagcacgattccttctctcaagtagaaatgtagaatgctctaaattccgttatatccatctgaatttcgcgcttctctcaagtagaatgcttctaaatttcgttatatccatctgaattccacaaaggacaaaagaaaacgattcatacagccccttnctccccaagtacacccnaggtggatcccgaaccttttcccantccacaaaaantggccnattctnnaaaccaacancttaaggtgcngggaacanaaccttcaaccaaatnacnccttgnatctgaaaaggcaaaaagggcccacaagttggtcn

SEQ ID NO: 86350 - DNA, 509 bp, Triticum aestivum
  unsure (1)..(509): unsure at all n locations
  Clone ID: PAT_TA_86350
tttttttaggcaaaccagataacatgcatattgaccaaggtgcgaagcaggttcaaacataccacaggttcatacaacacaacaggttgtaaaccaaacaccacacagcaaacattcaaacagacagacaacagataaagccgcttgggcagatcacaggatagtagtagacgaagggacgcttgacgtacatcaggtcgcaaactcatctgctctagtactcatcaccctcatcaccgtcctcgccctccgtcgaactcagcgccaacttcttcatagtccttctccagggcagcaagtcctcacgggctcaagagaactcaccctcctccatgccctcaccacgtaccaatgggacgaaggcacgcttagcgtacatcaagtcnaacttgtggtcgatgcgggagaagacctcnacaacgctggtgggagttggagatnatgcacacggcctcctggacttggcgaagtcgccgcctgggacacctggtggtggganttgatacacn

SEQ ID NO: 86351 - DNA, 455 bp, Triticum aestivum
  unsure (1)..(455): unsure at all n locations
  Clone ID: PAT_TA_86351
cctccctccctccctcccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagtctcttctgcaccctgggtgcctccagtactcagcgtgtgatctccttcgaggagacctgtaccaaagcacaagggtggaagcctncgtcaaancctcaagggggcatgtctccccggataaggtggcaaggtacatcagctnctnggacaacggtaaaaacaaccaagnttnaatactggnaacctgncaatacataggtgggccct

SEQ ID NO: 86352 - DNA, 207 bp, Triticum aestivum
  unsure (1)..(207): unsure at all n locations
  Clone ID: PAT_TA_86352
gagaaagctgtttcaagcaataagtatccgtgcttactggggcctgaccgagcaagaaaagattaacaanatccnctgggnanttggtnctccgcaaaaaacctgatccggcannctatttgctancanaacctattttggagtttnttcanccaactttgttgttgtttnagacanttacaanaggttttcaacnggcaaagcttc

SEQ ID NO: 86353 - DNA, 278 bp, Triticum aestivum
  Clone ID: PAT_TA_86353
tttgaattgattgaattctccatactatgtccatgcagaaacaatacgtacaataatacttccttcctcccaaaaaatttgtcttatatttatatagatatagatgtatctaatactaaaatgtgagttgatacatccgtatatagataaatttaagacaaaaattttgggacggaggaagtacatacgtagacacgcagcaagttaaatgcatactccacacaacatgcacgcaggacgcagcagcaacacacgcacacccatgcaaaaaaaaaaaa

SEQ ID NO: 86354 - DNA, 520 bp, Triticum aestivum
  unsure (1)..(520): unsure at all n locations
  Clone ID: PAT_TA_86354
ctcactcctcacagcatcctctcagtccttagcttccttccctcgccaccacccacagccaaggaggatgtcttgctgcggcggcaactgcgggtgcggcgccggctgcaagtgcggcaacggctgcggcgggtgcaagatgttccccgacgtggaggccaccgccggcgcggccgccatggtcatgcccaccgcctcccacaaggggagctccggcgggttcgagatggccggcggggagaccggcggctgcgactgcaccacgtgcaagtgcggcaccgcgtgcggctgctcctgctgcagctgcaactgaagccggcgcccaaggaggccggccggcanaggcgagcacgaggatgaggaggagaagcaagcaatcatcatcacatcacaacaaccaagcgtatcagtacactagccgccgcatcgctcgcgcgcgcgctaataaaataaacctcatgtgtcctaattcttaccctcncgtgtatgttgacaatgtcctctcatctcaattcnatga

SEQ ID NO: 86355 - DNA, 521 bp, Triticum aestivum
  unsure (1)..(521): unsure at all n locations
  Clone ID: PAT_TA_86355
cctactgctatctggcaatgcactttctagtcttaaccaaattttatctggaatatgcaatattagctgttcatctagacttatgtagtcctggttataggtgaattcagtgaaggtactatgctagtaatcagttaaggcaaaatgttcgctgtccataatggcagtttgctaacttactaacttgtcatagctctaactggaagtctgtactgattaaataccagtttacaggaaaattcatgcggtactaattattaactttgaatatgcggtactaattagcatatccatctcgacatggcagtgtgcctacttctagggtaatcagtagccagacagtttgttgatactctcagtttanactgcattacttttggtactaatgagtanaacaagttcagttcatagtacaaatgtcaattcagaacaacaccaattgaaccctttctgaaacncctcccngtttttacatgaaacaacttgtgactnaacccactacaatgaagtacccgtataaa

SEQ ID NO: 86356 - DNA, 480 bp, Triticum aestivum
  unsure (1)..(480): unsure at all n locations
  Clone ID: PAT_TA_86356
gaaccgcaacaccattaaaagtgaatcgaagtggtgtcgaaagtgcaccacattacatttttttgaaccacacacccatcaacctaaaaatcaaaatgaagtgtagaagaccttttcttttttctgaacaaataaatcgaacgacactgcactgacattttttcttcaaaacaaaataaagtgaatgacatgcccacgctctcgggactgcatgcacacagccagccattgtgctccaagtgaacggcatgcccacgccatcaggacggcccgcacacgccagccatggtactccaagccaccggagatgcaacaggaaactagcccatcacagcagcacaccgaagacaacactagcgagcggcgaaggtggggcgattgggcnaagcanngtgttggtaattggccgctggggtcgcgntngggggggcccnggnnccaattcccctanagngagtcctnttaccgcgtcacngcctn

SEQ ID NO: 86357 - DNA, 258 bp, Triticum aestivum
  unsure (1)..(258): unsure at all n locations
  Clone ID: PAT_TA_86357
gcctcatccgcaatggncgcctccttcctccgacctctcntcnctcccaannctttcctctcaactctcaaaccatangtccctatcgnccccatcactgccgtacgcngnatcgcggcgcctaaancgnccaactccaccccaanagcccgcccatcaatgagggcaaccaggacnaggagcaatgaacccactcccgacnaggccgaagccaacccccancgnatcnccgacgacnagaccccgccgtcgagcgac

SEQ ID NO: 86358 - DNA, 462 bp, Triticum aestivum
  unsure (1)..(462): unsure at all n locations
  Clone ID: PAT_TA_86358
tacatctccctctcccccaacctccttctccacctccgtccgccgctgcggccaggccggcatggcggcgtgccaccagcaccacagcaccacccagcacatccaccagggccgcctcacctcccagcgccatccaccacctcatgcgtccaacaccactgcgtcgccgccacagcaccaccacatccagcgcctccctccagctcgggcgaccctgccttctgccgctgtcttcttcttccccttcctgggtgctcccccaacttgtctccctgctcctcttcattctcaaccacctgctgcttcttctctcatcaactgctgttgctcctcccttgcgccccttctctatcagtctgctactgctcctcaacttcccttgccccaaactgctgctactcttcctcccaatgctcggttgctgcnaattcttgctaccctcttctttccaagcttttgcgg

SEQ ID NO: 86359 - DNA, 197 bp, Triticum aestivum
  unsure (1)..(197): unsure at all n locations
  Clone ID: PAT_TA_86359
gactggcactcctcagagccaatnctaacntgcccccaatccaattcttacacttctgctcggnagcnacatggacacgcagtccngctcattgncactgtcantgccactntcanatcgctgttacgtcacccgntaaaattntagactgtacgatcataggtactgangngagncgantcgctggatncgcctgt

SEQ ID NO: 86360 - DNA, 467 bp, Triticum aestivum
  unsure (1)..(467): unsure at all n locations
  Clone ID: PAT_TA_86360
ccaacaccccgcaccactccttcccatcttcctcccccagccggcttccccgacggagcgctctgtcccacgccacgccggctagaggaatcccatgcaccacgcaggagtgcccacctcacctgcgccacccctccaacctcctcttgcaccaccatgccccgacccatctgacttccatctctaccagcccgatccagatcggggtcgagcgcgtcggtagcgtcacccgtcgaannnaaccaagggnnaaccaanccccgaccaccacccaccgncgcccttcccggccaccgcccagaccaccacatcccgctgcccgccccggncaccaagccagcactgctgtatccacaactctcctcactcctccttcggtgggtccgccccgtggtgagggattgggntggtgnagtccgcgtcatgccgccggggtgtccctgctggtgccaactagtcgccaatgt

SEQ ID NO: 86361 - DNA, 457 bp, Triticum aestivum
  unsure (1)..(457): unsure at all n locations
  Clone ID: PAT_TA_86361
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagacctgtcctacttgcaacgctcagaaggagcctcctttaagcaagtccactaacttattcgctcaattggtgccttgcccccagtttaacaaggtngggttaaacttcccgttagcaaaaggaaccccgggnacaanatggcgtantggnaaattggaattnccaatttcngatgaaccaaccnaccaggttttancaggggaggagnaaaaagggancctaanctaatccnanaacgntt

SEQ ID NO: 86362 - DNA, 462 bp, Triticum aestivum
  unsure (1)..(462): unsure at all n locations
  Clone ID: PAT_TA_86362
gcttagtggtttcttactcggtctcctcatctgaatagatggtcgcacgcttcaactagaatccaaaccatagtagaacgggggctcaaaaggaaacttcagagctggaatatataatctccagtagtacacttagcccttcggccttatttcaacttgaacatgaatttgcagcacattttgggcgttattatattaacataagcattgaacactggacggctagcccatacatgcaaacacaagaaatcaaaccaaacaaagacactttagcataggagtanatcnggatcaaactaaagacaaagacacctgacatgaaaacaatgtctccaaacacttattgatttaaaccaaccttaggaaactaaaaaatctacgnccttcatcccaancgaatgctagacgataaaanactgcngnccaccggaagntctgcttcctcnaactcnaggcctcggg

SEQ ID NO: 86363 - DNA, 449 bp, Triticum aestivum
  unsure (1)..(449): unsure at all n locations
  Clone ID: PAT_TA_86363
gccatggccagtactggtgctcctatgtcggccggcgcagccgtagagaaagaagaagctgtagcatccgcggtcatcgccaacccgcatgccgacctagcggagatcatgccatcgctgcccactgcgccggggttccccccgtaccggctgcgccgatacggcggcttctggcacactgacctctatctcaantcatcggcgcgttcgcacgcgtgtttcaaagccgcggccaccgactgcttctcgcnacttccccaaagaccggtncaactggtcaaaggcgtcgcttctccgggctnaactgcgccnaccgcctccgtcggancgacaaccgtccaacgcaaaacccaagacttntcgttcctcaactcgccggacaagacacatggctgtntacaagaancctttccccggtgtgcnacaagngcctaaccctgntgcccaag

SEQ ID NO: 86364 - DNA, 490 bp, Triticum aestivum
  unsure (1)..(490): unsure at all n locations
  Clone ID: PAT_TA_86364
gttccatcggcgccttctcagtcaaatatgtccaccagctatggaactcagaatccaccaagagcaaacttcactccttcagcaacattacattccaggcctcctggtggcccccagtcttttcctccagtttcatctcatggtcctatgtcggtgcaagtactatcatctcctgttggggcgccaccgcagcaaacttacccgccatcgatgcaaatgcgtcctcccatgtcaacacctcctcaaaatgagaggcacacttcaactttccctcaagctgggaccaacacctgggcaatgcacaagtggnacttcatcgcncccgcctgctggtatgcacggatgtcttctcaantcaacaaacaagggtacaatcagacatctatagcggnttcaaactccaagtcnaancacanggatttactttaagccaacgtgcaacttntggggncanccactnaagcgggacaaagggantcaagtancccct

SEQ ID NO: 86365 - DNA, 456 bp, Triticum aestivum
  unsure (1)..(456): unsure at all n locations
  Clone ID: PAT_TA_86365
cttgaaagcagtggaattacatctgcaacggatagtagcgtgccactgcattgtgaggatgtgaattcctcgaagggatttcttctagttgctcacgagccaggtacaacagtaggcggttcccacatcaagaggaagcatggttaagagcatcagaaggtggtacgaagaatcgtcttgttctgccaggcaccggcagatccgtgtgcagctaagggtgaacatgcaaccccaactccggaattgctggnaagcacgacgcgnccaagatacanttctgtccaacccggancaatnacaaacngcaggatncanaacgtccaaaagggggacantngggcaaaccccaaatntacccttttcaaaaaaccggtattcgacttnattncaanatncctatccccaagaggggggnccgnaccatttcccnaaaagagnctttaacngccaangcct

SEQ ID NO: 86366 - DNA, 229 bp, Triticum aestivum
  unsure (1)..(229): unsure at all n locations
  Clone ID: PAT_TA_86366
gctacctccaccacggccgccatctcctgtctcctcctcctcgccacgctcaccattgccgctgctgaaataaggcacccgcaggctccggcggtagccggaggcgccgtgggcggccggacggagatcagggacgtgggcaagaacaagctgggtgcagtccctgggccggttcccggtgtccgaaaacaaccggccgcttcaagcnacggcggngncaattcaacaa

SEQ ID NO: 86367 - DNA, 475 bp, Triticum aestivum
  unsure (1)..(475): unsure at all n locations
  Clone ID: PAT_TA_86367
acctaccgagaagaagagagaaaaaaggttcgagtgcgttccagagtgaggagtgagaagagatggctccggtgaagctgtacggcgcgaccctgtcgtggaacgtcaccaggtgcgtggcggcgctggaggaggccggcgtcgagtacgagatcgtacccatcaacttcggcaccggcgagcacaagagccccgaccacctccgccaaggaacccttcgggcaaggtgccacttttcaagatggtgacttatactctttccaacaacntctatttcaantacccttcccgcaaaaacaagccaagttttttaanggagggcgacattcaaggagtcanaangtggtnttttgtccaggntggaggccancaatanattgcgtcttacccattctccttnnatgccttatccatccaagcttgggggancactgacaaaagncatcgacacactttttaagatnaaaactgcggg

SEQ ID NO: 86368 - DNA, 460 bp, Triticum aestivum
  unsure (1)..(460): unsure at all n locations
  Clone ID: PAT_TA_86368
gctgctcatccgcaagctccccttccagcgcctcgtccgtgagatcgcccaggacttcaagaccgacctccgcttccagtcctccgccgtctccgccctgcaggaggccgccgaggcctacctggtggggcctcttcgaggacaccaacctctgcgccatccacgccaagcgcgtcaccatcatgcccaaggacatccagtcgcccgccgatccgtngagagaggcctaagctgcantctgcatccatgntccnctgttaantncctgttaacctaattcntccggtggaatntttgtttgcaacaataaggtttnaaatgtgccggtttntccnttcaaggngntttggaagccaanntaatgaactcntgttgcaatttcaaggaatggaatttcccattaaaaaagggggcccgtaccattccctanagagccnntacnccccaanctcntttaaat

SEQ ID NO: 86369 - DNA, 507 bp, Triticum aestivum
  unsure (1)..(507): unsure at all n locations
  Clone ID: PAT_TA_86369
tttttttttggaananaaacgattttgattgnnaaagaagccagtgacttcanctttcttcagtcctggccaggctcccctgtttgctctgactataccccccgtcaaatantaatagttatctgcagttttgcggtcctatcccttgctgttcaatccccaccattatttgctaactaaaacacctcaagatcaacacttacatggctantacagacaagaangacaagttgatgcctccaagaattagctagggaaggaataaacacttgctgtcggtggcgctgctcggtctctcgctggntggggngctctgaccagctcacgacgatgccgacgtcgccgangccttcttcttcgtcacngccgacgggcttcttgctggnggacggtntggcgatcttgatgtccagcttgtaatactgcacgaacaatcaacacntggcgcatcccggcgtcangnangtccanggcggnaccggaagcatcgccgctggctaaanttnn

SEQ ID NO: 86370 - DNA, 241 bp, Triticum aestivum
  Clone ID: PAT_TA_86370
atcccattaaaatgatacccgaccttgctacactcaggaaacaatttgacacaccaggcaggagctcccaactgccaggcatcgatgtcattgtcaccactgctagtgctactgatgagcccatattgtacaccatgaattgtgttctctctatctttgcagtctcaaccaatgcctcatagaggaccaatgagccactgtcatctgataggtagcagttgcacctgccaatatgatagcc

SEQ ID NO: 86371 - DNA, 300 bp, Triticum aestivum
  unsure (1)..(300): unsure at all n locations
  Clone ID: PAT_TA_86371
gaaacactcagcgccatggccatggcttccaccgctctctcctcggncctctccctcctccacgccaagcccgccaccacctccctgccccgancacacncattcntccccatccacggtcgccgntcctccgtcgccgtcgcttgcacctcaaccgccgcggactccccgaaggtgctgganctgggggacgccatcncggggctgaccctggaagaggcgcncgggctggtgagancacctgcangaacgcctgggcgtgtcngcggncganttcgcccccgncncagccgtgnccgc

SEQ ID NO: 86372 - DNA, 506 bp, Triticum aestivum
  unsure (1)..(506): unsure at all n locations
  Clone ID: PAT_TA_86372
cggcctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacgggagatgggttgcatcaccaccaaaggagcttgggaacatcatgcttccctggggnaaaaacccaacgggaggctgaactccaaagacaatatcaattganntccaccctgaatgnaatggaacaattactttcccaaagttccccaaactgaatggccccaagattnaagnaaccacncaaaaggaagagtncaaggagctttaaagggntttcanaaagggcnaaacgtttaancctggnngctagtccccaantnaatgacaaccccgggaaaatcaccgacaggangggnccaatntctttaaccncttcaagggann

SEQ ID NO: 86373 - DNA, 462 bp, Triticum aestivum
  unsure (1)..(462): unsure at all n locations
  Clone ID: PAT_TA_86373
cccgcttcctcctcctcttcctcccgctcactcccgaagcgaagcctcgagagctcccaatggcttccaccacgttctcctccgccttctccatcctctctctcccctcttcctcaccatccccctccgcctcggcccccaggaccctccccgtcgccaaccgccgccgccgcgccgtcgccgtcgcctccaccgtcactgagtccccgaaggccttngagtcggcgacgccattggccgggtcaccttggaggaggtccgcaacttgttcgacatctccaaaaactcttggngtctctggcgctcctttgtccgctgcgcngtcgcggtcccgccgcggcggcggcgaggaggacgtcgagaaacgattcactggcatnaggaagtccaacaggcggtatcnaacataagtntgccgatgacaactgggctgangagcaaggtntatnaagggcccaaaaa

SEQ ID NO: 86374 - DNA, 477 bp, Triticum aestivum
  unsure (1)..(477): unsure at all n locations
  Clone ID: PAT_TA_86374
aatttcctgagaagtgtgacatatacacttatgaatttgaagatgtacacttcatggcgggctatctagctggtgcagtaatatggtgaccttggcaaggctgtcctttgtgcagtgcatgtaaatgactgtcagcttttaatttggagttaggctactctgctctgctctttgaaagcagtcaagttgcaggtctctgaagcagctgattttccttttcttttccctgggtgtcttgcgttggtctcctgaaaaactaggttttttnggatacatcaatcaatacaatacnggatttcaacttttaattnanaaaaaaaancccccangggggggcccngtacccaattcccctaaaggagcctattaccccgccaaangcctccttttaaaagnncngacggggaaacccggggtacccactaaccccttgnaaaaacccttcccaacggggnaaacgaannagcccacgtttcc

SEQ ID NO: 86375 - DNA, 509 bp, Triticum aestivum
  unsure (1)..(509): unsure at all n locations
  Clone ID: PAT_TA_86375
tttttttttgccacttgtgccctcacagcctcttcatttcattactccaatgcagtacatatatatacaccaggggtaggacacacccactaacccgaccaccacgttggccactaaccaactaacgctacatacttcatgcagacccatgcactagccagccactaccctcggcaactaatcccactagcccatggacttatctttatccctggaatcgctccaacgactcagccatacaactagctactcatgcatgctaacaaactcatccatgaagctagctaaccacttgcatgcatctaaccaatccatccaagccgggtgccgcttcgccgtccatgcgcttgccgtacgcacggncgtgccgcctcgcgcagtttgcagcctctccgctgtcatcggcatctccgccgtgctcgcatctcacacggnagttggnatcacgcctttttcgcaccctccctgaaccttgcgacctacaactctgagggggggccngtaccaat

SEQ ID NO: 86376 - DNA, 519 bp, Triticum aestivum
  unsure (1)..(519): unsure at all n locations
  Clone ID: PAT_TA_86376
cttgccacaactcctcctcaatttccacgccgaccaacctccgtgatttactccggacgccacccaccacctccggctggtctccagaacacccgagctccacctcctcgtccccgtgtccgcagcagtagagcaggagccctcgcgtcgagcctcctctccgtccaaggagcccgagtcctccgatccctcctccaagcgcacctcctccgctcctccgatccatgggagacgagtcctccctgaaccantctgggagatgttggcaaatgttgaggatcctttcgactaccccgctgtcttcttcaatggatcattcttcttccnaacnggtttcaagnttgggttctccaatccatcaaagtggagctnatatcaaacaactcttctcaacaacaagtttggaancatagtttantcctttaataaccaatatctttaagttcaagttcaagaancctaagtnccactggngtccctaccgcgtganataggaggaagaaggcacatcaaggagga

SEQ ID NO: 86377 - DNA, 477 bp, Triticum aestivum
  unsure (1)..(477): unsure at all n locations
  Clone ID: PAT_TA_86377
ttccactcccatcatcctccggccaccaccgcccacccccagtcccccacccgccatggcctccacctccacctcgctctccctcgccttctgccctctcttccgcccaaccccccaaccccaatcccaaccgcggtaccttgaccccaaatttcccaaacccctgcgccttagcctcgcgcctgcgctctcctgcgccgcccccctcgccgccgtccctgacggcgtcgccatagacnatatcatanagaaggactggtccttcctcaacgcgtccggctcccaanctcccccgcgcgctcgccgcgggggcgctctcgccggcgtcgcncgtgctggncgtgatgcncaccgtgtnattcntgagcgcctcctcttcngagtccccctncgagctcctggtcgcagntcangagtcgctgtncgtnctgggcnnattcatgangagcanancaacntctgtnnctnatttgtntg

SEQ ID NO: 86378 - DNA, 183 bp, Triticum aestivum
  unsure (1)..(183): unsure at all n locations
  Clone ID: PAT_TA_86378
gcccaacgtnntntacaagggganactcaacncctagagctncatcnccntcaatcgcttcaacngcccnncactntcccgacacgcgccagttcctggcacaagctaaatcagttggncagctccggagcaaaangttancaaatctgcttggctgttgctgcgaaggtgacgngagattgc

SEQ ID NO: 86379 - DNA, 206 bp, Triticum aestivum
  unsure (1)..(206): unsure at all n locations
  Clone ID: PAT_TA_86379
gcagcacacaaccctctccacccccagcaatccatccatccaccccacccccacccccctttctcctcnnctccccggcgnattccctccccganctcngnaatgntaaacgcttnatcaggagctgggatncatgatgnctgcaanctgangttcgtgganctcaagtccaatangatncancgcttcactaacctacangctgg

SEQ ID NO: 86380 - DNA, 327 bp, Triticum aestivum
  unsure (1)..(327): unsure at all n locations
  Clone ID: PAT_TA_86380
ngccgccgacgccnacnccganatgccgccgtccctcctactcnctacatcctctagnctaangatgcaccttccgcagacgagccngtcnacgcccctgctcgtttcattccccccgngccgcctccatgtggatctccncctccgactcgacgccgccggacccaacngcngtcaacngtgcggnctctcccggngacngtngtggcgccaacaacntgncnaaaaaccggagggatattctcctggaatacgnaaaaggtgtcnagncaaagtttanngacntttccgtnaaaanagcctaacacaaggttgnttgatcgccat

SEQ ID NO: 86381 - DNA, 471 bp, Triticum aestivum
  unsure (1)..(471): unsure at all n locations
  Clone ID: PAT_TA_86381
ccaaggtcagcagacagcaggccattacttgctctctttttttcaaaaaaacaaaacaaaacaagcagaacaaacaaagtcccagtagtgaattgaatttcacagctgattcagagcaaacaaacaaacaaacaaacagaagtgaagcaattgtctgtcttggatatgctgaaagaatagaatatccaccaagtggatggctcacagtgcgatgcccttgggtcctcaaagggtttggtggatgcggcgggtatgcagcagcagcagccaacagagattccaacaagggacatccattcccaaaggatgctcaaataagtgggacgtggttgggtattgggattcaacatcagctcgcacgcacaactttagaaaaattttggggtatcccccccggttgattaattgggtacggcagtaatgtgtttttccnaatagatannaagattaaaccgtccatttgggggacaa

SEQ ID NO: 86382 - DNA, 406 bp, Triticum aestivum
  unsure (1)..(406): unsure at all n locations
  Clone ID: PAT_TA_86382
agcgcctcctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgaagaaaccagcactgggcagctgccgatgtaaccaagcagattccaagctgggaattccaagtanccgggcgaacaactacnaccgtgcaaaatggcaanaanacggaaattccttaacggcgttctttnaaccaagggttnanntgccccggggggtggcccnccctggganatntttggggaaatttccngtnaanaccngcaaaattgcctnacccgtaaca

SEQ ID NO: 86383 - DNA, 468 bp, Triticum aestivum
  unsure (1)..(468): unsure at all n locations
  Clone ID: PAT_TA_86383
cttaaccacactcatctgatcacccatagctagctagctagcagcttaaggaactagcttgcagctaccgatcgatggctcgtctcaacagcaaggctgtggtggccgccgtggtcctggcggcggtggtgctgatgatggccggcagggaaggcctcggcggcgctgtccgtgcgggcaggtgggactccaagctcgcgccgtgcgtggctacngaacggggaanggcgtcctccattaagcaaggagtgctgctccggcgtgcaaggggctgaacggcatggcccgcagcagctccggaccgcaagatagcgtgcaagngcctcaaagacctccccaacaacatcaaanccatcaacatgggcaagtctccggnctgccccgcaantgcgctcagtgtgccttccccatcaacattccacaactgcacatgtcaactagtcaatatataccttccnactgcatgca

SEQ ID NO: 86384 - DNA, 328 bp, Triticum aestivum
  unsure (1)..(328): unsure at all n locations
  Clone ID: PAT_TA_86384
ttccagttctggcatagttctgatggttgaagtgtatgtctatatgatttagtatatgcatgggagtacccgctaaacgatgaagcatattgtgtcgtgttagctccatctagctttattatcttgaattctgtatctagattttgtatgttgtattccctttcaccgcgtctacatacttgatgaaagcttttttcctgattgcaaagtatgtgcaagtcagtagtgaacactctatacggnttgttcccagaaaagcaagattcaagcaattttccgcaacatttcatgtcccgttccatgtggnaantttttncggaattaaatg

SEQ ID NO: 86385 - DNA, 482 bp, Triticum aestivum
  unsure (1)..(482): unsure at all n locations
  Clone ID: PAT_TA_86385
ttttttttttttttttccgttaataaacttcattcatttctttcgtctccgacacagcagtatgtatcacattacaggtgattttacaggcacggcagaagatcgtgatgagcatcctagttatctacgcgccgcggcaaccccgcgggctaagcaggagaagaagaataccagtgcccccctctgtgttctggatttgcttctagtaccaatgtacgcttcaccgtgttttcgcgccgggcatcatcccgtccttctcgatcgcccgctgcctcgcccgctccatcttccgcttgcgccactcctccaagagctctttggctgctgccgtcgttcccttggccgttaactttcaaccttttncgataagtcaacagcagcgtcccttctgcgttggttgaatgccangtctccataacttctgctcaattccttnatctcctaacaaatcacaggtccgttcacgacgcaancctnggatc

SEQ ID NO: 86386 - DNA, 444 bp, Triticum aestivum
  unsure (1)..(444): unsure at all n locations
  Clone ID: PAT_TA_86386
ctccgatcgggcggctgaccgtgctccgtcgccgcattgatgaatgccgaagctatagcggctccccgtcgtcgctcttcccaggttagcgctcagcgcaagcactgcaccgccgggagcctccggggcacggactctcggccggccggcgactgatcccgtagttcttggtttgcgtgcgcgcagggatgccacggtcgcccggatcatggattgccaaccgcggtcgtagccggcgttgccgcgtccgtcgccctgctggtgctgctggcggtccgccgccgcgctctgctggtggcggtccggggcgcgccgtaaccngactccganacgctccgacnaaatcctcccaacgctancggattgggnaagtncngccggactcntccgggccggataacaangngcaagcgttaacctgagganattccangcacaagaatt

SEQ ID NO: 86387 - DNA, 333 bp, Triticum aestivum
  unsure (1)..(333): unsure at all n locations
  Clone ID: PAT_TA_86387
aggtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgaagaagggcgtcggcaagagcggcaagccgctgcactacaagggcagcgcttccaacgcgttgatccccgactcaatgtgccaaggcggcgactnaacaaagggcaacggaaccggaggcgatccatctaacggga

SEQ ID NO: 86388 - DNA, 190 bp, Triticum aestivum
  unsure (1)..(190): unsure at all n locations
  Clone ID: PAT_TA_86388
ttgnnaagacanaagctctgctcgctgaaatgatcattctgntcattcattcctttagcctcttcttcaacnccncctccatccctccctccctgacttctaaatgttnctggatttgggcctgtnttgncatnccangttagcatgtccttggatacatatgatgggngcaggtctntagtcnacaaat

SEQ ID NO: 86389 - DNA, 466 bp, Triticum aestivum
  unsure (1)..(466): unsure at all n locations
  Clone ID: PAT_TA_86389
gctccctcccccctctctcctgtcctaattcactacgccgctatttattttactattaattgccccgactccgtccccgtccgcgtccccgcctcctacgccgtcgccaccccaaattcccacgcaaaccctaagccagccagccagctagctcggcagcccagcccagcccagcccagcccaatggcggaggacgccggcgacagggaccagcagcagcagcagcccgccgcggccgtggggcccggagcagggcacgcctgcggggaggacggcggcggcanggacgagagctccgtcaagtcttcgtcgggcaagtgcccaagtcatgacggangccgagctggccgccatttccgcgactcgccgtcgtcgacgaagtcaccgtcatccgcgacaaggcacaaggngtcccnagctgctgctcctgatntgccatcaagggaggagnttacangnaatnaat

SEQ ID NO: 86390 - DNA, 702 bp, Triticum aestivum
  unsure (1)..(702): unsure at all n locations
  Clone ID: PAT_TA_86390
ccacactctcccacgcagcgaccaacaccctcccccattccattccgtccgcccaccacaccacctacccagagaccataccatcaccatgagagggcgagagacgccccccaaggctcgcagcggcgcggcgaccccgagctgcccgcagagcccgctccgcatcacgcacgacggcgagttctacgcgcggctgctcaccagggagagctccctcgccaacccctccttccgctactacggcgccggccccgccgccgtgcccttcggctgggagtcccaagccgggcacgcccaaggacgccacctcctgctgcaggaaggcgctccccgccgtcccggccatcaccccgccgccgtcctaccacgcgcgggccgccaccgcgtcgtcgtacggcgacagcggcaggtgcagggccgaggagcaagggcgccccgcggcacaggagctgnagtgctgctcggcggtacaggaggccaagtggtcaggtggctcatcgccgcgtgtccgccgggatngcgtcgnaagtcccgggtgtctntcgcgggtcgtcatctctcgcgtcaccgctggttctcgnggtcagagngctngacagcgngcacantcatntncagngcgcatacggatttctcggtcgccagccttgangnanttcggcgagaaccntgtaggggcttgcgaagtntccncgcctatat

SEQ ID NO: 86391 - DNA, 779 bp, Triticum aestivum
  unsure (1)..(779): unsure at all n locations
  Clone ID: PAT_TA_86391
tcaaacaacaaactatcgtctctttttttgcaggataacaacaacagccttcaattaggaaccttaacaatgttgaaacccaggcaagtgttcccaacaatanatattttttgaatagtgcatatcattttttcgattacctcagatttttttaacaattcaattaggaaccttaataatgttgaaacccacgcaagtgttcctactaaacacttttttatacctctgatgcgcagccgggcctagaactaatcgacaggataattgcttgtaatctggactcattctgtgtcacaatcaccatggntgacgttgggaacaaagccacaaggaacaagaggaacaacagacttagtacacaccaccacaaccattggatctgacgaggaacaaccattctctcaaagcaatgggatgcaatgccgctactcagcaatgaccaagtgtgtgcctcctcctttgctacttctcagattagattaggagctcctgaccagtacangtcatatcgcataantnnaaaacgtcccattaatggcagatgatctgtctctagaacgagagagtngtganacagacttangcgncgtgggtctcactcagtntaaccagtaangctgncttgctccagacaggcgtagaactnganacgccggatgttngtcgctagatccacctcanncatagaacacactgctgagcncgctagttgngagcagncgagtcgtngtcgtcnngagcntcatgtagggggcgtccgtncagatgtncnggggngg

SEQ ID NO: 86392 - DNA, 431 bp, Triticum aestivum
  unsure (1)..(431): unsure at all n locations
  Clone ID: PAT_TA_86392
gtaactgaagccctccctgctgtgatggaaaaatcttggctcctgccttttcatgctggcttcgcttcattttgctgatgttcagactaagtggatgaccctgtaatattgtgtctgctataaaatggtagtttctctttgtagcctctgttcttataacagagtctgttgccgctctggggctggattcttctgaatctagaccttgaaccattcttgtaggttctctccactgtctttggcntccggggaggagaaagggatgggcttctcctccttcctcaatgtggcagtaggttgatccgttagaagagtggagtttcgtgttgaggggagtgtgttccttttttcttttttctgtagcaagacttggngatttttgttaatggaaatcggagaggtgctctctttancaaaagaaaaaanaaaac

SEQ ID NO: 86393 - DNA, 620 bp, Triticum aestivum
  unsure (1)..(620): unsure at all n locations
  Clone ID: PAT_TA_86393
gtcctgcaggctgtcatcgaccaccttgttctttggcgcttaataccagaaagcaggaaaccaaacagtgtcgtcatcaatttcttcgatgaggacgagcactcgcagccctacttcaagcctccccacctggacaaccccatttccactctcctgctgtctgagacctcaatggcatttggaaggtcacttgtcactgacagcaatggcaactacaagggacccctcacactctcactgaagcaagggtcacttctggtgatgcgcgggaacagtgcggacatggcgcgccacgttgtgtgcccgtcgtccaaccgccgcgtgagcatcacgttcgtgagggtgaggcgtcgacgccggtngacctcaagccgctccgtcgccacanggncatgacgctctggagcctccnccgactgcgnaacggcggatgcagnaacagccatggaanancgggnctcattggctacgnccgcggcacaggcatgtcgccctncgtgggaatgnctgcccgcgggnctgtatatgngccggccgnangcnatgtatggcctcagaantcacaagaggtggggcgaggacgggngtnctcctgnngntgggcaaagtaacagactccc

SEQ ID NO: 86394 - DNA, 416 bp, Triticum aestivum
  unsure (1)..(416): unsure at all n locations
  Clone ID: PAT_TA_86394
tatttttttttgctttcgcgctaaatttatccaactgcgccctgctgatggacgagttgatgtgacttctcacaactaccaacacctccaaacgaacttgggggatttttcacgctcactgccccgcctctatacacaacacgcaacaacttacaaaagacaatactcgcatattacggaaaagaacgaatattactantactaattttgttaaataaccggcaacagtagcaatggccattattaagctcttcctttgctctctgcttttccatattttggggggaaatctggaatgcttttttacttttaccgggagaagacgggctgagggtttgganaacccgcggagcgcgcgtanccgcaggaggtgaagccgaggnancgacacccctgccggtacggaagaacctcgc

SEQ ID NO: 86395 - DNA, 618 bp, Triticum aestivum
  unsure (1)..(618): unsure at all n locations
  Clone ID: PAT_TA_86395
ggctattgcatcctcctatacttatgtctgaacaagctgttagtgttcaggcttcagaagtcggttcagttcagggattgtagaccttaaataacctggttcttgtgccaatgaatatctgcaccatcatttactaaggctagtcatctcaggctcatttaaatttgtcttttattcactggaatccatgaattgcaggctgctatacttcagttgcattgcatccccttgtacttctctctgaaaaacaatctgctactgttcaagaattcagagttggttgaattcaggctttgcagatcatcaagatgtgtttcttgtgctgatgtattatgtatattggggaaacataaattatatgtggattcaccatctacgaatactgggatttaatccactgctaatttacaagtgggtagtgtctcaatctcaactgtcatgtttgttgtttgtccatgggtaatgcaggngacctgaaagcctggcgccgatgtcaacataacaaggccaagtaggcaaaagagatgctcatgcctaaaagacccaaatgctactaataatcaagctcncaaaaaggaaccggtatcgcgccgttccggtcttctgtgnaaaagttcg

SEQ ID NO: 86396 - DNA, 275 bp, Triticum aestivum
  unsure (1)..(275): unsure at all n locations
  Clone ID: PAT_TA_86396
ctgcagccatctcctccgcgcaccggattccatccactctaatctctccaatctctcatggcgacggncancgcgagtcggcccaancggcccggtcctgtcgatccccatgctaccgctccgcctcgcccacccgcgtcaacctccccgcccgctcgcccggcaagtccgtcagcgtctcgtcnccgtcctccaccagganccgtcgatnctccngcatgtgctcnccgacnanccactcgggctccttccgctgcatcctccacannggagcg

SEQ ID NO: 86397 - DNA, 509 bp, Triticum aestivum
  unsure (1)..(509): unsure at all n locations
  Clone ID: PAT_TA_86397
ctcgccccacatgacccccggcgcaccccgaccccgtcgcccgcttctgaccacatcggacctcntcnccgccgctgctgcggctcacggccttgacgcaccgggcctcgtcgcgttcgcctccccgcctcgaccccaacacccacggcgccccgaggccaacgtcgccacccatcgtcgctcgtcntagcctcgcctcctcatctctccctcgtcggctccgtcaagcctcgccggncccctgttcatctacaacggggtagaccctgagaccgctgctgatgccactgtgatcgactacgtcgacnacgaccctgcntcttgtctgagcaaccagatggtggatccttgggagccagatgccanccctggtcgannactacnacatggaggccgccgatnactaacgagtagttangaggtcccanncatgaggccntgcctantcgatnatgntgcttttgtgccancccttcntnanggatcttgttaaatttatgtcngtacta

SEQ ID NO: 86398 - DNA, 260 bp, Triticum aestivum
  Clone ID: PAT_TA_86398
cccaaaagccaggggccccctcccagatatacgtacgtaggtatacatacaagcttcgacaggaaaaattctatcagcgcctcgctcagcttcgcgtgctagcctaggaaagtaaatacgttgggcctggcccatgtttgcatgtactcacgtggagtcgtggagaactgcagatcggagaggaaaaggaatcgttgcctcgttggattgatttcctgtaatttaggaattagcttcggtctttcctcaaaaaaaaaaaa

SEQ ID NO: 86399 - DNA, 552 bp, Triticum aestivum
  unsure (1)..(552): unsure at all n locations
  Clone ID: PAT_TA_86399
aggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggatggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaagttcgtccacaancacaccaagcnngggatcntctccatggcaacgcgggcccaacaccaacngctccagttcttcatctgaccgtcccctgcaattngctcanggcaagacgtgtttggcgaatntnagggatggacgtgtaagaaatcgagaaagtgggctccgagggnactgtcaagcagtgtatgcnatgggnag

SEQ ID NO: 86400 - DNA, 539 bp, Triticum aestivum
  unsure (1)..(539): unsure at all n locations
  Clone ID: PAT_TA_86400
naggaaatccactccaatccaatccccacagaaatncccatctcaaaancctancncgtncgancccggcgaganggccaacccgagggtgttcttcgacatgancgtnggcggcgcgccggcngggcgcatcgtgatggagctgtacaangncgcggtgccgcggacggtggagaacttccgcgcgctctgcaccggcgagaagggcgtcggcaagancggcaagccactgcactacaagggcagctcgttccaccgcgtgatccccganttcatgtncnagggcggcgacttcaccaagggcaacggcaccggcggcnagtncatctacggcgagaagttcgccgacgagaagttcgtccacaaganaccaagcccgggatnctctccatggcaacgcgggcncaaaacaacggcttccagttcttatctgntcgtccctgnnttggctganggnagaagtggtttgggaggtgtcgagggatgacgtgtagacatggaagtgggtccgaacggcactgntcaagcagtgtatgcgg

SEQ ID NO: 86401 - DNA, 550 bp, Triticum aestivum
  Clone ID: PAT_TA_86401
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaagttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagtgattgacataactgatgatggatatgtcagcttctaactgagagtggcacacgaaggatgacctgaagcttcccactgatgatgttctgcttggcagataagactggatttgctgatggcaagactgatctgttgtgatgtcgcatgggtgaagacagttgcgctgtgaggaatcgtgtgcagtaacactgtc

SEQ ID NO: 86402 - DNA, 409 bp, Triticum aestivum
  unsure (1)..(409): unsure at all n locations
  Clone ID: PAT_TA_86402
ctccagtcgaagcgcctccgcaacaaggtggccggcttcaccacccatctgatgcgccgcatccagcgcggccccgtgcgcggcatctccctcaagctgcaggaggaggagcgtgaggccgcatggacttcgtgccggagaagtcggcgctcgaggtcgacgagatccgcgtcgacaaggagaccatggacatgctggcgttcctcggcatggctgacctccccggcgtcgagcgcgcccccgaaaccacctctgccgccgccccctaccgccagcncttcaacggaccccgcggtggcaaccggcctaggttcntccgcatngtcatcgtacccctatattatgcttnatgtctttaaatntgtactttggaataatgtttttancnaaggttaanttcgaggggttt

SEQ ID NO: 86403 - DNA, 531 bp, Triticum aestivum
  unsure (1)..(531): unsure at all n locations
  Clone ID: PAT_TA_86403
ttcaagcgcatccacacacacacacaccacagaccacctctccccgcccaagcatccccatccgcatcctcatccatggcccccaaggcagccgagaagaagccggtggagaagaccccggcggggaagaagcccaaggcggagaagaaggtgccggcgtccaangagggcggcggggacaagaagggcaagaagaaggccaagaagagcgtggagacgtacaagatctacatcttcaaggtgctgaagcaggtgcacccggacatcggcatctcctccaaggccatgtccatcatgaactccttcatcaacgacatcttcgagaagtggccggcgagtcggccaagctggcgcgctacaacaagaagcccaccatcacgtcccgcgagatccagacctccgtccgcctcgtctccccggcgagctcgccaagcacgccgtctcgagggcacaaggcgtcaccaagttactcgctgattcggtctgtcctgtgtgtgtttctggtgatgatgatgtgcctgtagttctgct

SEQ ID NO: 86404 - DNA, 286 bp, Triticum aestivum
  unsure (1)..(286): unsure at all n locations
  Clone ID: PAT_TA_86404
cccaagcaagcaagcaagcagccaccgangcagcctccgntcccctccccgancccgaagcaatggcgcgcacgaagcagacggngaggnagncgaccggaggcaaggcgccgaggaagcagnngncgaccaaggccgcccgcaanncggccccggccaccggcggcgtgaagaagccccaccgcttncgncccggcaccgtcgcgctccntgagatcngcaagtagcagaagnncanggagctgctgatccgcaagntgncgttccagnggctggttcgngatat

SEQ ID NO: 86405 - DNA, 528 bp, Triticum aestivum
  unsure (1)..(528): unsure at all n locations
  Clone ID: PAT_TA_86405
gatttggccatttctgttttattaataggtactacatgaaaacaccatgaatcccttgcacgacatcgatccttgaaattatctaagtgtccttcctctggtcagtaagttacatcattatcatgtacggcgatgctgtctagcttttagcatgtagtatgtagtaccactgtacttgataatgccaaattgccaggttgcacatgcacgaaaacaacctgcaaaagctctttgtcctgaagaaagctagcctgaaactcatattctgaatgtctatgcttgagggcgtgtcctgacatcagaatgggatccttgttcatgctcctagtctgaggtaatcatgcttcttcgtagcgagcttgggcatgacaaagcaccgcctgaaccggtccagagccttcactctgatctcagccggagccgtcggagcccgtcaatgacggacctaaaaancttctgcagtttntggcttgcaaggctgaacagcttctcttgtcttcntcctcactgtagttcttctnatctggn

SEQ ID NO: 86406 - DNA, 433 bp, Triticum aestivum
  unsure (1)..(433): unsure at all n locations
  Clone ID: PAT_TA_86406
cagcccccctccgatctcgccgagaaatctcctccgatcgaagcgaancanaggctctctcgtccccctcctcaagatgcagatctttgtgaanacctcaccggcaagaccatcacccttgaggtcgagtcctccgacaccatcgacaacgtcaaggctaagatccaggacaaggagggcatcactccggaccagcagcgcttgatcttcgctngcaagcagctcgaggatggccgcacnctggcagactacaacatccngaaggagtccacccttcacctggtgctcacgctccgtngtggcatgcngatatntgtgnagacattcaccggcaagacnatcaccctngaggttgagtcctcggacaccatcgacaacgtcaangtaagattcangncaaggagggatccntccggacaacagcgnctatttt

SEQ ID NO: 86407 - DNA, 464 bp, Triticum aestivum
  unsure (1)..(464): unsure at all n locations
  Clone ID: PAT_TA_86407
gggcggtgattgtcagcgaccacatcaccagaactcgaacctcatcgctctcttcgcctccaagtagttccccgaggcgccgccgcccgcatcatgccctgatccacctccccaaggatctcctctcagaacccaccccgctcatcttcacagacacctccttcgtgtcctgatttcccaaactcgctggctttggcctttcttcagtttgattgcgttttggatttcgttacatcctcgcatctatattttgcagacctgggtgcatgatagagctgattacanggtgcccggccgcggcggcggacgcantcgttgctgacgtatgcgtgcgacanggntaggacgcgggaacagattagctcttctggctttcccaagctccgctgattaggtgaagggcggcngattggagtgagtgggtcatnggtangggangnaggcttgcaagttttganacaagg

SEQ ID NO: 86408 - DNA, 514 bp, Triticum aestivum
  unsure (1)..(514): unsure at all n locations
  Clone ID: PAT_TA_86408
gtgctttgggaatgatttatttggcgacaaaagggcattatacatctagtgatatctggatcggttgatgttatatcttataaacttggaatcaacgtaggagaatggcttggcataaacaaaattagagtatgcatatacagaagtagattatttagaaaacaaaagtgggcaaaaagatcaaaattccagttacttaacgctttcatatgcattaacataaacaaactttgctgtattcacatctattcaagtgattacaaacacctgcagatggtttaaattaaattatgtgtggtctagaactgttttctccctcatacccaccatcttcatttagaatgataaggcagattgaggaaacacagcgaaacctgcagatggtaatatggttcttatagtacttttactgcaaaagtactcgagcgcacangggcaaaataaatcaaagaagatcatcactaagacaaacttgaaaaaaaactcatagaccacgtgtggtttaatgtaactg

SEQ ID NO: 86409 - DNA, 472 bp, Triticum aestivum
  unsure (1)..(472): unsure at all n locations
  Clone ID: PAT_TA_86409
ctagaaccaaagtagcactagtacactgcagctgaaggcactgggctgctgatcaaggtagctagctaggatcaatggcgtcgagcaggacagcagcgatgctggtcctcatggccgcggtgctgtgccctgcagccttgtgtaagccgtcggcgggcgttcatctcgatgcccaccgaccacgtcgtggcgcgtattcctcctgtctccccagccgaaggntcnccttcaacttccattccgactcctgcccgcagctgcaggatgtggtacgctccgccgtgcagantgcgctccagagcgagatcnccctcgccgccggnctcctccgcatcttnttccacgactgcttccctcagntcatcgagtccatccgtggcccaggtgcatgncgccttcgggcccgtcgtctnatgngcaganatcaacgcccttnttanaccgtgatgccgtggccttntnccggggntaa

SEQ ID NO: 86410 - DNA, 311 bp, Triticum aestivum
  Clone ID: PAT_TA_86410
ggatctgctacatagcattccgccccaggcaggaacttagcaggtcttcaatcttctgcagtcaaggagctgaacaagcgcctttttctatggattgcaaaaattaggcggtgttcttctcgactgctccaatctctaatttattcacgtattcgcatgtaaatacagtcaaggagctgaacaagtgcctttttctatggattgtaaaaattaggcggtgttcttcccgactgctccaataaatgtgtctgcacctcattccttattgaaaatgatatgattgaccgatagcaccttccaaaaaaaaaaaa

SEQ ID NO: 86411 - DNA, 451 bp, Triticum aestivum
  unsure (1)..(451): unsure at all n locations
  Clone ID: PAT_TA_86411
gagcgcccccatcttccctcctctctcttttccactttcccctcgcctccgcctccgccatcgcctcctcccctctcctccctctctcccgtctcctccctctcaaccctagccgtcaccacccagtacccaccctctactgctccaccgcgcacccacctccccttggatcaggtgcaggccggccggtgcgcgcaggcggcggcgctccactcgagggcaaagggaggcaacggcggcggtggccgnttggnacacccgcggctatggtgagcccctgcgccaccgccctctctcctctcctcccctactccctcacccatctctctcccacgcagacgaaccccgctgctaggaggccaccatggaggcccgtcccgagcttggcttgcagctcctccggtgaancctcgttgtgcntgattngggtcgggcggattcgaagattccc

SEQ ID NO: 86412 - DNA, 393 bp, Triticum aestivum
  unsure (1)..(393): unsure at all n locations
  Clone ID: PAT_TA_86412
ttcatgtgctctacaacaaggatcactacaaacttgcaccggtacagggtgtctccatacttgagcagcctcagatagtccttggagatctttgcaatgatatttctagctgtattgatctgacccaaggcaagtttgtagtgatccttgttgtagagcacatgaaggagatcgccatagaaagggtggatgtcatccagtctggggaactcatcgatgatggtggacagcttttcatagaagttctgctgggtatagcgaaccttgcgcatatagaactggcgaatnnggttgatagcatagcccttttggacaaaagttggtgtttncccctnatgcggggaacngcactngaaccctcnggggaaccaaccaanaaaanacccnccccta

SEQ ID NO: 86413 - DNA, 368 bp, Triticum aestivum
  unsure (1)..(368): unsure at all n locations
  Clone ID: PAT_TA_86413
tttttttttttttttagataaccagatagcntgcntattaaccaaggtgcntaacaggttcaaagatacaagggtcttacaacncaacaggttataaaacaaacaccacaaagnaaagattcaaacagacngataacagataaagccactcgggcngntcntgggatagcngcngcacgccttgggaaagcnccangaggcaggctctagtactcgtcgccctcgtcaccgtcctcaccctcgtcgaactcagcnccaacttcttcnnagtccttctccngggcagcnagatcctcncgggnctcagagaactctccctcctccatgcctcacccacgtaccagtggccgaangnacgcttggcgtac

SEQ ID NO: 86414 - DNA, 295 bp, Triticum aestivum
  unsure (1)..(295): unsure at all n locations
  Clone ID: PAT_TA_86414
ncnacnnncccgnccataatatacaaccgccctcgcaagaaccaccagacctcacatgctttnntccctcccccttcntcctcctcctcctcttaacctcncccgcngcagcccgtgctctcccgtacttcttgganccgatnatcgnaagatcatcaaccagctgccactcttcgncgtttctttggcaccacaccatccggcgatcnccganatgatgatgggggtacttctgggcgcngaggaagtnnncggcggngnagagggngcanaancctgcngtgcggngctgcta

SEQ ID NO: 86415 - DNA, 400 bp, Triticum aestivum
  Clone ID: PAT_TA_86415
gagcaatctactgaaactccagtgaattcagtccgggaggagcctgccgtagcctggaaccagaacgctccgcgacaggaggccgaggcatctacaagctcatccaggaaaaattaagcaagacgggaagactaaagaaacggtgatatgaagcatgttgctgctgcataagtgaagtcctctcagcgtgattgggaggaattctgatctccatcagaagattatcctatttagtactgtcattattagcaagaagaatcatagttataagttactattaagcgtctcttgtgtgatgctcgaatttgtgtgttaagtttgtgggctgcttatctgaaccgaagttgtgatgctaccctatatttatttgacctttttctccctaaaaaaaaaggggggg

SEQ ID NO: 86416 - DNA, 190 bp, Triticum aestivum
  unsure (1)..(190): unsure at all n locations
  Clone ID: PAT_TA_86416
cgcnagtggagtccttcgccaccaggggcctcggcgacgtcgccganctcgtggcgctctccggcgcgcacaccatcgggcggncgcagtgcngcancttcgaagancggtcgcagcgcgccgnngataccttctcgcgcaannggccgccaactgnagcaagnncccggatcggctgtagaanctggac

SEQ ID NO: 86417 - DNA, 482 bp, Triticum aestivum
  unsure (1)..(482): unsure at all n locations
  Clone ID: PAT_TA_86417
cctaaaccctacctcgacgggatcggccgatcggcgccgcgtcctcgccgggtgagctctcctccgcctctctccagacgctcctttcgttttttcttcttctgtacttttttttgcccggtcggtcggtcgacgcattggtcgatttcctaaggatttcgcttcgctcgcgtcggtgatttggtgggacggatcgacagccagtggtcacatgcgttgctgcggttttagttttcggggtaatttggtctctggcgagtggcgagtggcgagtagtggatgtttcagggtaggtggcagccgaaaggaccgatttcgcggtcctgttcgaaacttcagaaattataattgttttgtcctcgcctgttccttatagtatcttcgtcggtcgtttgcaaatctatgtaaggtctaagtccgccccttctgtctgnctcttttgcttaggatggatgaatcagtacggactgaacctgaacgcn

SEQ ID NO: 86418 - DNA, 459 bp, Triticum aestivum
  unsure (1)..(459): unsure at all n locations
  Clone ID: PAT_TA_86418
cccggcctctctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagattgccgagttcaaggaggccttcaanctcttcganaaggacggagatggttgcatcaccaccaaggagctgggaacagttatgcgttcgctggggnaaaacccaaaggaggcttagctccaggacatgatcaatgaantcgatgctgatggcaaaggnaacattgantttccagagtttctnaaactgatgggcccncaagattaagggncactgnactcanngggaggaggctcnaaganggcttnagggngtttgaacaaggaccaaaaaagggttnattncctggtngctnangctccncaatgttattagg

SEQ ID NO: 86419 - DNA, 245 bp, Triticum aestivum
  unsure (1)..(245): unsure at all n locations
  Clone ID: PAT_TA_86419
gagagcatccagattccagactccagagcaacagtttcangctgagttgagtgttttttangttgccaatggnggacatcgcgatgctggtggcggaggagcacnagaagaggatgaagcnangggngccangcccggncgccggcccgangangaggcgtccnggggganggtnaacttncggggncgtnaccaaagtttggggcnccngggccgaatncgccgccgggcgncgggtncggggt

SEQ ID NO: 86420 - DNA, 505 bp, Triticum aestivum
  unsure (1)..(505): unsure at all n locations
  Clone ID: PAT_TA_86420
agcccccctccgatctcgccgagaaatctcctccgatcgaagcgaaccaaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctggcagactacaacatccagaaggagtccacccttcacctggtgctcaggctccgtggtggcatgcagatatttgtgaagacactcaccggcaagaccatcaccctggaggttgagtcctcggacaaccatcgacaacgttaaggctaagatccaggacaagggggggatccctccggaccancaggggtctcatctttggctgggaaaannagctcganggantggcccgcacccccttgntgaantaaaaaaattcaagangg

SEQ ID NO: 86421 - DNA, 347 bp, Triticum aestivum
  unsure (1)..(347): unsure at all n locations
  Clone ID: PAT_TA_86421
ctgggcggaaccatcgcgctgggccttacgagccagccggttctgcaaggccttatcgttttcgccgtcctcggtcttctcagcttcgtggcaggcctacctttctcctactaccacaccttcggcatcgaagagcggcacggcttcaatcgccagacgaaaaaaggcttctggctcgatcaggtgaaaggcatcctgctcggcgccatactcggcggcctcatcctcgccgtacttctctggattatgaaccgcatgggttcgagctggtggtgggtcgcgtggatcgctttcttcggtttaagcttcgtaacggcttggtctaaccccggaattctnggggcggt

SEQ ID NO: 86422 - DNA, 515 bp, Triticum aestivum
  unsure (1)..(515): unsure at all n locations
  Clone ID: PAT_TA_86422
atccaatccgcacagaaatccccatctcaaaaccctagccctcatccccgatcccggcgagcgagatggccaacccgagggtgttcttcgacatgaccgtcggcggcgcgcngcggggcgcatcgtgatggagctgtacaaggacgcggtgccgcggacggtggagaacttccgcgcgctctgcaccggcgagaagggcgtcggcaanagcggnaanccgntgcantanaagggnagcgcnttcnaccgngtnatccccgantttaattttccaggggggggatttcaccagggggnaaagggcccccgggnggngntttctttntggggnanaaantttccccgacganaaatttcgttccaanaaggaaaaacaaancccgggantcttttcaattggcnaaacgcgggggcccaaaanacaaangggtncccaanttttttaaatttnnaacggtccccntaaaattnggttcnnagggaaaaaaaanntgntttttngggaaagtttttaa

SEQ ID NO: 86423 - DNA, 216 bp, Triticum aestivum
  unsure (1)..(216): unsure at all n locations
  Clone ID: PAT_TA_86423
gagcagcggcaatttagagggtcttataaatacgaagcgctctcgccggtgccaaactcagtcatggcggcagtcggaacggnaccactgctctaccaacagcaggcgcatgcggcnggcgacggctgctacttctctttcangtcctcctacntctcccacngggaagccanctcgaacgcctccagcccggngtccagcttctncgccgngctc

SEQ ID NO: 86424 - DNA, 450 bp, Triticum aestivum
  unsure (1)..(450): unsure at all n locations
  Clone ID: PAT_TA_86424
gccaaaggtaatccaatccgcacagaaatccccatctcaaaaccctagccctcatccccgatcccggcgagcgagatggccaacccgagggtgttcttcgacatgaccgtcggcggcgcgcngcggggcgcatcgtgatggagctgtacaaggacgcggtgccgcggacggtggagaacttccgcgcgntctgcaccggcgagaagggcgtcggcaagagcggcaagccnctgcactacaagggcagcgccttccaccgcgtgatncccgacttcatgtgccagggnggcgacttcaccaggggcaacggcaccggangcgagtccatctaccngcgagaagttcgncgacgagaagtttcgtncanaagcncanccaagtccccgggattctctccatgggcaaangtcgggntccaanaaccaancgggtncccagtttntttcatct

SEQ ID NO: 86425 - DNA, 292 bp, Triticum aestivum
  unsure (1)..(292): unsure at all n locations
  Clone ID: PAT_TA_86425
gtcaaggtggagtaggaaccatgtccaacgtncccacctccctccgcgactcctccctcaccgtcttccgcctcgccatctccagctccnanccctggcccttctcttcctanncccanaccccnccatccccctcncgagctccgccgtccgatctccctcnnccctctcctccttcctcgcaacagccacnagactcgtccggtcctcgcntccgatgnacctcaggcagcagcagcancaccaccaganggcggatatngtggcgcacaangggtgcntgacggtgcgc

SEQ ID NO: 86426 - DNA, 336 bp, Triticum aestivum
  unsure (1)..(336): unsure at all n locations
  Clone ID: PAT_TA_86426
gtctcgagtttttttttttttttttttttttcagtaaataatcctttcaatatctattaacagtgtccataacaaccaggaacaaaaggcnaatccaagtatcatcaaacaaaatgtttatcagtaccactagcagaaaggccaacaagtgcaagactagcattgtgcagttataaaaaattgtacccgtagttgtgaaatgttctacatatgctatctgcgcaaaaaacccatggcttggtagacgttgttgagggnggcgnctgcnatcccagaagctttccctgccccatctagnaganncactaatccanataacctggatcatgccatgat

SEQ ID NO: 86427 - DNA, 463 bp, Triticum aestivum
  unsure (1)..(463): unsure at all n locations
  Clone ID: PAT_TA_86427
cttcgtactcgcctctctccgcgcatcctagccttcgccctcctccttccccatttcgccagcgggcagccanccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactggtgctgggaagcatgtcccccgtgctgtctttgtagatctcgagcccactgtgattgatgaggtgaggactggtgcttaccgccagctcttccaccctgagcagcttatcagtggcaaggaggatgcagccaacaacttcgcccgtggtcattacaccattggcaaggagattgttgatctgtgccttgaccgtatcag

SEQ ID NO: 86428 - DNA, 241 bp, Triticum aestivum
  Clone ID: PAT_TA_86428
ttaacctgttataggcgaacgaacagatttttttcacggatgacggtctcatccacggtgaaggtatgaagtaataaccggcgcagaggtgcctttgcgcgcagtttgtcgatgcaagggtccaaaacgttctcttctgtgtaatagtatgtatgttgcactttgcacgcctggtagcagcggtacttcctgggaaagtactcctttataatagatctgatctttttgcaaaaaaaaaaaa

SEQ ID NO: 86429 - DNA, 538 bp, Triticum aestivum
  unsure (1)..(538): unsure at all n locations
  Clone ID: PAT_TA_86429
cttccctactgctactggtccacaccctccccgccccttgctcttcttcttcttcctcattctccccttcctccctctttgctgctcgcattcgccatttcccacccacccacaatgcactaaaccctcgtaaaacctcccaccccatcccaccaaacgacggacttctggttcatacgacttcgggggattcccctggggagcagggactgagccaatttcttcttgattttttttgtcgatttggcttctactctcactgaacaagtcccttgggatgaagatccacacccacccctagttcctcttagttttttcaccgagaaatccccaagctggggattttgtttttttatcctttccgttcgcccccaagtttgggaaatttttcgatccatttgatcgtttggtggtgaaagtgaaacaggangagggganaggtccctctatgagcagagcaacgccgccgcgcctgtcgatactgagcgtgcacgatgctttggggtctggtgtcagntcgcggcgagtcgcttcttcc

SEQ ID NO: 86430 - DNA, 221 bp, Triticum aestivum
  unsure (1)..(221): unsure at all n locations
  Clone ID: PAT_TA_86430
cgccgcctccgccgcctgcggatntgacggagctgatgaaggcgcanatngccgggcacccccgctacccctccctcctctccgcgtanatcgaatgccgcaaggtccgtccgtgttnagctccanntccantttgcatgctgnagcccgctagnagnanctagagcnagctanctngctcancgcantntatcgtcanaaattaantnncacgttgattc

SEQ ID NO: 86431 - DNA, 457 bp, Triticum aestivum
  unsure (1)..(457): unsure at all n locations
  Clone ID: PAT_TA_86431
aaggcgtcttcgtactcgcctctctccgcgcaaccgagccttcgccctcctccttccccatttcgccagcgggcagccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaanaccgttgggggaggtgatgatnctttcaacancttcttnagcgagantggtgctgggaagcacntcccccgtgctgtcttngtanatctcgagcccactgtgattgatnaggtgaggantngcgttaccgcagtctttcacctgagcagcttatcantggnaaggaggtngagccaacaattngcccgnggnattacacaattgnaagaganntttatcttgcctaatcgtatagg

SEQ ID NO: 86432 - DNA, 506 bp, Triticum aestivum
  unsure (1)..(506): unsure at all n locations
  Clone ID: PAT_TA_86432
ccggcctctctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaggccttcagcctcttcgacaaggacggagatggttgcatcaccaccaaggagctgggaacagttatgcgttcgctggggcagaacccaacggaggctgagctccaggacatgatcaatgaagtcgatgctgatggcaacggcaccattgacttcccagagttctcaactgatggccgcaagatgaaggacactgactcagangaggantcaaggaggcttcagggtgnccacaaggacaaacggttattctgctgctgagtcgcatgtatacgaactggtagaacnacgacaggagtgacgaatatccgnancgacgtcacgnatgcagataananagantgtnagg

SEQ ID NO: 86433 - DNA, 369 bp, Triticum aestivum
  unsure (1)..(369): unsure at all n locations
  Clone ID: PAT_TA_86433
gccagcgccgacgcgcgcatcgtttttacgttacaactcgccacgaaagcgagagttgaaaggagcaaccgcccacccgactcctcctcccccggccgagtccacccctcctctccnntcntccctccgcccgccgacacacgcgcaangggncgccgaactnaccanccccanctcaacctcctcgnctctctcgccccgccggccganggattnccggccancaaactngncttccgcgagatccgcagcaatggaggtgaggncagtaaaanttggnaatatttcattgagtgctcaaaaaagggatnacagagttctttttttctctggngntatagaaatnttgaaatncaaaatgaaangatt

SEQ ID NO: 86434 - DNA, 413 bp, Triticum aestivum
  unsure (1)..(413): unsure at all n locations
  Clone ID: PAT_TA_86434
ccctcccccccaacccacaaccaccggcggcggcgcacgcagctcgaggaaggaggcgaagatggtgaagttcctgaagcccggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaagactcggccaagaagacggccaagaagtcgcgcgtcaaggtgttcctcaagctcgtcaacttcacccacctcatnccacccgtacaccctcgacgtcgacctcaaggaggtggctccggggcgccganttcctcactccaaggacaagaaggtgggcgcgcaaagcgccaagcaagtcgggagag

SEQ ID NO: 86435 - DNA, 486 bp, Triticum aestivum
  unsure (1)..(486): unsure at all n locations
  Clone ID: PAT_TA_86435
cttcgagcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcggaanccgcacctgctgagaaaccagcaccggnagctgntgatgtagccaagcagattccagctggcattccaggtagccgggcgaacaactattaccgtgcagntggccagaacacgggcnacttccttacggaccgtccttcaaccaaggttcatntgctcctggcggtggtcgtcctgggtatttttgggggaaatgatgtaatgatgngctgntaataagaggatgattggctgnattctgtatcangggngaactggatnttggttganagttacactgngngatgaactgctgatgntanttgtccnagngacccccn

SEQ ID NO: 86436 - DNA, 190 bp, Triticum aestivum
  unsure (1)..(190): unsure at all n locations
  Clone ID: PAT_TA_86436
ggccagtctgctggacggcgacgataccaacggcaatagaaggatgtttccggtaatttccgccacaccttaaacattttttctgtatttttcactatatttttctctgagagaaaaaaaagcttttgaccggatctgagtcactttgaggtttcagatctcactgattccnttgttgctgacaaaaaan

SEQ ID NO: 86437 - DNA, 504 bp, Triticum aestivum
  unsure (1)..(504): unsure at all n locations
  Clone ID: PAT_TA_86437
gaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttnctgcggttccanctggtggtggtggtgtggctgttttactgctgcccctgctgtggaggtgtgtgcccctgcantgagtcaaagaaagaagagaangtctggagaagaagagantnatgatgacatggggtcagnctgttcactaaatgtgggacttgtgtctnannattatcttggcagaaanngagtnatatgtttagncnattagcggtnttaaactgnnaanaagttttntttaatcac

SEQ ID NO: 86438 - DNA, 221 bp, Triticum aestivum
  unsure (1)..(221): unsure at all n locations
  Clone ID: PAT_TA_86438
ccagcccccctccgatctcgccgagaaatctcctccgatngaagcgaaccaaggctctctcgtccccctcctcaagatgcagatctttgtgaagaccctcaccggcaagaccatcacccttgaggtcgagtcctccganaccatcgacaacgtnaaggntaagatncangacaangngggcatncctccggaccancancgctttatnttngctggcaanc

SEQ ID NO: 86439 - DNA, 249 bp, Triticum aestivum
  Clone ID: PAT_TA_86439
acgtcgctcaaaatggtcacgccactcaaggccgtgccggtgccgttgttctagtagctagagttgcaccgatgtccttcttaattagtctcattatgcacgcagggcacacatgatcactgcggctatttgatttcaggttgatttgaaaactatccttaggtgatactgtgagacaagtgatcatagtcatgtaaaaatactaagtgacgccaatgaaggataaatcttaatttcaaaaaaaaaaaa

SEQ ID NO: 86440 - DNA, 360 bp, Triticum aestivum
  unsure (1)..(360): unsure at all n locations
  Clone ID: PAT_TA_86440
agcgcctccgctcctctcccccgccgccaccccttccccgcatcgtctcccacgccaagaccgccgccgttcgtcaagatggtgctgcagaacgacatcgacctcctcaacccgccggcggagctcgagaagctcaagcacaagaagaagcgcctcgtgcagtcccccaactccttcttcatggatgtcaantgccanggntgcttnaacataacgactgtgttcanccactctcagancgtggtggtgtgccctngctgccagaaggngntctntcaanccaccggaggaaaagcgaggntcaccnagggntgctcttccgccggaaggngntaaactgcacgcctgtttatgggaaaa

SEQ ID NO: 86441 - DNA, 511 bp, Triticum aestivum
  unsure (1)..(511): unsure at all n locations
  Clone ID: PAT_TA_86441
agaagagtcatgaacatgcattaagattaatcaacaatgagtgcaancatnagtaggatataaatcnccatgaacataaatatcgtgaangntatgttgattttatttcaactacatgcatgaacatgtgccaantcaagccactcgaatcattcaaaggagtataccaccctatcataccatatcacaaccattttaatagcatgttagcacgcnaggnnaaccattntaaactcccagctaattaagcatggcatgagcaactataatctcnaattgtcattgcaaacacgnttcattcgtaataggtgaatcagggcgatgnactaancatatttacaataacaagtangcgagtcataccagcttctctcatctcaatcagncatcatatatcatcattattgccttcactcgcccgatcgnacggtgtggnnaaaataatagtggcgtgcgtggactagctcgatctgcagcatttatacaagggtagnncgggnatatggggctn

SEQ ID NO: 86442 - DNA, 272 bp, Triticum aestivum
  unsure (1)..(272): unsure at all n locations
  Clone ID: PAT_TA_86442
acaatgcgtgaaggtcaatccggattcgccgcagaagcaagttcgattcttaacactctcaggcgataagaaacttctgacaccgcaaccacggctcaggacggggttcttctccgttctagaatctcagatgatacccactggatgcattcctgaagcatgcacttctgttggcgcagtcaaatatggaaggccgatagatctagatgaagtgattaagtggntctgattgtnattggggtccggtnccantttgntcaaagncncgggaa

SEQ ID NO: 86443 - DNA, 284 bp, Triticum aestivum
  unsure (1)..(284): unsure at all n locations
  Clone ID: PAT_TA_86443
caccaccacgccaagccaccggccgcttcccacgctccggcgccacccacccacggccccccgacgcctaaacctatccctcccgcccctaaacccacaccacccacctacgccccgatcccgaagccgccgaagccatctccctcgcctccggcctacnaccctangccnaagcttgaacttccaagttaaaaaccaccaaccaagcntaggccctnancgcngggngnaaaagcttgnacctcncatnttnaaaaccacnacccaacnnttaggcctttaac

SEQ ID NO: 86444 - DNA, 343 bp, Triticum aestivum
  unsure (1)..(343): unsure at all n locations
  Clone ID: PAT_TA_86444
ctcctagccaacaccaatcaaagcctccatccaatcccaagcaacctcgaggatgtcttgctgcggaggaaactgcagctgcggcagcgcctgcaagtgcggcaacggctgcggcggctgcaacatgtacccggaggttgaggccgccggcgccaccctcctcgtctccgccaccgccacccacaaggcgagctcgggcgggatggagatggcggcggagaacggcggctgcggctgcacccagtgcaagtgcggcaccagctgcnggctgcccgggnantggaaatttanaacggcantnatgaaccngggcnantcaaaccnanggnttttanccaaaaaa

SEQ ID NO: 86445 - DNA, 342 bp, Triticum aestivum
  unsure (1)..(342): unsure at all n locations
  Clone ID: PAT_TA_86445
caacaaatccccagccaatctcgtctccgatcgaccccaggctcgtcgaatcctcctcccccaccgcctcaagatgcagatcttcgtgaagaccctcacaggcaagaccattacccttgaggttgagagctccgacaccattgacaatgtcaaggccaagatccaggacaaggagggcattcctccggaccagcagcgtctcatcttcgcnggnaagcagntggnggatggtcncaccctcgctgacnacaacatcgagngggagnccaccnttcatctngtcctccgcctngggggaggttncnttttttcntnaagacnctcanggnaaanaccatcagg

SEQ ID NO: 86446 - DNA, 442 bp, Triticum aestivum
  unsure (1)..(442): unsure at all n locations
  Clone ID: PAT_TA_86446
ccgaaaccctctctcgcccccgcccctctcgccgcacggcgcttccgccgaccgccctcgccgaatccaggtgcgccgcctccccctcctccgggaggccttcctctccccggccgcgcggcgcgtggtgtcttccgcctgggtcgattctcccgcggagttcaggtttttcaagatacgtgggcttgggacgggtcggaacaccaagaaattcggattcagttgggtggctcaagaatggacctaatacttccgtttaaagttggagatgccgttagagataagatcctataatgttggttaatangggtgcatggttccggtgcaagatatttgtcccttgaaataccattaagtgaaaggtggatgtttgggttgcccatcccaaggaccttgaggccagcgcttgattgggccccttnnaaaatgggcgccccctttt

SEQ ID NO: 86447 - DNA, 173 bp, Triticum aestivum
  unsure (1)..(173): unsure at all n locations
  Clone ID: PAT_TA_86447
ttagttttggtctcaccaatttagagctgttgcttcctaaacctagctagcaagccaagctaccgaacccatggtgtccaaggacttgtgggccggcgttggatcagctctggcgttcttagctggcctcatcaccttggcagtgaaccagntcaggatnaaacgtttatcaa

SEQ ID NO: 86448 - DNA, 250 bp, Triticum aestivum
  unsure (1)..(250): unsure at all n locations
  Clone ID: PAT_TA_86448
ggccaacagagtaaattacacggcgctggcgcccagagagtcgccggccaggccgacgacgctgcacgacatccccgacaagctcctcaagctcatcctcttgtacctcacctcaccccaatggctcgtccgagctgcggccacctgcaagcaatggcgccgcatcatcgttgacgcaaacttcctctcctacattgattccagccccaatccctcatcnctnttnaaggcaatttnnatgacccaaaaa

SEQ ID NO: 86449 - DNA, 501 bp, Triticum aestivum
  unsure (1)..(501): unsure at all n locations
  Clone ID: PAT_TA_86449
ccgcacagccaccgcctggttatgtctatgcacagatgcagccacaacagcagttacagcagccaccacagcagcaattacagcaacagttacaacagcaagctcagcagcaattacaacagcaagctcagcagcaattgccacaacaaatacagcagcagccacagcagcaattgccgccgcaattacagcagcaagcacagcagcaattacagcagcaagcacagcagcagctccgcagccgcagcaagtccatcaagccagtccacagcaatatgtccaccgcgggaatcanatttcattcacaaccaagcaanggnanttcattccannccaaccttntttcccaanagangtcccctcaagnaaggccggcaanaacagancacctgcatttggccccaatacngnatgttcnanatcccctatgcagcgtcccgatgacctccaacagtttacattcccggcnggggctgtnacccccctanggggcnccccaan

SEQ ID NO: 86450 - DNA, 518 bp, Triticum aestivum
  unsure (1)..(518): unsure at all n locations
  Clone ID: PAT_TA_86450
ttttttttttttttttgagggctgtcaaccttttttttttgtgcatatattcacatcctgtaacttgacacagaaacaggcctaattacacccaaaagaacaagctacctgtctgtcagtaaccacttaacactctgttcttcctccttcaccctaatagacagagcagagcagagcagatcgaccagccaaaatgccaaaagagaaggacaccatggaaactaatcgctcaaattaactataagtttcttcatcgtctccncctttgcacctatcagtaaatccngaacccgctgcggcctaaaaaaccatcncantcccaaggccnaaggnnggggacnttngcccccnnggggncaaaacnangagggaggccccnggggnnggctcnaactcngctgngggttcccccnaaccccnggtaaacccngtcccccnaacgcccnacgccnangggggnttncggngcgtncttngcaaangggccaccccggtttgggcncnccncctttccgcct

SEQ ID NO: 86451 - DNA, 538 bp, Triticum aestivum
  unsure (1)..(538): unsure at all n locations
  Clone ID: PAT_TA_86451
cccagtagcacggcctcttcttctccgtcttgtacatctacgtcgccccggctaacaaccggcgtcgacaacctcctggcccgccgtgccatgaccacacagcgaaaccaccaccgagcagcagcggaagaattcccgcttcactcgccgggctcctccaccggctccgccgactccgcgccctggcaccaccgcgccccggccacgccgccacctgtgcttccgttcgacaccagcgacgccgacgagatgctcctgctcaacatgctctcccagcaccgcgaggtccagcaagccgcggccgcaccgacgacggcgccggtgaatcaagaggccgatgaggaggacaaggtggcactaggtgtggattcgcgcgttccgcggagtgcgggaagcgaccgtnggggcaattccgcngccgagatcccgggactccgacgcccaacggnttcgggtctggctggggcacttcgacaagcccccnaagctngctgcgctngcntnacgaccaagcngcgtttggcanccngcngggggt

SEQ ID NO: 86452 - DNA, 312 bp, Triticum aestivum
  unsure (1)..(312): unsure at all n locations
  Clone ID: PAT_TA_86452
ccccagcgccgcctcctctcgatccccactcatcttctcttccacctcgactcagaagaggagccccgcgcccgtttccccagtgccgccggcgacaaccaagactcccctcccggtgcacctcttctccttcctccacctagtacctgcggaaccccgcgcccctggcatccccacgctcgtcgcctccccttcgctcaagccctgcatccctgccgaggcgagcgccgagttccatcggnaagcngccgcctcgaacanaggcggnaacccntcggcctctttgtcgntgtcgcgcccagngggccacca

SEQ ID NO: 86453 - DNA, 533 bp, Triticum aestivum
  unsure (1)..(533): unsure at all n locations
  Clone ID: PAT_TA_86453
tccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactggagagtgggcaacactaaggatgacctgaagttcccaactgatgatttcctgcttggccaatttaaagactgggtttgcctgnagggcaaggacctgatcctgtccggtnatttcccccatgggttnaanaaaat

SEQ ID NO: 86454 - DNA, 250 bp, Triticum aestivum
  Clone ID: PAT_TA_86454
ttggcgttctcgtttttggcagagcaaagtgctgataacgtgtcagagtaaaacgagattgaaagcgaaagaacaatcagtcctggtttccattgattctcaagtgtatatacatctggaagaggtgggaagaagagatgcctgctccacaggtgcctattggcaatagaaagagagaagggacatgactgtttggggttgaacacacccctttactaatgactattcattaattagcaaaaaaaaaaaa

SEQ ID NO: 86455 - DNA, 468 bp, Triticum aestivum
  unsure (1)..(468): unsure at all n locations
  Clone ID: PAT_TA_86455
atcacaactcgctagtcaagctcgcagtatgaagattggaaacaaggccgtcggcgtggtggccctggtggctgcaacggtgcttttgcagctcgcggtggctccaacggccatggctcgcctgccgcgggtttcaaacgagaccatcgtcatggtgactgaggagggtgtgcaacagcagcggtactactgtatgcaatcatgcaggtggactccatgcacgaaccctaactgcaactgcatttctaactcgtgctttatgattcgctgaatcattccctgatgaagtacatgtttgaaagtactgttagtcatgatgtcgcgcatcgatcttctcattatattcttcttttaaaatttagtgtgtgatgttgttgttcgagncagtgccgttcacaatgttccgtggacgtggggcgctctgtactgttattgaataaaagngttgttaagnataaaaaaaaaaaa

SEQ ID NO: 86456 - DNA, 208 bp, Triticum aestivum
  Clone ID: PAT_TA_86456
gtctgtgagctcgcggcgagcaggtgctgtggttctctagatattcagtaacttgtagagctcattcagaatagaagcactgggtaaaattcttgtgctatttctctttgagattcagaaatatgttcttccgggcaagcagattctctgcaagtcttgtgagccaatatataaacaactgaagttttggttggttaaaaaaaaaaaa

SEQ ID NO: 86457 - DNA, 538 bp, Triticum aestivum
  unsure (1)..(538): unsure at all n locations
  Clone ID: PAT_TA_86457
gggagctggactgggagcgattgccggggccgtcctctccatcgaggttctcgaggcgtctcgcgcgtactggtgctcggaccggctcggcacatgctccatggcagatttcatagagcagctccttcatgcccggtttgtgcaacagcagcttggatcctcggcacacatggcgtaccgttggcagctcagcataccggattttgggcacgatgatgtgtacgacatcttcggggacatttccgtcgagagggtttcgcgggaggcactgggagaaataccgcactatgtggtggctgatcaggtcaggtcaaggcaancgggtgaaaactgtcctgcgccatcttctacangatatggtaccggtgagatggcgagaagntgccactgctccatgctttcatcactctgcgtggacaatggtcattancacggtcatcctgtgttcggcaacattgtacgtacatagtatacattgctacatctgagtcctcccaagagtatagntgttaaantcgctctaacatgtgaaagggag

SEQ ID NO: 86458 - DNA, 539 bp, Triticum aestivum
  unsure (1)..(539): unsure at all n locations
  Clone ID: PAT_TA_86458
gcgcaccaatgtctcgttctacactatggctggcaagcaatacanacacctcaagacgttngagaagagatcagccaatcacttgttctggtcccctgcaggcaagtacatcttgattgctggtctgcgcaacttcaacggtgtgttggaattctttagcgtgcaagacctcgagactatcaccaccgaagatcacttcaactgcaccaatattgagtgggatccgactggtcgatacgtcgctacttatgtctcgttctggcgtcatcccctcgagaacggttacaatctctggaccttcagtggcaagcacttgcatcgcgagtaccgcgagaattctatcagctgttgtggcgtcctcgtcctccttcattgttgagcaaagagtggaagagaacatcanaaagaactcaagcaatctccgacaagtaccgcaaagagacgangacgcattgaagaacactcgccaaaatcagcgcaanctagctcgcatgatacagaactttcgacacatggctgagtcaaagcgagcnctaaca

SEQ ID NO: 86459 - DNA, 539 bp, Triticum aestivum
  unsure (1)..(539): unsure at all n locations
  Clone ID: PAT_TA_86459
cccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgacaagaaggggaagaagaaggccaagaagagcgtcgagacgtacaagatctacatcttcaaggtgctcaagcaggtgcacccggacatcggcatctcctccaaggccatgtccatcatgaactccttcatcaacgacatcttcgagaacttgccggcgatctgccaactcgccaggtacaacaagaacccaccatcacgtcccgggagttcagactccgtccgcctcgtcctcccggcgactcgccaacacccgtctccganggcacaaggcgtcacaattcactcgtcctaggtcctcgtgcataagtctgtgttcttctctcgtggctganaatcttagcaactgntgtgtctgaagcgtcatactgtacatgggctctan

SEQ ID NO: 86460 - DNA, 401 bp, Triticum aestivum
  unsure (1)..(401): unsure at all n locations
  Clone ID: PAT_TA_86460
aaagggactgctgaacatggatagaacgagagtcgaactcgcatgtctctcttttcctgttagttaggaaagaaagccgatataaacagctccatattagcgaattgcctctgactactcttcccaggctggtcaaactataggattcccattcacttagtaaacttattggacagacgggtcaaccacttgaccgaggggagtaaggttcgtcaccacagtcccgatagaaggtcgagtttaaaaacaaaccgaagacaaagcaacgaatgaaaggaaggacggctcgcttcgctttacaaccagggcggtctcgctgccggatcaatgcgcangacgcacgatctacaaacaacaatagagagagcaaccaagaacgaaagaactggaaaaaaanccan

SEQ ID NO: 86461 - DNA, 550 bp, Triticum aestivum
  unsure (1)..(550): unsure at all n locations
  Clone ID: PAT_TA_86461
cgaagccgatcccgggcgactggaacggcgcgggcgcgcacaccaactacagcaccaagtcgatgcgggaggccggcgggtacgaggtgatcaagacggccatcgagaagctgggcaagcggcacgcgcagcacatcgccgcctacggcgagggcaacgagcgccgcctcacgggccaccacgagaccgccgacatcaacaccttcaagtggggcgtggcggaccgcggcgcgtccgtccgcgtgggccgcgacaccgagaaggacggcaagggctacttcgaggaccgcaggccggctccaacatggacccctacgtcgtcacctccatgatcgccgagacacgctcctcctctgagcaccaccacggcatgcctaccgccgccagtcatgacaccanntctcgatctctcgtcgagggtggcgattgataattctgcaaaacttcgtgttcattctttcaagncaatctttttggggctgccttggngtcntcacttactcggtaaataganaagatctagtcaccgaaatatttgtttcnattcnta

SEQ ID NO: 86462 - DNA, 571 bp, Triticum aestivum
  unsure (1)..(571): unsure at all n locations
  Clone ID: PAT_TA_86462
gccacgccatcgacttgcttaatgtcgggtgagattggatgcaacctatctgccttgattctaattctccacattatccatctacatatgcctgcgattgccagctatgttttctgcccaaacaacatatgtaaagtatgctggtggaagtgagagagaatttaagagggggagaaagagttagagagacaaatgatagggaaaaagatagctaggcaacaaatgttgtggtatataggttgttataaaatcggttgctactctcctgtttaattaaatgtccatgagctgatttctgctctatgcttggagtcggcacattcattaagtttatctatcagactgagcaaatgcatttgagttcgtctattctgaatttatgatctgctcatgtgtatttccacgcctgagtcatcatggtagtttgctagctgcctccttgttttggcgcgctaattagttacttactcacttgcattcaatctaatantacacttacagattgcatcagtaatgagcatgtcgcaataaacatatcacgccagtgtgcataatggcatnanagtgaaaa

SEQ ID NO: 86463 - DNA, 576 bp, Triticum aestivum
  unsure (1)..(576): unsure at all n locations
  Clone ID: PAT_TA_86463
acnatctataacctgtnaggttttgtncaccatgggcatggncnaaaanagttcggtggccagnaangccgggcngatcaccaanacgttggacnggtgccggancacgacaacgaanccagcaganggctgnttcncggtgtacgtcagnncacacagacaacggtacgtnatncggatggagtgcttgaaccacccnttgttccanncgctgctggatgaggccgatgaggcgtttgggtacgcatacgcacggcccctcaagctgccctgcaacaccaaggcgttcnccaaggtgcnagacaanatcnaggggganaancagatngcngcccaaaggacgcattcctcnctacggcgaactcctatcngtcgcntggcactggctggcctatgattgttggccggtcnnaacattgcatttggattggatgatgccgactgcngagttataactctanttcgttagcttcacctcctatatctgtaaagttngnagcaacttactccaatatggacgtaacacanacattactgnatctacaatttcntctatcantccgtttgtanaggatg

SEQ ID NO: 86464 - DNA, 574 bp, Triticum aestivum
  unsure (1)..(574): unsure at all n locations
  Clone ID: PAT_TA_86464
angactcactancagngcntctccgcgatcnaaatccncccgggaaanatcntggatgatctcttcctcctcgancgnctcccanncttttgccagtcncagcagganatttcangtctgatcntgacgttcagatcganctgcctttgacccctttgccgangngaatgctggggacactggngnacctgccggatcaaaagactacntncatntaggcatcnagcancgtaatggtcgcaagagcctgaccactgtccagggtctgaacaatgagttcagctanagcaanatcctcanagacctcaagaannagttttnctgcantggtacagttgtcnanacacagnacttgncangcaatcatctccaggngatcagacgaagaactcacaaacntccttgtcannccggattgtgataagaacacatcatcatcacggttctgacaactgcagctcnatatagntcaanancatacactatatatggtggtnagtaattagtgttgcaggcacagcgtacaactnncctcgagttcagaaacaganaccacttctgctttgctgtacnt

SEQ ID NO: 86465 - DNA, 392 bp, Triticum aestivum
  unsure (1)..(392): unsure at all n locations
  Clone ID: PAT_TA_86465
cgggtcngtcactgcgatgatatgttcgaccgcaagtgccccgccacctgcgcngagtgcntgtccttgggcccancccaccactantgcggcgacagttaccttgctggccccgtgcccaggtgcaccaaggttgaccgcaacggcgacatcnccggnggtacgcccggccgcagcantgcaccaggtgatggtgagtccaatanattgagccggccgttggacaagtggacagagtgagtcgctgtnccagcgtttgttcacctgttgtggtcgctcttccccccctttcnttctttgnttcattctttcattcattcttccgggatgttgctgtaacgcantttaantgcaccnatgaatactatgagctgtgttgatcacaataanaa

SEQ ID NO: 86466 - DNA, 563 bp, Triticum aestivum
  unsure (1)..(563): unsure at all n locations
  Clone ID: PAT_TA_86466
aacacctctccctctcccacctccgaagcagcagcagccatggcccccaaggcagacaagaagccggcggcggagaacaaggtcgagaaggcggcggagaaggcccccgcgggcaagaagcccaaggccgagaagcggctgccggcgggcaagacggcggccaaggagggcgaggcgaagacgaggggccggaagaagggcagcaaggccaagaagagcgtggagacgtacaagatctacatcttcaaggtgctgaagcaggtgcacccggacatcggcatctcctccaaggccatgtcatcatgaactccttcatcaacgacatcttcgagaagctcgccggggagtcggcaagctcgcccgctacaacaagaagcgacattacctcccgcgagtcagacctccgtccgcctcgtctcccggcgagtcgcaagcacccgttccganggaacaagcgtcacaattaactctctaactgatcgtcgtcctcaantggtatcgtacngtatgcgatcnctgtatctcaatatgtggtatcgttnctggtntcncacctcttgcta

SEQ ID NO: 86467 - DNA, 377 bp, Triticum aestivum
  unsure (1)..(377): unsure at all n locations
  Clone ID: PAT_TA_86467
gggacaatttccaagggacctatgtccggcccctggatgcagacgatctaagtcacataatccaacaacctagagaatcaacccataagctttggaaccggtttctcactaagaagaaccaaatcgtcgactgcccggacgccgaagccttagcgaccttcaaacacagtgtctgggacgaatggctagccaggcaccttgggccaggaaaagccaaggacaatggaagccttaactacactaatgacctacttttgcgtgggcaagganacgggtaacccgttcaaacaatgcccccgnnatctaaatcncggnggnaatggnnaccacacncgtaaaanatcttcngggcantantgaagcccctcnnataatcg

SEQ ID NO: 86468 - DNA, 493 bp, Triticum aestivum
  unsure (1)..(493): unsure at all n locations
  Clone ID: PAT_TA_86468
agaagccccaccgcttccgccccggcaccgtcgcgctccgtgagatccgcaagtaccagaagagcacggagctgctcatccgcaagctccccttccagcgcctcgtccgggagatcgcccaggacttcaagaccgacctccgcttccagtcctccgccgtctccgccctgcaggaggccgccgaggcctacctcgtgggcctcttcgaggacaccaacctctgcgccatccacgccaagcgcgtcaccatcatgcccaaggacatccagctcgcccgccgcatccgtggcgagagggcctaggctgctgctgcaatccatatccatgcgtcgtgtcagatagtctctgttaggtgtgtttcaaaattgcgtcgtgttagttcatgttagaacctgttcctctcgtggtgggtggatgtgttatcctaatctggtggacctcctgttgcatcagaatggaaatgaaaagtttgtcctgttcnaaaaaaaaaaaa

SEQ ID NO: 86469 - DNA, 531 bp, Triticum aestivum
  unsure (1)..(531): unsure at all n locations
  Clone ID: PAT_TA_86469
ggcggatgcgcgcaggcggcggaggtgcgggcagacctcgtagtcatctcggagcatgtcgaagaaggcgaactcgtccgggtgtagcgagccatcgtactgctcgacgaagagcggggcgtcgcacgagaggagctcaagtagggcggtctttcgccttaacagggacggtgcagcgtgaagaagggcggtggggatgtagaggctgttgacagaagagtgttaacgtacaagatcttaacgtaagttagttagaataggcatgtatatcttgttaaacaaccagcgtatatctccaccggttgttgtacttatcctgtacttgtaatcttggcaatcaatcattgcccatataaatacatgacctgctcctcggggcattgcacggcaaacaatctctttaacttgggtatcagacacaagtccatctccacatggcgacacaccccagcctctctcaacacgccggcgctctcacaccagccatcgnacctgcacagttaagctctctgcgcaccacgatactcatan

SEQ ID NO: 86470 - DNA, 498 bp, Triticum aestivum
  unsure (1)..(498): unsure at all n locations
  Clone ID: PAT_TA_86470
ctttagggtgattgccgataactatgtgactgatgatagtggaaccggtgttgtccattgtgctcctgcatttggtgaagatgatcatcgcgtttgccttagtgctggaattattgaggctagtggacttgttgtcgctgttgatgatgatggtcacttcattgagaagatatctcagttcaaagggcgacatgtcaaagaggctgacaaggatatcatcaatgctgttaaggataaaggaagacttgttagcaaagggagcattgagcactcttatccgtattgttggcgctcgggcactcctcttatttaccgggctgttccaagctggttatcaagttgaaaagncagggatcattactagaatgcaacaaggagactactgggtccagattattcaaggaaaagagatccataactggctagaagtgcaaggacgggctgtaacagataatctgggtacccactcagtgtgatancanatgtgagaaaaaaaaa

SEQ ID NO: 86471 - DNA, 410 bp, Triticum aestivum
  unsure (1)..(410): unsure at all n locations
  Clone ID: PAT_TA_86471
gcaaaaggtagggtttccagttgcaagccgcgccgccgccgccgccgccatgggacactcgaacgtctggaactcgcaccccaagaactacggccccggatcgagggtttgccgtgtctgcggcaactcgcatggcctgatccgcaagtacgggctgatgtgctgcaggcatgcttccgcagcaacgccaaggacattggttcatcaattaccgttaagaatggaaacctccaaaggaancaaggactaggaaatatcaacgaatgtggtgctccatccagctgatctttacctataactatntaatgaactgctatatnttgaacctggtgacaaaccgtgaaacaattaatgactgcgtttgacatgtnaaaccgattccgntaccctgtcatcctggtaaaaaaaaa

SEQ ID NO: 86472 - DNA, 531 bp, Triticum aestivum
  unsure (1)..(531): unsure at all n locations
  Clone ID: PAT_TA_86472
gaaaggccaaccaagatcggatatagctggttttccgcgaaatctatttcagtagagcgtatgatgtcgatggcccgaggtagagcactcaatgggctagggtggcccccatttcgctttaccaaccccagggaaactccgaatacaggccgtcatccttagtacagacagactgattgggtgctaagatccaaagtcgagagggaaacacccagttcgtacgctaaggccctaagcancactttagtgggaaaagaagtgattcgagcgatgacaaccagaggtgggttggaagcaccacctttgaagaaagcgtaatactcactggctactccatggaccgaaattctcaagcncaatgatcaccgaacgacgaacttgaaacactttcaatgtcattacggactctgtcatccggaagtttgggtgacaaactggagaacagaatgagatctgacatgntacaaaatctgtaaacacatgctgcatngaagcttcgctcatatcaccaagtgatcgtccaagaaccca

SEQ ID NO: 86473 - DNA, 546 bp, Triticum aestivum
  unsure (1)..(546): unsure at all n locations
  Clone ID: PAT_TA_86473
ggattagagactgttattgatcatggatgcgcgattgatcgggctctgtcactccctgcaaatgaggctgcagttttaggtcatgttatttcaatagctgttgcatgttggtatccctgatcccactgataacgagtcggcccaaataatttgattggggtcgttgctgacccaggtgggagaggagaaaactggtccacggagaaacggtacaacaaccggcacaaattgtcttgtcaattttggctctagctgaaaattttactgctgctgcagttagttcggctaaataaaaaggaatccatggtccagaccaccttcaggacatatcaagctgaatgtggatgctcgtacatttgatcgctcagggaacagtaggactgtcatctgatantctggaatttttggnacagtaatacagactggtgatgcatggactttcatggcaaggccaacctccttgactaactgcaaccgtcgatcaaagagtantgcacctgatacatggttatacacatcagatgggatactccttctattgncacg

SEQ ID NO: 86474 - DNA, 356 bp, Triticum aestivum
  Clone ID: PAT_TA_86474
gaaaatcagacccctattcagcatcagacgctggaaatggtgaattgctgggtaatttgctactctctcttcttgataatgcgtagttgtctgaacaaatgttcgactgtagcctgtaaataaggactgtacatttttcctttttactctgaaggttgagatgacggagtcttgcatgtttttgtgaaaggtggagtgatttaccattctgttcaaacgctgccaatggtgaattgttgatgatgtgtattctgaacgaacttgggttatatcgacgggcaatgttcattgtaattgcaaaagaggactgtactttgtctccgaagatgtgataacgaatatccaaaaaaaaaaaa

SEQ ID NO: 86475 - DNA, 527 bp, Triticum aestivum
  unsure (1)..(527): unsure at all n locations
  Clone ID: PAT_TA_86475
gtccgacttgatctgatggtacccagagtaggcatcctaaaaactcaacagctcgcatccggctgtggaatctatcacttggtcaatccgtggcaaagcaaacggatccttggggcaggccttgttcaggctggtgtagtctatacacatacgccacttgttattcttcttcaataccagaactgggttggcaagccactctggaaagaacacttccatgataaagccagcggcaaggagccgggctatctcttctcctacgattcttcgcttctcttctgacagtcggcggaggggctgcttgaccggcttcgcatcagctcggacatgtaatttgtgctcggcgaaatccttcgggacaccggcatgtcctttggggacatcaaaaatgtctcgattctcacggaggaatcgacaactcgccttccaattactgtcaattcgcccaatgacacgaaatctcggatctcgggtcagagtactctggctcttggcggtggaaagctgtcacanatcttggggtgggg

SEQ ID NO: 86476 - DNA, 533 bp, Triticum aestivum
  unsure (1)..(533): unsure at all n locations
  Clone ID: PAT_TA_86476
gttctcaccagcgcggagctaagtgctaccactgggcgtgggagggagccccagggcctgaggccggcacccctgagactccggggcatgtacagccccaactccttattacgtgagagtgtcacgggcggcgagcttcacaggcgttggccttcttcacaggctccgggcctttctttggggaagcaagcttcacgggcgttggccctcttcacaggctccgggccctttccaaaacgcgacagcttcacaggcattcgccttcttcacatgctccgggccttttcccaaaagatgagcttcacaggcatttgccttcttcacgagctctgggccttttccaaaaagatgagcttcacaggcattcgccttcttcacagctctgggccttttcaaaaagatgacttcacaagcattgcctctcacagctctgggctttcaaaaagatagctcaangcatcgcctctacagctctgggctttaagggtaaactccaagtctggatttcagcgtcgtnagnaccctccgatccn

SEQ ID NO: 86477 - DNA, 522 bp, Triticum aestivum
  unsure (1)..(522): unsure at all n locations
  Clone ID: PAT_TA_86477
cctcggcaaagaagtaggacaccgcatccgtcacccanatcctgcagtaggagagcaggcaagcagccaccagccaagcgagctaccacaacatcggctgctgccaaattttgtctgtctgaaagaaggctctccgaaaacgcgccacggatcagttttttgccctgatctgttgttcctgtatagctactgagtgttcntaagctgtgaagccatttgtgcgcagggaactcgancaatatctgtaagttatggncgtgttggtcctgngtgttttgggtttggtctgggggttgtgcatctcgtgttcaattcctgganaccaggaactcttcattggttgctggtgtactggtgttgtggttanctgcttgactgccatttggnattgtgatgattgtgtgggaagaactaaagaangattatangtccttttcattggcctgtgnattccatcgtaaataacaanattacacgngaaaaacanaaancnaggggggccggtccaatcccttatgatcn

SEQ ID NO: 86478 - DNA, 195 bp, Triticum aestivum
  unsure (1)..(195): unsure at all n locations
  Clone ID: PAT_TA_86478
tgggcctaaaaaaagaattanccnaanggataactgtcttcatagttgaaaaagtcctagaagttgagtacaactggtgttgcttcatgagatgaccagttttaagcataagggagcattgatgtgccatttttcatttgtaaagcagtgaacaataaaatattctagattgtatcaaaaaacaaaaaaaaaaaa

SEQ ID NO: 86479 - DNA, 556 bp, Triticum aestivum
  Clone ID: PAT_TA_86479
ggctcataggttgttgcctggaagttgataccccattgctagtatatgagtttctttccaatggtagcctccatgacattcttcacggcaatgacaacaaacctttgaacttggatacacgtttaagaattgctgcagaatctgcagatggtctagcttacatgcattcaaaaacaatcaccaaaatcctacatggtgatgtcaaaccagcaaatatactgttggatgataggtttgtcgccaagattgcagacttcggcatatcgaggttgattgcaagagacaagcaacacaccgcaaaagtcatcggtgatatgagttatatggatccagtatatttacagtcaggcttgcttactgaaaagagtgatgtcatagctttggagttgtgctcttggaacttattagtacgaagaaggcatgcacctgatacaacagttagcaacatttcattggagctcataaaagagggagaggcaaccgagttgttgcaaagaaatgcgtaggagagttgggatctcaagtcatcaggatggaacgaagtccacctgagggg

SEQ ID NO: 86480 - DNA, 446 bp, Triticum aestivum
  unsure (1)..(446): unsure at all n locations
  Clone ID: PAT_TA_86480
gccgggttcgccgagtccttcacctccgccgacggccggtgaaccaccaccaccatcatcgtcgtcaccatcatgtctacaagaaataagtacattgcctctcccggacctccctcccctgtttcggcacagcgatcgtttcgttcttgtaggtaaagtaaaaggagttcgtcgttcgtcgtcgtccatgtgcttgtgcttctgccgccgccgctgtagatagacatcttgcttcgtttttgttctcttttttgttcaaccgggtactagtaccgtaggatggatggattggccggtcaccttttgcattantccagccttgagactgaacttctggctttactagcaatcanatcacataatgcttcaaanaaggnaaaaaaaccgagggggggccggtaccaatcgcctaaagtgatcgattaccgcgctaatggccgtnttta

SEQ ID NO: 86481 - DNA, 553 bp, Triticum aestivum
  unsure (1)..(553): unsure at all n locations
  Clone ID: PAT_TA_86481
atgatttatcaattcagaggtggcctcagagaagatctgcaactagctctcgtgctttttgagccgaccgagtatgatgaattctacaacatggaactaaagcaagaagctgctcagctcaagtgcgatgcttctaagaagagagtcagggatgcaactccttcttattcttcaactcaagtggcaactaagcaacagaagttctagttgcctcctcctcctccgtttcgtcagccttatcagcaaaagagtaaaggtggcaatggtcttcccacccacccaacccaggctatcagaacaaagctccgtctcatgctccaaggtcaagtgctccgtatcaccgtccgctctcagagttacttgcaacaagtgtcagcagaaagggcactatgcaaacaaatgctcaaccagangcgccttccgcctctctctcccctgtgagattgcaacaatgcatggcaacatatccaagcatgctaagncacatgatgaaggactcagnagagaccctcagagtgatatggtaacctcaantacccatccgcaaagtctt

SEQ ID NO: 86482 - DNA, 555 bp, Triticum aestivum
  unsure (1)..(555): unsure at all n locations
  Clone ID: PAT_TA_86482
gaaaaggaaattcattcaatccattttattagtccctagctgatttttcagataaatttctcaccatgtgcaacacatggtgcattaacatatttgtggatgtccaatcctcaaaaccaaccccaccaacttggtccctgatggagtatgagcaacaaccaggacgaaagccatgcacggataagaacggtttgggtgagtatgacagaacaacagctgagtttggcttgtcagtaatcctctgtttgacgatacatagtgtaacagtttctccgtggggcttgcaaaaagggaggcaaaaattttcttaaacgacaggggtttatttggaattttaatgcagttaaaaaagctgctcgctggtataaaactaagacaaataaccctgtcatttttcgaacatgtccaagttaatttaaacagcacatgggctgcaagaacattggtgctgacaaaacatagttgatgatacgacataganactcaagaagaaatggaactgatatacattagacanacatggtcctgtggctggtggtgctgnaaananatttg

SEQ ID NO: 86483 - DNA, 567 bp, Triticum aestivum
  unsure (1)..(567): unsure at all n locations
  Clone ID: PAT_TA_86483
gctgaacatttccgtgacgctgaaggacaaagatgtgctcttgttattgacaacattttccgtttcacccaggcaaactctgaggtgtctgctctccttggacgtattccatctgctgtgggataccaaccaactcttgccaccgatcttggaggactgcaagagcggattacgacgacaaagaagggttctattacatctgtccaggctatttatgtgcctgctgatgatttgacggatcctgctcctgctaccacctttgcccatcttgacgctactactgtgttgtcacgacagatttctgagctgggcatttaccctgctgtcgatcctttggactcgacatcaagaatgcttctcccacgttctgggtgtggtnactacaacacgcccgtggtgtcaaaaggtctcanaactatanatctcaggatacatgccatttggggatggatacccattaaatgatanatacgttgccctnaagaantcanattccgaccancttccacntgccaantttcacgggcccaggaatnnnggtttaaggggggtcaaanttcaggtttt

SEQ ID NO: 86484 - DNA, 564 bp, Triticum aestivum
  unsure (1)..(564): unsure at all n locations
  Clone ID: PAT_TA_86484
tanccacgtctctgtcttccnctccctctcgttctccatctcgttacctctctgctgccaacccgacccaaggttgttcgtcgccagcatgggtctggcgaaagatggcgccgagatgganganggcacattggagattggcatagagtatangactgtctccggtgtggcagggccattggttattttggacaaagtaaagggcccaaagtatcangagattgtgaacatccgattgggagatggcaccactcntcgtggtcaantcctcnaagttgatggtgaaaaactgttgtgcaggtatttganggtacttcagggatagacacagtatactactgtcattcacaggcaggttttgaaaaccctgtctcacttgaatgcttggaccattttaatggtctggaaaaccattgataatggcccccnnattgccaggctactggaattcnggaattctacaacccattgagagnctaccanaagatatgttcaacaggatancacatgattcatacccatgcccnggcaaaatctcttctggcgcggctcccaaangaatng

SEQ ID NO: 86485 - DNA, 538 bp, Triticum aestivum
  unsure (1)..(538): unsure at all n locations
  Clone ID: PAT_TA_86485
gttttggagaggttgggaatccagaatcacaggataagcaaataatttctcgcacccaatcccgtgagcaacatgcgttctacatgtttgtaggcaatagtactgctgaacttgggcaaaagcactgatgaatacgggcaatagtgctgaactttttcaggtaatagtatactgaaatgaactgggcaatagcactgaacgaaccgtgacgcaactattctattttttttaagtaaatccagaatcacagaataggcaggatgtaggcaataggagaggaaataaaaggcaacaatatagtaggatggatgtttttcaggcaatacagtagattgcatacgttttgaaaggagaaacacttgttcattaagtgtagtgttcagcaatcagataggaatcagtaggatggcanaattttttgtganaaatcagcaccgaantgtntttcanancatgtggnattgggaaaatccggccatccattgnggtcaaacntttgnggaaataggnggatncatnggtccaacccatgtaggat

SEQ ID NO: 86486 - DNA, 565 bp, Triticum aestivum
  unsure (1)..(565): unsure at all n locations
  Clone ID: PAT_TA_86486
cggacgaggtaagaagcagcagccgcagcgcgaccccgcgagaaaccctaccgccgccgccgcanaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaattcaacgccgtcatcctcaagagctcttcatgagcaagaccaaccgcccgccgctctccatgcgccgcctctcaaacttcatgaagggaaaggaggagaagaacattgctgtggttgttggtacaatcacagatgacatgcggntcaagagtccagcantgaagttaccgctctangtcacagagacagcaaggcaaggatttcaatgctggtgggagtgcncactttgacanctgcatcctgctcaactgggagacacatctgttgaggggaccaagaatccnttagcgtagnactcggaagccctgttncccaaacaaacancctatttcnncagggtngganttaaaaggtctgnagagan

SEQ ID NO: 86487 - DNA, 407 bp, Triticum aestivum
  unsure (1)..(407): unsure at all n locations
  Clone ID: PAT_TA_86487
gtcagggcgggctcgacgacttcgtgggcgancattttgtacccggcagcgtggcctacgctctctacggagtggccgttgacgagggcgactactcgaccatcaagtacctgctgatcacctacgtcgatcccgaggtgcctgccattcacaaggcccgatcgtcgcagcaccgtgtgacactctacaactttgtcaacaagcatctgcagctggctggcgagtaccattgcctcgatcgacagctgagtcgcnaactgttgctgcagaagctcgctggctcgtccatcgtcaacgtcggggatgatgccggcgctcgcaaggcggacttgcacgcgttcaaccgangtgaatcatctccacgcagttcagcntcggctcgggctacagttctanatangcgggat

SEQ ID NO: 86488 - DNA, 567 bp, Triticum aestivum
  unsure (1)..(567): unsure at all n locations
  Clone ID: PAT_TA_86488
ctggctcaacactgtcacatgcctgacgacgagccggctcatcagtgactgccccttccttgagaagcatcatctgcttctccaagcggcgattaatcacccacatggccccatttcagctgcaaccacggcaatgcggagatcgccaggatccagcaacgcangcctgcgacacgctggacgtcggtcagtttccaaggcagatgagctgtctctagacaggtcagggaaggatcctaactgcgccagcgacgccganagggccttcgcgctcgaggaattcaacatttcaaggatgtccgtggcgcctgtggtgtaggtagagggactgtcaggtcaagcacaangaccgcgccagagtatggtgaatcgctcaggtctcgctggtttgggaagaanaggctgaagattatgaggtaccaggtacnggaaggacttggaaattacgacgctccttcncccgggtggcngaagtaatttcnaggaacaaacnatatgnaatccaaagaagaatntacttnaccacccaagttttancaggttggtctngaaantcacntaaccacc

SEQ ID NO: 86489 - DNA, 551 bp, Triticum aestivum
  unsure (1)..(551): unsure at all n locations
  Clone ID: PAT_TA_86489
ttttttttttacatgcagcaaggaaccaccacaatgattcattgcaaacttctgaatgtcaagcatgcggtacataataaaacattaccggtaagattcagacagctacggttactacaaggtgtaacctttaggcacattttgcaggttctaccaacatgtagcaggcttaactaacacctgacagcagcccaggggtgagtgacaacagctaccatcaaggtcactacatagttcttcccaggattaagtactactacacagacagcgctacatcacactgcataggaaggtctcgtggatcacatactagaaanggctcgaggccaacatagctcgatacatcatatcnagtggatcanggggtgtccggnaacccggtggtcatcaaactctccgcttggctatggagggacggcttttaaggcacagtactccanatttctgataggaagagncccagcacgagatcacactgtatacgttacaccatgacatacatggctcaggagcctgcagacatcaatctatacagatggatcggaatagat

SEQ ID NO: 86490 - DNA, 297 bp, Triticum aestivum
  Clone ID: PAT_TA_86490
tttttttttttcaaatggtgatttcatcagtatatttaaacatcccagtagcaattttaaggcaacaaaaaaggtaacatttatacgccaattttaggcgtgtacaccaccattcctccacagtatatgcatctaagttcgcacggttgtagactaaagacaaaaactgacatgagatttatttaaaatgcagactggatggtacttcaaatgcagagtctaaaagctctgctcaaatctcaaacgatatttggaagagcagctgaatatattttatatgtaccaaaacaagccatg

SEQ ID NO: 86491 - DNA, 380 bp, Triticum aestivum
  Clone ID: PAT_TA_86491
gcccctcgagcttccctgcaacgccgaggcgtttgccagggtgctgcagcagatcaaggaggagaagcagatggtggcaggaaggaggttcgtccttgccaaggggaactcctaccggctgctcggcaccagccggtctgtcatcatcggacagtcgtagcatacaaattggatgatggcgagttgatgagctctaaagtttctgttgagcattcccattatgataaacaacaccatcatatactgggcaatgttagatatttttcttcttcttcttttttcatttttgtaaggtaatgctggatgttgatgtgtgttcccaccctaagttgtagtaacagtcggtgaaagtgttatacagatgcacattcgaaccaaaa

SEQ ID NO: 86492 - DNA, 152 bp, Triticum aestivum
  unsure (1)..(152): unsure at all n locations
  Clone ID: PAT_TA_86492
nattttctgagctcacagacccanttgatcagaggagtcnttttgaaaatcaccatanagcaccncaatgctaaacgcgctgcgatggataagaaggtcaaancgnacgacagtaagggggatgatgactactcanangaaatttccttgga

SEQ ID NO: 86493 - DNA, 543 bp, Triticum aestivum
  unsure (1)..(543): unsure at all n locations
  Clone ID: PAT_TA_86493
gtcgtctacttcgtcacgccgctcttcaacggcctcggggtgtccgcgatatgggccgtgctcaccgtcgtcgtcgtcatggagtacaccgtcggtgccacgctgagtaaaggcttgaacagagccttggcgacgttggtggctggctgcatcgccgtcggagctcatcagttagctgaattagctgaacgctgtggtgatcagggagagcccatagtgctcaccgtgctcgtcntcttcgtagcgtcagcggcgacgttcttgcgcttcatcccggagatcaaggccaagtacgactacgggtgaccatcttcatactgaccttcggtctggtggcgtgtcnagctacanagtggaggagctcatcagctcgcgcacaacggttcacacataccgtcgggtctcatcngctcggacacgtcttctctcccgtctgggcggaaagagtcaaanctcctccggaactcanaanncgccagttattnaggtaagcacagtcgcaagtnagaaacatgtcgccccanaggtacggncgtttttcaa

SEQ ID NO: 86494 - DNA, 351 bp, Triticum aestivum
  unsure (1)..(351): unsure at all n locations
  Clone ID: PAT_TA_86494
gcagcagcaggagcagccggagaagaagaaatcgagagcgccagcagccatgtccggcatggaggaggaggagaacgccgccgagctcaagatcggcgaagagtttctgaaggccaagtgcctgatgaactgcgaggtggcgataatcctggagcacaagtgggagcagctgcagcacatgtcggacggcggcgccgaccangtctcgcangtcttcgagaagtcgcangcctacgtcangcgcttcagccgctacnagaaccccgacgccgtcngccagtcngcgagacgctctccgctanagctcntcgatttcgantctcacctcggaacttgcccgaaactcnacca

SEQ ID NO: 86495 - DNA, 552 bp, Triticum aestivum
  unsure (1)..(552): unsure at all n locations
  Clone ID: PAT_TA_86495
ttcatctcaaaaagggattcatctttgtatattatataacaacgtaccacttgggtttgtttatangtatcttgcaactgcatcatctgaccacactgtaaagatttggaacgtggatggcttcaagttggaaaaaactttaatcggtaatttccgggctcctttttaattctgaatttatcagttagaactaaaagttgtagaattttaaccggtacactaaaactatgtggggtancgattttccaggtcancagcgctgggtttgggactgcntttcccagtanaaggggctattgaaaacaggtgcgcgctaacgctcaatggacgccanctcctgctatcacattaaaccancaaatctngctgtttanactcgtcgganacgacgnaaanatgtgganatnncacgggagaggcacaggtgtacanggcacacanacaacgtctgcgcgcctcaanacggggtgaatcgganctcatancaanacgccgcaccggnaggtccgtaanacccgtcgtcaaaacaaacaggtgncgcaaatttantgc

SEQ ID NO: 86496 - DNA, 235 bp, Triticum aestivum
  unsure (1)..(235): unsure at all n locations
  Clone ID: PAT_TA_86496
gatgggctctctggttggagctgcaggccttgtcngcctcgccctgatgggctaggcaagaggcagtgctttgtttccgttctccgaattgttcagttcacgttttcttcntcccttgcctcaaaaanaaaaaaacgttttcttcttcccgagttgcacactgcgtgcctccccgtggctcctctttatctggggccttttnatttgtgctctattcggttgtgtggtnaantcc

SEQ ID NO: 86497 - DNA, 572 bp, Triticum aestivum
  unsure (1)..(572): unsure at all n locations
  Clone ID: PAT_TA_86497
gttatccgagatcaatatgatagaacatacaacttccaaaggttgaaaggaagaaatgctgatggaatttctaaatgatgctatttaagtaagttcttttaagcgaaaaaatatacggtaacggataaaaagtttaattaaaggtgctaaacatgaataatttatgtggataagctgttcggcttccatacggcggtcgagactactctcgaagaatggaatgatggaaaggtttttataatttattgaatgtcctgtttaaatgagttctgagtttcaatagaggagaaaatgtatagtaataaattaaaaggtacgaaaaactactaaaattatgtgactcctacatttataattattgttggatttcaaatggcggcatacgcaattcgaaataagaaacgaacaaggctctacacttgtcgtaagctattaaacaatatcagttcgccaaacagaaanctacatgatggataaaacgtaaaaatgtacaaattgtcaattcataggtagtgcatcgaggnnatataacnacgggcancacaatnagaaaggggaatattccgaatagt

SEQ ID NO: 86498 - DNA, 567 bp, Triticum aestivum
  unsure (1)..(567): unsure at all n locations
  Clone ID: PAT_TA_86498
ggagcttctcctttctgtattgcgctttcttgatctctcttgccttttcaaacttccatttctcttcagtgatgaaatgggtcagcatgtgactttgaccaggagtcagatgaaaatcaggcagtggggtgtttggatacttgtgccagagatcaatgtaatcgaggattttcctcggatccacaagcagtggcacagatgtgcctttggctctagcggccttcacctgtctgtctctgatgaattctgcaagttcatcatcagaagcttcatcatcagaaggcacatggaatgcgacttgtttcctccttggacttggccgaggacccgtccaactgttgctttggnctcaacggtgtgggcctgatgaagaaattggtgcaactaaggaactgctgagacaccagagnaatcnagaaacacatccttgacattacaagatcacanganggaggacttgaangactgctgaagacttggtggacantagatgtgaggaattacgtganggcatgcgaggactggccgtaggggctgttgtaacactggntacaaagcncttgatgt

SEQ ID NO: 86499 - DNA, 581 bp, Triticum aestivum
  unsure (1)..(581): unsure at all n locations
  Clone ID: PAT_TA_86499
gttggnatgttaacaagcaacaacattttgtnatnaccaagtttaacaccaatgttacngggaagtccgtcatcctagttacgaagccgccaatgttacatacaaactcattcaacagaagaaaaacatccatccaagctgccgtaaattttaaaaggctaacaacaacaatgtntacnggacgaaatagaagcaatcaaattgatncccccggggaaaaattcggaggggtgtcaacaacggccgtctggctgtnccgggaactnacgaacnaccaaggtgaagttgtngccgntcccaacgggcgaaagcaatctccgtnancttccggggccgccgnctccgggtcctcaaacatcttcacganaganacgggtccncaattgggancacatnccacaagccatcactaagccaaaatcagaaaactccaaatcatcanccaattcctggtcccgaatcnccnggttccncgaaaaanaaattgcttcaanaancggttgcaaatgcccgagacatgcaagttcacaacaaaccncaagttcanccaactcgtgccgaattcgganaaagtccccgcc

SEQ ID NO: 86500 - DNA, 280 bp, Triticum aestivum
  unsure (1)..(280): unsure at all n locations
  Clone ID: PAT_TA_86500
ccgacctctccatcgagctcgcagtgagcttctcctccatatccccatgttttccccttcgatncgacaccgtagactgctcancctgtccgtgcccatggtcgcgcccgcacgcatgtgntgctccaaggtaaggccctgccccgngggccgcgcaattnagnctcgcccccgttgggcgcccgttnangcccctggattcccggcttcngaccgaaggcgnccccgttctgncccatccggtcggnatgnngccggatncccgcgccaattgcnccag

SEQ ID NO: 86501 - DNA, 506 bp, Triticum aestivum
  unsure (1)..(506): unsure at all n locations
  Clone ID: PAT_TA_86501
cagcatcccatgtcattccagcaaggtatgccccaagcaccagcataacagtttccaaggcctgggtgctagtccacaattccaagcaagcatgtgatnaatcagctgctgcaagaagccaaggataacaaatagtcgcgctcctgctcatcatcatcatcaagcaagcagcaagcagcaacaacatcaagcancagcaagcaacaccatcaagcagcaagcaagcaacaacagcaacagcaagcaacccgcaagcancaacaacatcaacaagccgcangcagcagcaacatcaacagccgcagcagcagcaacatcaacagccgcagcagcagcaacatcaacagccgcagccgcancagcagtctctagcatcccaatgcaaatgggggtctcanatccgggnccgcggtcacaacagcgctgctaacgcagagcaagnacaacacatgattacggacaagaaanggtgcnctcccatggtataccgggctatatctattaaa

SEQ ID NO: 86502 - DNA, 548 bp, Triticum aestivum
  unsure (1)..(548): unsure at all n locations
  Clone ID: PAT_TA_86502
ctacaatcccggcctggattccagctactctcgcggactagaatttgggccggcccactataacacaacaagaattcgtgaggtttaaaaaatgttcacacatttccaaaattgttcaaaaattaaaaatgtttccgttttccaatttttgcacaaattcaattncttttgtgtttttaaaaaccgtttggagtttcctgtttcacacaaaatcaactccaatgggaatttaaaaaaaactggtcgtgaattaaaaaaaatcacattatcaaaaaattantaagaatccaacagnttttcacatgctatgaaaaatatttgtattccaaaattggtcacaatttttaaanacggttttgggattcnnaaattattcaanaagaaatgttccgattgtggnaatggatcacngggatccaccagcatnagtgagttttcctacacgcaagtaaaataatcctcctcccnanggggactanaatccaaacaaagaaaaatntggntcaactgggaccgntaccctaaccangntttnacgnatagtcngg

SEQ ID NO: 86503 - DNA, 539 bp, Triticum aestivum
  unsure (1)..(539): unsure at all n locations
  Clone ID: PAT_TA_86503
acaaggcggtgccggcttaaaggggctcaccaaggagatcaacaagtcaaacaccaggttcatgggaaggctctggctgaagacgggagacccaaagaggangangcagctgccatactgtatgctccagtcncaagctctactcctggaggaatggcgttcaaatgattctgacaaanggaaanaattntgatttgggagggatttaaggnagacaccaaanccgttttacaattgaatcnaggaaagaaagcannccatnggtacaantttggttaaaacaccatcgncaagcanctgtgttgaagaatcccgttcatgacatgggttaanatnatgggaacaccaccgangttggntccgacnaaacacaaggggtattagangcacattcaagattcactccaccgttcnanatttaaggacactnccgtccaggatcctcccaagaaataaaaccngaacacatttttcacaagcaccatngcatccccgttaaaggagnatttaagcccaagaaacttcccctgancaaaaaa

SEQ ID NO: 86504 - DNA, 321 bp, Triticum aestivum
  unsure (1)..(321): unsure at all n locations
  Clone ID: PAT_TA_86504
tctatgttgtccccagtgttaggacgcttgtgcttgcgtttgaactcgtgttgaaattgatgccggttacttcttgtttgtgtgttgtccgcaagtggcatatgccaatggatcaatgtatgattttccccctnancaatttaacttccttgttggtncgtttggaattgtgaactgctgcaatgtatgcantacctcattcatgcccaccctgancagagcangccaacgggttganacttggnccattaaancagtactagctgaatgtccgtncgttgccacggaacatngaanttggncacatacacattgntnaga

SEQ ID NO: 86505 - DNA, 400 bp, Triticum aestivum
  unsure (1)..(400): unsure at all n locations
  Clone ID: PAT_TA_86505
gagacagaagcaccagctgctgctgctgccgaggcagaggctgaggccaaagagccggtggcagaggcgccggtccangaagaagcagcgcccgcaagcaccgccgcccgaaagcntcntcaagttgcaaggaagaaggcagcaccggncgaagggaaccttcngattgcgcccgcngnccgccaaaggcggngccgnnaaanggaacaanttgtgccggcgancccgnacaaggcaaccaattaatttatccccccggttncatnttnccccttancnaaccctttccttggntccntccccttttctgnaatgccattgnaaccttaccaaattcgtttaataatgggtncgtaagtttagggtnttcnttattggccttcgtctnctnccctngggg

SEQ ID NO: 86506 - DNA, 390 bp, Triticum aestivum
  unsure (1)..(390): unsure at all n locations
  Clone ID: PAT_TA_86506
ctcaagcttggggatgcccaagtcaccccaagtaaatattcaagtagactcaagcgtctaagcttgggggatgccccggaagggatcccatctttcttcaacaaagtatcaagtatgttttccggattcatttcggtcaancgaatatgtgcaaatccttggggcaaccttttcaattaggtttcaactttaatttaatgncacaangcgggtatnaaanaagncctgggttgatttananaaggcncttgcacttaacttaaanctttngagtagggcttnataaaatgcttcaggtgcttcacttaaacatttgaattttggattccngttnncttcacatagaannccacntttcnaaatgccctttgctcactaanatttgttaaa

SEQ ID NO: 86507 - DNA, 532 bp, Triticum aestivum
  unsure (1)..(532): unsure at all n locations
  Clone ID: PAT_TA_86507
acgaaggtcaatggacaagaaccgcccaaacggcgagcacaaccttgtggagtgggcgcgccccctcctaggagagaagcagcgtttctacaagctagtggaccctcgcctggaaggcaatttttctgtcaaaagtgctcaaaaagggaagcacaattngcaagcccatgcctgaacccggaacccaaancccgggcgcttataaccaaattggccaagctctcaagccantgctgaanctcaangacatggcanctcctcctantttcaacanacatgcaagccggaaaagattgnacantcnacaacatgaatggcaagaacaaccatagcctcaaggtcacnggtctttgcccgcncaagcgcnaacgggaacaaccgatnaggacattctgatggccccgcgcgtcccgttncctaccacaaagccgacatgaataacanantccctccctggaaaccnggttaaccaaaatccccaattatcgggggnggngaacttgtnggggggnaagttccccggntaaatttt

SEQ ID NO: 86508 - DNA, 258 bp, Triticum aestivum
  unsure (1)..(258): unsure at all n locations
  Clone ID: PAT_TA_86508
ccccggntcggnaagccgccggcgncgcggcngagcnagattcagcatcnccgttggcaagctaccggnagtaacttcttcctgggcccggcgggggaaaggtcntcctgctaacaatcgcgcanccttggaagttccttccaacaaacgaagggcggcccngacaacnatgaaagnacaatgttgnaaacctcggctccgcggcctgcttcaancaatcgcggcttcgggcaaactnacctngancctcccttcaat

SEQ ID NO: 86509 - DNA, 197 bp, Triticum aestivum
  unsure (1)..(197): unsure at all n locations
  Clone ID: PAT_TA_86509
tccacacaagacttagagaagatagtatggtgagtggaaagaagacaatgggcgtggtggcgctggtcactgcaatggttgtcctgcagctggttttagctccgacggccaangctccgcacaaccaaaggtaataaacatgaatgaagcccaatccaattatcctttgggaaggaaatgggtaccccgtaaaatgg

SEQ ID NO: 86510 - DNA, 413 bp, Triticum aestivum
  unsure (1)..(413): unsure at all n locations
  Clone ID: PAT_TA_86510
ggcttgcaaggaaattcggcaacnaaggtctgaagcaaaagaacagcaaaattgaagtttaccatcctgaaattgaaggcctacaagaaaccctccggggacaaggggggcccgctcccaagccaagccaaggntccgttgaagaagatntcaantggaaaggttccgcctttcaatccctggtacgaaaactgtnttcgaaattccaaccnttcgtccgctgccnaatgctgaatgggcaanttatcccccttcttccgggggggcgtncaaatnctgnangaacnaccttngggttccccggaacgaacaatgaagctncccaaagggaaggttttggaantncaatncggggccaattcccaaaagggcggcttcnaaacaaaaatcgggaagggtnnaaaacttncaaa

SEQ ID NO: 86511 - DNA, 576 bp, Triticum aestivum
  unsure (1)..(576): unsure at all n locations
  Clone ID: PAT_TA_86511
attcattcctgcgcatgctaggtgcacctaccatgccatgtggtagctaggcaacatacctctgaatgcgattgtgatgggtcgcactcacacaagtatccggagctaaatgcccttcggacgggatgagtcccggtcctgctgccaatttcaacccaatgtcccaaccctttgctccaacaaggaacaanaccnaangccgggctncttgaaatccncaacattcaagtaccaccaaccaaaggtaccgnccaaaagnaaagnatganatgatcnatgggcaaagnaagttcaacaaggantcaaatagaactccacaatcaaacntttcnccaaaaaaaatactgcaaagttgatatcangacacaattttttttcaanccgaatacgaataaactagcnttcgccttcacttttctggcaaaagtctaaacngaaaaagggaattanttgacttgttaaatatcannatnagtgtnatgccaanaggcaaanantggntcccaagggttaatcccncttctngtcttccagncccaccctaacgaattnccntaagccgcgnnccacctctng

SEQ ID NO: 86512 - DNA, 519 bp, Triticum aestivum
  unsure (1)..(519): unsure at all n locations
  Clone ID: PAT_TA_86512
gcttgcaangaaattcngcaacgaagggcccaaggaagtccaaccgccgctcacgggccgttcacgcaaccttgggcgcaacaacgggcatgctgtttcngtgcctgtccggggggcnacgcaacnggcgccnggcatgcctgaatcaattggacgaanggtcaaagggccggcaancgccgttacngggggccgggcaaaccttccgcccgggggcccaacggtaancaagggttgcccaactgggcgcccaagcttcgccntttggcggggagncaccaagggggaaggttacttncgcccngnaatcncctaaagaaacctcnaagttccntnttnaaatccnnggttttaacngcnccgttaatgccaancctaatnncaaccgcaaaagaatggactcatccnnaaaanaaaatgttggagccaagganttncaccaattcnggttaacacgtttcccctcctttccactttttgtttaanaataataatactcccccccaaaaaaaaanagaa

SEQ ID NO: 86513 - DNA, 393 bp, Triticum aestivum
  unsure (1)..(393): unsure at all n locations
  Clone ID: PAT_TA_86513
gaactcgtacagtccatatctggaggtgaaggctgttttggggatatcttccgttcgtaccttcaattgatggtatcctgaccttaagtcaatctttgagaataccttgggctgagcaaagttgatnaaacaaatcagttatccttggcatcaggtaattgttttgactgtgancatgttaagtgccgatangcaatacacaatctcagtgttccatccntcctcctggcaaataaaattggtgatcccaaggtgaaganctggcccgaatgtacccttaaccagtaaatccnttaactgcttcctcaattcgatnaactcngatggtgccattcngtatggttctgtanatggggtggttcctggtggcagctcaatgcggaattcaattcc

SEQ ID NO: 86514 - DNA, 389 bp, Triticum aestivum
  unsure (1)..(389): unsure at all n locations
  Clone ID: PAT_TA_86514
ggaaaagcctagttcgtcatgtttgacgtcatttcctgaggaaaagcctagttcgtcatgcacaccggtgagtaatgaaagcatgatcagctcaggatctcaaaatgccgactatctagacaagattgggtctggaacaacaacctctagtgttgcaatggtgactaatagcaacaattccttcngttctgcattggctattcnaacaagtcatgctatttgctggatcccaagcctanctgttcatgacgatcgcttcacctacaacaactctacanacctcggttgttgggatcaagttgattaantttcctctatattttagtggttactatgttgtatgctcgtgattcagtataaacnaagaaatgtgtaataatngtgaggcc

SEQ ID NO: 86515 - DNA, 267 bp, Triticum aestivum
  Clone ID: PAT_TA_86515
gaggcctagtttctcatcgtacaagctgctaattgatggactctgtagttttaactgcttagatgatgcacatcttgtcttgaagcaaatggtggaccaaggttttgttcctaggatgggtacttggacaaaacttcttacatccttatgctgaaatgtatgttcatgtcagtggtttactggacctgacaatacacttgagcaatgagattattttgttactggaactagtggaccaacctgcctgcttttctgaaaaaaaaaaaa

SEQ ID NO: 86516 - DNA, 572 bp, Triticum aestivum
  unsure (1)..(572): unsure at all n locations
  Clone ID: PAT_TA_86516
agtcggaacttacccgacaaggaatttcgctaccttaggaccgttatagttacggccgccgtttactgggacttcaatcaagagcttgcaccccatcatttaatcttccagcaccgggcaggcgtcacaccctatacgtccactttcgtgtttgcagagtgctgtgtttttattaaacagtcgcagccaccagtttattgcaaccctttcacccttctgcagtaaagcagtcaagctaccggggcgtaccttatcccgaagttacggtaccaatttgccgagttccttctcccgagttctctcaagcgccttagaatactcatctcgcccacctgtgtcggtttgcggtacggtctcgtatgactgaagcttagaggcttttcttggaacacttccgattgcttcgcagcataaagccgctcgtcccgatccttgaatacgcgcccggattgcctaagcgcttcatgaaccagaaactgactatcaacagnagacaacttccgcgatcgtcccccatcgatcatacacggtgcaggatntaacctgctccancagcaggcactcngcctcnc

SEQ ID NO: 86517 - DNA, 583 bp, Triticum aestivum
  unsure (1)..(583): unsure at all n locations
  Clone ID: PAT_TA_86517
ggaagttgctgctgctgaagctgatgttgtgaatttgaagcaaaaggcttgtgatctacgcggacaactcagcagccaggcccagctgagctccatcccactatgtgaatcatgcaacaaacggctccaagacaagcttgccgaagagaaacaaaatgaaatcagctcatcaaccgaagcatcatcagctattgggaccaatcctttatctcgaatgttacccaatgcaggcatggcggatattgttgaacaattgagaaggcaagccgcacagaattcgtcttcttcaacaggtgctcaaagattgttgaggcaaaactcaaatagcctacacaggcttcaaggactgaatgccttttcaagtaatagaacagaggaacctgggggtggaccaccaactgcattagctaagctgacaaaccggctcaactcttgaaagaaagaaggnaatgctcgcaatgagatcaaaactagattggtcgccacaacgggtcagctcaaataaagaccacataagacgggaattgcacncatcatctaaactgaaatcagtntgggcatcacatatacancgcaaggacat

SEQ ID NO: 86518 - DNA, 550 bp, Triticum aestivum
  unsure (1)..(550): unsure at all n locations
  Clone ID: PAT_TA_86518
gcgaagctggccaacctccatgtcaccgccacctgtggcgcccgcaacatggatcttgtcaagggcttgggcgcggacgaggtgatggactacaggaccccggagggggctagcctgctgagcccgtccggcgccaagtacgatggcgtggttcactgcaccgtcggcgtcagctggtcgtcattccggccgttgctgagcgacgccggggggagagtgatagacatcaccccaaacttgtgggccatcctcagatatatcctgcacggggtgacattctccaagaagcgcctcgtgcccctgctcgtgtcgcccaacaaggcagacctggagttcttggtcgccttgctcanggacggcaagctcaagacgtgatcgactcgaggttcccgttgggcgacgcgggcaaggcttgcagacagtatcnaaggcaccgactggcaaatttcgtcacacacagactaacgtctcactcatgctacaatacgttatacataaccaagagngtaccaagacacaaaacattggccacattttcaaaaaaaaaaaa

SEQ ID NO: 86519 - DNA, 577 bp, Triticum aestivum
  unsure (1)..(577): unsure at all n locations
  Clone ID: PAT_TA_86519
attcagtttacgaggcacaaatacaaaaattcaactgtaaaaggcaaagaaccttgaaaaatataaatagtttcactggcagttcaatgggaggcactaagttaggttcctctcatgacaaggaaaataagagcaaaaaacagcttttcctgagtgctaaagtatgtctcctttcgttaaagcgaactttggaagatcttcataagaaagatttattcccttacaatccaaagcctctgcttaaaagcttgtccagatttgaggagctctgtgcgcagtactgaaacaattaagttgcacccggtgacacgctaccatttctgtggttgaatatttgtttatgatctggttcttcgattggttgtccacgtcttggacgcttctccacctctctgcggcgcggctggctccaatgcaacctcaatgcctggtcacactggcaacacacaacgctgcatcttcgacaagtnaagcctctactcggacctgttcgcccatnatggaggaantcctcctgggaactgctggaccaaggagtaancataanccngtactnaacgaagttttggggggacac

SEQ ID NO: 86520 - DNA, 556 bp, Triticum aestivum
  unsure (1)..(556): unsure at all n locations
  Clone ID: PAT_TA_86520
gacatcctcgttctctgtgcagttccaacaatcctagtgatggcgtgtgcaagccatgtcatgattttccttgtgttctcaaatttagccatagccatggccacccttcctcctcccttgtatgaccctaacctagggaagtgtaagaatagttgtgaggaagagctcaatctatctttgtacctacaccaagttgtgacaggaccagcccacaaccaagaagtaattctcagccctggctttcctaacatgtttggtatgatagccgtcgttgactggaccatatacnccgtccctgattccacttcaagtatcattgctcgggcaaanggaatgactatccaagctacccaaagcgangtcaatggtgttgcctggtttcctcctttcagcatggtccttcaggattccaaggtttgggcggttctacnctgcaagtgatgggaacaattacgggtgcatacatggtgaatgggctaatgtgggtgggacnggnaaatngtcangggacggggacataagttcaagcatcaaggaagagnaccagncttngggg

SEQ ID NO: 86521 - DNA, 280 bp, Triticum aestivum
  unsure (1)..(280): unsure at all n locations
  Clone ID: PAT_TA_86521
agcgccttatctttgctggcaagcagctggaggatggtcgcaccctggccgactacaacatccaaaaggagtccaccctccacctgggtgctgcgtctgcntggtgggatgcagatnttcntgaanancctnaatnggaagaacantaaccctgaagntnaaaactcngacancaatgnaaatgtnaagggtnaagatncaagaaaaggnaggantcccccgggccaanaaggcttaacttcntngggaaacaatgggnggaangtcccacccctaaccg

SEQ ID NO: 86522 - DNA, 527 bp, Triticum aestivum
  unsure (1)..(527): unsure at all n locations
  Clone ID: PAT_TA_86522
gaggttcagacaccaatcatgatagaccaattctactgcgacaaaacatcgtgcacgaaccaaacctcggcggtggcggtttcaggcgtgcagtacgagaacatccgggggactttcacgatcaagcccgcccatttcgcatgcagcgacagctcgccgtgctcggagatcaccctgaccggcatacaactgagacccctgatagtgcctcagtaccacacatgcagcagccccttctgctggcaggccttcggggagctgtacactcccacatccctcctanttcaaggcttgnanctcgaaaaccgggcnggaaaccgnttttttnggncaanattagtgctgaaacccanggacaatcggggaattcttgtcccggggtgaatatattacagcataaatagtgatnntgancatgtttggaatactgaacncgagaanaaatttcancaantcgaaaggtnntaaacantttgaaangccgnattnttttgaaaggcagggcctgcncntttaaaaaaaaaaaa

SEQ ID NO: 86523 - DNA, 289 bp, Triticum aestivum
  Clone ID: PAT_TA_86523
ccgctatgaatcgtcgtggtgatggggttggttcttccgatggtgaatcgggcaccaatcagttcaagtgatggctccgaagcatggaagaggagtgagcacttgcgtcggaggaaatcatgttgacagaacctcaagttgttacacttttcatcttgtttgctgattgtttccttcagtgtatgttttgttcagtttgacagaagtttagaattgttatgcggtgttggctggctgttagtctgatattaattcagaagcattgattttccttggtaaaaaaaaaaaa

SEQ ID NO: 86524 - DNA, 522 bp, Triticum aestivum
  unsure (1)..(522): unsure at all n locations
  Clone ID: PAT_TA_86524
ccgccatcctcgcgcctcgcccgagatccagccgccgtccgctccgcctatgatccagccgccgtgttcgcgctcagggatccacccccatccccgacctctancccccaacctcgtccgtcatctccatcgcgctcctccctanagctctccatccgtgctccccgcccctgctgccgccggtagtcggtagagatccatccacgagatcttcatcccattgcgcccctcacgaaggcagccgtccgttgctgcagatctccgcacaacactcgtttttccaatatgagcgggtgtacatgatggtgagcttgcagacagtgagtacgcggtactacctggcaacaaggctgaggaggtgggcgagcggagggcgccgagatggaccctgagtcactcagtgtttaaggaccacattcaatttattcgcatcactattgaactgcatcgtcatcacactagatattatggntaacagtgtcntgtttgaatatttttangtacacggttgtttcctttgat

SEQ ID NO: 86525 - DNA, 553 bp, Triticum aestivum
  unsure (1)..(553): unsure at all n locations
  Clone ID: PAT_TA_86525
ctccattttgttggagattcccatgcaatcatgcatgatgcttgcatgtaggggtgggcacagtcacaccgaaaatcggaaaaccaaaccgatttaaccgatttatgtgtttattcggtgtatggttttattgttcggtggcagtttcgttttctattcggtgttcggtgcaacttcggtttcctgcggtcacaaaccgatatcagcgaagaaaccgctattatttaagatggccgtacgcccgtgccctgtacctgtacgtaactgtggctatgacttgtgagcggttgagcgcagccatttgtccttcggccaactaatgtagatacataatcaccacacgttcacacgtccgcgaaacctaatcatagccatacatccnttcgttaggcgngcctctctctcaatcctanaccacatnagctaccatcaatcgntccggcgatcgcgtcgcatcctttgttcgcnactctcagtcaaatancgtaatccaaacagtactggacacactactactcancaggatagatgncacacacaggatattatatng

SEQ ID NO: 86526 - DNA, 556 bp, Triticum aestivum
  unsure (1)..(556): unsure at all n locations
  Clone ID: PAT_TA_86526
aaagggttctattacatccgtgcaagctatttatgtgcctgctgatgacttgacagatccggcccctgctatcacttttgcccatcttgatgctaccaccgtgctctcacgacagatttccgagctcggtatttatcctgctgtcgatcctttggattccacatccagaatgttgtctcctcatgttcttggcgaggctcactacaacactgctcgtggtgttcagaaggttcttcagaattacaagaatcttcaagatattattgccattttgggaatggatgagctcagtgaggacgacaagttaacatcgctcgcgctaggaaatcagcggtccttagcaactttcatgttgctgaatttcacaggcgcacctggaaatatgttgagctaaggagggtgtcaaagtttcaaggtgtctggatgggaaatacatgacttcagagcagcatcacatggttggaggaatagagagncatgcaagctganaagatgcaagganacctngtaagaactctctaaacaactgnatttancnttcgggcaacngtgtcnt

SEQ ID NO: 86527 - DNA, 569 bp, Triticum aestivum
  unsure (1)..(569): unsure at all n locations
  Clone ID: PAT_TA_86527
aagacagtgcaaaaagaatcagaaccatttgacttcccagtaaaaaatgtaaaatcgcacactatagaaaaagtttctgtcctgcaccgtacaaaccaacaagcattgtaaacatcctaaaggcaaaccttggcacattatgtttataatacaatgaaattgtacaaggggataatttttttttaaaagtttctgtaattaagattcacaaagtttccgtgttgtctccctggctagctcccactttaacaatgcttgtctctctcactttcactttcatttttgactatatgaaagcacacaacagaaataaatgactctctaaaacttccgggttgtctccctggcagcgctttctttaaagccattaaaaatttggcagtagcgcgtggatttcattttttactggacatgaaaagttctgaaacttttacacagattacatcaaattgcntagttgccaattgcagaatattgcttacaaaagtatggtgaagtcantacacacacgtcctattaaacaattgtttgagcatgtttgctgtttgataacannatcacgggtanag

SEQ ID NO: 86528 - DNA, 570 bp, Triticum aestivum
  unsure (1)..(570): unsure at all n locations
  Clone ID: PAT_TA_86528
cccagaagccccgacgctcaagcccccagacgccgcagcgccgccactccacccgcagcggcaaccatggcggtcggcaagaacaagcgcatctccaaggggaggaagggtagcaagaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgtttgaagtatctctagctgatcttcagaacgacgaggaccaggcctacaggaagatcagactccgtgctgangatgtgcaagggatgaatgtcctcaccaacttctggggcatggacttcaccactgacaagctcagtccttgtaagaagtgcagacactcattaggctcattggatgtaaacactgacaactacatctccatgttcgcantggctcacaagaacgccgaacaagtaagccactgctatccaacaatcagttagcagttcgcncaaatgttagatatggcaacaactcagtgtactnaa

SEQ ID NO: 86529 - DNA, 219 bp, Triticum aestivum
  Clone ID: PAT_TA_86529
tcaaattataaactcacattttgtgtcaaaggaactaacaattaagcagcctgccaaatgccaatagagtatcaaaagctgttcctccatctcaatttccatccacatcacacaaagaccactcagcacgctcatcagacagagagagagatacgtgaagtactagctagtgccggtcgtacttatctccggcgccgcctaaggaagagaagaacccag

SEQ ID NO: 86530 - DNA, 321 bp, Triticum aestivum
  unsure (1)..(321): unsure at all n locations
  Clone ID: PAT_TA_86530
tccatgtccgttcttgatagtatctatttccgtattcatttccggggtttctgtattcgtctccgcttctgcaaaaaaatgaaaacaaatataatagcactcagttctgtccgtttccgctccgttttcatccctagtcctgagtaaatcatgtctcgtgtcaaattgatctcaccaaggtcctgagtaaatcatgtctcgtgtcaaattgatctcaccaaaatttaccgacggggcccttgtattgtctattcatcatctatacgcattacatgatcaacacaaatttggcacggnacccccagcttgtgcccaccatgg

SEQ ID NO: 86531 - DNA, 562 bp, Triticum aestivum
  unsure (1)..(562): unsure at all n locations
  Clone ID: PAT_TA_86531
ctggagcatgcactcccgcatgaaatagtacctcaaaaaaactggtaaactgttttaaaaaaattctcattttgttggatgtttgtgttagtgcacaagcatgcttgacaattttcatggggaacagagcagtagtgttttgtcggtgaaaaaatatattaagatgacctttttgtgtaacatttggtgtctaatttcttttttttgcacatgctaaaatatttaacctttttgcctgaaactttgcaggtagcattttgatgtgactatgaatacataaaaatttgttgggatttttctgacatttcaaaagtaatttttcgcacgtgctcccgggagcnaaattggtttccacgaaggcttatgcatatgtaaaccctgtttgtgtaggaaaagggagaagagntagagganaggatacgccgtcggncaanaanagcgctgcangggcgtctggtgcaaagggcaacaaatgcataatctctagcgaaacatcaacgtgaaatgtgttggtgcgctcgancgctggtcccgaacgaccatcgagcgttgantacaatta

SEQ ID NO: 86532 - DNA, 343 bp, Triticum aestivum
  unsure (1)..(343): unsure at all n locations
  Clone ID: PAT_TA_86532
gtttgcaaatgcttaagtgaagctcatgcattgctatatgtataattgcatatggcgctgctgaggtcgagaccctcaggagtgaccttccccgcgcaaaggagcaggcaagggcgagtgacgcngncgctgagaaagcggctgccaatgtgaaggataaacgggccacccggcgtcagttctangagcgcgtatcccagattgagcaaaactcaaggacgcatcgcaagngcaatctcctcgangaggnnattaangctaaggcgacagacctcgccagggcccttnaggacgcccaanaagcnaggtcngaatcccnagcngnttgtaannagcnccaata

SEQ ID NO: 86533 - DNA, 535 bp, Triticum aestivum
  unsure (1)..(535): unsure at all n locations
  Clone ID: PAT_TA_86533
tttttttttttttttgatccaatctcatttctaccattaaaataaaatgtgaaaacaaatgtgaagaactcgtccgtttttgttcctagaagatatgcccatcggtggtattacaacataaccaattatatacgagagtctccgaaaaagaaaaaggaaacatcaacactctcttacatatacagtacagtacaattgtacgtactccctccgttcctaaatacttgtctttctaggcatttcaaatgactatcacaaacccaaactttaagacaatcacttaatacatttatgggatcaccaacttttggcgtttattgagactagctaggtgggaccatgaattcctagaagattgtgaacaaaagtaaaaaatggaaggccagcttactttggtattaagagacaaggagctgcagcgtcatggattggagcgaagganaatctgacggctgaanatggttcacggagganccnaagnggccnccanggggggatggtgtgtcaggggcaactctaggtgtngggcattgga

SEQ ID NO: 86534 - DNA, 331 bp, Triticum aestivum
  unsure (1)..(331): unsure at all n locations
  Clone ID: PAT_TA_86534
ctcttttcattttgcttcttcagtcattgtattctttcttttcaccctgcgctctgaaaagaaaaatcatcatttggttggagttctacaccttctagtttcttgcttatcttctatcttataataagtgcatgatctgcttcaagggtgattcatctgtattaagcagctcngtaagtcaaaaaacaagttccaaacctgaactcttccngaataatccagggatgaagaacangaancggtgaccnctgaatcnaaanggncccaagaanaacangnggtgaaaccnggcccccaggaaaaaaggtgacccccggnttgaacngttcgg

SEQ ID NO: 86535 - DNA, 401 bp, Triticum aestivum
  unsure (1)..(401): unsure at all n locations
  Clone ID: PAT_TA_86535
caagatgctcgctctgccccgcttgggcgaagatagcattagaggtgctctacctttttttctcccaaaaagaagaagcttcgttgattgtttcacggcgctgaatagctagggatgtcgatcacgtgtagcgattacatcccatcatgcctcaaaatcccagatgaagccggctcgtcgttgcgcaaatggttgtgcttcggtatacctgcagcactcctcgtcggagcaggtagtgtgcttcnccngtttcgcttacattcangcgggaaatcagggctagtcaaggaccccgtctnaanagnttatctcnacngaanacctcnggttnagngganacaaaaaaatcttgggtanaaatcncaacgaagtngccctaacggtcggtaccccnantaggg

SEQ ID NO: 86536 - DNA, 228 bp, Triticum aestivum
  unsure (1)..(228): unsure at all n locations
  Clone ID: PAT_TA_86536
ctcactctcactcttgcccgcgccagttccgtcgtccgcgaccgccgcgctgctcctccaccgaggtactcccttcgtccctcctcctccctcactttctcaaattcatcaagagtcatctcattatcctcttccttttcttcctcnacaactgcagcgcatctttggtggccttgtctaatctgcctgtggtgaatctccggtgcgcctgctctnagtgaaaggggc

SEQ ID NO: 86537 - DNA, 179 bp, Triticum aestivum
  unsure (1)..(179): unsure at all n locations
  Clone ID: PAT_TA_86537
ctcatctttgctggcaaagcacctggaggacgggcgcacgctggcagactanancattcaggagggagtctacccttcanttggngctctgcctttgnggttgctgaaatgnatggncantcaacatccagttttattttgcngcaggtcatccttgcagtaggtgtgtgttgccatta

SEQ ID NO: 86538 - DNA, 257 bp, Triticum aestivum
  unsure (1)..(257): unsure at all n locations
  Clone ID: PAT_TA_86538
gcgggaacgagcgtgccaactgggtgcccatctgcatgcagttccacggcttctgccggcgcacgagcggcgccgtcgtggcctccttcctctccgtcttcatcttcgtgctcctcgtcgtcctcgccgccttctccatcaggaagcgctgaaaccagncttgctccagccggcagtccagctgcggnaacccgggctttgttaattaacggtgcctgtgttttaatgtncatgatctnangttccttttcggaatt

SEQ ID NO: 86539 - DNA, 249 bp, Triticum aestivum
  unsure (1)..(249): unsure at all n locations
  Clone ID: PAT_TA_86539
gtatgcttgtgtggttggtttttaaaataatctagccattagcttgtatacatatttctggaggcatgtataactttgccaaaacgcccctgcccggctattcaaatgtctggaccacgcactcgcggacagaaacagccgcttctganccanagcgtgttncacatntcggnacgcnccgccgcgtcctcttnnaangcccaangtttnaaacnccccccccaaaaaaaanagccccnngggnccttt

SEQ ID NO: 86540 - DNA, 244 bp, Triticum aestivum
  unsure (1)..(244): unsure at all n locations
  Clone ID: PAT_TA_86540
ggggagaangtgttgtgctgtgctgtgttggttacttggtgttaggggggtatactccagtattgttgtacgtactgctanctagctctcctttgtgtggtggttggtgatgtacataaagaaatggtanacatttgtgaacngaatccaactctttggngaacgcatanatgcatacctgatctttgttgcngggnaaaaatcnantctgccccngtgtcggaacaaaaataanaaaaaaaan

SEQ ID NO: 86541 - DNA, 550 bp, Triticum aestivum
  unsure (1)..(550): unsure at all n locations
  Clone ID: PAT_TA_86541
gcctcctctagttcttctcgttcatgctttagttggtcctagttgactaattagagtgtggcaaatcctcttgtcctcataattanaagcccagtgtggttcnaatctcctccctctaattctctancgacgattagctctggacggcgaancgctgccggatcatgaaggttgcatgcttgcaaccaagtagagaggtcgtgctttcggtcttcagttcaagggactgttcgtgggcggtacnagggatcgttcatcgacggttcgagggactccaaatacnatctacaccgacacgttctttttccgctacaactcggtgacgttcgggatcacgacacatgctggactgcaagtggcagncagaaaatccgaacctgacgaaactcagtcagttgcaacaagggtggttatctggtcatcaggtantaacaactgcgttanataaccctttcctaaatggngctaaattancctggggtccgctttanttgcaataaagttttcaaaggcgnctgtggcnaattaccaanattgntntttgganttg

SEQ ID NO: 86542 - DNA, 291 bp, Triticum aestivum
  unsure (1)..(291): unsure at all n locations
  Clone ID: PAT_TA_86542
ggcgacgatccccatcaccggcaccggcatcaacccggcgcgctccctcggcgccgccatcatctacaacaagaagcagtcgtgggacgaccactggatcttctgggtgggcccgttcaccggcgcggcgctggcggccatctaccacgtggtggtgatcagggccatccccttcaagagccgcgactagtaanctcaatcagccatggaatggaatggatggaatcctgtcgttcatcnacatcgtttgtgctgatcgtngcncctgtaattaccggtctcctttntttc

SEQ ID NO: 86543 - DNA, 288 bp, Triticum aestivum
  unsure (1)..(288): unsure at all n locations
  Clone ID: PAT_TA_86543
gttctgtcgacgtggtctanatatattcacgcacgcatgcanccatgcatgcatggcttatgcatgaagtcntgcaagcaagcattaatattcgctattaaacttttttccttttccaagaaaaataatattcgcaccaccacggtctgcaggtgcctgtacctacctattgtatgtntgtaaaacanactacgtatgatgatnatcggcctgggtctnaggattggaagccaattnttcaanccaataatgtcccaaaggtntttagganttntcanccgatttacc

SEQ ID NO: 86544 - DNA, 190 bp, Triticum aestivum
  unsure (1)..(190): unsure at all n locations
  Clone ID: PAT_TA_86544
gaaaaaaccaatcaatttggatgaaatatttcgtagatcacgaaatgatatcatgttgcacatattttaaccctctaactcaaataaccccaattaggtttttgcccaattttgtgggaaattctcttcggcttaattaattganggatcaaggccttaacccccaatttccccccaaaaanangggaaa

SEQ ID NO: 86545 - DNA, 205 bp, Triticum aestivum
  unsure (1)..(205): unsure at all n locations
  Clone ID: PAT_TA_86545
cctcgccgctgangtcttggngctggccggaaacgccgccagggacaanaanaanacacgtatcgtgccccgccacatccagctcgccgtgcgcaatgacnaggagctgaccaagttgcttggnggcnccaccatcgccancggnggtgtgangcncaggcatccagcagcacctcctcccnaaaaggggcntcttcctccaagg

SEQ ID NO: 86546 - DNA, 216 bp, Triticum aestivum
  Clone ID: PAT_TA_86546
ggcgcgcggcggccgtgggctccgacgacggcggtctggaacgagcgcagccagcaatgtgaccattgaccggcgtgatgtaattacaagtagaatcacaagtccaggagtacctcctagttgatcgatcccctttgcctctggttagcacgcaggtgccaaatggccaaggtttggctaaattaatttctgttcatgctgattaaaaaaaaaaaa

SEQ ID NO: 86547 - DNA, 354 bp, Triticum aestivum
  unsure (1)..(354): unsure at all n locations
  Clone ID: PAT_TA_86547
cctacctgaacacctatgatggccgcaccatccgctacccagaccctctcatcaaggccaatgacactatcaagctcgacctggngaccaacaagattgttgacttcatcaagttcgacgttggtaacgtggtcatggtgactggcgggcgcaacactgggcgtgttggtgtgatcaanaacagggagaancatangggaaccttcgagaccatccannttgagggatgcccagggccactntttcnccacccgtcggggananttttncacnttgggnnggggcaccanncttgggtgccccncccngggggcaagggttncnccncacatttttggggggnaanngaagggg

SEQ ID NO: 86548 - DNA, 549 bp, Triticum aestivum
  unsure (1)..(549): unsure at all n locations
  Clone ID: PAT_TA_86548
cacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacaacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgatccgcctaaaattaaataaaactcggacaaatgacaaggtatcntncaaagcgttgtgtgtcccaaaaaatagtanacaatattcgtgtctcgtcgctgtgtttctctccganaaaattgggttgcttgttgttagcatcgggaatactccgtgaataacactgtatgattgtcgtgntgcaatatgtagtccctgtcaccanaaaaaa

SEQ ID NO: 86549 - DNA, 300 bp, Triticum aestivum
  unsure (1)..(300): unsure at all n locations
  Clone ID: PAT_TA_86549
ggcacaagggccttcaacctcattgacggcggcgtcgccgccaacaaccctacactatgcgcgatgagtcatgtggcggaggacatcatcgtggctggaacggtgacttgctcgggaagtcatacatggtcatctccatcggctgcgggacgtcttcgaatcccaaaggcaagtatagtgctaaggacaccgccaagtggggcatcctgaactggttctcaagggcggcaccgtcccgattctcgacatgttcaacncggctancggcgacatggncacatncactctccgtnctctccg

SEQ ID NO: 86550 - DNA, 531 bp, Triticum aestivum
  unsure (1)..(531): unsure at all n locations
  Clone ID: PAT_TA_86550
tgacggcttccggtcaatcgccgacgaggtcttccaaggcatcccgtccccggcatttcagctccaagaactccttgacaacttcgccaccaaaggcctcaacgcagaggacctggtggtgctctccggcgcgcactccttcggcctcacgcactgcaactttgtcaccccacggttgtaccccaccgtcgaccccactatgaacgccacctttgcggcggctctcaagaaggtgtgccgccgccnaggaacgngggggattaannccgtgagaaaaaccgggtnacggnccnaaaaagngggaaanattttanaaaaannggcccngggcagggttnttnacgttggncaaaattggtgggcaaaaaccgaaaacngggaaaaaangggggcatggtaacgaaaancgngtaacccaatcnangntggcaattccanggctatgnaaatggagnatcaggggttacggaccacccgnaatttagaaggtnttttcacaaaaagncttaancnggggttaaanttnntttt

SEQ ID NO: 86551 - DNA, 537 bp, Triticum aestivum
  unsure (1)..(537): unsure at all n locations
  Clone ID: PAT_TA_86551
gtcaaattcagagcaagacgacgaaggcgacgacatgggtggcggcggtgcgttcgcctggctgctcgtggccgtcctcctcatggccctgggttcttccacgagcacggcagcctgctcctcgcgtgtccttccagctgcggagggtgacgtgatggcacgggctgccggagccggaggagcgtacggcggacgcggaggcgagagggttgtgatgggaaggtctctgctgcagagggcggcgtggaggccgccgtcgccgctgccgaacccgccgagggccaccgtggcgccggggccaccgccgcggaaggcgtagccgcagtgtctcgtctgcgcacatacatactctgctatctctgtgtaacactgttgcgcatacaatgatacgactacgacacacgcatggagctgctgccgttaactctgtggtgacgtacggcgcgctaactttacacggacaanctcgaccatttgtaagagnatanttttttcgtaggagaatgtgtagaatacaancctatgtanttacggagg

SEQ ID NO: 86552 - DNA, 526 bp, Triticum aestivum
  unsure (1)..(526): unsure at all n locations
  Clone ID: PAT_TA_86552
gagaggtaagggaggaggaggaggagagcggcggcgaagatggtgtcnctgaagctgcagaagcgcctggcctcgagcgtcctcaagtgtggcaagggcaaggtctggctcgaccccaatgaggtcaacgagatctccatggccaactcccggcagaacatccggaagctggtaaaggatggtttcatcatcaggaagcctcanangatcattccaggnctcgngnaaggagggnacattaggccaancanaaggccntcactctggatatggtaaacntaggggtaccagggagctangtccccaacaagtcctgtgatgcngaagatgcgcgtcctgaagcgccttctgcgcaagtaccgtgaggcaagaagtcgacaaacacattacatgacatgtactgaagncaagggtacatgtcaagacaaaggtcctcatgggattcacaatccaaggtganangnaagaagaagactcctatactttgaggcaacgcgcaaaacangcancagganaggaacatcac

SEQ ID NO: 86553 - DNA, 339 bp, Triticum aestivum
  Clone ID: PAT_TA_86553
gtttctggtagactttggtcaatgtatcctggcctgcatgctttggtggttacgaaaacagccaccttttgtttcgcatcaatgagaccaatatctttcccctttcggagaactccgagcaagctatatataaactttagtcttcccctgctgcttctatggtgaaaagtactgtgtaatgtagtctatcatctttagattatattgttctctttgtagtgaaaagcggttatcaccgcttattgtatatatatgtgaagaaccttctgctactgttcctgaaaactatgactcaagaaacaacttccttttagcatgctttgcttcaaaaaaaaaaaa

SEQ ID NO: 86554 - DNA, 586 bp, Triticum aestivum
  unsure (1)..(586): unsure at all n locations
  Clone ID: PAT_TA_86554
ctcaacttgaaaataccatgtttgcccctggaagcagaatggagaactacaacaagaagccttcaagtccgaaggatactacagctctcgctaatttgaaagaagttctacatgaatcaggtttggagattctgtacagtgtccctgtcgtacattgtgcacaggcgtttggagttgttttgagagccaaggagaaggtgagtagtgctgggaaggcaattccaggatggaaagttgtatattcaggcgacacgcggccgtgcccagctcttgtagatgcgtccagagatgccaccgtgctgatacatgaggcgacgtttgaggacagcatgaaggacgaagcgatngcgcggaaccacagcacaacgaaggaagcatagcagtaggcacatcggctggagcgtaccgcatatcctgaccactttagcagagtanctaaatcccgtcttgcaagaganatcacaagactgcatcgcttcgactcatgacgtaactcncnattgccgtctgcaagnctcccactaagncnctcangataatgcctcaanatcgataagcctgagcctgttaccaaggaanatataaa

SEQ ID NO: 86555 - DNA, 566 bp, Triticum aestivum
  unsure (1)..(566): unsure at all n locations
  Clone ID: PAT_TA_86555
cttgtaccaacgttgcggactgtatttcttgtatttacggactgcattacgcgcactaaatctattcgtttgtgcactgcacgaaagtgcatctcttgtgcttcattttgagcatgtactgcacttcatgcacacatattttgtgaactgtctgatattactttgaagaactgctatcacttttatttagaatggtctgcggattataattttttaggaatataaatttttaattatctacggttagtttgtgggaagtattgaagtcaaagtacaccttttttgggtcctttttctttggtaacataagcctgcattgattgtccttcattcttggtaacataatttcattaactcttgtttaatttcagttttgacctttttgatcctcttcaaaaatgtaggcaacttctaccttcctttcagtcattctctctggccgcaactctctctttccaanctncttattaattcatttccaggtttgtgtatgacccagccctgcgtaacttcngcacggcatggtaggntccaaggacgcatggtnactgtccaagccatgtcnc

SEQ ID NO: 86556 - DNA, 246 bp, Triticum aestivum
  unsure (1)..(246): unsure at all n locations
  Clone ID: PAT_TA_86556
cagaaggtgaactcgttgtgagatacgcgatatatatgtaatcagtgaaatacttcataaagtgaaattgaaataggcacccaatacgaaagaccgggagtaatagggaattctaaagagcaaacaccaaccttggtaagcagatcagcaaacgaagagcaatcagatgacaaggcgaggagatccagtcaaacgaaaatgaatcangagaggatgcattaaaatancaggcagttggcccattga

SEQ ID NO: 86557 - DNA, 524 bp, Triticum aestivum
  unsure (1)..(524): unsure at all n locations
  Clone ID: PAT_TA_86557
agagaacgtgcgatttgtgctgcantgagacctccagaggagtggggctactgacaagggctcgaacccaggttcttccataaaaaaagaaacctctgtgtattgttccccatgcctgtcaggttcgccaatggtgctgagctggcccacatgtcagccacacaaagttaggtcatgtaagttanangatcttcgnccgtactgtagtgggtggagccgtgttcagggccttttgttaacctaaaaaaatgccttcgggtttcttccccaagggccaagtttagtaaaccaattaggccctatgtaagtacaattctccctaaaagttgtgngatgtgcnaagtagcaaatttgaactagaatctgcctanggtctcacangttanagtgttggaaaatcttgggagggtatgttcagatgtcggnccttgtnaaataccngtancagngtatgtcanttacnctggnacaacaagctaccgtttcctgtccatacttaaaggggccttgatatntccanatta

SEQ ID NO: 86558 - DNA, 566 bp, Triticum aestivum
  unsure (1)..(566): unsure at all n locations
  Clone ID: PAT_TA_86558
caggcgaagcacccactcaaaccctagcctcctccccactccatctccgatggcccgcacgaagcagacggcgcgcaagtccaccggcggcaaggcgccgaggaagcagctggcgaccaaggcggcgcgcaagtcggccccggccaccggcggcgtgaagaagccccaccgcttccgcccgggcaccgtggcgctccgggagatccgcaagtaccagaagagcacggagctgctcatccgcaagctccccttccagcgcctggtgagggagatagcgcaggacttcaagaccgacctcaggttccagtcctccgccgtctccgccctgcaggaggccgccgaggcgtatctggtggggctcttcgaggacacaacctgtgcgcatccacgccaagcgcgtcacatcatgccaaggacatcagctcgccgccgcatccgtggggagncgctaggttggcgtacagtctgtctgcatcggtttactaaggaattgctggttccntntgtgataaacttcagtgtctacctaaataatggtatgaaatcatttctttaaaaaaaaaaaa

SEQ ID NO: 86559 - DNA, 419 bp, Triticum aestivum
  unsure (1)..(419): unsure at all n locations
  Clone ID: PAT_TA_86559
agtgggtccagatgacgcagaactgggggagcacgtaccaggccttcgccgcgctcgacaagtccgtggggctcgaagtcaggatcaccggcggcaccgacggcaagaccatcatcgtcggcgacgccatccccgcctggtggagccccggactctgctaccagggatcaaacaacttctggtagatcatccatccggccatgcatcatggcgactatatatatattcntgcatacctcgattgacatcgangctgttcncangtgttttggttcagtaatataccnctcgtgtctcccatctcattttgtccanngggctatcncaatcatgtantccnaatcctgtaaantcttaaacttgattcttcnacaacatctaattanatgctaaggnatctcaacaacaaaaaaaaaaaa

SEQ ID NO: 86560 - DNA, 364 bp, Triticum aestivum
  unsure (1)..(364): unsure at all n locations
  Clone ID: PAT_TA_86560
atnanaantgtgttttactgcgttnancgacaanggtgctgcaacaacactgggantccaacaanacanncaacttacanatagccagatactacaattaancgaaatcccttgtgcnttcagcagattgaaagntaagcacaaaaaggtcaagcaanaaactcntgctggtggtttnagccgtncgcancaatttcnnggatcntgtcactgacctccggatcatctgatttgactgctagcttcanggccacttctttgngtccgctgatccatnatgaaanctcactaagantncacattaccgntaaacacacctgcagacannaatgtgcgttcccattgttntggacacatcattcct

SEQ ID NO: 86561 - DNA, 155 bp, Triticum aestivum
  unsure (1)..(155): unsure at all n locations
  Clone ID: PAT_TA_86561
accgacgaagcttccctccggctccccacccccgcaccgccacccggggaancccagcgagaaggagggganaggcngtggccgccgngcaggggatgccanagctngcgtcgtntgtttngggacnagaggggatcngtcgcggatgtcnacgc

SEQ ID NO: 86562 - DNA, 392 bp, Triticum aestivum
  unsure (1)..(392): unsure at all n locations
  Clone ID: PAT_TA_86562
aagacattgaataccagggttaccatatcccaaaaggctggaaagtcttcgcagcgcaaagtgtgacacatatggactcgcaattctttcatgancctaacaaattcaatccttcccggtttgagaaatccgcccctccgtactgctacatgccatttggagggggtccaagaatgtgccctggtaatgtgtttgcaagggtagaaactatggtggccatgcactatctagtaaggcagttcaggtgggaaataacgtgtgaaaaggaaacctacaagagggatccaaagccgacgccatccttggacttccaattaaactcaggttgacaccccttgccaaaaacctccaantcaccacttggtaccgnaataggttaacccatnacanga

SEQ ID NO: 86563 - DNA, 285 bp, Triticum aestivum
  unsure (1)..(285): unsure at all n locations
  Clone ID: PAT_TA_86563
gcggttcagatggaagctctgctgcaaggagaacaccttcgtgagggaccccatgccgtcgccgctgcgtggcctgcccatccaaatcgagcgtaggacctcccctccgccgtgatcgagcttgacggcaacctcagtatcatggtcggtcgcgttgcattanaaaatgtanctgctgctgcacntgtatgtgtgatgagtaataaatggccatcactaccatganttttcttgtgtgccacatatntttanttcaggattaagtactcnaataaaaaaaaaaaa

SEQ ID NO: 86564 - DNA, 397 bp, Triticum aestivum
  unsure (1)..(397): unsure at all n locations
  Clone ID: PAT_TA_86564
acctagtggagctatggctcctgccgagagccggtcttcgccggcgagctgcggcttcttcgggccgaagggcggccatttctttttctctgggccttgaaaccatttcagacgaagatgctgcatttgtttggaggccatgatgtncaacgttcatggcggttttgtcgtcccangtggtccgtctccggcnatggcaaagctcgatccgagcggangctgcaatggacccgantgcttttccatctcttantttggggtcctccccataaaattcagggactantttgtaattctatatttctgtcgggtctcgttgtaaactgctatgttttcatggttatgtttaatgcaatgttttggtccattggaactttccttgttaaaaaaaaaccca

SEQ ID NO: 86565 - DNA, 186 bp, Triticum aestivum
  unsure (1)..(186): unsure at all n locations
  Clone ID: PAT_TA_86565
aggatnaaggtcctggctgggtaaatngcanaacgcggtanctgtccaaattggncaaangggtgcaacaacgtcanagcanggtaaangtgctgacgggtggtgtacatctcntggcgaaaganctcggttatctcgattagnccataacagnatcaaancaatttgntggtgaaanagggtctc

SEQ ID NO: 86566 - DNA, 555 bp, Triticum aestivum
  unsure (1)..(555): unsure at all n locations
  Clone ID: PAT_TA_86566
gttcatcctaagaattggtaccccattcctctgatattatgccgcccttggggtaaacttccagaaaatgtcccttgtcatccaaaacttgctgatttcgccaattgtatgaagaagaagggccgtggtatgtcaatatttgtctcgacaattgacggtgattatcatgaactggctgaggatgctaagactgcctgtcatcagctggaggcctacattgagtacaaacgttgtgagggtgttgcagagataattgtagcaccttcaatgtctgagggcttccgtagcattgttcagacgatgggccttggtaatttgaagccgaatattgttgtggtgcggtacctgagatttggcgccgtgagaatctgacagagataccatcaacctttgtcagtatataaatgattgcatcactgctaacaagnaattgtattgtaaggtctgatgagtggcctatgantcagagcanatggacnttgaccctactggatgtgaagatgagnntgatgctctcngctagccctgctacaaanactcaaactcaaatcanct

SEQ ID NO: 86567 - DNA, 545 bp, Triticum aestivum
  unsure (1)..(545): unsure at all n locations
  Clone ID: PAT_TA_86567
ggatagcgccaatgaccgtaccgacgagtacggcggcagcctcgagaatcgatgccgcttcgcactagaggtggtggacgccgtcgtcagggaggtgggcggccattgcgtgggcatccgtctatctcccttcactgactacatggattgccatgactcggaccctcaggctctcgccctccaccttgtcaagaagctcaatgactatggcatcctctactgccacatgattgagccaaggatggcgcacggcgatggccggcgccaggtcccgcaccgcctgctacccttcaaggaggccttcaacggcaccttcatcgccaacggggggtacgaccgggaggaagggaacaagtggtcggcgaggggtacactgacctcgtcgcttatgggcggtgttctggcaaaccagactacaaggaggttcgagctcagtgcgccgctcatgactatgacaggatgacattcatactctacctgtctgggctaaacgatatcatcccgacaataataactctgaaactcatgtcnagaaaaaaaaaaaa

SEQ ID NO: 86568 - DNA, 279 bp, Triticum aestivum
  unsure (1)..(279): unsure at all n locations
  Clone ID: PAT_TA_86568
aattactcctattatagtaagcaacctattaattctaccattcgcggaaccggatgcatcattcttctgtagataaacaagcgcgtatggtgcaagctgaatacagcaaagaattgtaaaactattaagcgtggcgttcgtgtgtgagtgcctgttttttgtccgagaccagcaacggttttggattacttggaactaaatggttgtaatgggcttagtancctccccctgtttcgtgatatataatatcatttgatttgatgtcctaaaaaaaaaaaa

SEQ ID NO: 86569 - DNA, 300 bp, Triticum aestivum
  unsure (1)..(300): unsure at all n locations
  Clone ID: PAT_TA_86569
aataaattgcacttgcacctggttacctcttgccatatgtcatcgtaactaccacaataatttactaaatcattctttggccttccattcattacaagctaggaaaaatattaagccccggccgggtctcatgaccgagacgatcgtgaagtagaaagccacagagaaatagatcaacatgtatccatccaagcgagaggtgcaagaatcacgctcctttgctcataatcactttcgctacccagccatcacctcttgngtggatcaagacccatagggatagttggccaaaaatattga

SEQ ID NO: 86570 - DNA, 295 bp, Triticum aestivum
  unsure (1)..(295): unsure at all n locations
  Clone ID: PAT_TA_86570
cattgtctctcccggacctccctcccctgtttcggcacaagcgttcgtttcgttcttgtaggtaaagtaaaaggggtgcgtcgttcgtcgtccatgtgcttgtgcttctgccgctgtagatagacatcttgtttttgttttcgttaacttttttgttcaactgggtgctaccgtangatggatggattggtcgcctttttccattattccagtcttgagactgaagcttctggctttacctagcaatcaaatcaaatcaaatcatatcatgcttctctgattgaaaaaaaaaaaa

SEQ ID NO: 86571 - DNA, 403 bp, Triticum aestivum
  unsure (1)..(403): unsure at all n locations
  Clone ID: PAT_TA_86571
ttgaggggtgtatggagcggaatattgatgcttgatcccctcatcactaaggaactcatccaaggtgtagttcttgaactcagtgccgttgtcacttcttattgtcaagatctttacatcatgttgtcgttgagcttcatttgcaaagtcgatgacggtttgttgaggtttcactcttcctcttgaagaaatatacccacgtgtatcttgaatagtcatccacaatcaccaagcaatactttattcccccaanantatcanaggatggnggcccaangaggtccatgtgaaggagctccaagggtctcttcgaatanatgatantcgtgggagggtganccttcccatgaagcttccttcaataaagnactgcaagcacgatcttggaanaacaacattgtta

SEQ ID NO: 86572 - DNA, 272 bp, Triticum aestivum
  Clone ID: PAT_TA_86572
gcaagtcgtcaaggcaggtcctggagcggagagagcgagatggtagacgggaaggtaaatgggagcggaagcaatgaaggcaagccactccacactcatggtggccaccactctattcagtagtcatttggtcagtggtcactactctaactctactcagcagtcctttggtcaattatgcaatgcatctcttgccccagcaactggcctctactgtaatcaaatcgagcgtgctgtgcctattgcaaattttgcgtcttgtatcatggatt

SEQ ID NO: 86573 - DNA, 549 bp, Triticum aestivum
  Clone ID: PAT_TA_86573
aagtgctgtggtttcatagtacgaggacgtgctttggttgacgagttactcatcgaccaattcttcacagccttgcctccaatgacctccatatttgttatttctcgttagtgtatcactcatgcagtatgattgatttgcttgttgtaccgttttgtacgcatgttgtttaggtatttgagatgttttattccttgcattggattgcatatgtttcccttaagtctagaaatccagaaatagggattatgagctagatgggcttttggatggttgccttaatacaatgtatttaagatcacagcgtgtttatctttacttgctacctgtgtttttatgttgcattgatatcactacactatgtagtctcttttcctgaaagttgcaatccttgtttacaagcatgacatgcccagaaatgtgagaaccacaactagtgctctcttctcttgcaggtgtgttgccaatcaattagttgtagctggctcctggatgtcgtaacagtttgatgacaggttatacaaagattggagtgttagtatagatgta

SEQ ID NO: 86574 - DNA, 563 bp, Triticum aestivum
  unsure (1)..(563): unsure at all n locations
  Clone ID: PAT_TA_86574
gttaggcataggagtgttagggtccttgtgccagagatcaatgaagtctaggatcagcttgggatccaaaagaagaggcacatcggtgcctttggcgctagcggccctttgttgtctatctctgatgatttcagcaagttcttcatcatcagctttgtcttcactggacggtacttggaaggcaacctgcttcttgtgaggacttggtctagtgccttgtccagcagtggccttggtcttcagcaaggtggggcctgctgaggactgcggaggagcagaagaacttgcagaggctcctgaggcaattgagatgcctgtggtcctttgacacgaggcgagatgcacaggtgccgaggactttgccggaggagctaaagattttgcagcatgaggaactggagccgcttgaggaatttgccgtgagggcatggatgagcttggccgtgagggcattgctgangaactgggcttgtgtgaagcttcttgggcatagcttctaggctncaacagaggctacaatggaacacagatctcattaattcccacgcttcttaccattttgg

SEQ ID NO: 86575 - DNA, 395 bp, Triticum aestivum
  Clone ID: PAT_TA_86575
cctggtccggcacgtggggcgcggcacgccgcggcggcccgggaaggccgtggagacgtatatcttcgccatgttcaacgagaaccagaagccggagggcgtggagcagtacttcgggatgttccagccggacatgagccaggtctaccacgtcgacttctcggcatcgtcgtagaagacgcctggctgctgcatggaccacgcatatgcatcgatcatccattagttaggaagttattgggtaggaccgattctgtttatttgagcttctccatctctcattatctctcgagaagtactactacttagtataccattattgcttcagacatgttaccaaatatagttgaaacaaaacattgatgatatatatgttctacctcaaaaaaaaaaaa

SEQ ID NO: 86576 - DNA, 533 bp, Triticum aestivum
  unsure (1)..(533): unsure at all n locations
  Clone ID: PAT_TA_86576
gaggagcccgcggcggagaaggccgagaagacccctgccgggaagaagcccaaggccgagaagcggctgccggcgggcaagaagaccgcctccaaggagggcggcggcgagaagaggggccggaagaagggcaagaagagcgtggagacctacaagatctacatcttcaaggtgctgaagcaggtgcaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctctgtccgcctcgtcctccccggggagtcgccaagcacccgtctccgagggaacaaggcgtcaccaattcactcctcttagatcgttgcctgtatctatacagatgtggtgtcactctggtatcgcaagtagaatatgctatgctggatggattgctgatgctacgatctcgtccttagaaagattataacctangggccctt

SEQ ID NO: 86577 - DNA, 333 bp, Triticum aestivum
  unsure (1)..(333): unsure at all n locations
  Clone ID: PAT_TA_86577
tattcaactaatttcataatccataactgctcagtatttacaaactattgcctggttgagtacagtcagatccaagcaaattttacaagttaatctcatgagctgaaattgacaggatccagggacataacatgtatccaaatacagactttgtggttcactctatcaacggtctccgaattttgatcaggcaaagaactcgaccatgttgttaagtccaagactgtcattttgaaggggtgggnaccttgtcttgatgaanatccggtnaagctggggcataagaggaaacgttccggtccagtaggattgcctgaaatcttgtcccganat

SEQ ID NO: 86578 - DNA, 586 bp, Triticum aestivum
  unsure (1)..(586): unsure at all n locations
  Clone ID: PAT_TA_86578
gttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatctcttagcaagctcaaggaccttcaattctttgttggcgaaagcatgcatgatgatggcggctggtgttcgcctactacaangagggagctgctgatcaacttcctgtacttgcacatgggctgaaaaagcaagtgcaacccacgtatgcaaaaccaagcgtctcagtantttgcnctancaagggtgcaatcaccncaatgttgggcagtaactgcanatgttatgctaaacttcgaaaatgggaatgcttgaaggaaactaaattgggggtngt

SEQ ID NO: 86579 - DNA, 403 bp, Triticum aestivum
  unsure (1)..(403): unsure at all n locations
  Clone ID: PAT_TA_86579
cgccacggcgctgagcccggaagtcttgtgggagcacgggttcaccgcggctagggccgacttggtccacctcgatatggagatgaagtggttccgtgacctgctccacctgctttgccccaccgatgtagccgactgtgtggacatgatgaacaaatctcttttcttggttggagaaattgggggaaatgactacaacgttcctcttacctctttggtgcctgttgagaagattcgctcgttcgctccgagtgttatttcaaaattcatcanaancaaccgatcngattgggttgggancaaaacccnataattcccggaaactcccaatcggggcttgccggggtacccacnatttccaagntttnancggggaatttgtncaaaaagggnttccctgggg

SEQ ID NO: 86580 - DNA, 540 bp, Triticum aestivum
  unsure (1)..(540): unsure at all n locations
  Clone ID: PAT_TA_86580
gctgggagctgcagggaggtgaggacctctgtttacatctgggtgttactccttggcatcttcgcctatgtcacactccatgtggtattcttcaagcacttggcacctcaatgtctgcgagatatgttctggggtattcgtgcatattggaagaatactcttgggcacataatgacaccaggatcagggaagacagcagatgatcaangtccagcangtcagttggaagagangataacagatggngaacaggcctcaattgcanagaggatagcanatggccaanangcctcaaatgcanagaggataacanatggccaagagcttcaatccanagaggataacagatggccaagtggcttcanatgcagagagaataacanatgangctcaaagantaganaagatnaggaagtcttganagaancgcagcccttgctggtcttgccacattggtagcaacagtgacatatgtggcatggttaaccctcaagtggctctggtctgatnatacaggaacacatctggtgatcnggggtg

SEQ ID NO: 86581 - DNA, 541 bp, Triticum aestivum
  unsure (1)..(541): unsure at all n locations
  Clone ID: PAT_TA_86581
agacggtcgacctgctgtcgtcaatgtcgtcacgacctcagccacagtgaccacagccatggcggccacgacgacgaccacgactaatttatttttgtattttggagtgtcccacatttggtgtaaatagtcccaagttttccttttcactatgtaaaatattaccaagctaataccagaaccactgtccggacttcttaaaagcgtatgtgcctatactaaagcatactgccacattcagcttatttaaccttgngtagtttgcttacgacattcgggctaggttactgcatgtgtatgtatttggagtagcctggtcaggatgggctctaattgggtgtgtcatgtgtatgctcacagctttagtanacacttgattacgttttattgatgtacacatatatatgctctgtttgatctttgaacctagctttctattctaaatcaaaattatagacatagggatgctaaaagactctgtccgcatgctttggtcgcacgctataacacaattgattcaattaatttgnngccancctat

SEQ ID NO: 86582 - DNA, 533 bp, Triticum aestivum
  Clone ID: PAT_TA_86582
gacatcatacaccttcaggtgatgcctataagttacctgaatagtttaggacttccatcattttactttgacaataatacttcctgagttcacaaattatataatatgaaaacttgcaacatccaatgcttttagttgaacgcacattccatcacatatttctaagctaacatgttatcatttttatggcaggcgcactgacctagaatagcgtaagaatgaccactcaactagctagtgtttgaaacttcaattccatgtatagatacccaacccagcaatttgaatctcttttttctatacaaataatctccctggctccattttattaaaaacaaagcacatcgatcctattcctacaatatgtgcagagtacagcagtgtactacgttagtaaaaagaggtaacctcgcctggagccaaaactacaagatgtctgatgacgaaaagatacatgcccctcgcaccatagcagatagatgaatattacacactggtatgcctcaattagtcaggcggattacaaaagcgaa

SEQ ID NO: 86583 - DNA, 574 bp, Triticum aestivum
  unsure (1)..(574): unsure at all n locations
  Clone ID: PAT_TA_86583
ttcttatccacagtggttcaaatttgacattttgcttatcggttttgttgctcttgtttagtccatgttaagaagccttcctttcatgtataaatgtatagaaccggatataattgcatagctaagcttcatgctctgcctagataagatcagtttctctgttctagagatttgtttgttcataaccaaatgaataaaaggaatcggttatttttggaaactcattttttaaggatgtattgagatactgcctaagggtttaacttcggattatgtcataaagaagtgtaataatttttttgacagctggtcatgttcattagctgtgcaccaagtgtacgatgttcttaacattgagctacttctaagttcagtgaactacagttantgttatggttccccttaagcatcgtgtgaactttgccatttatacctgtaattttgtaactatggttgaaaaaataactcatanggggagacacgtancgctgcgtgaaagtattagtggtcaaatatttacaagggtggcaattgtttaggatggagcctgataatgtcaaacggntagatctaa

SEQ ID NO: 86584 - DNA, 567 bp, Triticum aestivum
  unsure (1)..(567): unsure at all n locations
  Clone ID: PAT_TA_86584
tctcaccggcgttcaagcttctccccgctgggcaaggtgcctgggttactccgcggccgatccatccgctaagtatacccccatctcccgtttccgttcttcagtctggtcggcgcttcctctcgttggcgttttgtacactgtagcgtgttcggtgcagcaatggctgttgattgacgagattgtcagtgcattctgaggacttgagctccacgcagaatccactcgcgagctctcggctaccatgtccatggaagtggctcttgtgagtgtggcgacgggggtcctcaaacctgtcctggagaagctggccacccttcttggcaacgagtacaagttattcaaggatgtgcgcaaggagatnaagtctctcagtcgtgagctggagccatggaggctttctcccaagattcngaggaggaggttcagatgtcaagataaatctggatgaataagtgcggaacttcctacacatggaggatntatcgacactcatcaaacatagtacaagacaaaagcctatggctcttaaaaataaggccacttggaaattgggaaataagccnc

SEQ ID NO: 86585 - DNA, 558 bp, Triticum aestivum
  unsure (1)..(558): unsure at all n locations
  Clone ID: PAT_TA_86585
gctccgagtattgatagctccaagcaaggggattctatacaagctattagactatattctgaaacaggaaacctctgtggattttgtgcccgtgaatttgagcgacttaagaaaatggcaagtgctgctttggcctataaatgtgtggaagtggcatatatgaaggctgccttctacaagcatcctggtgctattaaagataaacatgcattgcaagcaacatctttgatggttcctccagctgagtcaccgtcatcttctgcctcagatgttgataatctgaataaccagagtacagctgctaaggctatttcaagagctttgtactctcctaaaattggtggcaattcataccccggaacatcatcacttgatggggttgctgcttatcagatgacataaattatcattgatggaacagnaatcacaagttcattagcggctatgttactgatatggaaaggtcaggctgagggatgctctgttaggaatccttgaatcagtttcacatgtcanggctgcanaacnattccatcattggatnanaaccatgaaatt

SEQ ID NO: 86586 - DNA, 556 bp, Triticum aestivum
  unsure (1)..(556): unsure at all n locations
  Clone ID: PAT_TA_86586
gtgcatctagcatttaacctttattttcgaattaatttaaattccagagtattatttaaaattttgaaaattcgtaaaaattaaaccgtaactcggatcgaaaaactttgtacatgaaagtttctcagaacaacgagacgaatccgaatacacggtccgttcgcccgccagacatcgaacctttcatctccggttcatcggtctgacagacgtccgaaaccaggaaaactttcccggatgtttcccccttcgccagtatcgcctagcactgcgttagaacacacctagcaccgcttattgccttgttatgcatatgtttgcgtgtatttatcatttcttctccctcttctctccagtagacccgagaccgttgctgatgccctgtgatcgacacgtcgacgacgacccgccttcttgtctgagcgacaagcaagcccccccttgatnacccgatacgccantcaatctccagtttgataaatttgcacngtatgatgccctatccgggntaccggtttgtactgctatggtacactgctanccaaacgtttggaag

SEQ ID NO: 86587 - DNA, 577 bp, Triticum aestivum
  unsure (1)..(577): unsure at all n locations
  Clone ID: PAT_TA_86587
gttcggtctgtggtccacttcgatgcgggacgtggaggcgcgatccgacaaagcctcccgacgctccaaccactacttcccatcaacgccaaggagcagcagcctccgcagattctatgatgactgatgcaaagtccgtgctgtgctcctatgatcgaggaatttgcagcaggtctgatcccttgtgcgtgctcctccgcttgtcctcaccctctcgaccctccccttgctcatcgccatccattttattcagtgtagatggcgggcaaaacacctaagctccagagcaaggatgaaagcactccataaacacccgcaaggatgatgatccatctgtttctaggatggtgggacttgaggcatgcaccagaatcaaggatcagctacttgatgaaaatatacaggagacctcctatactcaacatgacgttaaaaaatatcaaggatagctcagtgggaattggatgatgaaaacacttgtttgagcaatgnatctcataaacatatttgtataaatcattgtnncaaacactttttanaattcgtagtaatcggggggccgtacaatcgccttntg

SEQ ID NO: 86588 - DNA, 217 bp, Triticum aestivum
  Clone ID: PAT_TA_86588
gcaggatcaagcagggggcggacaccggcaagatcgtgccgcaggtgcagcattgcatagacgtggcctggggcttaaaggttgttcctcctaatacataacatggtcacactttgtatacttttgccggcaaccattccatcgagcgaaacctggtggcgtgtgcggcaactctataattttataaagggttcaagatttcactaaaaaaaaaaaa

SEQ ID NO: 86589 - DNA, 207 bp, Triticum aestivum
  Clone ID: PAT_TA_86589
attgaacacgacttttttttaacacaatacagacacaagcgctcatatacacgcgcatacactaatctctattttaacacaatacagacacaagcgctcatatacacgcgcatacactaatctctatgaatgcacacatgcacacccacgacttgaaggcatcccgacacccaaacgaggctaaattgcagtactcactaacctaca

SEQ ID NO: 86590 - DNA, 419 bp, Triticum aestivum
  unsure (1)..(419): unsure at all n locations
  Clone ID: PAT_TA_86590
cgaccatggaagctactacaaccagccagttacttctcttggtgttggtagtttgcagtgtacatgtggtcacctgcaactcttttttctcatatggaaacgagacagatcggttgtcgctgcttgacttcaaggacgcaatcagcctcgaccggcacgaagccttaatgtcctggaacgatagcacccacttttgcagctgggaaggtgtcctgtgtatggtgaagactccacatcgtgtcacttctctaaaccttacaagtcgagatttggagagaccccaccctcccttggtcacttgcatcgcctcnaaaccctgggcttgaatataacacatngaaggacgatncnaattttgnaaattgaaaaangctcagggggcccaantttcncaaaaaaaatngcggcaattttccggg

SEQ ID NO: 86591 - DNA, 325 bp, Triticum aestivum
  unsure (1)..(325): unsure at all n locations
  Clone ID: PAT_TA_86591
ccgacatctacagcctgggcatgatcatgctcgagctcctcaccggcaagtcgccaggggacacgaccaacgggctcgacctgccgcagtgggtggcctccgtcgtcgaggaggantggaccaacgaggtgttcgaccttgagctcatgaaggacgcggccacgggctcgganactggcgaggagctcntgaanacctaaantccattgcattgtgtcnntctttcgcccgtggnaggggcccgaggcncaaaagntatngcgggaanctcaannatttaagggccctctatggattcncggaaaactcnttttnagggggaacc

SEQ ID NO: 86592 - DNA, 281 bp, Triticum aestivum
  unsure (1)..(281): unsure at all n locations
  Clone ID: PAT_TA_86592
cccaggtctagggttccccctttcttcttctccacgcgaatcagctagatactagaaccagcatcgatggcggcggcagcaccggcggacgcgaaggcggaggccgccaanatggacctcctcgaggacgacgacgatttcgaggagttcgatatcgaccaagaatgggatgacaaggaagatggcaacgannctgtcnagcantgggaggatgactgggatgacgacaacgtnaatgnngatttctcacngnagntaaggaangggngggggggagncaa

SEQ ID NO: 86593 - DNA, 263 bp, Triticum aestivum
  unsure (1)..(263): unsure at all n locations
  Clone ID: PAT_TA_86593
ttgattgttagagaatgtttttttacctcaatgttattactgacgataataaatcatacaactacaatgaacagtatcagacatacatcctcgaactcgtgcagttacgacttacaactacaattacaagaatcaacgaactctagttgggggcgtagcatttcttcctgatctctccctcggccccggtgagcacgccgacgtctcccatcttgatcanggncttgctgaantcccngaanaacncacggtcgaatttcccc

SEQ ID NO: 86594 - DNA, 491 bp, Triticum aestivum
  unsure (1)..(491): unsure at all n locations
  Clone ID: PAT_TA_86594
gagctgggtttcagcttcatggagtgaaatggttgctccatgagttacccccccgacaaggcagatctatgcactgttggaagatacctcctctgtccactgggagcgattgctggtgctgttcatgtgcaacttcttgccatgaagcaagaacctggagaaacaagctgctgaagctggatttccaagagatggtcatgttcccctagcacctcccggccaggatttggccgcaccatgagctcgagacggccctctccagtgcatacatgtgggtacacgatttcaagatctcgcccagccatctcgccagctangaggacatgcngctgtttatcatcccggggaccgtccatttcagttgcactgtagactcgcatttcccataaggaaggatcatgagagtttccagtttgttttgatgagtttatnaacatgctccatttgaaacttccgtgaaacacatctggtgatanattancggaaaaaaa

SEQ ID NO: 86595 - DNA, 490 bp, Triticum aestivum
  unsure (1)..(490): unsure at all n locations
  Clone ID: PAT_TA_86595
gaagctcatagccaatcaaagcctctccatctccgaagctccaaccgaaccgaggatgtcttgctgcagaggaaactgcggctgcggcaccgcctgcaagtgcggcaacggctgcngcggctgcaacatgtacccggaggccgaggccgccggcgccaccctcctcgtctccgccaccnccacccacaangcnanctccggcggcatgganatggcggccganaacggcngctgcggctgcacccantgcaagtgnggcaccanctncngctgcncctgctgcanctgctagatcattgatcatcgatcatgcatgcaccncncgtgcacatcntcatatngatctacnacnacatacnatgtnaccgctacntgattcaaggcnttactagcactgnctgcatnacatcagtgcctgccagcttgttgtaacaaggccccaaaananatcccctgnttanngtggcaanaaaaaancngtggggggccg

SEQ ID NO: 86596 - DNA, 495 bp, Triticum aestivum
  unsure (1)..(495): unsure at all n locations
  Clone ID: PAT_TA_86596
gcggcgcgcaagtcggccccggccacgggcggcgtgaagaagccgcaccgcttccgcccgggcaccgtggcgctccgggagatccgcaagtaccagaagagcacggagctgctcatccgcaagctgcccttccagcgcctcgtccgggagatcgcgcaggacttcaagaccgacctccgcttccagagctccgccgtctccgcgctgcaggaggccgccgaggcgtacctcgtcgggctcttcgaggacaccaacctctgcgccatccacgccaagcgcgtcaccatcatgcccaaggacatccagctcgcaagacgcatccggggcgagagggcctangatagtgtctgtctcttctgcaggtgtagagattacatgtgttttgcgtggtggagtgatccgtgttcgtgctatttgggtgtgtgtgatgttctaatgcagtgtctgatgttacatcttgttgtatcagcatctgaatgaaattgctgtcaaaan

SEQ ID NO: 86597 - DNA, 558 bp, Triticum aestivum
  unsure (1)..(558): unsure at all n locations
  Clone ID: PAT_TA_86597
naaaganacattagtctgtgcatacgagtcatcgagccttcctgccaccgtgcgcacccaggcggtcgaagcagggttgcattgctttgacatggagggcatatcatccgacaaggatgccaaaggcagacagagggtgaatcatgtaactgtctttgagcgtcctggtttgcacgagtttttgcagaaaactagtgaatttgccgatcttatactcttcaccgctggtttggaaggatatgcaaagcctttggttgacaggatagatgctcacaatangttctgtcgccgtctctacagaccatcaactgttactacggnatatagagaccatgtgnaggatctttcgtgtttgtccaaagattccgtngaantgtgcttgtcgatcacatccatatnnnttcctactacanccantgaatgggataccgtgcctacttttcagctggacagccatggatgatcagctatgagatgatattccgcttcnangcgctcctctcaaatgagtgacaccgnatgcatgaccgttcacatgcangtggtccaagaacggtn

SEQ ID NO: 86598 - DNA, 556 bp, Triticum aestivum
  unsure (1)..(556): unsure at all n locations
  Clone ID: PAT_TA_86598
ttcacccactccttctcctacctggggttccagcccaggagcgtcgacaagcgggagagcagccgcaagtacctctactggggcgcccgcatcgactgccccggcaagcactgcagctcctgcgccggcctcggccaccaggagtccagcctccgctgcgccctcgaggaggccctcttcctcgacagaatatttgtcatgccctcaaggatgtgccttagttcagtgcacaacacaaaggggataattgattcaagcaacgcaacttcaaatccaagatgggaaacgagttattgtgcaatggaatccttatatgatatagacctcatatcgaaaactgtacctgttgttctggacaatccgcgttcatggtatgggatagtatcgagaattacaaaactgggagaaggagacgtagcgcattgcaaggattagcaaggatgaactcaaagatatccacttactcanatgctcctcctgtaaacgcactgcaatcctcntgcttggttatggagtgnaggtnggacaagcgtactcgtgattacataactttctc

SEQ ID NO: 86599 - DNA, 551 bp, Triticum aestivum
  unsure (1)..(551): unsure at all n locations
  Clone ID: PAT_TA_86599
cggctttacctaccgagaagaagagagaaaaaaggttcgagtgcgttgcagagtgagaagagatggctccggtgaagctgtacngcgcgaccctgtcgtggaacgtcaccaggtgcgtggcggcgctggangaggccngcntcgaggtacgagntcgtccccatcaacttcggcaccggcgagcacaagagccacgacgcacctcgccanggaacccctttggcnaggtgccanctttgcacgatggtgacttgnacgtcttcgaancacgtgctatttgcangtatgcctgcccgcaagaacntaccaannctgttnaagganggcgacatcaaggatcagcaatggtggatgtgtggtcnangtggangccatcagtacaccgcngctcggagcccatctcntcgagtgcctatccanccnagctngggggancatgacaaaaggcantgacgacaacctgtnagtntanaacntctgggaattacaagccaccgngcantcaatactggcnggaaatcctcatcntgggnnctaacatttctttactn

SEQ ID NO: 86600 - DNA, 310 bp, Triticum aestivum
  unsure (1)..(310): unsure at all n locations
  Clone ID: PAT_TA_86600
ctgccttctccancatccatgtnaaccncnatgacgncttcagttaccacgagctacgacgtcatgggcatngacgcttcggccctgncctatggnganatcgtcaanagggtcctccggtgctttgncccttcanagttctcagtgncggtcancatcttcngtngccncggtcatgccgccacntgcggcaagaagctcgangccgangcatacgactgcaacancgttgtggagcacgagctcccctgtggnagcntcctcatcnaccagagctttgncgcaaacnangangttgctgtctctnccg

SEQ ID NO: 86601 - DNA, 601 bp, Triticum aestivum
  unsure (1)..(601): unsure at all n locations
  Clone ID: PAT_TA_86601
gcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagctcgaggacggccgcacccttgccgactacaacatccaagaaggagtccaccctccacctgggtgctccgcctccgcggcggcgccaagaagcgcaagaagaagacctacaccaagcccaagaagcaaaagcacaagcacaagaaggtgaactcgccgtcctccattctacaaggtcgacgacgccaccggcaaggtcaccaggtcaagaangatgcccgaacgccgactgcggcgccggcacttcatggcaacactcgaccgcactactgcggaagtgcggctactacttacaacagaagcttagaggtggttggttctctgctcttactactactatcagatcaactcattaatggtccgtttctttaactgatcntntacatgttctatattacgctacgctgtatcatctgctaatttgggtcnanca

SEQ ID NO: 86602 - DNA, 390 bp, Triticum aestivum
  unsure (1)..(390): unsure at all n locations
  Clone ID: PAT_TA_86602
tttttaagcagaatcattcattagccacttaatctgtcatccatcacactaatcatcagcaaactctccaatgatggtatggcctagtatcaatcaaactaaacaataatccaggtgcttattagtagtaatcaggcaggcacacgcactagtaagcaatcatggtcactggatcatcgatcaagtggancgtggcnacgtaggcgtcggcgagcatcttgccgagccggacctgcgccgcggtggtnaggtgcntgaantcnttggcnacgggaaggcccatgggntcaacgtacctgaggttggncgcccgaacggccngnngcgcttcggnacaattccacgaattgccctgcccntcgcnatcccgacctgaatgacgaggggggg

SEQ ID NO: 86603 - DNA, 384 bp, Triticum aestivum
  unsure (1)..(384): unsure at all n locations
  Clone ID: PAT_TA_86603
gccccgtctccctctagttctagttcctcctccgtccatgtccattgtgcttggcgaagccctgcagatagtttcaccaacatcatcaccacgccgtcgtgctgccggaactcatctactatttcgcctctcttgctggatcgagaaagcgaggatgtcatcgagctgaacgtgtgctgaacgcggaggtgtcatgcgttcggtacttgatcggaaggatcgtgaaggtgtacgactacatcaaccgcgtttatcaacgcttccgtttaacagtctacgaagctacgtagacacactctcccctctcgtagctacncatcncaanggatantctggtgtgtggaaaaanttttttgttccangcanatcccaanattntttccg

SEQ ID NO: 86604 - DNA, 377 bp, Triticum aestivum
  Clone ID: PAT_TA_86604
ttttttttttcagcagcagcttacgtagatacttaaaggtcatagaggcatgtttgctacacttctgtatgcggagaggtgatccttctccactgcttacacttgctaccgtcgagctcctaaaacagcagtttaaattacacatttgcgctaaatctacacttgtgtgtgagaagataggttccaggcctcatcacggtttactcagtggctcgacagcggttctgaagagaagaatgtacgccttgtcaacggaaaagtacaggaagcctcctaaggagtgagtgacgtaggagccaaagttgtgccgacaatgcagtgccaagcaggccgtatgtcgtgtcgaatcctcttgagcgcgagcgcgaggcgcttgc

SEQ ID NO: 86605 - DNA, 162 bp, Triticum aestivum
  unsure (1)..(162): unsure at all n locations
  Clone ID: PAT_TA_86605
tgaacccggcgtcgtcggcgccgccgtctacgccgccgtcaaggccggttaccggcacatcgattgcgccagagaataccacaatgagaaggagatcggcttggcgctgaaaaagctatttgaagaggaggtagtaaagcgtgaagatctgtttancacctc

SEQ ID NO: 86606 - DNA, 194 bp, Triticum aestivum
  unsure (1)..(194): unsure at all n locations
  Clone ID: PAT_TA_86606
agatagttgaatgatttgtttatcatgagaagtaagaggttaacctatttgagcttggtgatagagttatttgatgagatcataaatagaagcatgattcaactaatagncatcantgttgatnaaggcgtngaaaatcttngcgtaancatgataggnngancgcccccntttttttttncggaggngaaaaa

SEQ ID NO: 86607 - DNA, 583 bp, Triticum aestivum
  unsure (1)..(583): unsure at all n locations
  Clone ID: PAT_TA_86607
gcccggaacatagttatattaagcttctgtataagaagcccccaggtataatgagcacgtctggcgcatcaagattgtgtagtcaagacatattttaaccttttaaggccgtgaagaaaaagggaagaaagaaagaaagagagatagcggatatatatatatatgtatatatatatatatatataattgacggaggtaaggagacgaacacagagtccggcactaggcgtagaacctttggagtctggccgcattccatgggtttggctcgagtcgattgtccgatgcatcccgcagacggtacgctccaccggtgagaactttgtcaataacgaagggaccttcccatttgggcttgagcttgtcctttttcctctctggtaggcgtagaacgantcgccaacgttataagttttggccgtactcctgcttgatacatcgagcctgttgctgatanaatgcggagcgggctttgcactcacgctctctcaggcgtcaaacgtctgctatcaactagcttcttccctctaatcgcactcaggggggccggtaccaatccctatntgagtctatacgncctcac

SEQ ID NO: 86608 - DNA, 302 bp, Triticum aestivum
  unsure (1)..(302): unsure at all n locations
  Clone ID: PAT_TA_86608
ttcaaaggtgaatttcaagagtggcagccaaaaccgtaactcgtcttcaggtcaccaaacaacaccaacagctaaaagctctgcagaagcacaaaggagacagggaagcaccaattcaaattctgctggctggggagaggcaccagggagcaacaagagctggcatccatcttctggcagtgctagtcgaggcagccagtcgaatcaacaccatgataggcactctcatggcaacgantcacgacggggtanctatcagggcaatgnttcacggnctgntanctcnaaccactctnggggtc

SEQ ID NO: 86609 - DNA, 374 bp, Triticum aestivum
  Clone ID: PAT_TA_86609
ctcgtgccgggagaatcaagatgcaatcgaggcgcttgctaagcggaagaggatgctggagactgagaaggcgaccatccagcaaaagccgaccctggacctgatggccgaaaccaagcagttcaggcagtatgttttcaagaggaaatacagggcaaaaaccctagtgagcgagtagattctccgtcaatgttttagactagacaatcagctgtcgtgccatttgtaactagtagagaactccttgggacagataccaaagatggccaaagctatccggttaagttagcctggtgtcaacagacggtgactgaggcgtgttgtaccaccagtatcttgaactatgcttaactcctcttcgcaaaaaaaaaaaa

SEQ ID NO: 86610 - DNA, 494 bp, Triticum aestivum
  Clone ID: PAT_TA_86610
gttagggataaagatgatgtttgaagcaggatccatgcccaagctagaaaagctcaggattgatttcaccccagcaacgaatggatatctcttcagtaccggtggtctaactggtagtggtccttatgatttcggaatcgagaacctccccagcactctcacgaccgtcgtatgtgaatgtaagtcatttgatggagattgcactcttgaagccacaagggcggccctggagagagcagtcagcacacaccccagctgccctgttctggacttctccatctactagttaagctaggctcttcattcagtgccactctccggattattccgtgtcagtagagtgaacgatccaagaatcaggatcaggaacatcaccaacaagaactgtagcttaaacaatgtatagttctcctcactggacaactagtagttcatattcaccaggatgccacaatatcagtgaaatgatataaatctatttgaaaaaaaaaaaa

SEQ ID NO: 86611 - DNA, 474 bp, Triticum aestivum
  Clone ID: PAT_TA_86611
cgcaaggctgctgaagcctgggccgccctgaaccgcctcccgctcgtcccctcggtgacccgtgcttgatggcgcgaagcgtggcaactccgtcgccacctacctcccgctcgtcccaactgagcgcattgcaagggttttcgccaacccggccgccgacactgcgcctgccacagctcctgagatgcagcccatcccgacgcagtaacaataagagctacccggagttctattattacctaatagctgtaggagtcagtatctcgttgtagtgtcttgtttggcttgtggtggacagtggtattatgtgtggatggtcactgtggtatccgcctgtgtatggaggcgagaatgctgctgctgtgcggcaacacctgctttgcgttttagttgtgctgcatgaacactgtgtgtaatgcttgaatcaaattacatgaaacacatctgtaaatcataacctttaaaaaaaaaaaa

SEQ ID NO: 86612 - DNA, 479 bp, Triticum aestivum
  unsure (1)..(479): unsure at all n locations
  Clone ID: PAT_TA_86612
gcaggcgctgctttcagaagacaatgagtccggaacagacgagtgaagatcattgctggatagtttcatagttcgatttctaccagtccaaccgattcatgtcctctggctatttttctgggaactactgtgcatccgaaggaggatatcactagtccacttgcagttcaactaatgatcgaccatgttccggtattttggaaatagtgaaatggcatgtgtgtcagatgatgctgctcctgatcatgaacctaggtaacatagaaatgtgtgtatttagttgtcattgctctgtgcaatgtgatctatgagaacagagtggtgtcatgtatatgtacaaatgttcttgcttttgagcaatccatgtacaacttttcatatgtaatttactggatgttgaatgatggtcattgattatntgtatgtaaacataatntggagccttcctaatatatggacacagtgttgattaaaaaaaa

SEQ ID NO: 86613 - DNA, 487 bp, Triticum aestivum
  unsure (1)..(487): unsure at all n locations
  Clone ID: PAT_TA_86613
gcaccccagttcctttttactgatccgtccgtctgacacctacgtcaattagccatctgtgctcgtgatgggagagaccagcgttcagcccctggtactgtgtaattcatcgtgtacctctgcatccatggcatctctatgtggacggaacttaaaatccaggacatcatggagcggtggagaagaactacgctagggttctctctagcaagttttgctgcgttggtggagcaggaaagtccgagggaatcttcaaggagatatttatggaagacaactctctttttttagttgggtgatcttctgatgtacggatgaatgggcatgacctttttgtaagatctttctgtttctgtgaaccggacgtgaccaagcgtaatttttctgaagnctctttcntatttgggtgtaaacctttttaagntangtgtatttttttcnagtcttcaagtacaacgtgtcttttaantgggtccaagtaaanaaa

SEQ ID NO: 86614 - DNA, 571 bp, Triticum aestivum
  unsure (1)..(571): unsure at all n locations
  Clone ID: PAT_TA_86614
gaggagagcaccaagggaacatggtctgatccaatacgggtttccgctactagagagcagagggggtagatcatttcccattcaggcacatgaacacccgatcaagcacataatgcaccgggttgagctgtttgttcgtccaggtgtatctagcccctgatctagccacttcccgaagggccatagatgcaatagcattattaaacatggccacccgaggccagttaatattattattgtttttgtccactcccgagcggatcaaattaaaatcacccctacaagcatgggggtggcggtcgcagtcaccgcaaggaccttggcgtggattctcccaagaatctgccgatcncgagtggtcggnaggaccatagacctaantcaacactaaccatggngagacgacgaatgcnantatgccacantgaanantaccactcctaggcatcagtcatacaggaattactcaccccangacatcaccgagtgcctacgcggncacatgggcatacaatcctaangtcantgatacattatggaatggaccaattgacgttcgtaactcaaacnt

SEQ ID NO: 86615 - DNA, 571 bp, Triticum aestivum
  unsure (1)..(571): unsure at all n locations
  Clone ID: PAT_TA_86615
gtccctaccaaagagccttggaggcctaaaaaaccttcaaaaactgaacctcgcaaggtgtgaaagactagcgtcnattccagagagccttggaagcctaaaaaaccttcaaacgctcaacatctttcattgccagaaacnggatccctncaagagagcctgggaagctccaaaaacttnaaacactaagaactcncaagttnctatnaactaaaatcccttccggagaacttgggggnctcaaaaaccttcaaacantcaacctccttccatnccccggactanagtacttccaaagagcgttgggagctccaaaacctcaaacatccgactctcaaacggtgggaataagggcctccaaagaaccttgaaagctcaaaaactnaaacatcaactctcatctggtataaactaatccttcggagagctngaaactgactataatccgagagtttaatgagttaagnatggtacaaagactcaattatggcaaggttaaacaccacaatccctgggtaanaatcggnacgtaacnagggtgttttacaaattccgatnaaaatgacnaanc

SEQ ID NO: 86616 - DNA, 587 bp, Triticum aestivum
  unsure (1)..(587): unsure at all n locations
  Clone ID: PAT_TA_86616
ttttttttttttttcttcggggttgatgcggtagggcactttgttcagaagcggagctccggggatgaggtagatgcggtgctcaatgcctcatagtggaggtagtcttggaggttgctcatcgaggaaaacgtcgtgaaattcctgtaaaagagaagataacactataggaagggtgtgagaagtgttagtttgtggtgcattgtccttgcacacaatgacgtagtgtaggaaactanatgggttctcacacactcctcttacctcactttggttttcaaaaaggactaggttattcttttcgctcatcgtggaggtgttcnatttgggcttctggcactcactctctttttggtggtcacctctcactatgatcccacaatgggtgggttgcttatcggcgatcacttgacttgggaacattggacggaggactacccttcccntcatatgaanantatggttgttcngcgtgtggtgaccctttacaaattccatggctcaaggagaaatacaaatatantggatactccacncaagtgtctcnagggcaattaaaganatntccaatnccacttggtgngccg

SEQ ID NO: 86617 - DNA, 456 bp, Triticum aestivum
  unsure (1)..(456): unsure at all n locations
  Clone ID: PAT_TA_86617
atcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtggtcatctctgccccaagcaaagatgcccctatgtttgtggttggtgtcaacgaggacaagtacacctcagacgttaacattgtctcaaatgctagctgcaccactaactgccttgctcccctagctaagatattaatgacaacttcggtattattgagggtttgatgaccactgttcatgccatcactgccacacagaagaccgttgatggtcctcnagcaaggactggagaagtggnaaggcncaagcttaacatcattccagcagcactgg

SEQ ID NO: 86618 - DNA, 562 bp, Triticum aestivum
  unsure (1)..(562): unsure at all n locations
  Clone ID: PAT_TA_86618
gtttcactcatttgctcgtggcagtcaacaaagttacaaaaatggaataaagccaagcctatcaagaaccttgattcaagcactgccatcagtttcatccgagagctgatatttagatatggggtccctcatagcatcatcacagataacggcaccaactatgagtatgatgagttcaaggcgttttgtgcttctcagggcactcgggtcgattacgcatctgttgcgcacccgcggtcgaatgggcaagcagaaagggcaaatggtttgattcttcaagggctgaaacctcgagtgatgcgtgacctcaagcacgctgctggagcctgggtaactgaattgccatctatcttatggggactgagaacaactccgaatcggttggctgaccgaaatcctttcntcctggtgtacggtgctgaattgtgcttccgagtgactgctgcanatgccccccccccccccgatggaaccctcaataagcaaaagagacaccacncaattcattatncatgggggaggaacananatggtccaatccggcgacatcttaaaaagctgg

SEQ ID NO: 86619 - DNA, 425 bp, Triticum aestivum
  unsure (1)..(425): unsure at all n locations
  Clone ID: PAT_TA_86619
ccaacgacagcgatgagccagggagagcaatcatggattcgctacggcatcgacgccccatctcaaggtgtggaaattgttcttaccttgcgtcctatccctagccttgaacaacatctctctaaatccatccctgatctgcaacacctttttttgggaggttgcaggtgtgtacggcatatgtttgcgtaaatgcccgtattggaaagacttctttttgtgtgcatcttcttttgttcgaaaagggctagctttcaccgtgaatcattaggacagtgtggcatatgaggtggtatagatggattagttacaaatatattaggtacttgaactacttatcatgatcctgatttcgagcgtttgagccgagatcgatgaccgtgaatcataaggactgttagagaagagaagaaaaagtaggaaan

SEQ ID NO: 86620 - DNA, 320 bp, Triticum aestivum
  Clone ID: PAT_TA_86620
agcgacttcctcgacgggttctccatcaattcctccacaatagacgaatctgcagagaaatcgtcgtcgtaatgttttccttttcttgttctttttttcatgctccggagggatagaacagcgagatagctcaatgattttaggttacaaaaaaaaggtcgtagtgtcctccaattcactgggggaggttgtaattttgtggttccactctctgtatataagcgtccaaagtatgaagagggacatgaaggtagtagctttcattttgcaagaaaaggatcaatcgtattgcttgtgtttcagcatcgaaaaaaaaaaaa

SEQ ID NO: 86621 - DNA, 497 bp, Triticum aestivum
  unsure (1)..(497): unsure at all n locations
  Clone ID: PAT_TA_86621
gcgggcacaagatcctgacgaggagcgggaaccagttcggggcggaccccaggtacgtccgggtcagcatgctcgacagggacgacgcctacgacatcttcatcagccgcctcgcctctctcaaatgacagagccgtgccatgcacacggcaaaaaatgcacgattcacacgcgaaaagtagatccagccggagatgcatatgaccgaagagcaactctagcgtcgtccgtggagcagtttcgaatggcaaatggagaccgccgccgcgacgtctacgacggtggctcgccgcggcatccttcgtcatgccggtcctgaggctgagcatcagtggtagtagtagaatagtccgggtaggaagaagaggacaaatgatttgttttggttcgattcgcgctctgcttgttttttttttttgaactgaaccgtggccgttatgagcgttggcctgttggccagttaattctattanattcatataaataanttttnagtg

SEQ ID NO: 86622 - DNA, 572 bp, Triticum aestivum
  unsure (1)..(572): unsure at all n locations
  Clone ID: PAT_TA_86622
cgaagctccacttcatacaaggacacaattgtttgtaaagtttattagggttatttactaccagttcaagcatggctttcaacgtacacatgattccagaagtagtgaggacaagggcaattctttgtttctggacgaagcatggttttcaagagacatattcctttaccggctttccaaggatttcttggcggtaatatttgaagctcaagtcgtggatggggaccttctgtcacgggctaggaaactgaagacgctcctggagaccacgtttgggtgggatctcaagaacaacgcggtgaaccttatcgatgaggacgatgagtttgctcccgtggtcgtggagatggacggctcctanggcgcgcacattccacggaatctcacgacgtggacgcaccgagttttagcaagtaacaaagggacatggtgaggttatcagctggctgcacctttctgaagatggatgcttagctcacgtcagaagagaagatggatacntgcttcactggcatctaatatattcccaacgttactgaaatatcaggattcaactgctggntcacacagaa

SEQ ID NO: 86623 - DNA, 579 bp, Triticum aestivum
  unsure (1)..(579): unsure at all n locations
  Clone ID: PAT_TA_86623
agaagagttggattgcatggctataaaccatcatcaacatcattgtccagtccgaaaaagctctctctcactgaaggtgaacctttgagccaagaggatggcaccagatacacaagcttggtaggtgcagcaggtcccttttttttggtcggacacatcgatcagaagaagtttgacctgaaccaacaccattcgagcagcagcagcaccacagaaacaaacaaccggcaaagatcaagttcatgaagtacctgtgcaattataccaagaacaaactagtactagtattagattagatcacccgacgaatcgcatttagttagacgtagaaaaaagcatcaaaatacggcactatggcccccaaaatagcagtagcatcacagaaacggctctagttacagcagccgtgatttcatcttcatacgtgcgtacgtacgtagcagcaaaaaaggcttgacaacccgggcgagtcgaatcacagtcggcgcagccgccggctctcctgctccgggcgcgtcagcgatgaggcggaagtcggagggggggccggtaccaatcgcctatgtgagtctatacncc

SEQ ID NO: 86624 - DNA, 323 bp, Triticum aestivum
  Clone ID: PAT_TA_86624
gccgtcggcttttctggcctatgtgtgcgcggtggctgggtggagggtgttcgccgtggcggctgggctgacggctctcggtgtcggctggcatggcatcatgagggagtgcagggctaggaagttgctcaggttcaacaacgtggttgctgctgtccatcaggaggatgctgaagacacggtgtgaacttttgagctggcttcagtcgcagtgagaaactatcagttggttcagaagtggcatgtctctctcatgtaactgggtgacgtggatttggagctaacacaacaattcaagtctcgaaaatcctaaaaaaaaaaaa

SEQ ID NO: 86625 - DNA, 440 bp, Triticum aestivum
  unsure (1)..(440): unsure at all n locations
  Clone ID: PAT_TA_86625
gagagagagagagagaactaggagtagtggcaggcaaggcctattggcctatgaactatggctggtttaggggatacgggatttagggttggactataggagtaggatgttgacgccacatatcataggagttattttcattcattaatattttgcgggtatccattgggctacccataagtgaaatttcatacccatgccctacccatatattttgcgggtatggatacccattacccatgggtaaaagatctatccaagtctttcccatgcccactattttcgggtagggtacttgcgggtacccatacccatgggaaaaactaccatccctagtcgtggcgctgcgaggtancggtcgacggtggagtcccatgaagctgangggcgcgcacgggcacaacagttgcaggaaaatcatgttgactggagccatggta

SEQ ID NO: 86626 - DNA, 437 bp, Triticum aestivum
  unsure (1)..(437): unsure at all n locations
  Clone ID: PAT_TA_86626
cgccggcgtgctgggccagctcacgccgcacccgtacagcgtctccaagttcgcggtggtggggctcgtgcgcgccgtagccggggagctggcgcgctcgggcgtgcgcgtcaacgccatctcgcccaactacatcctgacgccgctggtgaagcgcatcctgcaggagtggtacccggaggcgagcggcgaggagcaccggcggatcgtggagagcgacatcaacgagatggaaggcgtggtgctggaggtggaggacatcgccaaggcggtctgtacctggcgtctgacgactccaagtacgtcaacggcacaactcgtcgtcnacggcgggtcacggtngggaaangaccaacatcccggaccgggcaatgaaaggaacatccgnttcanctatgcnctaccggacaaccgttattccttaanattgcaaaaga

SEQ ID NO: 86627 - DNA, 363 bp, Triticum aestivum
  unsure (1)..(363): unsure at all n locations
  Clone ID: PAT_TA_86627
nccangcaggccgccanggagcatcatcaccagnggnctcgcacgcngntgcattgtgcanatctcanacgncancggtggtgcctgattctttgtctgtggttcgncnactcctacntgnaccggcangntccccganagggagatcctcangctcgtgaaggacaantttgacttcaggcccgggatgatcagcancaacctggncttgangaaaggtgganacatgttcatcaatacngctgcntacggtcactttggccgcgatgangncgacttcaccngggaggtggtgangcccctcangttcgacnaggcatctggcntaagagcatggngttctcttggngctgctgnctctca

SEQ ID NO: 86628 - DNA, 428 bp, Triticum aestivum
  unsure (1)..(428): unsure at all n locations
  Clone ID: PAT_TA_86628
gcaagattgacagcagcggcaacaacaacgacaccacaagcagcacaaacaacagcaacaagcagcaacagcagcagcagtaaagagaaagagagacttgaatacttgatgttactagggatccttggcgcaagtatgacataccagactggcctaaagccaccaggcggcctatggcaggacaacatgaatgggcactatgctggcaaccccatcctccacgacaccaacaagcaccggtataatgctttcttttatgggcaactccacttcattcatgggctcgttctgggtggtcctcatgctgctcccattggacatcccatggaacacgacctgtcactctggccggatgcatcancattttgctggncatgcttacctcctatttcctatgcagcaagcattctaggattgggaaactcccn

SEQ ID NO: 86629 - DNA, 424 bp, Triticum aestivum
  unsure (1)..(424): unsure at all n locations
  Clone ID: PAT_TA_86629
cccaaaagtacagggagtgtgcgatgatgatcatatcaatcttggaactacttccaacacacatcgtcacctcgccttttactantctctgtttattctgcaactcccgttttcgagttactactctttancaactgaaccagtatcaattaccgaggggttgctataaacactantanagtacacatcaataatctgtatatcaaatatacctttgttcacttttactaantctctgtttattctgcaactcccgtttcgagttactaccttancanctgaaccagtatcaattaccaagggattgctataaacactagtaaagtacacatcaataantgtcnacaanatatactttggtcaacttggcatccttcctatcnacaanatnttggngaattccgctcnangacatccctttcag

SEQ ID NO: 86630 - DNA, 543 bp, Triticum aestivum
  unsure (1)..(543): unsure at all n locations
  Clone ID: PAT_TA_86630
aacatgttcaatagtatattccaagaagcatgcctcnacatggtgccaagtctagattttggacattgtagtgtgcaaagaaatgagtacactggaaaaacantacatgtacattatttcttgttacacataatctgactgaaccaaaggatcctcctgtggactcctgcggtantacagcaccanaccaactagggaacatgcaccaatccaatacatgtaaccagcagttcagcaatatacttccccttgtaacacnnatatacctgtaaccaaattctgtcataggacctagnaccttcttctggaanggttggcagaccctagtgacccttcgaanagatcagacagttgattttccaagtcctctggggtgtacttatgtanttaccagaatttcntccattatccactagactaccatatctacccagaaancacgatagctggaatcacatttcagntatagatntcntgagctctcgcgtattgangtccggtaccttcacancgttgnccctgtaatccaacaaggnaagttgn

SEQ ID NO: 86631 - DNA, 517 bp, Triticum aestivum
  unsure (1)..(517): unsure at all n locations
  Clone ID: PAT_TA_86631
gcggcctaggcggctcaaccagcggcggccgctccccatcagtcctcctgggcttcgtctcccggactacccctgcgagatctggaaagcaagaggtagtcagcaccacaatgcaaccaacggtgtgtacaactgtgaaggaaggtcagctctactatgagtttgngcatgacacacnatagctgaaattgacttttcttcatttacaggttttgcttcactggttgtatcnttctcctttcctgcnntcntcgcttgcctattgcagttctggccaantcttggcagctattgctgtgntctctattactgtcaacaccgcctattcatacatcactgcagccnaggcatgcctctcctcnatcgntgctgcgtatgcctgcacngagcttgctgnggttggatcngacggnacggngttcctcccagttccanngctnctacatttntngaagatatgcccnntattgagctggggancattcgannggcagtcantttttatcangtctgggct

SEQ ID NO: 86632 - DNA, 378 bp, Triticum aestivum
  unsure (1)..(378): unsure at all n locations
  Clone ID: PAT_TA_86632
gaaataaaaagggtaaccacagatatatggtctagcatcacgaggttcagttagagattaaagaagactgaaattatgggctcgcagcgaggattgctgtgtctaacctgcacaataatgccaagaagtccttctccgagacgattaaggacatgtacctgcactacactgagagatctgggctgcttctttgtggcttccaaacttgaaatgtttgtttggaagttagtttagttttttgttgtgaattcacaacttctcacatgtaccattctcttagacttttagatttctaaanaaactaaatgaagatatggtggtatggtctcaatagtacaacttacagttctccatgttttaaaaanaaaaanaaaaaaa

SEQ ID NO: 86633 - DNA, 535 bp, Triticum aestivum
  unsure (1)..(535): unsure at all n locations
  Clone ID: PAT_TA_86633
aacgccctgcctgtccttttcccgcatctcaaggacgaaaccgttcgctctcggatgaagcttgccgagctcagtctccgttcggtcgaggccatcgagctcaaagtgcgcctggaaaatgccttggacgtggaaatctcctcgatgttcggacagcaactggacaccatcgccgatctcattcgcctgctcacgcagctgctgaggcaaaagcgcgatccgacatttaagggcgactttgagtttctcaagaagccgcgtcatcgattcgctgtcgacaagaacgaattcgccaagcgtgtactcgagaatacgaaccccgagctgttccccaagctcgtcnaggaatatctcgtcnagatgatcagctcgctgctgccttccgtaacgaatattgccaccgtcaagctctccactctcggtattcgctcctcgcaaatcgtcaatttccgaacctcgtcnaanaagaaccggntgttctctgatccacttccgtantgactcangcgtcacgtctcgacttgcnacaantacn

SEQ ID NO: 86634 - DNA, 336 bp, Triticum aestivum
  unsure (1)..(336): unsure at all n locations
  Clone ID: PAT_TA_86634
tctnactctcgtttcatcttccacgcgatccgccgccccttcctcgtttccttttccacgcgatccgccgccccttcctcgtttccttttccacgcgatcctccgccacgagcttgacatccaccttcggtgttgcgcctcggccacccagctccatcaagaagcggcgcatccatgtcctacccccatccatggccatcagganagcatgagagatttatgtgtgaaagcgaattagcgagactggttgggtacaagctctttctgacacgttcttattccttgatgaagattacgtgtgnaagagaattagngagggtggtggtgtagaagctc

SEQ ID NO: 86635 - DNA, 553 bp, Triticum aestivum
  unsure (1)..(553): unsure at all n locations
  Clone ID: PAT_TA_86635
ctcaacactaatcacgataaatgcaaacagatgcacgcaaccgctggtggcgcagactggaaccccgaggatcatgtctacttattcaacgacattcacataccatacgacgtctcaaaaaggcgtctggtagattcaccacccatgcctcactaacaacctagatactccaaactaaattctaacatattgttttcaaatttgtagatatatatcnctctccaccaaccgtttcatttctcagtctacgcatttgatatggagaacgagaagaacgagaagattcagatcatggaccccttaagagatacaagcaaaggagggcaggacattgaagctaggcactctaagactaaagtcatattgcgaaagcattgcaggattgcatggtcatctcttttccagactggaaacgcaatatgtcnagctggcagcatgagtccaacanatancagcacgcaacagttatnatgtttagtcaacattcgacacacttanttnatcctagcatggtaatttcagtgggacgcntcacgtcgctacagagaatgga

SEQ ID NO: 86636 - DNA, 301 bp, Triticum aestivum
  unsure (1)..(301): unsure at all n locations
  Clone ID: PAT_TA_86636
cccngggctggaggccnttcggcacgaggtcnantcctcctaaaccactctccctatccccgtgtccagaagctaccccccggctccaatggcggcgaaggaaccgatgcgcgtgctcgtcaccggcgccgcaggacaaatcggatatgctcttgttcccatgattgccnggggagttatgcttggtgcagaccagcctgttattctgcatatgctggatattgaatttgctgctgaanctcttaanggtgtcaagatggagttgattgatgcngcntttccatttcnnaggggatttgtt

SEQ ID NO: 86637 - DNA, 571 bp, Triticum aestivum
  unsure (1)..(571): unsure at all n locations
  Clone ID: PAT_TA_86637
ctcnaataatcgtctggtcaccgaatggtaatatatccaggtccttgataagtgagcatgcttcaaggaccttttcatacctctccctattcatttctgtgccgaaaagtatattatcttcaattttcccactctgtatccaaggtgtttggctaacataggagatcctgccacaagttttaacctctcctgataattttggtatctcaccgagtatgcaagacaataaacttgatttgccagatccaactgttccacagacagcaaccctcattccctgtcgtatacggaagttcacgtcntggagagtaggcacttgagaagatgtattccaagagaaatgancgttcgtcactcaatcgacacatcggtggtaccctaggaagcttagttcatcatcactagggagttctcaagacagaaaagacataccgtcagcatacttgtcgaatgtataagtatcgtctggtnacatggatagngtttgagcgtcnaatgtgcaggcaananacttacnttcantgatgccatacagcntccgaantgcatnnacaancaggngaaaagnggg

SEQ ID NO: 86638 - DNA, 546 bp, Triticum aestivum
  unsure (1)..(546): unsure at all n locations
  Clone ID: PAT_TA_86638
gccaaggacagagcgcaccggggtaatgtctacagtgccgatggtgaagtgattgcccctgaatactttgatgatgtgcgtgagcgtgcatcagaggttcaagacatcgtcgacagcgaccctactgtcatctcctctggggcacctgctctcctcacccgcgtggcagagctcttagacaatgagcggcaggacaaggttttcgatgttattctggagctgaacgccgttcagcgtgagggcataattttcatctaggcatgattgcatgatagtctctgttgtgatgctagtctgaacgccgttcaccttgtagatgtcatttttgtctaggcatgattgcatgatagtctctgttcgatgctgggctgaanattgttcaccgttggatgtcattttcttgcaccatgatacctcagttgcataaaaggannaaaaaatcanggggggccggtaccaatcgccatatgatctataccgcgctactggcgtctttacactcggacggaaaacctgcgtaccaactatcctganaatcccttcgca

SEQ ID NO: 86639 - DNA, 603 bp, Triticum aestivum
  unsure (1)..(603): unsure at all n locations
  Clone ID: PAT_TA_86639
cctgcagttgtaggtggnaaagctcatggagcaagttaactggatttgctgacaaaaattgcagctttgaaaatataactgaatttttacagttcactactcaagccattttaaaagttggatgaatttagttatctagaagatgactgaatttttacagttcactgctcaatgattgaattctggaagttaaatacctaacaaaattctcagttcactgctcaangactgaactactcaatgttgaacactttttcagttaactttcaaaattcagttaacagacaaagtttagttaagacaaagattcaacaagacagcaacatcaacagacaaaatttagttaagacaaaattaagttaacttctttggatcttgccttatatagcagcaacacacttttggattgttgcctatatagcaacangananacaacatcataacacatcacaagcncatcacacataaacacacanttatagcactcacatgcactacttgtcactactagttaacagacagacacacatnnctagtcacattcacagaanaaaaaaccagggggccgtaccatcccanatggcntagccccangcgcggtt

SEQ ID NO: 86640 - DNA, 503 bp, Triticum aestivum
  unsure (1)..(503): unsure at all n locations
  Clone ID: PAT_TA_86640
atcatgcgcatgaacgtggcgccaacattcttgaggccaaagggcatagtaatatagaaaaaacacccgaacagggtgatgaaagttgtctttatctcatcgggtccatacagtcggatctgatggtacccaaaataagcatccagaaaggacagtcgctcacatcccatagttgagtcgactatccggtcgatgcagggcagtggaaaatgatctttcaggcaggcctgattaatgtgcttgaaatcaatacacattcaaagtgnctcatctttcttggggacataatgacnttgggaaccactcggagtggatanccnccggataaccggngacaaaagccggncaccncntgcaancgcttcctcncaaggggggccanggaangccttaaaaggttnncttnggtcnacccaanggngctaaccaccccggggnaccgganttnagggtncaagaananttccntttcnaggggganggganggncttccnattcgggg

SEQ ID NO: 86641 - DNA, 273 bp, Triticum aestivum
  unsure (1)..(273): unsure at all n locations
  Clone ID: PAT_TA_86641
gtttttttttttttttttttaactaaaaacgcctatcaaagcagcagaaatatctcctgtatgtgaacaaaaaggaatatgcaacacactccccatcctccatatcccaaaattaacagaaagcacctagagtcctagactcaaaacggcaccaaatgataaaactatcagctaagagcatcttccattcttctgtcagctttgtgtcgggcgacctttgtacaccaagctangctcacnggnctttcactngattaancggaancaaaaggg

SEQ ID NO: 86642 - DNA, 322 bp, Triticum aestivum
  unsure (1)..(322): unsure at all n locations
  Clone ID: PAT_TA_86642
gccatataggcccttgaaaactgacggcgacacctctcttcgggcagaatgttatgcatgagcacaatgcgcgataattttcagagtcatagacacgctgggaattagtgtttgcatttttgtttttatgacgtctgatctttagcggacaatgttcactcacacanggcatatgtgctaaaccaacnggttgttcattggaaagttatangaactccaggggaanccanctttcaggtgtnncacccattancccccaacncggtccttctngncctgttttaananaaaggggnnttgggggcnattcctntncaagggg

SEQ ID NO: 86643 - DNA, 314 bp, Triticum aestivum
  Clone ID: PAT_TA_86643
gcaccacctcttatgaattcttgacgtagtgatacttcttaccatcatttttcattcctcggtcccgtgttgtcgcaaccggaatgccggcaagtgaaccatgatgcgtgaaatcaatactcctagcaactagttgctacgtagctaatggacaataatttcattcttagcatgttggttattgaatcatcattctaagatagattgtgctacctagttcatttttcctggtgcactctttgatcaatgagttaggattgtgtcagtccctcgctctcttgatatatcgtcttgctctgaaaagcaagattgtt

SEQ ID NO: 86644 - DNA, 302 bp, Triticum aestivum
  Clone ID: PAT_TA_86644
ccgacgtcgggataggtggttaattaggtgagggtgaacagcaaaaagatgacagatatgtgtcgatcatttggtcattgatttgaatattttaagtgttgctatctccgttaaaaaaaagcttgtcctcaaatgaatatatctagcatcaagttagcgctagatacatccatttaagagacaagcttgggacggaggagtatgtagtatgttcatctgattgcatgaagcatgattgtgctgtgttccattcggagacaaatatatgtaaaaagttccattcgggacccaaaaaaaaaaaa

SEQ ID NO: 86645 - DNA, 501 bp, Triticum aestivum
  unsure (1)..(501): unsure at all n locations
  Clone ID: PAT_TA_86645
cgcaagtgcctcgctggcgaacagtgacctccctggcccgagctctagccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggacaggtgctcttcaacaacgacacaccgacaacactgtccgcaactttcgtcaacgcggcggcttaacagcgctcacacggcatgtnagatgggaaaatcgcgcgctcacgggaccaggcagataggtaactgccaagtgaanctgatggcnttcntggacacacc

SEQ ID NO: 86646 - DNA, 303 bp, Triticum aestivum
  Clone ID: PAT_TA_86646
cgctccgtctcgatgcctccgagggaaccgtctacttccgtctgcagatggacatcaagctctacgagtgctatgtttgacgaattagggtgacacatccattgacggtgtgtgtcaataaggatgctgttgttttctatgctcttcgatttatcttcgtgtgtgagggccggtttgtgtgtcattgtcgcatacgttgataagtatgcgaaatgcactgtatttttattcgtctttactgtttactgtgtaagtgttagtttaggggaggtatctcttctacatattgtctaaaagaagaaa

SEQ ID NO: 86647 - DNA, 563 bp, Triticum aestivum
  unsure (1)..(563): unsure at all n locations
  Clone ID: PAT_TA_86647
ctgccgtatttaacagtggagcagtctaagaatttgcgtggagcattcgacttcatcggcatcaatcactacctcgttgttcgcacgcgagcccacgacagcactttcaatctggagcagagagactactatgctgacgcatctgccattgcaaatccattcgaagatatgcaagcgggacgtcttgagtatgctccttgggctctagggaagctactggaccacctgaaactcaagtacggaaatcctccaatcttgatccacgaaaacggctacgcagacgcgcccagaatctcaggaaagatcgtatacgaggacgacaacagntcagantcctgcaagattatctggaattcncaactgtcaaaaggttcggttcatcttcctacatatatancgtgttatttacctgttcagaaaatatgtctagcanaattcatcggaactttggggtcaagcangaatcattcatcaagtgatcctancaatcggagtcngcgcantanctctgatatggaanaggttgnccgttcaggaacggntgacccngggatatctttgtn

SEQ ID NO: 86648 - DNA, 255 bp, Triticum aestivum
  unsure (1)..(255): unsure at all n locations
  Clone ID: PAT_TA_86648
gtctcgttctcttttcttgcttgtttcccaagaaggagaaggagaagagcggcggcgtctgatctcgtcggcggcggcgatggcggcgattcggcgtctgatcccgtccttcaaccgggtgctggtggagaaggtggtgcagcccaagaagagcgccggcggnatcctcctcccggagacctcnaagcagctgaactctggtaaggtcatacctgttggccctggaanccttaacaaggaaggaaanctgatccc

SEQ ID NO: 86649 - DNA, 344 bp, Triticum aestivum
  unsure (1)..(344): unsure at all n locations
  Clone ID: PAT_TA_86649
gcgntgccgcggnccgagcctntcntgtcngctnagtggctccactccaacctcacggacccnnatgtgaaagtanctnatncctcttggcatatgcctgcacaacaaaggaatccacttcangagtacnagntngctcananccctggtgcnttantctttgagtgttganggaatatctgacagagcatctaatctgccacacatgcagncanctgaaaaagcattttccgccgctgtttcttcacttggnatctacagcactntggaanattantttcattgaaanggccaattannccttgccccgnttggggatnttnngttttnggccacaaaaattt

SEQ ID NO: 86650 - DNA, 383 bp, Triticum aestivum
  Clone ID: PAT_TA_86650
ctcaatcgaagaaagatggccatggtgtttaccatggaggaggtcgcccagcaccactccagcaacgattgctggctcctcatcgccggcaaggtgtatgatttgaccaagtttcttgaggaacaccccggaggtgaagaaatcttgctgtctttagctggcatggatgcaacaacgaacttcgaagatgtgggacatagcagcgacgctcgggaaatgatggatatgtactacatcggcgtcatcgacacaaccacggggtgacggttcggctctacgtgtgcgataaggtttcgaaccatgtgcgagggacgtatctacactagtgttgcaaccggcacatgcttgaatctgaatcaacattttaatttaaaaaaaaaaaa

SEQ ID NO: 86651 - DNA, 586 bp, Triticum aestivum
  unsure (1)..(586): unsure at all n locations
  Clone ID: PAT_TA_86651
ggactgctcgccggcgacgtcgaggatggccggcnagctgctganagccgtgaggatggagcaggagaggaagggcatggtctcctcctcctacgacagccgcaccatccatgtcatgccgtactancagcaagtaaatttgtcgagctaacccgctgtgcaaattgtgtttgcttccattggtgaaatcgctgtgcaaactgaaataacaaggagaaattcagantgggagacgcaagaaaccaagtcaaagtgancaagatagcatttttgtttggaaaaatgtcgagatactcncagtattgcctgtacatgcgaccctaatttggacgcgtagtggagtggatggctactcttgttctcttctgaattggtggtgtgctactgtgctatttantgcctttcgcagtggtttgttagttcagtcaatggactgatcaacacacaccngtcgacatttcgataagacgatttatacaaaaangggggccgtancaatcgccnatagtatctataccgcgncactggcgtctttanactctgacggaaacctgnntaccactaacgcttgagaatccctccantg

SEQ ID NO: 86652 - DNA, 566 bp, Triticum aestivum
  unsure (1)..(566): unsure at all n locations
  Clone ID: PAT_TA_86652
tggccgacatgagcttttattatacttatacaccagtagtatagacagactgaagcatcaaaccggaagtaagccgtcgtgtcacagaggaaaaggaatcatcactgtacgaaaagagaactccaacgacacagccatacacactcctgcagaatcttactcctcttgcaggagggacgacgatgaacccaccggcttactggatgccgcattctcctccgcctccgcgtgaccgctcctcatagcaggcgtatcccagtggcggcgggggtgtgcgcacgccgtagccgtagccattgctgtagtagtggaactgggcaggcgcaggggctggatagcacccggcgtgcaacggtacgacgtgtcccttctcgcatcgccgcacacggtccttgcaagcctctcgcactctctttgcagnctctcgtactctcctccaagcctctcgcaggctcctggnagggtctctcccttggttgtctcgtcacctatnaagcgcgggaacanactctgagctctcacgannacacgggtcgacgtgcgacacgtangtgatttctgncatg

SEQ ID NO: 86653 - DNA, 552 bp, Triticum aestivum
  unsure (1)..(552): unsure at all n locations
  Clone ID: PAT_TA_86653
agttcctctcactgcgaggatgccatgaaatctgccatctgccgagttcaataggaggtctgaggcagcttcagactcttgatgttagacacacctccatagtcaccctgccggtgaacatcaccaagttagagaagctgcagtacatccgtgcgggaaccactgctccagcaaatgaagcaccaacaccacatcatttagtgccccagctgtccaattgctgtggtggcatcacctggttggtgttgtgatgcctccagggattgggaaactgactgcattgcacacacttggtgttgtcaatgtcagtgcttcagggacaaaggcncctagaaatctcaaggactcaccattgcacaaacccngagtgtctggattaacaagaataacacangantttcccgcgcaactcattcctgtccatctggaacacgtcgtgcggtcnaggacaacatcaagtgtttgaatggataccgcgccttggaggctgangactaaaatcatgggctgggacattgcaacggatggcaccacatctncaagatgattgat

SEQ ID NO: 86654 - DNA, 440 bp, Triticum aestivum
  unsure (1)..(440): unsure at all n locations
  Clone ID: PAT_TA_86654
ctcgtgccgcttgctgccacttcattatgcaagtttgcctccaatgtctgcaaatatgaagaaaattccttcagattttgttaatgaaagaggtgaagagagatgatggtgaggagtttgtgtacgattgtcgctgacctgttgattccccgatctcccatggccgcctcccagatttgttctaggctgttaggtgagatctttgtagtggttgatggcgattggcgtgttttgttgtgcatgggatcggacaaacgggtcagatgtttacccgacccgtttagacgaccaggaggtttttttgctatctgctgatttcctgctcgctcacgtgtaatgtgttgattggcaaggaaattgactgttttcaaattgaaaaaatcaaatgtcaaatagacanatttaagaactttgcttgggggaacaanaaaaaaaaaaaa

SEQ ID NO: 86655 - DNA, 543 bp, Triticum aestivum
  unsure (1)..(543): unsure at all n locations
  Clone ID: PAT_TA_86655
tatcactcttactcactcagcagcagatcctcctcctgaaggacctagtggctccccaattaactttgagatgattgtgacccatcggactcatgcgcttcagcaaagcatcagacagaccactaatgatgctcggattgagaatccagtcgctcttgtggaaaatcatcacctttgtcggaggaacatggagggtgaaaaggtgcttcctaatggccttatctggaagcgtctgctcctcctcctgtgctactcactgaagatggtgctgagattgatacctttcaacccgccgtgctgctcctccaanctctttgatctccgtcgccagagcctccactccttactcctacactttgttgcaatctagaganacccaagcgtgcaaatgaacagaaggtgagagtgtggaccagagttgacctggatgaatgttgggtgactcaagaggngaagatatgacaactctcccttaagcataataacacaggtgcaaaatctcaaagacacagaaangtattcatagtagacacgacaactctc

SEQ ID NO: 86656 - DNA, 551 bp, Triticum aestivum
  unsure (1)..(551): unsure at all n locations
  Clone ID: PAT_TA_86656
gttgtttgatggtttaccagaaccaaaaagggttgtgcaagttaattagtatcaatgtgcaagtatcttccctgtatgtgcaactgtaacatctccaagtactatgccatgtaaaaaagaaaaaaggaaaaggaacaaaattgtatcattcttagggttaaacaaagcaccaaacagcggttcaagaaacagaatgtgcaacctggggcaaaaaaacccaggtgaaatgtgcaactaaacatgtattaggtgtgcaactgaatgggtaccattgtgcaactatcatgcagtcaatggtagcagataaaagaaggagcaaaaacaaaacttaccattgtaccgttagattccttccatggggtttgttgagagtagancaacacctgtaggcattacctcctcatgcttaggaccctttggntcgtattggnaatgtacccatccaaanctatattgaacacatgaacacacacatcatgctgtcaagaaaaaagaaaaaaagcttgtatcacgtagtgggcatatctaaaagaaacacaactgcatgcagg

SEQ ID NO: 86657 - DNA, 548 bp, Triticum aestivum
  unsure (1)..(548): unsure at all n locations
  Clone ID: PAT_TA_86657
caggctcgccgtctgggcaacagcgagcgccggtgagcgcaacgaaaggaagccaatcgtcggcgtacgtcaatgattcgggcgcctgcggcatgtatcttggtgaatgtacagagctaatgttcaattcattttctcagtttttagagggtgtttcggactcaagattgatctggtaatgcacgtggtgtggtgtgaccaggaatatctgatctgcgccatgacaatatggccttgctgcagccatgcggttcttcggagtatggtgcttcgatttggttcctgtggtgagcgtatctggagaggtcgcaagcagcaggggtcagcggagcggctgctgcggtcgacagagcaacangagcaaggagctcgagacgttcaagaagatgctacaacgatactgaactggatagagtgcttataagtatgatagtatactaaagaacatcagcataataatggactgccactagtgttgattttggtgtgtatatnaggcccaaatatgtattaaatgacacacgtatccgttaaattngagnagactt

SEQ ID NO: 86658 - DNA, 577 bp, Triticum aestivum
  unsure (1)..(577): unsure at all n locations
  Clone ID: PAT_TA_86658
cgaacataggacaagagtcctactaggactaggcaaaagaaggaagcggcggctccctggtgcacgcgcgctatggcctcttggccggccggcggctagtggcttgggcctttggcccaaggcgctgcggatttttttttaaacggtctcacgcgcagaaaaataaataaaagaaaatctaaacgaactccaaaattaataaagtaaattttctccgactcctaaaaatgagccgaacaaaatgaactttactccgggcctaaaaagcaaattttgaaaacgcacaattttccctatccgaataaaatgcgaataaacaccggaaaacaaagtttgatctatttattaaatctcatttttcctatattttgggaaatcatataatccctctcttatatttttttgataacggaaaaattattgaagataaaataaataatcaatgacctctttcaattcgagaaaactccaatatganataacgaaatctcactcttcaanggtcctgagttnntgaaattcaggnngacaaatgnagaaataatagcatgagatcatcaaataatcaagggcttgg

SEQ ID NO: 86659 - DNA, 282 bp, Triticum aestivum
  Clone ID: PAT_TA_86659
ttttttttttatgtgaataaagtatgtcaatatttgcatgctcctagtacagcccattcgactacatttaaaagaattttgaggtacttaaactttacagaaggacttggactgcatattcccaagtctccatttatgcatgttactgcctattctgatgcagactaggcatcgtgtgctgatgatagaagatcatagtcccgacggagactacatcttccttgggcccctccccctcggctcggcacacaccgtcaccgtggcgtggcaacaaaggggggg

SEQ ID NO: 86660 - DNA, 584 bp, Triticum aestivum
  unsure (1)..(584): unsure at all n locations
  Clone ID: PAT_TA_86660
ggggaggagggagtgtgcgcccccgagagctaggctttggtcgccgcccgacttgccctagcggggacgacgtggggctgcggggtcaaaaacatccaaaaggatcatcccaaaatgagtgactaataatatgccagtacgaatgtgtgtatggaatatagctgcgctgataaaccagttatttaattactcctttttgaaaagaaaaagggcaaaatgggaggaaaagcataaagcagagccagcacaggaaacatcaaactcaaacatgctctctagaatgttcaaaaangagatgataagttgataaccactagcactacaaccatttctggtcctcatttcacaccgaatgcgtccaaactctaaccagtactggtactggagtagatggcgtgcaggtgacatgttccaattgtctgatcgactcttatacanacctgcctacaattcangagaatctggcatgtaccatgccatagtggctatggcatgggtcggtaaggtctggctccgcatgtacatattgatgatcatggatagtatgaaatggaattcattgcgctcagggccgntcacgtttt

SEQ ID NO: 86661 - DNA, 593 bp, Triticum aestivum
  unsure (1)..(593): unsure at all n locations
  Clone ID: PAT_TA_86661
gccagtagtcatatgcttgtctcaaagattaagccatgcatgtgcaagtatgaaccaatttgaactgtgaaactgcgaatggctcattaaatcagttatagtttgtttgatggtacgtgctactcggataaccgtagtaattctagagctaatacgtgcaacaaaccccgacttctgggaggggcgcatttattagataaaaggctgacgcgggctctgctcgctgatccgatgattcatgataactcgacggatcgcacggccttcgtgccggcgacgcatcattcaaatttctgccctatcaactttcgatggtaggataggggcctaccatggtggtgacgggtgacggagaacaacggcgcctcccaggatgcgctggtgcgccagtacggctccaaccggcgctcttcgccgccgacttcgtggccgccatgataagatgggcaacatcgcccctcaccgggtcagcggcagataggcgcaactgaaggtctcaacagctantgattgtcncaaatgataattgatagcacgtatatgaatgtccaagtttggttgcacaaggtaacaacacatcatcatganaataa

SEQ ID NO: 86662 - DNA, 540 bp, Triticum aestivum
  unsure (1)..(540): unsure at all n locations
  Clone ID: PAT_TA_86662
aacacatccatggccggcgcgggcaagcaggccatccgcaggggcggggagcagggcggccgcgcttggcggatgcgagggcggtgagcagggcggcgccgcgggtggagagcagggccgccgcactagcagcgagcttggcggatgctcaggcgacgagctcgccggacgcgcgggcgacgagcatgacgcgcagcggcagctcactccaccgtcgactgctcancgcaagggcgcgactgcttcttccctcgggcgcgcggcggactcttcactccgggcgcgccgtgtccactccctcgagcatggcgcgttacggcaactacagaggactcctccctccggcgtctgcacccgacacgnactgggccgcggtntccccctctctcccaagnacaacnacacgtcggcngcgtcggnacaagtccggcaacttgttctgttnncgncacaagctagcangagttagaagtggagtgcgnatgttctgtggattcccgcanaaaagtacggaataatacgttctcatnagactatntt

SEQ ID NO: 86663 - DNA, 556 bp, Triticum aestivum
  unsure (1)..(556): unsure at all n locations
  Clone ID: PAT_TA_86663
ggatgctcaacgtcacctacgagaacgaccacaaccacgcgcagccactcgacctcgccacgctcaccgccaactccgaagcctgaccgaggctgccggtgccagaagaactctgaatttctatgccatggatggagcatgccattcagcctgaccaaatctgaatgcaagtgaaaattgtatgaggaaggcgaagatttcgcctacgcgtctttcncaatgtatagtgagcacttgattgtccttttggattgtatcctgtcgaaaaacgctccgtgcaaatgcttgttaaattccttgtanaactagtactaactttgcttgttttgttttcagtgtactttgcttgtttaaccacggtgaagaatcacaattcatggcaaaaaaactgacntgacaaanctgcncanaaaancnaggggggccngtaccattcgcccanatgancgtttacggcgtcacgggcgtcgtttaangnctgacgggaaaccgtgntaccactaacncctganaatcccttccaacggngtatacaagagccnacgntgcctccaag

SEQ ID NO: 86664 - DNA, 571 bp, Triticum aestivum
  unsure (1)..(571): unsure at all n locations
  Clone ID: PAT_TA_86664
ttttttttttgcacgtgaaggactccgaaacggattgatattaggctaggcacaaggacacagtcgtatactattacacagaataatttacaacggatagttatacgtacacaattcaaactcctttggactaatataaaggttggggcaaacaccccggaacacccatggattagcagatgccagaacaccctacaccatgtttaccaagattgaagggagttcaacacaacaacatatcaacacacgccaagaacgatcggttacaccagccattcacgcgacacaaatccgaaggggcgacatacggcaggacacccagcaancgaaggacggaagaagaaacgacagaaacacaacttgggnaatatatactgaaacttaaggtatatttatnctcccaccctgcattcttgcaactccttatgaacacatggttccnggattagnacgacaaccacagngaggtatgaacagaacctctaagatacgatttatagaactcaatactgcttgcactgcggacaatgcaccactcacccttangttgccccgccnatcaccagtcacg

SEQ ID NO: 86665 - DNA, 562 bp, Triticum aestivum
  unsure (1)..(562): unsure at all n locations
  Clone ID: PAT_TA_86665
ccctcccccgccgcctccacagcaatccaccgctcctaggccgcctctggctggcgccaccactacgccgtcccagagcaagaacgccattctcgtgagcaataggcagaaagggaacccattactgaagcacatcaggaatgcgaggtggacgttcgctgacattgttccanactacgtgattgggcaatcatcatgtncactctacataagtctcangtaccatcttcttcacccagactacttgtactatcggataagggagtccaaaagaattcaaactccgtgtcatcttgtgccatattgatattgaagatgtagtaaacctttacatgaatcacaaggacatcactgctgcatgactgcaccttctgttggttgganctggagaatgtgnaagtactggagacnataaatgtttgaaaacaancagctgacacatcgcgancacacagtatgatattactcggtcatcatgctctaatcaaccgggtgttacaaacagtgtttcaacttggtcgccttgggcacttccgatcatggngctcatggagaatacnct

SEQ ID NO: 86666 - DNA, 524 bp, Triticum aestivum
  unsure (1)..(524): unsure at all n locations
  Clone ID: PAT_TA_86666
cagcgcctcatctttgccggcaagcagcttgaggatggccgcacccttgctgactacaacatccagaaggagtccaccctccacctggtgcttcgcctcaggggtggtatgcagatcttcgtgaagaccctcaccggcaagaccatcacgcttgaggtcgagtcatcggacaccatcgacaatgtgaaggcgaagatccaggacaaggagggcatcccaccggaccagcagcgtctgatctttgctgggtaagcagtccgaggatggcgcactctggcggactacaacatccagaagganccaccttcacttgggtgctcccctccgtggtggcataangcctggncatgggactgcttatnctcctgggtcacaancanttcttccgttcctcgatgggatgtcagnttcccgtctgnctgtcttgttgctacgtgctgtggtcagcgtattcggtgtgtctgaactgcnctgttgtgcacaaattggtgaactgaaagataatgagcctgaaaaaaaaaaaa

SEQ ID NO: 86667 - DNA, 536 bp, Triticum aestivum
  unsure (1)..(536): unsure at all n locations
  Clone ID: PAT_TA_86667
gccgaacgaggccaccttcgtcgcggtgctgtccgcgtgcgacaatctagggttggtggagggcggcatgaggctgttctctgagatggagaacaagtacaggattcagcatactgtacagcactgtacctctgtggtcaacatgctaggcaaagctgggatggtggatgaggcttatgagttcatgtcgaagcggccgcgtctcggcagcgagccaacagtcttgagggcgctgcttcatgctagttcagtacatggcaacataaggataggcgaaatgccgccaagaantattccgacctgggacctgacaatgcgcatcatttcgtcacactgatgaaaatgtatgacaacacgggtaggttggaggactccgagaaggtgaagaaaacgatgagggataaaagtttaacttgactgttggncacactanctcaatctgtagaaanccggatctcatgctcattggtggtgattctacaatctgccaactccggatctcgtataacatacataagatcaaattttttacaaac

SEQ ID NO: 86668 - DNA, 564 bp, Triticum aestivum
  unsure (1)..(564): unsure at all n locations
  Clone ID: PAT_TA_86668
ccgtcccgtccccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgagaaccattaccntcttcggcgtcaggaaccctgaggaatcccgtggggtgaggtggtgccgattacttgtggatcnaccggtgtcttcactgacaaggacaagccgctgctcattnaagggtggtgccaagaagtggcatctctgcccaagcaaagagccctattttgtggttggtgtaatgaggacattacactcancttaacatgtctaaagcaactcacacaaggcctgctccctacaaatatattatgacantcggtatattgggttganacacgt

SEQ ID NO: 86669 - DNA, 562 bp, Triticum aestivum
  unsure (1)..(562): unsure at all n locations
  Clone ID: PAT_TA_86669
gcggaacttccgatccaggttaatccccgaaggtttctctatttataggaatttttggcgttggtttcacgtcagggaggtctccgggctgtccacgagataaggggccacaccctaggggggcgcgggccccactctcgtgggcancccgagactcttctggcccaactccgatgctccgtggtcttcttttggtccataaaaaatcctcaaaaattggcacgtcaattggactccatttgggtatcccttttctgtaaaacaccaaaacaaggagaaaacataaactgggcactgggctctaagttaatanttatcccaaaatcatatnaaatgacatatnaatgcatataaaacatcatagatgggataatataatagcatgaatactcaaaaattatanatacgttggagactacctgggggaatatggangaaggctcgcacatgataatgaacncgagactgaacaaagatcngactanttctgaaaattanccanatataacatanccccaacgatggatgaanacgacccataccccgggganttaantaatan

SEQ ID NO: 86670 - DNA, 556 bp, Triticum aestivum
  unsure (1)..(556): unsure at all n locations
  Clone ID: PAT_TA_86670
gtggatccctggccaattgctcgtctccaagcaatggccacccaaggtgtaaccctagagaccttaccgaacaaagtaccattagactttctgaagaaaatcacgagtaacttctccaaggagctacagcttggtgaaggtgcctttggggaagtttataaggggattctcgatagtggtgaattggttgctgtgaagaaactcgcagaaaatcccctgtgccacgtgaaacaatatttgacaatgacttcaaaatattatggtgctccgaacatgaaaatatgtgaattggtagcatctgccgggaagcacaaacagacgggtgcagacatggaagcatattattgcagaattattgaacttacccgttatgaatacttcctaangggggcttgacaagtctgttggtgatttagtacattgaatgggacatacctcaagatataaagggattgtcaaggnggacatgacacgaagatgcgacttggatctcagaatattggcaagacaaccaatacacacagtgttgtggttcgtgtacatgcccaatatcaan

SEQ ID NO: 86671 - DNA, 549 bp, Triticum aestivum
  unsure (1)..(549): unsure at all n locations
  Clone ID: PAT_TA_86671
caccccagccaaacttctctctcgccttcgaagaagcagcagccgccgccgtagcatccatggcacccaaggctgctgagaagaagcctgtggagaagacccccgcgggcaagaagcccaaggcggagaagaaggtgccggcgtccaaggagggcggcgaagataaggggaagaagaaggccaagaagagcgtcgagacgtacaagatctacatcttcaaggtgctcaagcaggtgcacccggacatcggcatctcctccaaggccatgtccatcatgaactccttcatcaacgacatcttcgagaacttgccggcgagtctgccaactcgccaggtacaacaagaacccacatcacgtcccggganttcagactccgtccgcctcgtntccccggngactcgccaagcacccgtctccgagggcacaaggcgtcacanttcactctcctagntctcgtgcattagtctgtttcttctctcgtggtctgataatctgtnctacttgtgtttcnacacctcatctgtacatgtgtccnnataatatcttt

SEQ ID NO: 86672 - DNA, 224 bp, Triticum aestivum
  Clone ID: PAT_TA_86672
ctgcgacggggtccagtagggaaggggtccgatcacaggacaaggcagaggagccggctgctcaactttcatgatgtacattgctagcgtgaagccttttttagtggagggaaaggtccaaagtgtacgcacgcacgttttgttcctgcttcggttcgtccggtgaattgttttgaccagacgcggtcagctcccgacggggatgcatggagttttgtcactgg

SEQ ID NO: 86673 - DNA, 590 bp, Triticum aestivum
  unsure (1)..(590): unsure at all n locations
  Clone ID: PAT_TA_86673
ttgaaacgtgcagtgggcatggaaacgcccggcggggaagcggatcatctacccgacgacagtcgctacgatagggtagggagggatggcgtcaggataccacgcatcaaatacagtgaccccggtgccatcactcaggttgtcgattttgcgcgtgcggtgccgatgatggtacaggcggctgcggcgaaaacgatagagttggctaaggcgaaaatggaagaagtggctaaaaatagacggggttaagttatactacctaccaacttgggctttaaaagaaagtgctacctactaagccgtgtggccaaatgttctcngttcccaattgttgcctggagtgcgtcaatccgtggactaagaaaaagngaaaaacttctaaaaaaaggagataacaagaacgtaggaaattctaccgctgcaactttaatccncgtagacaancaactatgggtaaccttntaaaaanacnaggagttcananaccaattgnctccctgttcctggttctctaaanaggntttgccggnncaccatggacattttcgcaaatttgaaccananttcttcngaatttcaaaaaaaaaaaa

SEQ ID NO: 86674 - DNA, 599 bp, Triticum aestivum
  unsure (1)..(599): unsure at all n locations
  Clone ID: PAT_TA_86674
gatagcctgtgacacagaaaatacaagagttttcgcatgcttctactcatcgcagaccgggatatggagcaaaatcaactcactgcagctgcaatcgtttatgtccacgccagaacccagtactttgattgggaattccttttgctggttacttaaggtgcatcctgaccttcaacatgtcatacttgagtttgatctggataagcagagcctaactgtgacagacctgccaccacaagtaaaagctcgccctttcaacttgaggattgtgccgaccgaagatggtgggttgggctcatccatctctcaacatttcacggcaattatggaagagagacctgggtctgtatggtgcacgacagactattgaatccaggactcagntagttgtaaggagaccgatacccctcataatggggttccgangacattaatgcaaccttacagacgaatcngggtttnaggncanctcggtcaaggagttaagaaattcaatatggggactcatctcaatatcanttnntgctcanctgaggtcgcaatgtgatgncatgtgaatacttaaaattaanggtgttgtaaaatcagacagtatacga

SEQ ID NO: 86675 - DNA, 347 bp, Triticum aestivum
  Clone ID: PAT_TA_86675
gcctgcaggagggcgtcatcggcggcgccggcttggacgtgttcgagagcgagccggacgtgccgccggagctcttctccatggacaacgtcgtgctttcggcgcacagagccgtggccacgccggagtccatccgcggcacgatcgagctcgtcgcggccaacctcgacgccttcttcgcagggaagccactgctcagccccgtggagctctgagacaaggacaccatctgtctgcggtccgatgtggtctgaataaattgcagaactccttgatgtatttgtagttcagtgtaatccagtctctgagtgaataaaatctgtgagcaatcggtcaaaaaaaaaaaa

SEQ ID NO: 86676 - DNA, 329 bp, Triticum aestivum
  Clone ID: PAT_TA_86676
gtccaggaggtttgtcgacagccttgaacacccagatccagtaccccttgcattgttaacgcctgacgaagcgaatccagccggccaggaagcccggaatgttgcatctggatgcggcagcaagttgacggtggtggcgctggtaggccgagctgcggcgaccgacggtagcgggagatatcacccactgcgtccgcgcaatctattgacagggtaacccagaaacacttggatggacgaagaggataattgttttgtgttgtttaccgctgtacgttcattgacatgctcagcctggggctatattaatttatttttggtctcacttg

SEQ ID NO: 86677 - DNA, 172 bp, Triticum aestivum
  Clone ID: PAT_TA_86677
cctggacgtagatcagatggtggagaggtactggcctggtagctactgatgagtgtacgtaggctgtgtacgtgagacgcctggggtgtcaggcgattgttgactacgtaggagagcagggcggtttgagtggtgtttaatctagtctcttcgttgtatcaaaaaaaaaaaa

SEQ ID NO: 86678 - DNA, 391 bp, Triticum aestivum
  unsure (1)..(391): unsure at all n locations
  Clone ID: PAT_TA_86678
cgccgccgccgtcacccgtggtgccagatggctggactgtcgtgaccaacacgaccgacctggcgatccagcaggtagggcagtttgccgtacgcatctacgccctgagcacgggtaagctgcggctggggttcgtcgacgtcgtcagcggcatgacccggccctccaacggcgggttcgactaccagctggtgatcaccgtgtcggatggcccggcgcccaggaacaaccgcccgtacaacgcgtcggtctggggcatactcggcaccatgagctggaagctctggtccttcacccttatggtgtgatgcatgtatgcagggggacggatggatgctctgccggtccgtgatcatgaataatgttccctttgctntttaaaaaaaaaaaa

SEQ ID NO: 86679 - DNA, 367 bp, Triticum aestivum
  Clone ID: PAT_TA_86679
caggccctcatctcccgcgtcgtcaagcaggaggccaaccccaacccgcgcctcatccacacccttgccaccatccgcgtcgtcgagcaggaggccaggtagttcgcccatcccctccctctccccctttcgcccaaattctcaaatcaagggctgttaacggtttcactgtatgttcgctttagtttgatggtgatgccttcgaatgattttgatgtacttccctattgtgtagtgttggtgaatgctagtgttgtttttattctgtagtttatgaaggttttatcttgggagtttaaacattcatggtcatggtgtttctgatatagcttaccactcatgccaagtggtggtcgtggtgtattgt

SEQ ID NO: 86680 - DNA, 570 bp, Triticum aestivum
  unsure (1)..(570): unsure at all n locations
  Clone ID: PAT_TA_86680
tgcactatctaccagatgactcccctcgccaattggcttgcacatttctgtttttttatgtcatatcacttgatacttgttcaatataccagcattagtaaaacatttgctatatattcttcctgagatcatgcttttgctcctttctgaataatgctatgtttgaacagtccatttcctatcttttgtgtagggacgtagaagctaggatacatggtgcctgctagagtgagataaagtaggaggaatagcttgttcggaggaaacaatatgcaaaattcttaaattcatctacattagcaaatcttgagaaagtaggaggaagaaattatttaatggataaagaatcaacagtgcggtctgatgtgccctaaagatatatgttagacaccagaagtgcataaggtatcatgcatagtaaacaacagatgtagcnccgtaggnattaccaanngangctaaaaaggcagnggattnaaacccgantgttaanaaattggcaccccaaaaataaggttgnantgccancaaanagntnccatatgacactaaatttnanagtccaggaag

SEQ ID NO: 86681 - DNA, 468 bp, Triticum aestivum
  unsure (1)..(468): unsure at all n locations
  Clone ID: PAT_TA_86681
tcccaagcagttcatctcctcaaccctgagcccgccgcgcccgcctgcccgccccgatggcccgcacgaagcagacggcgaggaagtccaccggcggcaaggcgccgcggaagcagctggcgaccaaggcggcgcgcaagtccgccccggccaccggcggcgtgaanaagccgcaccgcttccgccccggcaccgtcgcgctccgcgagatccgcnagtaccaagaagagcacggagctgctcatccgcaagctgcccttccagcgnctggtgcgggagatcacgcangacttcaagacngacctccgcttccagagctccgccntgtccgcgctccangaggccgccnaggcctacctcgtggggctgttcgatgacacantctctgcnncatccacgtaagncgtcacatcatctaacgaatcaagtcgccgcgnatcatggcanaggctngatntgcatctggtg

SEQ ID NO: 86682 - DNA, 532 bp, Triticum aestivum
  unsure (1)..(532): unsure at all n locations
  Clone ID: PAT_TA_86682
ccggcgcacggccaaccatgggttccacgtcgagaagcaccaatcagcgctggcgctctggtggcagcggtcggagctcgtgtcagtgtcggcatggcggtgctgatccatcatccccttgattacagagcctgagcagcccggtacagttgtagttcatcttgttaccaaaacttgaatctttcgcaagtagtactactgtagtaaccaatcttggtgtgtgatatattacttactagcaatttgaggcatgaagaatggaaattcgagatgccgaaaaactgttaaccccccaacctgcgttttaattgttgatgctgtaatcctccagtgtgatattgtgtattatgccagtcatattttcagactgattgaagtttaagtccttttttgttcctccccttataatatgtttttgccaatggaaatcaacaaggatttcaagcaaatatcacagttaacactaatcattgaaactgtgtaattgactatacanatatatgtatcaacgantntgctgaaaaaaaaaaaa

SEQ ID NO: 86683 - DNA, 175 bp, Triticum aestivum
  Clone ID: PAT_TA_86683
ctcatttttcctgcagggaacgttttttcttttttccttcttctgttctggtcctcttgtatttttgtttagttgtccgagacagaccgaggagccttgtaaatagtgtttccgccgagaacagagcagaaccgatctgagatctgttggtctaaacggatcaaaaaaggggggg

SEQ ID NO: 86684 - DNA, 574 bp, Triticum aestivum
  unsure (1)..(574): unsure at all n locations
  Clone ID: PAT_TA_86684
gatctaagatggtcaacttactggatgtttcgtatactatgactgtatatgatgttttgctgtttctttctttgttctgatgggaaattcagtgcttcagtcagaaccctgtaagatttcacgctgctccaatcacccaatcagaactcgtgatattgtagatattaatggttctcaacttgcttcaatcagaactcatgcgtatcagctaaacctagtactatgaaaatttctgtaactataaatttcaactggtagtgttctgaacatcgaggatcaaactcgtgtttttatacttcatgtgagcaaaagttggacatgaaggttatttcgtttgcttgtttctacattctctctaaaccaaatttagtacttacgtaagcaggtatacttgtgtccnaatgctgaacntttacagaaagacatgatgagtagacctcgtttggaacccagcttgttanattacaccaagnaaggagacaantgaacaaggtccgctcanataaaanngtgtggtcgagaaatacgatnaaatagnntctaatgataacnctgaacctgcatactantntan

SEQ ID NO: 86685 - DNA, 598 bp, Triticum aestivum
  unsure (1)..(598): unsure at all n locations
  Clone ID: PAT_TA_86685
attcaaaggaaacaggtacggcccatccaatttagataaaatactcgatcggccttgcctgtttcctttgaatggcttcttccgctgaccgggtttagagccactgaatccagcgttgaccgatgtatcctcggtttcttcaatgttgttcccgaacctttgtgtttgtgcctcccgaccgtccgttggtcgtctctggcttcggaaggtcccggggtcnccgggactgtncttcaacnacctaacanatgtcttctcccgcgcanaaccgggtcataantgcggtaagggctgcaangtncttcggattttcttggccgangtctcgggctancaactcgtcaaancgctattttaaaggcngctagggcttcangttcganaatcgggatttggtcttttaattaanaccgatcaaaattncgggcganncccggttgcngacaantnacaaaggcancggtcgggggcaaananagtacttggaattnccnaatcacccaaatctccaattgcaaaanantcctgggaggnattacaangncngtggccctaattnaggggggntaangggggatntccacaacnttaantggaa

SEQ ID NO: 86686 - DNA, 553 bp, Triticum aestivum
  unsure (1)..(553): unsure at all n locations
  Clone ID: PAT_TA_86686
aatgatagtctctcaatgagttttttgcagctcttaaggtgcccggcgaggcctgaggcaggcacctcgcgaggtggaaactacttcaaacgtgctaagataagttgttcctacacgcagacgtataacaacgacgccatgacatagcacaggaacaataaatgcagcatgttaactcgaaaatcatagtttgttcanggccccaacggggcccatacttatctctctcaatgcaggaaggaaggaaaagaaacaaaagcagnaccgccttcagcanttcgcaaggaaggttacgggtctcaaaagtcagcaagacccaantcgcgctnacgaancacggcaaggacaaccctccgcctcaagggggccgtacaattccctanntgatctattacccncnaacngcgtcnttaaactctgacnggaaacctgggtacaactaacncttcanaatcccttccaactgngtatacaaaagccgacgttgcctccaaattccacctatgnaatggaccccttnccggctaanccggngnttgngtacccactaccg

SEQ ID NO: 86687 - DNA, 613 bp, Triticum aestivum
  unsure (1)..(613): unsure at all n locations
  Clone ID: PAT_TA_86687
cgacggaggtgccacggggccccatggacctgcgctccatgttcgggcacgacgtgatgctcgtccactccagcggcggcctcctccccgtcgacgactacggcgtgctcatgcagagcttgcagatgggcgagagctactacctggtcgcgaggtcaaattaatcgagctggctggttgttgattggtgtgaaatttgaaactggttcctccgatcgttggagacgggcgcatgcatggtgcaggtttcagttaatcgatctctcgatgcaaacggaagcttctaaaattaggacgtacggagtactgtactgtggagtggaactggcgatcgcacgatggatcgagaggcaagcagtcatcaaccgtgcatgcatgccatgcctgtacgtacgtgcctggtcgacatagcagcagcttatagatatagcggaatatacacatatagtgcacatgttccggtcaaacatatatccactatgtatcaacagcaaccatatcatgatacacgtcacgtaacacatggaacgataaatgttactatccaanttacttgccggcgtcgagcatcttactanaaatcccggaattctcgcanatattaccaanaaca

SEQ ID NO: 86688 - DNA, 595 bp, Triticum aestivum
  unsure (1)..(595): unsure at all n locations
  Clone ID: PAT_TA_86688
ggggcgtccacgcgcctgcgtgcagtttagttcccccggtgatgtagtctgtcgtcacgtcgtgctgcagctccacatcgctgcttgtgcagtgcacaatcgttgctgctgcatctcggnagcttgcccccgtgcatggtcgccgccgcccgtgcagttcggccagagctgcagctctctctcctcacctcatgcagttcgcggtgaacgacaaagatatggcagcgagacgcgaatgtctgaagctttctatgtcagagcgacgagtgaaggggcacgccaagtaggaatcagggnatgggggtctctggaactggccgttgctcctcgtttcnatgccaccgatcgttgatggatgttctgtacctccctctctttaggctactgccatgacactctcaaatgaaaaaattatggccgctgtaactgaacttttgtttgtcctttgttagaaaaacaatggactcaataactattgcagagaagacaaaaatcagatttanttgtattattgagaatcaantantcgttgtgtatacttattccatgtaaagaaatcaaacccagataacctcttgtaanacnttaatctctt

SEQ ID NO: 86689 - DNA, 590 bp, Triticum aestivum
  unsure (1)..(590): unsure at all n locations
  Clone ID: PAT_TA_86689
gggaggaggaggagagcggcggcgaagatggtgtcgctgaagctgcagaagcgcctggcctcgagcgtcctcaaatgcggcaagggcaaggtctggctcgaccccaatgaggtcaacgagatctccatggccaactccccggcagaacatccggaagctggtaaaggatggtttcatcatcaggaagcctcagaagatcactccagtctcgtgcaaggagggcacatgaggccaagcagaagggccgtcactctggatatggtaagcgtaggggtaccagggaggctangctccccaccaagatctgtggatccgaggatcccgtcctaggngccttctgcgcaagtaccgtgaggccaagaagatcgacaagcacatgtccatgacatgacctgaagncaaagtacatgtcaagaacaagaggtctcatggagagtaccacaatcaaggtgagaagnaagagaaagacctctctgacattnaggcaacgcncaagacaagnaancagganagaaattcagaaggagaaaatgccaggccnaantatcncanacanggtgaatcactnggacaanaagcaaaataatttt

SEQ ID NO: 86690 - DNA, 590 bp, Triticum aestivum
  unsure (1)..(590): unsure at all n locations
  Clone ID: PAT_TA_86690
aaactgggagtcccctaggaacaaaataaaaaaggtcccaacctcttgtcgatgcttatcttaaaaacttggcatgaattttgtttcttacatatatttgtccatggttacctttttcaaacaagctttagcttctacaatgggataaggcctcacatgagtgactgaaaaatcgtccctttttaaaatttacctgatagtgtcgggatttaaatatttcctcggactattgtttgcatgcataatttctgtcatgcaattctgaactatcactgttcggtacttgagaattaatagcctaggaaattttggctctccccgtcatgcatgaggtatgtgcaagttgaggttngtattgatgctacgttcacnggttaatacaatatctttgangaccacaatcttttgttgaacatgcttgtataaatcctcttgaggtgccgaatcagcacaaaattgtggcaggatgtccaagccatgcagtgtgacactaggaataagcccatataggatagaatcgttgacaagaaatgtataaatgtggcagctgnanaaagtcccancggaatgaatgatgntanaacntttgt

SEQ ID NO: 86691 - DNA, 552 bp, Triticum aestivum
  unsure (1)..(552): unsure at all n locations
  Clone ID: PAT_TA_86691
cgcgcttgtgctggtgccggtggcagaggcatcggcctgcgaccccgatccgatcggacctttctgtagacaagggatcatcgatggtcttaccggcggtccagattttatcaagccgtgttgcacaaatttatcaccaggctacatcatgtgcctgtgtgagatccgtcagcggatctcatcgagggcgccggaccatatcttctgccccaatatctcatgctgataccagcggcacgatatgtcctcgtccccgggagccaactcggtatagagtcgttctagctggaataattagcaacatctttcgagcgattcatggacttgatgcttagtccaaggtcggttatgtttgttttatgtccacctctataattatccctacttttctcatactaaatcgtattatcttgtatcgtgttgttgctctactcactcctgcaagctcaaattgtcaacaatctatataaataatgatgcacctgtgtgtccttcgtaaaaaaaacactcaatacgcataagggngcacatccgtaaagtagcggtcaaatn

SEQ ID NO: 86692 - DNA, 531 bp, Triticum aestivum
  unsure (1)..(531): unsure at all n locations
  Clone ID: PAT_TA_86692
gactgagcggcctgccgatcaaagttcaaacagtcggcgacatcggcgtcaccggggttttgaggcggcctagaaatgaagctcttgctggcctctacgtgaaattagacttaacccacactttactttcccatttgatgatcaccccacccctctcaagattgacggggccctgtaagtcagtacctgtggcaaataaccctgnagcaaatcatctaagaccatgtttggtaatccaccaactcccagaatctggaggaaattgcagctccgtcattttgaactacagcttcactagcttcgggagcggattgtgnngcaaantgacaccgggcctaaatcttgatagtgtggcaaatatctaagcgccttctctgatgatactaaacatgggttaacaaaatcctgatatgtggcaaatnatcnagcgcctcncgatgataccaaacatgggttacggaagatntcatggcaaaancctgacnttaaaaacatggaaatgttntcatgataaaaaaggggggccggtcc

SEQ ID NO: 86693 - DNA, 548 bp, Triticum aestivum
  unsure (1)..(548): unsure at all n locations
  Clone ID: PAT_TA_86693
gttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttancaagctcaaggaccttcagttctttgttggcgagagcatgcatgatgatggcggcgtggtgttcgcctactacanggagggagctgctgatcaactttcctgtacttcacatgggctgaaagaggcaagtgctaacgcactgtatgctaaactaagcgtctcagtattttgctctatcaaggttgtaatcaccctcaatgttggtgtcagtacntcaatttgatgtctna

SEQ ID NO: 86694 - DNA, 493 bp, Triticum aestivum
  unsure (1)..(493): unsure at all n locations
  Clone ID: PAT_TA_86694
ggcagacggaggcggcgctgctcggggtggcctcatctgcgtcaccggctccatgcatatggtcgcggcggtgctgcagcagcttgagcagtaactccccatggttgcagactcgcggcacatgttgtcagttactgtacatggctggcactggcaggcatcagcatcagcaggcaggaatttgttgtttgtgcaagggggtgacgctgtagttacatgcttacagtacaccagtacagtgcttacatggtcncnagtcgatgggattaagcagtgatgttaactttcataaagctaccagaaagcgtcgatgcgccgtgcatgtccttgtcttggttgtctggtgagagcgactagtcctttgccttgttcacactcacaccttggtagttgacctcggtcactttacaaagctgtcctttaancaataattactttgtcgtccnataattatcactacaaagaatatacacgtctgatgatggcaaaaaaa

SEQ ID NO: 86695 - DNA, 575 bp, Triticum aestivum
  unsure (1)..(575): unsure at all n locations
  Clone ID: PAT_TA_86695
agcatggcatatagcatatcatggattcaataattagccgtgagcttacaaaatacaacatgaatcacaagctattcctactgcatggacccactgtactgcttatttactcatcagcaacaacctctggctggggccccgaagttacctacgttgaggtgaactgaatgccacggagacgacaggaaccgacatgttcagtgccaatgtctcaggtgagatgagatcacaactgtacttcaacatatgctttgcccggtcatcgtttctatcagctagcatggattagtattgtactattattactatcatagtatacacttgcacttcaaaaaaagtgagatgacactataaaaactagtcagtcacctttcgcgatcacaacaaacacgtcgtccagagacacttcttaactcgacttgtgctctggattaatgattgcctcatcggtgttgcanccgtagccgtnacatctcgtcctctcacagcctcacattagtcagaaaccactctctgtcgtcagtaaaccacagacgttgaatctgtgcccccagaaaantccaaaatcgtnattg

SEQ ID NO: 86696 - DNA, 569 bp, Triticum aestivum
  unsure (1)..(569): unsure at all n locations
  Clone ID: PAT_TA_86696
ggtggttccggtacaataccgattaccccgaaactttcccgatggccgaaacttgacttcctatatataaatcttcacctccggaccattccagaactcctagtgatgtccgggatctcatccgggactctgaacaactttcgggttaccgtatgctaatatctctaccgcgcgcccctccccctacttcgatgtaacgccccgagtccgatgcgccaggtgtctcccagttattcgccgttgttgccatgtcttttgcctgcgtnttgcatttcatcatgtcatgatgtgcattgcatcatcatgttttcaaaactttcatccgtcccggtatccccgttctttcgttgcccgttctgactccagtcacacttgcaccgctcgcggatgttcaaatagatttanagtggccggaaaatgttccgggatgggttgaanttgcgtcggtctatatgtgtaataggcgcctgcaattcacgatcggagttnttgataccaacgttaacatgcggataagngncnactcgagtccgcccggaangcgcggccccctcttcnttttctcaacg

SEQ ID NO: 86697 - DNA, 577 bp, Triticum aestivum
  unsure (1)..(577): unsure at all n locations
  Clone ID: PAT_TA_86697
tgaaatatgattacagctatatgcatgttttttgttctcaagataatatttaaatgattgtataacttgacaacaatggtattcaaatagggaaaattgattcaaatttagtccatatggtagacaatatgttcatagggtggagtaaaatgttcatatatgatggaagatcaaaatgtaggactacatccattataaaccgcaaggtcacctaattatatattcgttcaacataacatggattcaaaaattgaaattcaagatcctggcatntgtaatcatataaaaagggacatgaccctttcttttggtgggaattgatttgttttttgttgtagttgagggaaatgcgaatcgatttggtactgtcanggtaatcttgttctcccgatttttacattttcttgngttttcaatggcatttatagcatatagtaaaaggggacatgactccctggtctgtatgaatgtttttgncacgtaanttgtctaccacaggatcccncctgtanccgaattcaacncnagggggccggacaatcccnaannagccgatacccccacggcgtctttaant

SEQ ID NO: 86698 - DNA, 427 bp, Triticum aestivum
  unsure (1)..(427): unsure at all n locations
  Clone ID: PAT_TA_86698
cagctgtctcctgtgggggaagaggtgcggctctcgccggctttgtatccggcttccctgctgttgctatcgattgtgtgctgcactgccgcatgcttcgtagagtcctgattgtgagttggtgctcgctactgttcgaaagctgtgaaattatgcgcattgcatgtttcacacggtcctgactgtgtttgttgctgcttgccactgttggatgagtcatggctcataagtggatgctcttttgtgcagtaggatgatagctctgtcctttttaggtacattcgattttttttttgtttttgcaaggagggatcgtggactttggatgcaatagaaagagatttgcccctctagttttagagggcggtgaatctgatttaatatgataaaaaaaatagaaattgcgtccaaaaaaaanaaaaaaagn

SEQ ID NO: 86699 - DNA, 581 bp, Triticum aestivum
  unsure (1)..(581): unsure at all n locations
  Clone ID: PAT_TA_86699
gtcttgtctggcttacgcaggaagcttcgtcgtctacagtccactgcacccgcttgaaccacacttgcacgctagtttcttgcgccaacgagcgaattttttttgccaccgcagaaatatctatgtccccgccctctccctccattcaaaagccacatttccactgttcctccttgttttccaagttcaaaccttcactcctgcatactggcagtgccgcctcctcgccgacgacccttcttcttgcagtgctgcctcatcgccggctacccttcttcttggagctccgcctcctcgccggtgacccttcttcttgcagcgccacctcctcgccggctactcttcttcttgtagcgccgcctcctcgccagtgaccttcttcttgcaacactacctccgcgctgtcgaccttcttctgctgcgcggctccttgccgccgaccttctcttgccgcgcggctcatcgatatggtagtaatcacacccaccacacatctctccttccggccaatgcccgacgacagagaaaacttcacgaatacgcccctctcaattagcgcaccaaagcatttaatgagttna

SEQ ID NO: 86700 - DNA, 173 bp, Triticum aestivum
  unsure (1)..(173): unsure at all n locations
  Clone ID: PAT_TA_86700
ctgangtgctgcaggcagtgtttccgcancaacgccaagganattggcttcatcaagtancgtnaattcacctggtcntgcnaccctnaattgatgctgatcanggttgnaggaatggagcacntantacaaggcttanttacaattccagtantgtntgcnctgtacnccga

SEQ ID NO: 86701 - DNA, 583 bp, Triticum aestivum
  Clone ID: PAT_TA_86701
cctaggtccccttcaccagcccctcgtacggacaccatagcgaaggccgactttgaactctcctcttttagctcgaagagggagaagaggccacaagaagaagacaagtaagtgtcttgccgctttctttatctcctaagtctttgatttggataccttatctgatttgatcttgccttggcctgtccccacagagacacaaaaacgttggcgcagaggatggcgaagaaggccaagacctcaacgggtgatgagcccccggcaagcacctgaagtgcgccggagacgatcataatcagcccggagtccagcccacgacatagcccccaacgcaacccccagcgtgagtccattactcacttcccgctggcggatgttggggcatatatctttactgctaacctttcagtttgcaggaggagaaaagacaggaggagcactgagggcacccgacatgcgcctcgtaacaaacgccaggatgatcccacaaggatcacggagtccacactcacaaatgtgctggggaggagcactcacactctaaagtagcgctactccgtatgcatttcatagtctttccctg

SEQ ID NO: 86702 - DNA, 426 bp, Triticum aestivum
  Clone ID: PAT_TA_86702
gctgagctgaagccaggcgaggacggctggacgtacgacacgcgggctaacggtatgctggcaggcaaccgcaagctgcagaagaggctggaccggtttgtgtgcaagctgccggatttcgagatcaacaccattgagatgatcgggaaggaggcgatacctgggatatcacactacaaggagaagactgtccgcaaggtagtccaagaacattgagtatcctgtgttgcctagtgaccacttcgggcttgttctgagcatcacctacgcatcatagggttgaaaagtatgtgtaaaaacgatatcacctacgcatcacctacgcatcacctagtagtagtagtagtggcggtgaattttgtacccaatggaaataccctatcaatatctctaccctggttgagaagataacttaaaaaaaaaaaa

SEQ ID NO: 86703 - DNA, 531 bp, Triticum aestivum
  unsure (1)..(531): unsure at all n locations
  Clone ID: PAT_TA_86703
cggcgggtggtgcttcgagcccaacaccagggtcgcgcacgcctcatacgcgttcaacgactactaccagcgcaacggccggtccgtccagtcgtgtgacttcggcggctgcggctccgtcgtctaccagcagccaagcttcggcaactgcgtgctgccacaatggcgtaatggactcaagaggttgggaggaggaccaaacacggggccgccctacgtgcacctcgctcagggatagccatagcagcttgtgcctgctttaaagaagctctagcattgcgatgcactccgtgtagtagtactacttgggaatcccgtactacttccgtcctggtttatccctgtaatattttgtgacaaataacaaagggtgtgtctagtgcacatctagatatgctttagttattacacatctaaatgagtgaatcaagcataaagagaaaaagaaaaagagaaagaaatatcatacaatcctaatgtaaatcaatgaagactaatgtcatacttatggacatctgattntttnacaan

SEQ ID NO: 86704 - DNA, 583 bp, Triticum aestivum
  unsure (1)..(583): unsure at all n locations
  Clone ID: PAT_TA_86704
gtcatgctgatcaccaccatcctgctctccctggtgatgctcatcatctgggacacacatgtggtgcttgtggctctctacttcgtgccgttcctgatcctcgagggcacctacgtgagcgcagtgtgcaccaagatcctcaaaggtgggtggatgccgtttgcagtgtcattgttgttggcactgatcatgttcggctggtactacggtagacagaggaaagccgagtacgagatggcgaacaaggtgacactcgagcggcttggtgagctcctcgctggtcctgacgtgcaccgcatccccgggctctgcttcttctatagcaacatgcaggactggctcacgccggtgctcgcgcactacatcaggaacttgcggtcgttgcacaaggtgacatcttcctcacactccggtactcctggtggcaagtcatgcaaggacgtgtggcatccggcgcttggaccaatggattatggtgacatacagtatgctacctgaccgctcaccnangaggataatcacggctgtggtggcgcctcggacanatcacgagagagagagtgtctgctnaagagcaagaagn

SEQ ID NO: 86705 - DNA, 418 bp, Triticum aestivum
  unsure (1)..(418): unsure at all n locations
  Clone ID: PAT_TA_86705
gaacaattagaaatatacatacgaaaataagatagtgctcacatttggttcagtgtgcttatgttccctacaataaaattgggacaaacatgccaacactgcaaaaaaattcttctggacagatgttgtaccaagcgcctgtcaactacatatattaagtgacaatcagcatcaaggcagggaagaaattgaaaacaagactcatgttacttgcatcgaattaggatagagaacatgacaattatcacctgtggaccggctgggataaaaatacatannggacccatcaacacccaaccatttactgcatttatttgacattatttagcataaaatagnttggaacaagatactccaacgtacaangaagtacnanagaggggcattgatgtgtcagcccattccntgcgcatccgat

SEQ ID NO: 86706 - DNA, 568 bp, Triticum aestivum
  unsure (1)..(568): unsure at all n locations
  Clone ID: PAT_TA_86706
ctctctcctctccctctccttcgttctggtgaggagaccgacgcggtcgccgccgttctccgtcgtccacgcggccacagccatcgcatcgcttcgccgtcctgtccatcgtctccaccggtctcgactacatcgtcctcaaccacgagcgcgancaggagagctctgctacgccgcggatcnagccgttccctttgcttcggccgccggcgatcgtcctccgtctccggngactctgctgctactaatcttccacgggccaccttgagccgctcgaccccgagaccgatgctgcccttgtgatcgactacgtcgacgacgaccctccttgccatagcanccagatgcgtggagtccaggagccagacgccaccgttgacgacactctactacacgggagtgctattactacgtgcagccgcggaggngacagagtattaagagatccaggaggagctgcgctcttcatcgtaccatttggcaactctaaggannntgttaactagtcgnaccagatattgtgctccgcnatctcatatcnacntgtatnagcccnaggcctgntttn

SEQ ID NO: 86707 - DNA, 460 bp, Triticum aestivum
  unsure (1)..(460): unsure at all n locations
  Clone ID: PAT_TA_86707
cttaaaaaactagagcttcatgagtttcgcatggttgaagctaactctctcggctttggaattgagaacctcccttgcctcactagtgtcaaatgcactgccgttgttggtgatgatggcattgttgaagccgtgaagactgccatggagagagcagccagcacacatcccaaccacccaagtctactctttcagagattacgctgatacttcaaattaacaagccaaaaacaggggagttgcttctgctcgtggtccggccggccaaccggttctcaagtttaatactagtgtctagctcgattcatctctcttttttatacattattctctctgtcggataaaaatgtaatatggataatgatacaaaattgtagaattggtaagactggtactgtacgcattttcgtataacatcancgtacgtgttgaaggttaatattatcggaaaaaaaaaaaa

SEQ ID NO: 86708 - DNA, 557 bp, Triticum aestivum
  unsure (1)..(557): unsure at all n locations
  Clone ID: PAT_TA_86708
tctagcacaccacacaatcacaatggcatgcaannctgccatcttcgtcncactgagcctcctcctctccgccgtcgccgccancggttgcggnagcacctattgncaaccgccggtcntcgtgccgncacaacncgtcntcgttccgcctcnanaccattnnggaggagggcanggncacggncanngccacggagggcagtgctccatcaacgtgctcancctgagggtgtgccccaacnttctcggtngacngctcggactcaagattggcgttccggcgcgnnaccagtgctgcccgctgctccaggggttggccgacctcgacgccgcngtctgcatctgcaccgccgtcagggccaacatccncggctcaactcaacntgctgtggacatcagcctcctcctcaacacngctgtaagacttcccgtctgtttaattgccagccattaagngacgtatgttgatgggcgccantaaattcctccgtacttgtttttattcataatgtggntcgtcantccaaatttcattgtgtacaatnnactttgttttg

SEQ ID NO: 86709 - DNA, 592 bp, Triticum aestivum
  unsure (1)..(592): unsure at all n locations
  Clone ID: PAT_TA_86709
ggtaaacatcgtgtcccctttgtctcctgttaccttcgatcctcaaacgcacagtttgggaccccctacccgaggtcggccagttttgacaccgacattggtgctttcattgagagttccttcgtgtcatcgaaggaaggatcgatggatcgccttgtcattaatgaaagcatcacctctagaagggccctagctccaggaaaggtcctccagcttcgcggtttcaccgtgggcgtccgcttggccgttaagccaaaggcagccccgacaatcgctaaacatcaccttcgcatcagcctcgaacactccgaaaatatgtatccggcagatgtctctaatgacacacangtataggggatctatcagagtctttcgataagtaagagtgtcaaaccaacgagtgcaaaaggaaacgacaagcgtttcaataagtatctcgcaagcactgaattatcggaanaatantttgtgaaagnaattgtacgggtaaantaaaaantaacaggggaacaagnggccaancttttaagaaaggnaaccggaaaacctatnanggancccccnagacaattattacacagcnttttccatg

SEQ ID NO: 86710 - DNA, 361 bp, Triticum aestivum
  Clone ID: PAT_TA_86710
tgagagccagcaaggcgtcggaacagcgcacgaagggcggtttgcgagagatcgcacatgcacgccgtgcttgtcacgtgactcggtcggtcactcccttgtacgtaaatgtaattcatccgccattatcggtgagtggttaattaagtaatgggatgagacgagtcagcggtcgctactgctacaaatgaagtttttaggggaactacaaatgtagttaagcacaagccttctttgtaaatccacagtagttcttcatgtttgtgtggtggaatatatggcgatctcaaataattgtagaacgctcaagagaaaacaagccgaccattctatcgatcacttttgatttaaaaaaaaaaaa

SEQ ID NO: 86711 - DNA, 391 bp, Triticum aestivum
  unsure (1)..(391): unsure at all n locations
  Clone ID: PAT_TA_86711
gggtggcctgcgattcaccatcagcggcttcaacttcttcgagctcgtgctggtgaccaacatcgccatgagcgggtcgatcaggagcatgtcggtgaaggggaccaacacggcgtggatcacaatgtcccaaaactggggcgctaactggcagtgcctagcgggcctgaaagggcaggcgctcagcttcgccatcacctcctccggcggccagtacaaggtcttccaggacgtcgtgccggcctggtggctcttcggacagaccttctccacctggcaacagttcgactactagctacgtacaatttgtnttaccctactattattacanttgcttcgttcagggcnaacatgcntgganctctccagaggcatactcgttatttcgngg

SEQ ID NO: 86712 - DNA, 325 bp, Triticum aestivum
  unsure (1)..(325): unsure at all n locations
  Clone ID: PAT_TA_86712
acggctccggcgttccggcaccgaggatgacacgggatgtacagaggcgggcgaggcggcgtacgtgcttgccagggtgactgcgcggtgccgtgtgcggtggaaaccggtcggaatttattcccccattgttgtcacnaaggtttcgcccgcggcgggtacgcgactcacgcgcgcattgtactcncgccctgccccatccgccattcgggggccagtagctagcttagcgttattattgtctccctggaccatccgcgccattgatgatcaattcaacgacgttaaaattccgaaaaaannttttagaaanaaaaaaanccna

SEQ ID NO: 86713 - DNA, 253 bp, Triticum aestivum
  Clone ID: PAT_TA_86713
accacacacaggagacatgcacttggtcggccacaatggctccgtggacaagcactccacgcatgcatgatagctagcaagctagctagctagcacacacatatgagacatatacgaggtcagatgcctatggcactgacctcagatacagctccaggagcactctgtaccagatataccacatatactcagtcatgcaggagtaggggtgttatctctccggggagccccgaacttgggtaaaaaaaaaaaa

SEQ ID NO: 86714 - DNA, 564 bp, Triticum aestivum
  unsure (1)..(564): unsure at all n locations
  Clone ID: PAT_TA_86714
ctcacttcttcaataacaaaactcatctatcttcagactattgatctgagaggcacaaccacaaagtcatccatgccaaaatccttttggcatatccctactctaaggcatgtttaccttaatgaagaattttcgccacctgcaaggaatgtgcgaccaaatgatttccagaccttattcatagaactttgcagtaatcgcatgattaagttcttgggccaaatgactaaactaacaaccttatccttgggtacggacccatgattttaagggcttttgtgtatatttggaagcatgcctcacctagttgatgtttccatcggtaatttccaagattatgggatgcattctgtagtacaatcatgaaagaagacccgatgccgtcctggagaactccatgtctgtggtgttgaactagagggtatgtagtgaaacattcctgctctgccaagattcctcgatgcaagattagaactaacagttcttgcacgatggacatggaggatgacatgacaagctcctactgaattgtagttacaaatagncactccaaggggtgtcccg

SEQ ID NO: 86715 - DNA, 335 bp, Triticum aestivum
  Clone ID: PAT_TA_86715
accacaaaatcatctgttatggtaaccttgttgtgctgtaatgtaaaattttctactcgttttttgtactttgacaaagaagaaccatgtctaaccgacaagctagttccccgtcctttcctcggaggagctgccacgaccctgtacaattttgtcaatatgaagtaccatgcccctatatttctgttaatatgctgttattctgatcttgtaaaccttttgcaatcagagatgctctttgcctttgttaatttatgcaaatgtttgtccagagatgctctttgtatctgctatatatgcaaatgcttgccctgttttccattaaaaaaaaaaaa

SEQ ID NO: 86716 - DNA, 565 bp, Triticum aestivum
  unsure (1)..(565): unsure at all n locations
  Clone ID: PAT_TA_86716
gttgttgagccatacaacagtgtcctgtccacccactctctccttgagcacactgatgtggctgtcctccttgacaatgaggccatctatgacatctgccgccgctcccttgacattgagcgcccaacatacaccaacctcaataggctcgtttctcaggtcatctcatccctgactgcttccctgaggtttgatggtgctctgaatgttgatgtgaacgagtttcaagaccaacctggtgccctacccgaggatccacttcatgctttcctcctatgccccagtgatctcagctgagaaggttaccatgagcantctctgtcgctgagataccaacaggcttcgacctcctccatgatggcaatgtgaccccgccacggcaatacatggctgctgcctcattacgtggtgatgttgtgcccaaggantcaacctgctgtggcacatcaagagaacgcacaccatttgtggacggtgcccacgggtcaatgtggnataacacagcaccaggtcgtccagcggngactccaagtcagaggccttgatgattcactcacacgntgtg

SEQ ID NO: 86717 - DNA, 564 bp, Triticum aestivum
  unsure (1)..(564): unsure at all n locations
  Clone ID: PAT_TA_86717
atcgctccaccgcctgcctgagtgtaggtgtgggcgctcatgccagcgagaggcgcacgggatctgtggccgtcgctagggacctggacgcacgcggggcagccgccggcaaacgaagccgcttgtgagagtatggcacgcgcgccgaacaccggtctcctccctgttgtcataaggccgattctgcccttttgccactgcccacttcgataggccgagggtcaccatacattggttctccgccttgcagcacttcccaatagggccaaaacgttgcagatatgggaaaaggatgttgattgatcatgcntgggtgttctctggcaacctaaatatatttgcttctgataatancgaaggaagtgggcacattaagatactcatgatgaagatatcagtactgcttgaattattgggaaaatttcaagcaactacatgaccgctcaagtgacctgttcaactggatcaactcatcctgcctacgtcagaaatangaaantccgtttgaaccctttgttaacaaattgcatccagatggattaccttatgtgatcaatgggttaa

SEQ ID NO: 86718 - DNA, 537 bp, Triticum aestivum
  unsure (1)..(537): unsure at all n locations
  Clone ID: PAT_TA_86718
gccaggcggcagggtcggtcgggcacgcggggatcgagcgcctcccccctgatggcgttgagcatagcggcacacgactccaagacaacagaaagaacagagagaggaaaaaaggctcagtagcggcgatggcgagaggcggcggtttgatgacgaagaaggagctcggcgagacccacgacgtcctccgctttggtgtcaatgacagcgtccatggcgacctcgcgctggcgcaccccgtctaggccaccatcaaggaggccaagttctgggataagaagaagaagtttgggaccgaggccatctacggatcgaccttcaacatccgcanggatctcgacacccagatctctccagatgcanggcccgatgattccgttccagatgatgcgcttgagctcaagtgtgagttcnacgaagaccacccgttacatgttcttcctgatgatcagtatggtgccanttgggcatccggacgtgtccatttgggattgtcttaattggnacctancggccataatgtatggataatgtatg

SEQ ID NO: 86719 - DNA, 454 bp, Triticum aestivum
  unsure (1)..(454): unsure at all n locations
  Clone ID: PAT_TA_86719
acaagtcaacctcaccgaggagaangaagganaanggagaagatgtcnggccgcggcaagggangcaagggactcggcaagggcggcgccaagcgccaccggaaggtgctccgcgacaacatccagggcatcaccaagccggcgatccgtcgtctggcgcggcggngcggcgtgaancgcatctcgggtctcatctacnaggagacccgcggcgtgctcaagatcntcctcgagaacgtcatccgtnacgccgtcacctacaccgagcacncccgccgcaagaccgtcaccnncatggacgtcntcnacgcgctcangcgncanggaccaccctctacgnnttcggaagctangccgccaccatattanctagcctgtgtcaaggttcgtggtcgttntgtatcgcannactcgctgcngttgcanctcgtaaatgggattgaatggaaatcac

SEQ ID NO: 86720 - DNA, 517 bp, Triticum aestivum
  unsure (1)..(517): unsure at all n locations
  Clone ID: PAT_TA_86720
ccacgacgtcagcttgtttgacaccacggcactgactactacacacaacctgcacgacaatcggacgctcttcatggatgagttcgggagcaagtactgcgacttccctggcgtggagaaatggcgttacgagctgcttgtgtcgtcgttagtcaacatgttcgataacctcgagaccttccgcgacgagtatcaagacagcgactccatccgcaagggtgtggaggagtggcacttgtctgcacaacaggcccaagctgctgttgttgctgttgcacctgctgctacgaaagaacaattacttggtcttctcgaaaaagtanagtgacgattatgcactatatgagcgccttccattccatgacacgcgtgttctgggcttccacgtcggatcgatgtatctattctttcataaacgtgtcacagacaccttataagtgcatttagatttgtatcaagaggttcttganacacaattgtntgtaatccacatttaaaactgcttgtgaaaaaaaat

SEQ ID NO: 86721 - DNA, 331 bp, Triticum aestivum
  Clone ID: PAT_TA_86721
ggcccggctcctggcgaagtgccccgggaagcgactggggagctgcacggggtcaggcgaggtgaagcggcacgcgttcttccgcggtgtgaactgggcgctcgtcaggtccgtccgaccgccggaggtgcccgtgccggtggcaaggagcaaggcgaagacgatgagcaggaaggagcggcaggagccgtacaagcaacaacatgaggaccatttcgactacttttgagttgacaccttgtattctagactagacgggcagacgggattaagcggtgtacataaagttggtagtgattccataacgaaatattagagcaaaaaaaaaaaa

SEQ ID NO: 86722 - DNA, 268 bp, Triticum aestivum
  Clone ID: PAT_TA_86722
aaagtgctggtactgtgttccacaactgctctacttgttactttttttgtatttggttgagagaacatgtctatttgaagtttcgatgaaagaccgatcaaaagaaagtttcggtgaacatatctatttgaagtttccatgggaattacctgttgtgaaaaatagctgtaggaagctcatgtaatatttttacgttgtttgtcatacttttttttagttggaagctggtcatatatcgatgagctaagagcaactcaaaaaaaaaaaa

SEQ ID NO: 86723 - DNA, 219 bp, Triticum aestivum
  unsure (1)..(219): unsure at all n locations
  Clone ID: PAT_TA_86723
nntccatcacnntgattaacctcagcctcatgctcanctctgtcngcttcaatcagatctccaancngaacatcattccggtggttngctctaanggnatgggtgcccaacancangcactatacaaggaangttanatcggcagtggttgtctcgcagnggncgtcaggatttgcaccttcaccgatgtanaggtcaatggctaagggnttcanttgt

SEQ ID NO: 86724 - DNA, 565 bp, Triticum aestivum
  unsure (1)..(565): unsure at all n locations
  Clone ID: PAT_TA_86724
ccaaagcccatcttcttctccttgaaatctttttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttgaataacgagcgtctgatctgatggagtcgncaagggtgcgtgtgcgtgtgatttcttgctcgctctccgcctatctctgccatggtgtccttgtgtgtaggtgtgncccattcncccgtaatnctcancatcncacnatggatggnggatnatatgtagaagaagnttaccaaaaaanaaaaaacccnggggggccgggaccaatcgccnaagngtctataagcccccaggggt

SEQ ID NO: 86725 - DNA, 496 bp, Triticum aestivum
  unsure (1)..(496): unsure at all n locations
  Clone ID: PAT_TA_86725
accgagtatgcccgtgcctcggccctcttggaccttgtctccgtcttcacatctccgcagcgaagagaacacagaaaggatgaggaggaggcaacatcgctgtgggatgctccctacctttccccaaaccctgatggcatccctcccgatcgatcttgtagcgggactccttctcgcccccccgacggatgaggacgtgcagcaccgtcaatttccacagcaagggtgtgaaccctttgcatcggcaacgttgaggcgggcatagacggagaagtggtagcagataagatcaaggctaagatgctggagcccaagagcttgacgccaccgtcgacgacgactcctactacaccggaggtgcctactactacnncaggccctgacgacaacaagagtattaggaggatccangcaggaggctgcgctctttgtngtacccatttgtgcnancatcttanggcacttttnanttangtcgtaccaaatttttgctccg

SEQ ID NO: 86726 - DNA, 574 bp, Triticum aestivum
  unsure (1)..(574): unsure at all n locations
  Clone ID: PAT_TA_86726
tttttttttttaaaaaacacttctgacatattaagtgacagtatagcatccactttctgattaaattcttaactgaatcaacagagcgctggttacactcggcaacaatacccagaaagagagaaaaggttcgacatccgccaggaaaacccactagttatactctgctagacagctagagtataacctatgggacaaaaaacctggcgcatcaatgaatcctccctgccaatcaagtttttacataataccaagtacagcacaaagcaagaagattacagcggctgagaggtattagccgcactaggtagctagcatcacccccttcatcaacccctcgtggacatgcaccagacggaattgagcttgttttcgcaggctgctctcacttcttggatatcaagaagctacctcttctcacaggcagctttatcccttcaattttcacagcctgaatccacacatttggnattctaaatgtcatctgctccacaacggacacaactcgtcaaaccgaagttcnaatccctcaggggggcccggtaccaatcgccnaaggagtcgataccccnnc

SEQ ID NO: 86727 - DNA, 541 bp, Triticum aestivum
  unsure (1)..(541): unsure at all n locations
  Clone ID: PAT_TA_86727
gaggaacagactggagaacctccctggtgtgctgcgtgcaatgggactgagtcatcgattcctggagaagatttctggtggcggtgagagcttgcggtatttatcaccagatttcgtcttggaggatgctagttatgatatggaggtggagagagcattctcagacagaatggttaaggtaaaggtggagatgaatgcanagcatgtggacaccaagcttgagttcttgaanagcattgggtatggtgagaacaaaaaanccgcacacatacttcntgttctgcacagcactcgggaaatgctgaatgagcgatttgactacctcctgggaaagaggggtggagtacaanagctgtntcggttcgtgagtgtnttccaaaggtgctgaaccaggncangagatgccaatgaaaagttnactacatgacccggatcgggatacncttgggtatcttattgctccggnatactgtccttgattngagaccggtcannctangttgcancctcgtggncaaattangccttttaaaaacatagc

SEQ ID NO: 86728 - DNA, 409 bp, Triticum aestivum
  unsure (1)..(409): unsure at all n locations
  Clone ID: PAT_TA_86728
tatgcttcagagttcgccccaccttatttttttccgtcctccgccacgggatacaatatataacaatccatgtacacaccttgaatgggaacagaatgttaaacccagcctgcgcggcttcgaggtgatcgacgctgccaaggcggtcctcgagagggtctgccctagagtcgtctcctgcgccgacatcatcgccttcgccgcacgcgacgccgccttcttcctcagcagcagcctgatngactaaaanatgccgggggggnggnttcaagggcncnttcctttaaaatgnaggcnttnatttctggcccccgccnttcttaanctcaagaactcntcaanacntcaagggcaanaanatggacnaggacnactcgttgtgcncnccggngggnaaacaacggggttt

SEQ ID NO: 86729 - DNA, 528 bp, Triticum aestivum
  unsure (1)..(528): unsure at all n locations
  Clone ID: PAT_TA_86729
ccgaaacggcgcctcaaggttcgaaaacctcttgcgctactgctacctacgccgcgttggtgactgccagtggagactatggtgatcgcccacggcgttggtgctggctttaatggacaagatggcctcgagaatacggagaggtggcctgaccgctcgagcttgctgctgctttcccagtgacaccagcgtccaagatttcacctatggtctgatgaactgaagaacctgatccacttctcaaactgctatggcctactgctgtcaatgccatgagttgtgtttcattttcagtgataatattttcttcttttcattgcagccttgtgtcacagaattgagaatattatcttcttctcattgcagacgtcgtcatagaaaaagctggagtacctgtgttagcttttctgaaatctgaacactgcaatatgttgttactgatttacacnctgganaagatctgtcctgtgcaanagaataagtcttcaacttggntgtagacnattactaataattccaatcccncaa

SEQ ID NO: 86730 - DNA, 399 bp, Triticum aestivum
  unsure (1)..(399): unsure at all n locations
  Clone ID: PAT_TA_86730
gacggatttaatggtgaaaacgaattttcaatcaaattttttatttaagagataaaacattttaaaaactggaaacctaaaaagatttctacatgcatgcatgcggtgacatggcaatctgttgctataagaacgtttgatcaggacggttcgtcttctcctagactccctccctcccgcccctcccaattttggcacacagccaaaacacncccagaaatttcanagacanngcaagaactnnccgntgattccaccccatncccctctttccttcgggtcttcgtcggacggcaaccatggacagcggcaacgacggcaacgacaacggcgggcggcgggatcntgnaggggtacaggatcggntgggccnaaccgtgccgcggnatttttccccca

SEQ ID NO: 86731 - DNA, 558 bp, Triticum aestivum
  unsure (1)..(558): unsure at all n locations
  Clone ID: PAT_TA_86731
gtgggccaagtgggctgcgctaggtaagtctctgttctctctctccttttctgtttttcatttattctattatttctgtaacttcagggctttattaaaaatgccagggcatttccaaaaatcataaaattaatcatggccactgcttagaatatatccaacagcaaacattttaggttatgattatttgagcatttaaaatattttatagcatttaaatgcccaaatgaaaatactataagaattaatccaatgaccttatgatgtcctagaaaaatgtgcaccatttttttcaaaggttttaacccaaaataaaaagggtgggctttttanaaggcatttcangttcattgaaaaatttttagtanacctattgttccagggggttgctggggtctgcnccnactcaantaantaaatnngcatgatgacantctaagctgaagngntaggggtgcaccacccannaaagantctccngattaggtctcaggaaaaggggaancanggggccggacaatcgccanatgagncatagncnccatngcgnnttaacgt

SEQ ID NO: 86732 - DNA, 511 bp, Triticum aestivum
  unsure (1)..(511): unsure at all n locations
  Clone ID: PAT_TA_86732
gctacctcaagaagggccgctacgcccagcgcgtcggctccggcgcccccgtctacctcgccgccgtcctcgagtacctcgccgccgaggtcctggagctcgccggcaacgcggccaaggacaacaagaagacccgcatcatcccgcgccacctgctgctcgccgtccgcaacgaccaggagctcggcaggctgctcgccggcgtcaccatcgcccatggcggcgtgatccccaacatcaactccgtgctgctccccaagaagtcccccgccgccgccganaangaggccaagtcgcccaagaagaagacgtccaccaagtcccccaagaagaagaccgccgccaccaaggagtaaccgccccatagnctagcagtgttgcttagatcatttctcatggactaagatgagacctgttgtatgcctgcagtctgtgattcgtcaacatgggtgcattgtactgcnntcatgnctaagatgagntcatattcatcgtgttcaaaaaaaaaaaa

SEQ ID NO: 86733 - DNA, 526 bp, Triticum aestivum
  unsure (1)..(526): unsure at all n locations
  Clone ID: PAT_TA_86733
ccgagacgccgaaacgagcatgcaagttcgtgccatacccgtgtccgatgccgtaccctatgcagtgctacttgaactgccctccgcagcagtgtctctgctgccctacccccatgccaccaccgcaggagccaaaaccctgcgagtgctcgcactggcagtcacatcaccatggcggctgctgctgcagcagcaaacctgcgctaccaccgccatgcaactggttaaaccacagaggctgcacctgcagcaggcagccaaactggccgccgcccacttgtcctcccttcttccctccgctatgctggatcgaggagtgcccgccggacccctgctcatcatgtgatgagattgatttattattactactatatcaacaccgcccttgatttgctttggactgtacgctgctacttagctacctactcctcgaaaataagaataatgcaatcggtgtactgtgtacatactaaattgtantcactggtctgcgttataacacagatattgtncnatagcttgtatt

SEQ ID NO: 86734 - DNA, 569 bp, Triticum aestivum
  unsure (1)..(569): unsure at all n locations
  Clone ID: PAT_TA_86734
gtagctcgagctatgtttgcttgttgtgcattggatgggaagataattgttgctgggggatttacaaactgccgcaaatcgatatcggaggctgagatttacgatcctgaagctgacacatgggagtccctccctgatctccgtcaggcacacccctctgcatgctctggtcttgtcatcaaggataagatgcacgtattgcataaagggatatcaacagtccagattctcgaagatggcggtaattattgggctgttgaggactactcttggctgcaaggcccaatggcaatggttggtggagattgtatgtgctgagcaatagctgcattaggaagcagcatggtgagaatttccctgataaatggtccttgtgatcangattccaaagcaggattggctttgcanattggctagggacacatagttgtttggtggatgantgggcctgggcaagaatcatgataagcatgctgagtnatactgattccagcanagcactgcacagatccnataccttccaggataccagtgtccgctaaaaagcttcattgatntcgtcnaangag

SEQ ID NO: 86735 - DNA, 343 bp, Triticum aestivum
  Clone ID: PAT_TA_86735
ttctttaacttgacctttttgcagtacatctaacagcatataggggaatgccttttttatattacatttgcaccaaaccaagctattcttaatactaattcctttgcatagatactttccaaagtgctgagaatagcaacagagagaaaacgctgcagaagatatcacaattgaattactaacctggtacttgttcatagattttctagcatcttcaataagctttgattcttactcaagtagtttggtttgtagtgtcgttttttttcttgactctagtagtgtagttagcatgccttccgttccttgcttgcttatgcacttttgaattaaaaaaaaaaaa

SEQ ID NO: 86736 - DNA, 599 bp, Triticum aestivum
  unsure (1)..(599): unsure at all n locations
  Clone ID: PAT_TA_86736
ttttttttttgaaacaatgctcgtgtgtattctggctgcattgagttggtgcaagaggtgcatcagaccacaagaattgatcaccgaataaaaaacatatttaccacttacaataatagcttgatcaaatgttttctatagatttcaatacctagaccctagtaacagtatccagctactcaagctaagtatgaataggtacatcatgtgccaaatgtaaatatgaaaaatgagaatcattgtatctcctttaagaaagctgggttcgaatttagcgcttttttcgctaggttacgggcgtcgtctcttgaagactcttttgatatgcgaaggagctccttaatccctccagttatgatgatatcacgggagttttccacattttgagctagatggcagaacgctagctcgatatgtctcgcgttgaaggaggaaacatggtnaattggcatgatcaacaaggacgcatctcatgagaaggatcccttctgtacttggctataccgggatcaattgcaaagtccagcccggcattggcatacatcgagtcattgaaatccagngngnttatcacactgttnaattggtgcanttattca

SEQ ID NO: 86737 - DNA, 576 bp, Triticum aestivum
  unsure (1)..(576): unsure at all n locations
  Clone ID: PAT_TA_86737
cagacacccacatgttctaagttgcctactttctcttaccacatgactgcaattcttcaaactatgttgctttttaatcatcaagagttttaataatttccaagttctgccagcataaattaatttgttttgtcaactaattataaacaacatcatgttaacgtgaattttggttcacctacactcattctgacattttcaccataaatattttacatgcaattgtctttgtcgttgatcatggacgggtttggttgtggtacacttgtgtacagccctgtaagttatcaagtactttggtttcctattttttgcaatatagaatctgtcatgatgcattttcttctgcggtcttanttaagtgagtaccagcgtctctgaaacttttcagaatacagtaatgaggctgcatttgttttcatggccggccgatgcgctggattcggtcaacgaggcntcggcgacatgctgctggancgganacagntatgatctcaaggcaaattgaaatattgtgccnaaaccgangtgtggccncaactggcaacnctgtgcaaatcanaancaaaaaggccn

SEQ ID NO: 86738 - DNA, 419 bp, Triticum aestivum
  unsure (1)..(419): unsure at all n locations
  Clone ID: PAT_TA_86738
gcagtgccgacagcgcgctggcccgcgaggtgagtgcatgctgcaccggcagctagcacgccgcgcagtgtncacggtacggcctaaatgccctacacactaggcgtcgctggtggagaaagcgcgcgggagagagaggaggaagaaaggaccagagggagcagaggagactgacagtggaccccgggtccacctgtcggccagagagagccctgtgctctcgggtacgaccagcgtatatctaaatttaggagttatcctaaatttatatccagcatagaaatcgcccgtttttgtcccggaccgtagactttgccgcgcagccccagtttttcacactgtggtttttcaccacttattgccctctcactgtagccacatctttaatgcgtaaatatttcctaacaccgctttaacaa

SEQ ID NO: 86739 - DNA, 288 bp, Triticum aestivum
  Clone ID: PAT_TA_86739
tgagggtaatctctcatatccgactgacttgtaatcactgacttatcatagaactgctggttatctttgagttgtgttcaaggatgtctgccaaaacttcgaggaagagactagttgagtggagacaggcttggatcccattaattctcctatgaaggatgaaactgccatgaacgtgctccgactggagtctcgtgttgctggtgtggttgactaccttgctcgactgaaggttgcggcgtcgcggatcgacacgacactctggccgagagagacgcttcaaaatga

SEQ ID NO: 86740 - DNA, 565 bp, Triticum aestivum
  unsure (1)..(565): unsure at all n locations
  Clone ID: PAT_TA_86740
agatgaatgcctacgtttgcaactgaaatacagtgaaaaggatcaggctgaaaacttgatgattgttgatctcttaagnaaacgacctgggcaaggtctgtgagcccggaagcgtgcacgttcctcgcctcatggatgtcgagtcatacaagtcagtccacaccatggtgagcaccatccgcgggacaaagaagcctgacctaagccccgtcgactgcatcaaagccgcctttccaggaggttcgatgacgggcgccccaaaggtgaggtcgatggagatcctcgacgcactcgagagcaacccgangggcatctactcaaggtcgatcgggttcntctcgtacaancgcacgttcgacttgacatcgtgatcaggacggtggtgctgcacatggggaagctcggtgggggccggcgggcatctggtctgtcggacctgaggcggntatctgaatatccaaggtagacacgacaaggtntcaagagtnagcaaaagcgcgngaaacatccgacgtcgattggtcgncactatagtanagnatacctgctcaatgaataacaaatn

SEQ ID NO: 86741 - DNA, 287 bp, Triticum aestivum
  Clone ID: PAT_TA_86741
ttcatgtataagactctggacgagatatacgacgacgtcgttgagtacggaagggccttgggaatccttccgtgctagtgtgcatgatgtccaattgaaatcaaacgatgcgcttgcaagcaaaataggcttagcctctttcttttttgttggttaataagcttagcctcctaaaagtacatatatgatgaaatgtgggtgttagttcatatgaaaaatgatttgtaaaacatacttgtatgaaaagtgatatatggtattgtgaacattctcggaaaaaaaaaaaa

SEQ ID NO: 86742 - DNA, 586 bp, Triticum aestivum
  unsure (1)..(586): unsure at all n locations
  Clone ID: PAT_TA_86742
gagaaatggcacttgctccgggctggtctccgtctctgcgctccctggtgtggctcatgtcgcacagaaatccacatctgagctctttctcctctaccgccgccgcggccgccatacagccggcggctccaggaactgccattccagctgttcgtgccgttcagcctccagccgctccagattcgagttgtagccggtccgttgccccggagcaaaaggttcttcacccacttccatccaagcacacctaaaattccaatccacaagccttctcgtcgtcccaccagcaaacatcctaagaacatgattcatcctagtagagaactcaacttgtaaccaacacgccgcagatgcgcagctcgaaagcccacgcacctgatcctggtggtcatgcagcgcactcatctctgaccgacaagcgttgccggnaaactggtgattacaaagtncaaaacccaagttaactctcaaccactcctgacancgatctgaactacgggatcttgagccacctgnantctcaaatcgtcctgtgatctgaganattaacgtactgannctcctaaacagttcgntagagcgggga

SEQ ID NO: 86743 - DNA, 611 bp, Triticum aestivum
  unsure (1)..(611): unsure at all n locations
  Clone ID: PAT_TA_86743
ttttttttttcaccaaatgaaatctggatgtagatttcattccatttcatttctaccaaatgaaatgaaatctggggagccaaacgagctgtgaaggaaaaggcatttcgcatgtgtaactttgtcccatgctttacatagaatattgtatgcttgtgaaacttaagtagtaactaagaaacatagggtaattagatgaattttccaaaaacctttccttaaagaagtactaaagctcaaaatgacaacctgttaggctctgcacaaagtacaaaacaaactctaaggtttatcagaagtagtggtttcactgaaactacgaatgttacatgtacatcatgcacgaaaataccagattatccatcatgtgtagttcattttatcttggctgatctttgcatctatgggcacctctgtactggcagggaggagacactctatgatagctggctctgaattgattgttacaacacactgcaagcggtcaacacttcagcattgccctcattccgtcgcnaatgttggtcaagactagtcgctacccagactcactgtgaaccatggaaagtcttagtccagacggacagtcnctctgtacagtcagcagacan

SEQ ID NO: 86744 - DNA, 602 bp, Triticum aestivum
  unsure (1)..(602): unsure at all n locations
  Clone ID: PAT_TA_86744
ctcacacacacatatcaactgttgctgctggcactcttggctacctcgaccctgagtaccatgcaactttccaactcactgtcaagacagatgtttacagctttggcatcgtcctcttggagatcatcactggccagcccccagtattgatggaacctcaaaccgcccatctaccgaattgggtgcgccaaaatatagctaagggaagcattcacgatattgtagacaagaggctgttggatcagtatgatgtcagttccgttgagagtgccgtagacattgccttgaactgcgtccaaaatgcttccatcnaccggccgaccatgaccgaggtgtttcaaggctcaaagtgtggtaccggcggtttcaacgcgaaaacaccctattccgggatcccatccaagaatccatggatattgaaattcgaaagcattcganatgatgatatctgggtcaacagtgacnagactcntcaatccggtcanactgggtgggctgctgacagagtagcactttctgacgtnaaggaaattcnccgactatgttcancgctaaaaattggaattttcagtgggtacantgttttagaacanangtntatt

SEQ ID NO: 86745 - DNA, 598 bp, Triticum aestivum
  unsure (1)..(598): unsure at all n locations
  Clone ID: PAT_TA_86745
accaatgtttgcaagtgtcttacaggatgaagatgatgattttccaagatcagcaagaggattccccagatgatgccaaagatgaagaatacgaaagcattgaagagaatctcagggaaagtgattttcctgctgattcagacagtgagactccaaaactgagtcaggattttggaaattcagacgatccaggatcagaaaatggcgacgtttcttttccacgggaagcatccagtaccaagttcaatgcttttgcaagaaacatgcatgatttacctgggtgaattaccagccccctgggagctcgcatcatccacacctattgccttatgcaaatgatacctcggatggtgatgctttgtcgatcaccaaccggcatccatcacgtggaatctcatcgctggtcaaatacagatgctgatttcccggatgagaaaaatggggaacgctcanagccttggtgggcaatgcatccaacagcaccaaagttccaaaaggttaagaactgcgaaattggagaagatagggtgatggntagaatgacggttcgctacgcccaaagtncatatatgaatgccgatttgataggatcncnagt

SEQ ID NO: 86746 - DNA, 559 bp, Triticum aestivum
  unsure (1)..(559): unsure at all n locations
  Clone ID: PAT_TA_86746
cagacaaccagcttacagcaatgagggattcacaattgcaccgagaggccttgataaaaacttgcctacctggcctccggatccagtccttggtcattttggtagagtgcagcaattctcgacatgcactcaggagagggtgatctctgaatgtgacattctgagacctcagactggaaaaatgagacggctcaatgtgcaagatttgaatgctaccacattgccttccaagcatgtttctcagcatggctctgggagtcacgtgaggctaaaaccttcactgggacttgacatctggtaatcagcgccttgtgcgcaaccatggtcattgattctgaaggtaagattgggcgatagcgttgagtcgagtttgatgagatatctccantgctagtttgcccatctctctgttaaaactggaattgttcataatcaataagggtatcaactaattatacagatgctgacattacantcatagacncccaagtgattccattattcaactanggagagactgcccnataggaagagcgtaacngctactggtctgcatttt

SEQ ID NO: 86747 - DNA, 462 bp, Triticum aestivum
  unsure (1)..(462): unsure at all n locations
  Clone ID: PAT_TA_86747
cgacaacacgccgctgtccgtcctgccggcggcgattaaggtgcgggtgctgcgggccatgagctcgtccctcggcatcaacatcggcacggcgacgtgcatcaccacggggccggacttcctgaagcagcaggccgtcaccgacctcaccaagtgggactgcctctggatcaccgtcgcctggggcttcctcttccgcatcctcttctacatctcgctgctgctcgggagcaggaacaagaggaggtagagcgcgtgatcgagcggatcatcttcttggatccctcggctttactggcgcgagcaatgtgggactgtctctcagtcttctgtaatttttctttgttcaatttttttcgatttttacttaaccgcgtgtgattaagatgggaagggaatgtttgctgcgtgtaaatttgtttccaagttgtaacatatcatggaanttgaaattgaaaaaaa

SEQ ID NO: 86748 - DNA, 487 bp, Triticum aestivum
  unsure (1)..(487): unsure at all n locations
  Clone ID: PAT_TA_86748
ctgcctcgcccccctgcaagctccgtcagccacctcccgagctccgtcgccctgttccccatgatccatcgggcccctgctccaacgccccttctcccgaaagttgttgcctcaggggcattgcgctgtcggcagggcctcctgccctgcctaagcatccatcgcaggtggccttctttggcgcatctgatcgaccttcccattgtcttttgcttgaacgtgtgaattcttgctgctcctccatgtaaatctgctgctagatgaagaccaatctggccgctacactactactgttgttatgtgttgtgcccttttgctgggtgaagctgttgttatttgctagcctatgttgtagtatttcagtccagattcacatgtgtatgtantttaagttccaagtatttgtgaaaaacattaggtgagagtgaaattgaaattggaatcncaaaccatatanatttctagtctcagtctgaaaaaaaaaaaa

SEQ ID NO: 86749 - DNA, 566 bp, Triticum aestivum
  unsure (1)..(566): unsure at all n locations
  Clone ID: PAT_TA_86749
attcccccggaccagcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcagcgtctcatctttgctggcaagcagcttgaggatggccgcactttggcggactacaacatccagaaggagtccacacttcacttggtgctccgtctgcacgtggcagtaagctcctggccatggatctgcttctgtctctgggttanaagtctcgttgtcctcggtgtctccaatggatcggncgttcgttgatgcctgaactgtcttgtttgtaacatatacgtgatgcntgttatcgttgtatcgcaaactctgctggggncggancttataactagatagtagcctgggtcggcaaaatcgttgtctgcaatgngttt

SEQ ID NO: 86750 - DNA, 571 bp, Triticum aestivum
  unsure (1)..(571): unsure at all n locations
  Clone ID: PAT_TA_86750
agatttagctataaagagttggatagggcaactgcaagatttgaccaatccaataagattggtgagggaggttatggaccagtttataagggaacactcagggatggaacagccgttgcagtaaaggtgctctctttgcagtctaggcaaggcgcgagggaatttcttagtgaacttattacgatctctgatatttcccatgagaatcttgtcaagctttatggctgttgtgtggaaggaagccacaagatccttgtctataattatcttgaaaataatagccttgcacaaacccttctaggttctcagcagcataacagcatccagtttaactggagaactcgagtgaatatttgcattggtgttgcccagggactagcatacctccatgacgtgtccgacctcatgttgtccaccgggacatcaaagctagcatatactctggataagatcttacccgaaattccgatttcggntagcgaacttcacctcagtgtacacatatagcacaagatccaggaacctagtacttgntccgatagcaccgagacagtgaccgaatcaaatnttn

SEQ ID NO: 86751 - DNA, 558 bp, Triticum aestivum
  unsure (1)..(558): unsure at all n locations
  Clone ID: PAT_TA_86751
attgcttgctccctacgcgatctccgttcccgcccagctttgtcgccctttctctcccaatttttttcacttttgttcccttcccaggtgttcctctcggaacaattctttggccagcgtcggtcttcctactctgatccgacgttgttgctttgccgccgattggttcccagcaacattgtgcagtggtttaacctccctcccctgatcccaacttctaacctcctccgccctctctctcttcttttcgcagatccccttctgtttcgcgtggttttcattcccttgttccccaaagttagttatgttctcccatggcgtcacttccccctgcttcagttctcagttcgcgattatcctttgttgctgaggcgattacagtaagtacggatggtgatcatttgggatcaagagataanagaagagtcacgaaattatccaaacatacgcangatgctgctaaccgacacacataaggacctcganaaacgatggatgcataatcgaatcggggtgtaaaaaccgtcaaaangngaaaacgtttgcnagacaatcann

SEQ ID NO: 86752 - DNA, 542 bp, Triticum aestivum
  unsure (1)..(542): unsure at all n locations
  Clone ID: PAT_TA_86752
gcaaagagcctagctaacagacgttagttggccactttcttttccgtccgctagccgacgacaaacattctttgtcgtccgttagctgatggcaaagaaagtggccgttaggaatccctcgctagtatgccaccctccctctttgccttccgctagcgtacgacaaagcttctatgccatctgctagcggnnggcaaagaantggctgatggcaaacaccatctttgtcttgtcngtgtcaaaaccgggcggntctcgggtanggggtcccnaactgtgcntcaagggccggatggtaacaggtnacaagggacaagattttttnacccaggttcgggcctctcgatggnggtaataccctactcctgcttgataanattgatganatgggtantcaanagtngtntccacgnnattanggagntaaaccctaaaagctacctanggtccgattgttgtanaggagtttatgccnanggctacaacctccggttaatagaacnggtagggtagggtacatagatnnggtaaaaggtagggna

SEQ ID NO: 86753 - DNA, 552 bp, Triticum aestivum
  unsure (1)..(552): unsure at all n locations
  Clone ID: PAT_TA_86753
cgaagatattgcaaatgaacggcaggataaggcttgccaaattaaacagctagctggtgtcagtgtcgacactccaaaatttcatctatcattgatcattcgaagtactcacttaggttatgcatgacatactcatccactatttttgacgttatataacctaatccctaccacacccaccttaaagatgctccgtgtaacataacaacctgttttaaaatctgctgcatgcatgccaccatcgaccaaatgatttaactatgtcaaatttattcagtttttctaaccatagcgaatcaaatcgttataagataagcaataaagattgcttcgtctgtcatgtacatcacataaacttccaatgaagcggcgccgctgccgctgatntgcctgccactgctgactgcgttgtgttcntcaatggatctctgggtggggcacgatnggcgccgcatcgccgcgcctacacantactgctgagggcaacccgcaacttggtctacagacacaatcacgtccccggcggcgaatgtaatantgcaagaaaggcgc

SEQ ID NO: 86754 - DNA, 555 bp, Triticum aestivum
  unsure (1)..(555): unsure at all n locations
  Clone ID: PAT_TA_86754
ggagcacgtcttcggcgtcgcgcacatcttcgcctccttcaacgacaccttcatccatgtcacggatctgtccgggagggagacgctcgtccgcatcaccggtggcatgaangtcaaagctgatcgtgatgaatcatccccttatgcagctatgcttgcatctcaggatgttgctggttagcttacaaattcaagtaatacgactattgcaatgcatattactacgtgtgtatttattccattganatttctcctccttaggctccaaatcgtttgtgggtcataaatgatngngcattatggatnattacgtcatttanntgacaanaggcngggtttanagngcatggcttgaaatgtgacctccaatcaanaattccacaggggagaactatgtgaaaatgantanttaattcgcatttanagtcccttcaaattgtaacggattgnannggcatttcttganaananttaccccncattttaaaaaaaggggggccggnncaattccccnaaggggnntttancccccaagngnttttaaactggangngn

SEQ ID NO: 86755 - DNA, 272 bp, Triticum aestivum
  Clone ID: PAT_TA_86755
aggaagcaagctagcttctaatagtactgtagtagtggtagtactagtacaccgtgagtttctcacttgtattagtgtgtgtttgagtccacaatatatcaagtgtgtgctactagttcgtactagctccagtatactttgtttttcctcgacttcgtctgatcctcggcagccagctagtttcgagtttgggctaacataaacttcactaatagatctgtttttgacatccaataaattgagatcatgcagtctttagcaaaaaaaaaaaa

SEQ ID NO: 86756 - DNA, 276 bp, Triticum aestivum
  unsure (1)..(276): unsure at all n locations
  Clone ID: PAT_TA_86756
gtttttttttttttttttttagacaatacagaaggtagcacttgatctaaacaagaacatgcatgctcacccagcagagttacaatcaacttgtagatagtacagaaggaagctcttgatctgaaaaaccatgcatgctcaccggccaacaaaagaaacagaaaaaccagccatccagatnattcaacaaggtacaatggtccactttccagacaggaaagattgtanagttcgtaacaatctcatagacaggcgganctcananagctttanttg

SEQ ID NO: 86757 - DNA, 425 bp, Triticum aestivum
  unsure (1)..(425): unsure at all n locations
  Clone ID: PAT_TA_86757
ctaaacatgtcgtttccaatatttcacgctgctgggcgtgtgttgatggacgagtgcaggatggcggcgttgtttggcgtcgtggtggcgtcgacggcagctagacctggcaaggttaatgcgtcagtagctctgaagatggattggtggcggttggtggcggcggcctctgagtgtgcgccggaccgatgggtgccccatacccggcaggtggcttggttggggtctcaggtcttagatgttaggtttggctgcgangtttgtttggtattangcctagatnagcatcccttcatcaactggatangagtagcgacagatgttgtctanacgtggttcagtctactgttgtatacttgtaagtctttgtgaataataataaaatggctgcatcatggccagatcanagccggggtctccccttg

SEQ ID NO: 86758 - DNA, 354 bp, Triticum aestivum
  unsure (1)..(354): unsure at all n locations
  Clone ID: PAT_TA_86758
gggtggtggngtctcgcgactcggaggccttctacatnatgnaccccgacagcancanntccggatcngggatcaatggagggccngagctcanngtctacctcctcagagtctgatctgccngcggcccggcacggtggatggtcattggtcaactancgtttcnttcggttttgtgcattcggttggtgnaaangngttagccttcagggggcgtntacgcncgttggaannntaaagtggntgtganccaaatacaactttttgttgctnancnatttgctanttttggatgtaaggattntttnattgaaaagaaaattttgnntggncccgganaancnatggtgtgga

SEQ ID NO: 86759 - DNA, 252 bp, Triticum aestivum
  Clone ID: PAT_TA_86759
agcaaacaacgcacgtcctaaatgattcaaagaataaaaagttcaaaaaacaacggtagaagagggtaataaaggaaataaaaaaagcgcaaaaacgacagaagaaatgactgaatgataaaacaatagtgatctaaaaggacaggagacatagagacaaatagagtaactacaaaagagcctaaaggaaaatcaaaagcaagtaaatactaaaaattggtttaaaaacaggtcagcgcacgaaaaggacgg

SEQ ID NO: 86760 - DNA, 273 bp, Triticum aestivum
  Clone ID: PAT_TA_86760
ttttttttttttttttttcgaagaaaaaggaaagccgcaaataaaataagtaaaatataggaaatactaggcatctctgttcggcacggcataatgcagagctgcctaaagaagaatagaagatagtgacacattaacgtattatatggataggcacacaaattccacatagaaaacacaaacaatatacagaaaacattatatggtggtagccttgtaggcacgtctctttagtttgtagcgccggctgcggcggctgcggcgcgagcgtgg

SEQ ID NO: 86761 - DNA, 257 bp, Triticum aestivum
  Clone ID: PAT_TA_86761
gtaatctatggattctttgtagttcaaatggactaatctatatattatttatgcagtactgtttattcagttaaaggtgcccttttctagagagtgaaaacgggtgtagggcaggctatatgggtagaccaccaaaatagttatgtagttgtagttggctagcaatagcttatatccctaattatattcgattttctggttgtacgcaatttgctttcctcgtaggcagaagtaatggctgagctaagttaacggcg

SEQ ID NO: 86762 - DNA, 266 bp, Triticum aestivum
  Clone ID: PAT_TA_86762
agtgttcacaggtccagtgcttatgtaagttattatttagtcaagcttatgtaagttattatttagtcaagattccgttctgatgcataatagctaataacttgcctcttaagttgtctctacaaactaaaatttgaactttaaaacttatctagccatagtttttgcagcaagaatagcatgacttattttatctccttttcgagctggaacacttggctattgtgatttttctttgtagactttcctatactatacaaaatgta

SEQ ID NO: 86763 - DNA, 263 bp, Triticum aestivum
  unsure (1)..(263): unsure at all n locations
  Clone ID: PAT_TA_86763
caacagcccgcagtgccatctgaagttcgatagctgtcagggagtcatggttcataacctgaccatctcttcccctgagaatagccccaacactgatggaatacacctgcaaaactccaaggatgtcaacattcaccacactgacctggcctgcggtgatgactgcatctcatacagacaggctgcagcaacntaacatacataatgttgaactgcggaccaggccatggatnaagcattggtggccaangaaagggtacaca

SEQ ID NO: 86764 - DNA, 272 bp, Triticum aestivum
  Clone ID: PAT_TA_86764
cggcctcaaggtgggcgccaactgtcgtggttctacgtctgacagtagaaagggcgggtaggtatggagaggcgagatcttagctatggcgaagatgtacacgcaatgtttacgagttcaggcccttctcggaggaaataatagccctacgcctcggtgcccggaggcggtcgattggattatgtatgttgtattacaggaggtgcgaacccttgtcccagaggaggggggtggattatatagagtgcgccaggaccccagccccgctccat

SEQ ID NO: 86765 - DNA, 556 bp, Triticum aestivum
  unsure (1)..(556): unsure at all n locations
  Clone ID: PAT_TA_86765
ccccaatcaaaagagcagagcccccctcttctcccttctccctccctccctcccgtcccgggcactttcccaaatcgaccaggactcggggagcatggcgagggccctcgacggctgctactccgccaaagacgtcgcctacagctgtggatactgtggctatgcactgaatttgagctcctccacacggaacacggccaacattggatcaaagtacgggaagcagatcaggaaaggtgtcgtctcattcttcgcgatcgacgagagccggttcacgcaaaccgacgaggtgagctgcacgccatacttccgctcgagtcgttcctggggcttcttcagaaagagaacacgattgctctgccgcaagtgcagtgggcatatcggtaaccttatgacgacaaggatctgccttgtatgatacttagatgacacactcgcgactcagaggcacacattctatcgaaagaatagtttcaagtcatgcactacacctcacngagatcggttcatcctaatgacanatcngaangagtatgttgcctgaaaacatgtgccc

SEQ ID NO: 86766 - DNA, 459 bp, Triticum aestivum
  unsure (1)..(459): unsure at all n locations
  Clone ID: PAT_TA_86766
accatgagtctctcctggaggcgcttcctggtgacaacgttggcttcaacgtcaagaacgttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaagtttgctgagctggtgaccaagatcgacaggcggtctggtaaggagctggaggcctgcccaattcctcaagaatggtgatgctggcatagtgaagatgatcccaccaacccatggttgtggaactttgccacttacctcctcttggccttttgctgtcctnacatgagcanatgtggtttggtncataaagggtttnnaaaaangcccaacggggncagggaangggncc

SEQ ID NO: 86767 - DNA, 518 bp, Triticum aestivum
  unsure (1)..(518): unsure at all n locations
  Clone ID: PAT_TA_86767
cgaggacggatggctggacacggcctcgggagctgcaacctctacggcgatggagccgaacacttaccttgtcccgcataaagctcatgactccgaggtgccggactctctgccggactccgaacctcctgcgcccctgccagtcgaatccaattgggcgccgatcatggaattcaccgttgcggacatctttcagcactcaccctttggcgatatcttaaattcgctgaagcatctctcgctatccggagaccctgggccgaactacggccaggatggttgggacgcggacgacaaagaattcagacccacccaccacccacttcgtaccaccgtcgacgatctaaccaacgtactccgactacgatccgaagacatcgacggtatggacgacgatccggggagactatcaagaacaatgctacaagacactggaagacactcgtcatacgacatatacatggtggcatccaaaagatgggacgggaanaacaacgggggcgntccttaaaaaaacc

SEQ ID NO: 86768 - DNA, 546 bp, Triticum aestivum
  unsure (1)..(546): unsure at all n locations
  Clone ID: PAT_TA_86768
ccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaatctgacatcgacattgtctccaacgctagctgcaccactaactgccttgctcctcttgctaaggtatcaatgacaggttggcattgttgagggttgatgaccacattcatgccatgactgcaaccaagaagactgttgatggcctccaacaagactggaaagtggaaaggtgccactcaacacatccaacacacgggtgcgcaaagtttggaagtgnccagacttacggaatnacggnaggctcttccacgtgaagttcgtgtatcgacgtaactcaagcacactagatagtagntcacaagagatcgggaccn

SEQ ID NO: 86769 - DNA, 563 bp, Triticum aestivum
  unsure (1)..(563): unsure at all n locations
  Clone ID: PAT_TA_86769
acaacattttgttaaaccgcctacggtcgaaacgggatcctgttcattgggaggggtatggcgtaacgcaaaacaaaggaaatgaacttttgtttgtgcgcctacgatcaaaacagggtcatgttgatcgggaggggtgtgtcgtaccacaaaacggatgaaacggccttatgttgcagtgcctacggtcaaaacggggtcctgttcatcaggaggggtgtggtgtaccacaaaacgggagtcgacgggctactgttcatccatcgtctactactgcctctcgctctagcctccatgggatactgttcatccaccatcgtcctccagactccaccagctactgttcacagagcctccacaggggcctgttcatccacaccaaccggctgggatgttgcagcctcctcngggtcctgttcatcaagngnaaccactactacacgggtctgttcatccaactcatcggctgggtgggnataacttattacaatggcggaacacataactatcatcacagcaacaacgtctggaccacacnatcttgaccattcacatatgtggcg

SEQ ID NO: 86770 - DNA, 471 bp, Triticum aestivum
  unsure (1)..(471): unsure at all n locations
  Clone ID: PAT_TA_86770
aaatcatccatcacagacaggaaaacctctcttccgtcgcgtcgaccacgtagtgtaccgtcctcgtctctagatccaaacatggccgctcgcatcggcgctgctgtcctctgcatggtcttgatcatcatncgcggggctcgtagccactccgaccgaagctcgcnccgtggcacacgtcctctatgctgccgcggtcaccaatgcggtcggcgctgccagcggcgccggcgttcgtccggggaggtggaataccgcnaggaggctgcaaggagacgccgctcacaagcgggangtgccgggcngnccggacccggagcaccatcactaganagccgggagccatgcatgacgcgccgactacgtaggtanagcattcgatttccacgtaccacggtgtcatcgcgtggancctctatanaaaggtgttcggatganttggnnggaaattatttcatttgnnaagggatt

SEQ ID NO: 86771 - DNA, 463 bp, Triticum aestivum
  unsure (1)..(463): unsure at all n locations
  Clone ID: PAT_TA_86771
tgtacatcaagcagaagttccaggacaaggagcccaggttcgcagcggctgcggcgaccaaaaatatggtggactgatcagcctgagccagcaaccaaaaatggctgcacctgcaaagcttcagctacttcttcctccacttgctctcttaattaagttactcggtttacaatacagattggtacgataaatangttgttaagtacagatgtatcggtgccgttcggcggtctcacagccatacatgcaaatatatggtggcatatgagattgtcagaatgtgctgtggtcaggagatgccggagtgatttgtagcttggaacggcatctctctatgggtttcaaatatttcctccgtttgggtgtnagtatgtccgtgtggtttgtaaatgtncattagnggaaattgaggacntggaaaancctgtnagggaantanttgagggttgctaaaaaaaaaaaa

SEQ ID NO: 86772 - DNA, 573 bp, Triticum aestivum
  Clone ID: PAT_TA_86772
aacttgagctgttcatgaagtttgactggacacacatcacagctcagcctatttggttgtgctgttgtgattagattcggtttatggtagaagaatggtgtcagtcctttgtcaagttattccatctatgcacaacattggtcctggattattgttcagattaactccattttccctggaagcacgaaaggggggagacatttatcataacatatctaatattttgcatagcattgatagcatgccatcgatcggcactaccatatgtagtccatgcctgatgggtagcgtctggctctaagtagtcagtacttcagcacacatcctccttctccactttgctgaagatgccagtatggtatcattctgttaggggtgaacagaatagtagaacaatctaagcacattgtacaactactgagcgtcgctgctcatccggacatgtgtctacatggtgatatattactgaaccttcagttttaattaacaacccattaatacatggtataacgatatcgaagtactccttcttcaaaaagatattgaagtcatatagtacgaatctacatgtcc

SEQ ID NO: 86773 - DNA, 488 bp, Triticum aestivum
  unsure (1)..(488): unsure at all n locations
  Clone ID: PAT_TA_86773
ctccaacccgcggttcagcctcagctccctctcagagcccgacacctcctccgcctcccccgcggcggcctacaccaataccaggtcgcccgggaagacgacgacggcgacggccatcccgctcctattgctcgtcgccatcacactcctctgctagcttgattaagctctgctagcctgctaggtagatacatatcatacgctactgtagacatgagtgcatgacacgtcgtaattaatttgtgagactgatcgatcggccaggattttatcaggtgggtcgatcgagtttctcatgtgttttcttcgggccggtggggtggttagattgctttgaattgaagaagcaatttattccgattggatatatttatacaacaagaaggggaaagagaaatgagaaanacaagtcaagaacatgtcgtggtacacttgttgtttctgaactaacangacagatgagcaacattcttnaaaaaanaaaaggc

SEQ ID NO: 86774 - DNA, 544 bp, Triticum aestivum
  unsure (1)..(544): unsure at all n locations
  Clone ID: PAT_TA_86774
gcttgctccgcgctgtcgaaagaaaatgacaagcttgagacaagaatagtagagcaatccaactcacggaatgaagccacattgaaggagcagaagggaaagcagcagcagcttgatcagcagcagcagcagcagcagcagtccccacatgacagcttcgcgctaccagatctcaaccttcctgcgcaggacggtgctgatgggtcagtcccttgttgagcgctccagatcgccaccgcggcttcgctaaccgaataacaaagtgtacatagaggtagcaggcttagctagacgaggaggggcacgggacgggagtgccatccaaagaaaaagaatggcgcggatttcataatttttagaatttttacagggtcangtgtcactatcctgagtgacaagncagttgtagctaaacggatgactaattagctcactgcnaatgttctactactacaatgctcatattcaaanactgagagtggacactcaaaccgactcaacgttaccgattagtggttatcagttgcttgtanaatgatgataa

SEQ ID NO: 86775 - DNA, 411 bp, Triticum aestivum
  unsure (1)..(411): unsure at all n locations
  Clone ID: PAT_TA_86775
ccccgttgtcgctgactgggccattaggaacgcctcatgcccggaggaggggaaggacatgcccaatgactatgcctgcatcagtgtcaacagtcattgtgtggccgcaaacaatggtccagggtacttatgccagtgttccaaaggatatgaaggaaatccttatcttttgaacggctgtcaaggttaagtatctactcaaatttaacttctgtggttttccaagggatagttctctgaaaactgatgcaattctggaccatatctcagtgttagttccacaaagatatagattcatgaaaaattagtgctcgacacaatcttcaattttttgctantaccaaanggcacactcatatatcatattgatttctacacacctaangaaagactgggaanaaaaaaaaaaaa

SEQ ID NO: 86776 - DNA, 274 bp, Triticum aestivum
  unsure (1)..(274): unsure at all n locations
  Clone ID: PAT_TA_86776
acatgatgttaatcctgtttgaaaaggccatgttaatataaatgctttgcctctgaaagttgcagtttcttatctgaaactgaacttgcagtttcttatttgaaactgaaacttgcagtttcttctcgtctgcacttttanactcctatgaaactacattttttaagtgctaaaaatagatctgtagaattcataaaattcttcatatgctcaatactgcaaatctgaaattcaaaagacattcatatctgaaagtactctcaaaaaaaaaaaa

SEQ ID NO: 86777 - DNA, 284 bp, Triticum aestivum
  unsure (1)..(284): unsure at all n locations
  Clone ID: PAT_TA_86777
tcggattccnantacctgngaacggnnctgctnatttctcggtgcagtacancaatgtacatcnntanccagctcctgcttttatcttgtattcaccccnagcaaattctcaagacacnggacatcttnagagtnatgcctcnncctcaccttcacccttacngacatgntacaacgcgaactgagtggtcatccttatgnnggctngaatccatacacgnttaattcaatgttgaagntgntgggcncgaaggatgctccagatggtnacatattgcctgaca

SEQ ID NO: 86778 - DNA, 215 bp, Triticum aestivum
  unsure (1)..(215): unsure at all n locations
  Clone ID: PAT_TA_86778
tnagacaccaaggaccgccgtggantgaggcagaaccagcggagccngaggangtgaacgangaggccgcgcctcctgccgagccagaagcaccggccgtcnccgaagangcaccggctgcatcggaggaggcgcccncggccgcgncagangagccggccgccgcggtggnnagngtcagcntgtgaagcgccagcgcgcgcngaggatgagct

SEQ ID NO: 86779 - DNA, 538 bp, Triticum aestivum
  unsure (1)..(538): unsure at all n locations
  Clone ID: PAT_TA_86779
gtcatgacttgttagaattgctctctatgcttcacttaaatcttttatgagctaggacttgctctagtgcttcacttatatctttttgagcacgatgtgctttattatttttgaataaatgctttcttgcttcacttagatttgtttgggagttagtaaaattttgaagaaattctctcttccttcacttaaattattttgagagaaagaaaaattgttatgctgatgatcttcacttatatttggttgagcttatgaaaagcaactcatgaaaattagtcccaaagtgatagctatccaagaaggataaagtaaagaaaatgtcatgaagatcattggacaaaataaacttgattcttagtaatagtttgggatatggtgatgtgatatgtgagttatgttgatgagtaattatgcttagtaggatactgggttaaggttgtgatcccnagcatggcaaaatcataacatcatgaaatataccactgggggngcatatcgggtaatatgctaaactctagaatatcgncggggggnn

SEQ ID NO: 86780 - DNA, 554 bp, Triticum aestivum
  unsure (1)..(554): unsure at all n locations
  Clone ID: PAT_TA_86780
ctagtcctaatcgccgcaccggcgatgacggtgagtgatgctttgggttgctgccaccagccctactgctcccggtccctttggttgtgttcatcaaggttccagtcaactgatttgggcaaatcttggaggttggtactcatcgagccgccgatcttcaatctgatccattcaagtcaggcttgactgattgatgcagggcgaatcaaggcgggcctgactgattgatgcagggcgaagcaaggccggggtcaatttttgttggttctatcggtaacggcctcgctcgacacttccttggcgttgacacttacatgcggtggattttcacgcccctacgccccttcttcactggacaataatacaaagggtattccaaatttcatctttgctctcctccatgctttgttccccttttcgagtgttgtantttgcaacttaattcctgttaaaaggttaacatggttgattggncagganatacggaacaagtatgngctaanatatgattcccaggagtcacnccangtatgtataacncggttacttacntc

SEQ ID NO: 86781 - DNA, 552 bp, Triticum aestivum
  unsure (1)..(552): unsure at all n locations
  Clone ID: PAT_TA_86781
aancaanatgcattatgttgaaatatcataccgncnaaaggnggcanaagctatacagagtatgcantgatgncanggcaaacagctgacntatgcaagtganatcatcantggaanttcaanttcctaccaacagaaatccaattgcnagcaggcanangatatctgtacacgcanctgancangcacacttcactgatataagcaaggtcaagcacatcaatgctcnaaatcatactgtnnatattcacaagttgatgatccctatttctagtgtggtaccgccaatagcacgcagaccatagnttcatgagangatgaatctctggagatcagaangcgctgtacncgtcctcagagttcatctggaggaancacacgatggncacccgatgacgcganagaggacagntccatcgtcagngcgncccaccgatacgccggcgtgcttcagttcnaccggatggnatctgccacattgagcnccgtcagaanttgtaantaaccaccacatccgtncaatgangacgggaatcgngccagaaaatatat

SEQ ID NO: 86782 - DNA, 412 bp, Triticum aestivum
  Clone ID: PAT_TA_86782
gtggaagccgatacttttcagggaaggaagtggaagcgcaagaagatgagatgcgtggaggaaaattgaggtgtcgccaacctttatgctgcattgtagcggatggcaaatggattactgcattttattcccgcccagaatatggagccatcactttgctttgtgttatcttgtcgaactgtctcttatttgtctcccaagatgatgcatcacgtaccatttccttaggtttctcctgtaataataaggcttgatggtgggcaggagttagcactagttcctcgctccttgcttgactagccagggatcatattttcttgttattgttgtatgtgtgcgtttgcttattgcatcaaactgagtgtatcaactgaacacttatccttgtactgttgtattctggaaaaaaaaa

SEQ ID NO: 86783 - DNA, 512 bp, Triticum aestivum
  unsure (1)..(512): unsure at all n locations
  Clone ID: PAT_TA_86783
ggctggtcctgcgagtggcggcggtggtcgcctctgtggcagcggcgcaggtggatggtggcgctgcgccggacggttgatgcgctggtcgcttccgtgggcggcggtggtggggcagtgcaggtgggttgcggtggtcgagctgcgcaggtgggcctccgtggcggctgcgcaggtggtcggtggcgttcgacccgacggtggctcccgccggcgggggaggaggaaggaaggagacgggtttatttttcaagggggttaaacgtatgagattttttttcttttttgcaaaaaacacaaaacacttttctggacggagagagtagttttatgtcttgatgatccgtacttgatcatgttatatttgtttattatttgaaccagaaactgaatctaatttttaaagaaaaaaaanaaaaaaaacccanggggggcccgtaccaatcccctanaggatctattacccnnctattggcgtcgtttaaacgtcgnactggnaanccttcntacca

SEQ ID NO: 86784 - DNA, 569 bp, Triticum aestivum
  unsure (1)..(569): unsure at all n locations
  Clone ID: PAT_TA_86784
ttgaattgttgctggtgatggctgcaatttgaatgagcgcctcatgtcaacgacaacacatgcctcagatgattttgtccatgatgatctggtaggaactaatggatgaaccaagcaaaaagggcattcaagaagatcatcatgcagttaatcgtgatgctgatccctcgcatgcgattgaagatcatcacgaggtgtatccgaaaaaatttcaataaacttgttgtgtgttcttttaacttgttgcatgttcttgttgcagggccagagaagcacaccctttattgggtactagcgttgaggaaaaaggagattactgccagtggcaaactctgttgggacatcaacagcaatcgatgttccacatatggtgattgaaatctgagaaagacactaccgtggacaaccatcaaaacaaatgtcaaaaaccggtctaacgangataagaaacangcangcctgcaangctttcaagctagataaactcntgtactgtcacaaggcaagtcaatcacttcatcaattcgacacanccttgtgaatnatggggaaaggaaangaagctgttg

SEQ ID NO: 86785 - DNA, 542 bp, Triticum aestivum
  unsure (1)..(542): unsure at all n locations
  Clone ID: PAT_TA_86785
ggccaccaaggcggcgaggaagtcggcgccgaccaccggcggcgtgaagaagccccaccgctacaggcctggcacggtggcgctgcgcgagatccgcaagtaccagaagagcacggagctgctcatccgcaagctgccgttccagcgcctggtgcgggagatcgcgcaggacttcaagacggatctccgcttccagagccacgcggtgctggcgctccaggaggccgccgaggcgtatctcgtcgggtcttcgaggacaccaacctctgcgccatccacgccaacgcgtcaccatcatgcccaaggacatccagctggcgcgccgcatccgaggggancgccctagatcaacatctccttacaactccatcgctggttgcacatgtactnctgtcntccctctggttcaaatctgttggatagggactttatttgctgtaaaaaaatctggttggtacagattacaacgatcatttctantctcaagnttggctaaatgaancaagtaccnttgtttatncaatcgtattcacgctcaaana

SEQ ID NO: 86786 - DNA, 466 bp, Triticum aestivum
  Clone ID: PAT_TA_86786
gggtcagtcaagagcatgtcggtgaaggggaccaacaccgcatggatcccgatgtcccagaactggggcgctaactggcagtgcctagcggggctgaaaggacaagcgctcagctttgcgatcacctcctccggtggacagtacaaggtcttccaggacgtcgtgccggcgtggtggttgttcggacagacgttctccacctggcaacagttcgactactagctagtatgaacattgtacaatttgtattacgattatcagttcgcttcatcagagcgaacatgcatggaactgtccagacgcatactcattatcccattttgatttttcggttcgttgcgcgttgagtggatgtagatttgaattgtgaaatcggtaatccacgactcctctagtctcgtcatctggaacatatatacaagagtggacgtgtgtgcgcttgctgcgtcttttcaaaaaaaaaaaa

SEQ ID NO: 86787 - DNA, 555 bp, Triticum aestivum
  unsure (1)..(555): unsure at all n locations
  Clone ID: PAT_TA_86787
ctcgagttttttttttttttttttccaagcagatcttgaatctggtcaatcaaaaataatgcgttgatgtttctcaacaaaggggccgagggagtaacatcgaacaacagttttcccatctacagatacatgaattatctacaatatagcagtacaggatcaaatctgcgtcaggtcacacaacttggcgcagctctgctgtgttgagtgcgaacttacggtgttgtgacaacacggatggaactaccaggctttcctttttcaggccagctacatcatcgaggaaagatgggttttccttggctccactgantactgcttgaaaatctgcaanggntcccatggctgaaatangancagcaganccatgaaacncacgtcgtaaaaaacncacccctgcaatctacancaacatctgaacgctctccaacttcnggggccagaaggatntgctcactatgccatactcncaactccagtaaacaccaagatggccnaaaactcacaattcaggtgctaacagacccaatgganccacancgggacactgcgnnc

SEQ ID NO: 86788 - DNA, 411 bp, Triticum aestivum
  unsure (1)..(411): unsure at all n locations
  Clone ID: PAT_TA_86788
cttacaagatccttgaggtcaggtgtgataactagcgacacgtggtggagcttctgcggtagggcatcgccgacggcaacatcacctgcatcaaaccctccctggtcgccttcgagagtgtgtgcacccgacctacaagcttgttatgatgccctttgaatttccgagcaagttgcaacctttccagatttatcaacactggtcacattagtagtcaatatggttcagatgcataatagtacgtacttcgtttccttttcgttgcatacatggcatcttgtgaggaagtgtnccttatattatgtanctagggataaatatgacgaacccaacantaangganctcatgtaaaaaaactgaantttaanggaantgtataatatatatatcanttccgacattaaaaaaaa

SEQ ID NO: 86789 - DNA, 574 bp, Triticum aestivum
  unsure (1)..(574): unsure at all n locations
  Clone ID: PAT_TA_86789
ctggaggccaagctcaccatggccatcctcctgcagcggttcgagatccgggcgtcccccaactacgtgcacgcgccgacggtgctgatgctcctctacccgcagtacggggcgccgttgatcttccgcccgctggcatcgcagccgtcggcgggttccacgacgtcctcctgtcctcccagcccccagttcctttgtcaaaactgacagaacaggaggatgtttccactagactagaaaagaagggtagggcaggaagaggtgtgggtcaccgtggatggacatggagcccctcgaacgaaaatcataggacaagcccaagatgaccgaaacgccctccaacaagccccgacctgctgttatgtgtataatatgtgagtcaagtgatanaagagcaagaacactaacttttgtcctggcctgtgtgtggcctgcctgggaccgtcagttgcaaaatgcctccttaacaaacggntaggcagccctctttttanattgatggacanngaggaaaangcccactaactctctcttctctgttgtttccaaggctcgggtagtattgnnaatttna

SEQ ID NO: 86790 - DNA, 244 bp, Triticum aestivum
  unsure (1)..(244): unsure at all n locations
  Clone ID: PAT_TA_86790
gatggagcccctggaggcggcgatagcgatcgtgttcaacgcgctgctgctggtgttcatggtgaagctcttcttcgccatgttccagatgaagctcgtcgtcatcctcttctacctcgtcgtcctcctcttcgccctcgccttctccggccggggccccgccggcttctaggttaggtccttcgttttttttccccttgcttcggttggcnccggntcatcccttgganctgtaaaaggggtg

SEQ ID NO: 86791 - DNA, 419 bp, Triticum aestivum
  unsure (1)..(419): unsure at all n locations
  Clone ID: PAT_TA_86791
caaggctgtgaagtctgggtcaatcaagaagacggcaaagaagatccgcacttctgtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactcgtcttcatcgtcgacctgaaggccgacaagaagaagattaaggccgctgtcaagaaaatgtacgacattcaggccaagaagttaacaccctcatcaggcctgatggcaagaagaaggctacntgangctgacacagactacnannccttgatgtggcaaaaannnggatcatatanncgggggggggccctnnataggcntttcc

SEQ ID NO: 86792 - DNA, 564 bp, Triticum aestivum
  unsure (1)..(564): unsure at all n locations
  Clone ID: PAT_TA_86792
gttgcctcccgatgaacacgatgcattccgttgcctccccatgtacatgacgcattctgttgcctccccatgaacacgacgacgacgctgtttctccgttctgacccggccatgtacacgagcgctggccgtacgtatgcgcgagtaggcgttcgagatcccgcccgtatgtacacatacgtggccatattttctttcttgcaccctggccgttgtacgtacatgtacatgctacgtgcgcgcctctactatgacacgtacacgcctctactacgacacgtgcgtgcctctacatccactagtatatatgtacatacacgttcgcgaccagaatgacacctatgtacggtcgacaagtgggtcccgactatcaggcactccttgcctgcgaagatgtactggtgggtccagtagtcagggagcgaacattttgccgggccactcntgctgcnaaattagcgggggtccaaaantcgggggaatntttcgtnaaaanagggccctncgggggtccaactgtaggggngaacatatttcgctaaaggnggactcttgcgcggcttg

SEQ ID NO: 86793 - DNA, 179 bp, Triticum aestivum
  Clone ID: PAT_TA_86793
cttgacgcgacggggaactcgtgtacgtgcaattatgcatgacgcttgaggccgcgctgacaacgagcgcgtgttcttttgttctttccactcgtgagacactgacctgtggggtgcgtgtttgaaaacgtgatttggttatgcaaattagccgagtttggaggcccaaaaaaaaaaaa

SEQ ID NO: 86794 - DNA, 538 bp, Triticum aestivum
  unsure (1)..(538): unsure at all n locations
  Clone ID: PAT_TA_86794
ggggagctcctcgccgctcgctggtgattagcggcaggtcggccaggcgaagacggcgcccggcgagtcaccccacaagcggggtttgttcgcgggaggcgtgcttcacagggagggccgcaggcaagagaggtgttggtctggagaggagctcggccgtagctaccccttcgtgctcgccaccagcaagcgccgtcgatgggtgatgtagtattcgccggagccggtggggcgcaagagatgattgtggatttttcccaacgaagataatggagatatgggaaccagctttggatccgcggaagcatttctcacaggatgatatccagaatataaggattcaatatatgaatcaactattctttggaagaaaaacaccgcagacaagaggcttgtcactgattaacctacanggtgattctcacaatcctcatgatagcttggttcncatgtatttggctgttgactatatcaagagaaagagtccctactttttccgtgtccaaaagacttttttacacacaagacatgtatgngg

SEQ ID NO: 86795 - DNA, 221 bp, Triticum aestivum
  Clone ID: PAT_TA_86795
gatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggatcgcggcgacgggggcggttcgccgcccccgacgtcgcgagaagtccattgaaccttatcatttagaggaaggaaaaaaaaaaaa

SEQ ID NO: 86796 - DNA, 262 bp, Triticum aestivum
  unsure (1)..(262): unsure at all n locations
  Clone ID: PAT_TA_86796
ncagtacncagtaaagcgtnctgaattcctttggtcacaagtgtcccngctttgtctatgcnaagaatanatgtggatggngtcgccagcacgaccgcntgtttcagtgttaggttggacatganttaccttctgttttccgcatcaactattacntctgtaatgganttgcnaancaagtactcntntttggttgtggntngngaagatnaganaaatcgttcagtcnantggaatcaganccggnggnttctccaatgtc

SEQ ID NO: 86797 - DNA, 170 bp, Triticum aestivum
  Clone ID: PAT_TA_86797
gcaaagctagcactagctatgctggcctgtcgaggcaaaaagcgttcgtgacgtacttctagccgggtttggcccagcagcctgtaaccctaggtcgctgttaacttgtgcatgttgggggctagaagcgcggagcgatttaagtcttttataaaaagaaaaaaaaaaaa

SEQ ID NO: 86798 - DNA, 558 bp, Triticum aestivum
  unsure (1)..(558): unsure at all n locations
  Clone ID: PAT_TA_86798
gtttactgattgccctcaccaatttgaatatatcaagcaatcagttgacaggaaaaatcccaaatcagatcggtaatctaaagcatttggagtccctggacctatcgtacaatttgttatcaggtgcaatcccatcaagcttgtcatctcttacttctttgagccacttgaacttgtcatacaacaatttatcaggtgcaataccatccggaccacaactacaaactcttgacaaccagatgtatatatacagcggcaaccctggtctttgtggtcctcctctctccaggaactgttcagcaaatgatgcacancagagcggccttgaagatatgaaccttatgtcatcagtttaccttggcacgagcataggattcgtggtgggtcttggatagtgttcgcacatgttaataaagagaaccngagggcactactcaatttatgaatgancanacaggttatgtgaattgctgtangtggctccctgatgaaatgccagacatcccatgacaaaatgccattcncngnatgaatnntcaagantcattaaanantttt

SEQ ID NO: 86799 - DNA, 562 bp, Triticum aestivum
  unsure (1)..(562): unsure at all n locations
  Clone ID: PAT_TA_86799
gctctgcatccagagctgcaacgccggcaggctcatcagttctttgcccctcagtcgccggtgcttccgttctttctatgacgatggggttgcttcctctgctccgttcatgtcgtcgaggttttgtgctgtttgcctctctggcccaaactgttttcggagcgctcgtgctttagagatattgcaaggcattatcttcctgtcccagtaatcaaaaggcgcttcattggactgatgtaccagaaagtgtagtgccactggagacaattatttcagatcaccttctacttcntgatggaagtcattattagaatggtgaagaatatgagcatccagagtatatcatttgcggacagnccctgctatccaatattgccgagagctnaaaggtactgtcattggggcaatgaatgaagtctacagcacaatgtgaacaantgtttgcagttcgctgcanaaaacagatataatacaagtcncatcacaacaaacatccaaagcaggcaacggatggcactaacgaaacaactaaagataccctaaggnagctgancatgattaa

SEQ ID NO: 86800 - DNA, 275 bp, Triticum aestivum
  Clone ID: PAT_TA_86800
ctcatttcaagattctttgttggatttcggtgcgctcttgagcgctgaggggggtggtgctggaacggaatgtttcgttgcgaggatttggtccagggatgtcacacaattctttcatagataatgagattggttggcttggtgctttagatttcggacctcagctgtccagattggtcgccaaatttaggttgagatcgtgtaaaacagcttgtaaatttcggctaaatacattttgcagtgatctggttgtgcttgtctataaaaaaaaaaaa

SEQ ID NO: 86801 - DNA, 481 bp, Triticum aestivum
  unsure (1)..(481): unsure at all n locations
  Clone ID: PAT_TA_86801
cacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatattgatcatcgatcatgcatgcaccgcgcgtgcagcatcgatcatatcgatctactactaccataccatgtaaccgctacctgatcgagggccttatctatgcacctgacctgcatcancagtcagtgcatgccatgctgttgtaaaggccccctaaataaatctcctggttaactaaaaaa

SEQ ID NO: 86802 - DNA, 339 bp, Triticum aestivum
  unsure (1)..(339): unsure at all n locations
  Clone ID: PAT_TA_86802
tacatgtttaaagtttattataaagaagttcataaacataagtttctcctcaatttcattttttagttgtacaacctagttccttattcatagcatgtaaattaaactaaatatagtagagatattactcgtagtatgagaagggagagaagatctgacctctctactacctctgaaccaacttaattccttgctaaaacaggagctgaatttcattttttagttgtacaacctagttccatattcataccatgtaaattaaactaaatatagcaagtgatcttccttagcactgcatgtatgcntgttgatctgtaatccagtggtgtggtcaaacta

SEQ ID NO: 86803 - DNA, 546 bp, Triticum aestivum
  unsure (1)..(546): unsure at all n locations
  Clone ID: PAT_TA_86803
agaactataggtacttttgtcaaaggagattagctaaactataggtcggttctgccaaaaggagattttcccaaaatatcggtaggttttgccaaaggagatttcccagaaaaactacaaaacagtcactgtctgaaatgttcagtgccaagggaggttccagaagaactacataacagtcactgtgttaaatgttcagcgccaaaagagaattgccctaggaatggcttgttacaggagatgtttccagaggaaagttcaactgacatatgttcgctttcgatgatcaccagacatgagtagtcatcagagaatatgccactacccgaagatcaacattcgtcaagaaagcaaccaacaacgttcagataagctgatcctgcaaccatatcagaagatgttaaccaacgtcgtctctaatagacacatcangttgagattaacnangtgttgcatagttcataaacatggttaaagttaaacnntanttaaacacgngaaagaactgaggggtaggtcattaatgncnanatccagcatcatgtt

SEQ ID NO: 86804 - DNA, 560 bp, Triticum aestivum
  unsure (1)..(560): unsure at all n locations
  Clone ID: PAT_TA_86804
tagactctatctatggtcaatggaggctggtcctggaggagctgcggcatgggcacgacgcagggtcgtcgagctcgagccgttgctccctcctcgtgccctcttggacatgtcgagctcggatgtgtggacggttggttttgctgaaggagttagggtaatcttcctcagaactccggctgggttgtacgcagttgagcttaattcaggccgagccaacaagatgggtgaatttagcattgaaaaggtcatgccctacatgaggttctgcattggagcatggggccggttgccggcctcggatgaaccccacacgcagttgctggtggtacgatgatgtaaccaaatggcgtcaagaaagnggatcctctacttctgcctcccataaagacttgaagatgagctctgctgttggtagggtattacaagaacaagactcttgtactgcactgtgtctcttcgggggtcacctccttcggaaaaaactcntctcggtttaagatattcatgcaagaatcaattaatacancatgtctacaaagnaactanttcacantgnt

SEQ ID NO: 86805 - DNA, 451 bp, Triticum aestivum
  Clone ID: PAT_TA_86805
gtcggctgtagcaatggcaggtgggtgtcgccagcactgcaaggctctctcggctgctcggtcagcagcgccgccgtcgccgacgcgcgaagatcatcgtcaccgtcgtcgtcgaccccgccggagactcctgtggatggcgtctgcgctgcccctgtggagggggcgagctgcaagaagagagagctggtcgagttgatcgacggattaactgatccgtaggagctctgtgcgagtgtccatgtcgtcggcaggtctaattcttggctgttctgttgcttcgatttgcaaccagatttgattcctcgcgccgtgcgagcgcgtgttcttcggtgctggtatatcagagattcatctgcctccctcgttgctttcgctagttggtctgttgatatggcctgctgcttggttggtatattacaaaatcaattggaattctaaaaaaaaaaaa

SEQ ID NO: 86806 - DNA, 555 bp, Triticum aestivum
  unsure (1)..(555): unsure at all n locations
  Clone ID: PAT_TA_86806
gtcttcctctgctcgttccagtgatgcatcttccacataccaccagcaaccagcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtacagctggagcggatggtgttgctaacatcaatgttactgactgcatatccccttactggncaaattcaattgttggccgtctgtttcgtccatggtgacctatgatcttggnagggggacataactgncanagcatggaaacctggtgccgtttgctgcggatcancgggctcaggntaattcatctcccn

SEQ ID NO: 86807 - DNA, 433 bp, Triticum aestivum
  unsure (1)..(433): unsure at all n locations
  Clone ID: PAT_TA_86807
ctagtctcgagttttttttttttttttttatgtgaaggcatgtattcttccgctttggtatatatgatctggttaatacaagccaccatttgcttaaaagaaaaaaaacataaagcacacatgccatttggtccatgtgtatatcacacacgaacacattcactaccgcgggcaccttgatgagaacaaatattcttcttcccggctatattgtctgctaacctcctccgtgcttccgccttcaatcattgtataaccttgtgcatcaataacacccatcacaacattttcatggggtacttgaagactctcgagtgtcatctcaacttgcctcanggttggtcgttgaccccttcancctgacncanccgctgccaaaatanntactnctaatcttttgccaccttnaacangacggggggntcnacacact

SEQ ID NO: 86808 - DNA, 399 bp, Triticum aestivum
  unsure (1)..(399): unsure at all n locations
  Clone ID: PAT_TA_86808
gagagctaataatgggggcgagcaagctattcccggcggcttcggcgttcctggccggggtcctcctcctgctcgtggtcgtcgcgcagctcgccggcgcccagcacatcagctacatcccggataggccggcgtgcccgggccagtgcggggcgccggggcagtcctacaccagggactgcacgtacaagaacctgtgccggcactgagcgcggcctgtgcgctttatgtgcacaaacacaacccaggtggttcttttcttttctttccgaataatctgtgtgcgcaagcgattaaatccggactagcgaatttctccatgtaagtaacggtatattcagtgtactgtgtttcatttcggcagctgcagtcactttcnatttgtccaaaaaaaaaaaa

SEQ ID NO: 86809 - DNA, 531 bp, Triticum aestivum
  unsure (1)..(531): unsure at all n locations
  Clone ID: PAT_TA_86809
gagaccaacttggccatgagtgggctactagacaacattgtggctgagcgggcggcacaagctgacaggggggagaagaacttcctgtctgtgatgcttaatgcaagcgagagcacagacgcaatgaggaagttgttgacgcaagactacgtgagcgcacttacatatgagcacttacttgcagggtcggtgaccatgtccttcacgttgtcaagcctggtgtaccttgtggcgatgtaccccgaggtagaggagaagctactcaaggagatcgacgcttttgggcccaaagatgtggtacccaatgttgaggacatccagaccaanttcccttacatggagcaggttttgaaagagacgatagattcacacgtgtccctctgattgcagggaacatccgaggattcaaattggaggtatgtcctccnaaggtacttgggtgtggctacacaggcgncaagcaaagaccaaagcantccaaaccgacnnttcggctaacgtttgccnaaagcaggatcaagcaagganctn

SEQ ID NO: 86810 - DNA, 240 bp, Triticum aestivum
  unsure (1)..(240): unsure at all n locations
  Clone ID: PAT_TA_86810
accgcttacctgcaangtggagctccaaanagaatgangaanaactttgncgtggccgtgctgcctcanggaaatgttgcacangacatccctgcttttgaccatganacgaactactcgttgccttatgttgagancagctcggncggatcaatggaganncttcngctgaatggcgcnattcacgncggggcangcagtggngatctctgnancctcgatgngctcgtcatggcggct

SEQ ID NO: 86811 - DNA, 547 bp, Triticum aestivum
  unsure (1)..(547): unsure at all n locations
  Clone ID: PAT_TA_86811
cgaaggtttcatagcacgacagcagagtcaattacaacagattataaatcaggaacacaggaaacttcctgaagacttggattaccactcgatgctaaatctatcccttgaagctcgtgagaaactttccaaggtaaggccacaaaccttaggccaggctggcaggatcggtggcgtgagcccagctgacatgacggttctcctcatctcgatggagagcacccgccgcgcggctgagtacaagcgacaacaagaaatgatgaggtccgtcgccgcggccagggccaacgccaatgccaatgccaaggcggacnattcttcagacgaggcggttcatgccagcaccgcgtaactgcatcacccctgnctgtgactgctacaggcaaccganccgggacctatcaacagaantgcttcgcgggcaatgtgccccacgacgaaatagatccacgggcaggtactggaaccancgaattgtcaggagatctgagatgcatggcatactggaatcactctttaaatggctgcggaagggtagtggtctnca

SEQ ID NO: 86812 - DNA, 368 bp, Triticum aestivum
  Clone ID: PAT_TA_86812
ctcgtgccgctcgacttctcgtcgccgctgggcaagctcgacggcgagggcgagttcgacggggtcccggccacgcccggcagcaagctcggcgtgctggtgtcacctgacgagtagacggatgcccgggaccgggggggagaatgagctgctgggtggtgtgttccaatggtggaatttcttcggcatggcttggcttttgctgttgttttgtggttgcgtgcttcagtttgagcactctctccgggactcttttttttatccagatccagattcagaggcttcagcgcctcagatagtacaaactgtgttgtaactgcacagattattattagcatgtccgatgctctctccataaaaaaaaaaaa

SEQ ID NO: 86813 - DNA, 277 bp, Triticum aestivum
  Clone ID: PAT_TA_86813
gcgtgggcgagctggagagcgagagcgagaaggtgttcaggagcctcctgcgcaccagggtctccctgctcaacatccacacgccaacaatttagcttcatatattgctatacagtatacacacacaagattaattatgagatttagattattcgtttagattataatcaataattggatcttaattaagtctcctgccgtgcagtgatctcatctcagggtaaaatgattactgcaatatatttggcacacaccaatgttttgcaaaaaaaaaaaa

SEQ ID NO: 86814 - DNA, 585 bp, Triticum aestivum
  unsure (1)..(585): unsure at all n locations
  Clone ID: PAT_TA_86814
ctccgctccaaatttgttttgagcattttcttcaatgtgccaaaatcaattgcttggtgaagttccagtttatgtttactatccaatagtaatttctaagaggatacatctcaagcaggatggaaagaatttttttttaatgcaatacaagataatttgttgctagactggcctggaatgtgaagtcaatatgtatcggatgagcatcctggcatgtgagatgcatgaaacatggtatttttttactggacatcaaagataggactgatgagtatcaaataccatgtgtgagattcaagaattcattgggaagaacgaaaactggagacaaggaacatacttgacggctcctttgttttggttggcgctgtacttggagattgcttggcgtgtactaagctggtggcactttttctctgggcgtcatctctgagactgggtattaataagatagaccttgcatccgagtgggtatggtccgatggtcattccatccagttgngtagtttcatgtcgatcagttgggtagctccgatggatttcctcactcaaccatagtgggaagtttanatgtaaatacttcgg

SEQ ID NO: 86815 - DNA, 568 bp, Triticum aestivum
  Clone ID: PAT_TA_86815
gactgcaacacttaccttcaaggacacaagaaagcttggacagggtgcatttggcattgtctataaaggtgcagtgatgatagaaggcacacaagtggaggtggctataaaaaagaatacaagtgatgtgtcagatgaaacgaggaaggcctttaagaacgaggttgaaattatgagcccgctgaaccatcgcaacattatacatcttgtgggttggtgcaacgaaaagaacaacctcttgcttgtctacgaactagtggagaatcgcaaccttgaagctcggctttacaaccatggtggtacagatttagttcttgattggcgccaaaggtacaacatattggttggaatagcctcgggtcttgaatatctccataataattgttcaagaaccgtcctccacagggacatcaagccagctaatgtatgctggatatggactcactgctaaacgtgtgactcgtttggtgacacaacttacacgtgccgcaactcacgctcacaaatacattattgggacacaggcacatgaccatatacacagaacgcaagttcaaagaatcgatgt

SEQ ID NO: 86816 - DNA, 558 bp, Triticum aestivum
  unsure (1)..(558): unsure at all n locations
  Clone ID: PAT_TA_86816
gttcacctgacgccccacgccttgtctttcatcttgccaagatcgaagacctggcgaatggatgatatcgacattggtgtggtctgtgacgagggatccccaggttcaacgttgtcaaggacaagaacacctgtacccaaggaagatgactacctgatagtaattccttatgcccacatatttgaccttatgctaaaagctttaaagttgccccctgcaagttactatcacaagatatgtctgggcggcaagaatcgtgtgacggttactttcaattcttcctcgcaattggttgatggtttgcttgttccgacctcaatatcgggtgcaattttagatggctatgaagatgcagaagacagtgctgctatcgcagctattaggtacatggaaaatgcatatggcagagaaatgagagactaccactacaccatgtcaagagcagaaaacaatcaacatctggtcagatggttagtatagnaatagaatcaagaaataccaaaggtggacacccgtcagatatatatcaatcaccaatcaacaaacacgccnacactg

SEQ ID NO: 86817 - DNA, 450 bp, Triticum aestivum
  unsure (1)..(450): unsure at all n locations
  Clone ID: PAT_TA_86817
gttttatttagctgccaaatgcagcgagttgatgctaaacaaacagacacaagttcagtaaagaaaagcctcaatttaccaaccacaaaattgtacacccagataagtaaaaacgacgcaaacctgcaagagcctcttttactttcaaggaatggattaaagctagacatctagtacaactactcagacgttaggataccaccactaaccgattacaagattcgacatcagataaccaaactccagttctgaacctaccaagaaatcactacaaaaatagtacagagcaatcgaacganaaagacncaacagttcatggngaacaagggacnggttaccntcgtgtgcnaanggngtgtccgctccttaaaggtggaactcatccgggaaccggggtttcggtnccgcaaaaaaantttnttaaaananngggacctgccctttcggggg

SEQ ID NO: 86818 - DNA, 564 bp, Triticum aestivum
  unsure (1)..(564): unsure at all n locations
  Clone ID: PAT_TA_86818
cgagttttttttttttttttttttgaagtgtatccggtgtcgcccacgagtgacacaggagcgagatccaattttttcgggaggtacataaaaaatactttacacatttgtgtcaaacctgaaaaaggagtcccaccaaacattagaacaatctacaaactaaaaggccttgcacaaaaaatctacaagctaaaagtgtatgtgctagcctcttcgagatcaagcacatcctgcggtttgaacttataattcacatcacgttgttgctctctaccaagcaaactttgcccctcctccggtcaccagcaccagctggcccatgggtgcctctggtaccttctcaacgcctccaacctctcagcaacttccttcatcgacggcgctcctcgccgctcagctcacgcatcgcatcatgagggtgtgattctccaatgcctcaggcgcatctcattctcactggttgtcaaggactcgtatgccacaacctcgctgcatcatgaaccgacacagntcctcctctctggccgtcnagcgatggntctccgtaggactcacaaaaancan

SEQ ID NO: 86819 - DNA, 536 bp, Triticum aestivum
  unsure (1)..(536): unsure at all n locations
  Clone ID: PAT_TA_86819
ttacaagtcaaactagcagaattgctcccggaaacagaggtcgttccgatcttacgttacaagtcaaactagcagaattgctcccggaaacatacaactgactagaaaaggcattttgtagccggcatcaactttttttacaagcacttcaaaaggcttccgttctaccgagagccgtgcagaattggacgagctacttgtcatcctttcgtttttgtgctcatgttgacttgaaaagccttcaatggtcggttgtttcttcttagataacgcttgctggaaaaggctttcactgttggttgcgatcttagagctatcacttcctaacctttctactaccgttccatacgaccttcaatgaancatgctcaccgactaagaaacaangatccnctcntaagngcancacgaaggcaggacactttgtacacaggtcctgaaaancccgactttgcataaggcaacacagaattggacttcgttcncaaattctcatacacgggtcacaatgagagcatnacntgccncatcctcat

SEQ ID NO: 86820 - DNA, 564 bp, Triticum aestivum
  unsure (1)..(564): unsure at all n locations
  Clone ID: PAT_TA_86820
tttttttttttttttttttaagataagatgcttgttaattatacatattcttgtcccccaaatcaagcaaggcgagcggaggaaaagaaactaactttatacagtctcgcgcatcctaattttggtaaaggaaaagtaaaaacgcagcgaggggaggaggcagagggagccggaacggaacttggaaaagaagaaaggaaaaacacagcggagcagcaccggacggacggaggaagacgacgacggcgacgtcctagatagtagtaagatgattgacggaacgaggtgcatttccatgtctccgatcggcccaatcacgaagtagtaagcccatgtgtgaagcgactggaacggtgggaacttctgctgcagcgacgatgncagtaccccacaggatggncctcnaggcggacacccgggccgacattctcgtcnacgaccaagacgaccgcacggangccgccgaggctcatatctcagtcaagacaagccgggaagcaacaggctctccggtcttggacggtcggcgtcggtgcagcggggcgcgcanacgcctgcgnngag

SEQ ID NO: 86821 - DNA, 398 bp, Triticum aestivum
  unsure (1)..(398): unsure at all n locations
  Clone ID: PAT_TA_86821
caatctggtacttaggttgtataatacagggcagagttcttccagctactaattcacgtaatctgatttatagcctaggcacttttatttaagcatagttaaatattcgatggtgaccaaccatccgtcacacgcgccatacaaacaattcaggaggaggcccgcttgtgggcatgcgccggcaccaaagacctcgtgatcatcatcccggagacgtagtcctggtccatcgtgggaggcgcttccacagagatccatgcntcnaggcagcttactcatgccttccacatagtccatgcgtcgaggcagcttactcatgccttccacatagtccatgcgtcgaggcagttactcatgccatccatgcgcacatgcntgcangcggcttttgttgttgc

SEQ ID NO: 86822 - DNA, 450 bp, Triticum aestivum
  unsure (1)..(450): unsure at all n locations
  Clone ID: PAT_TA_86822
gcggctcctagtctcatgtcgccatcgtactactcatctagcttggctgccgatgttgtttggcggcaggccgaaagcggcatcaatgggagagcggctgcagcggcaatgaggctgtcgtcggtggttgccgcggctccagcgccgacggacaagtagacgcgcatactcgagcaagctgtgcatggatgggatgttctccttgaccttgtccaccagctgcaggcctgtgatctcctcaaagacggctagccggcggcggtagcacgacgagctcgccgcatcggacggaagaggctattcgcgtggccttgggctttacgtcgacattaagaagtccttgtcctcttggcactaagccgggatatcgccgactcaatgactcgaatagcatancactgtaacgactcantttaacatgtcgggtattatgggggaattantttgttt

SEQ ID NO: 86823 - DNA, 569 bp, Triticum aestivum
  unsure (1)..(569): unsure at all n locations
  Clone ID: PAT_TA_86823
ttttttttttttttttgcatctgtttttcttttcgcatgaactgacgagatccatacaatttcagtctcaaggcaaaccctcaggatggatggtggtattgttcagacttgaactaaactggagctccgaaaagaaatatccctacctagttcatacaacccctaaaactgctgaaattcaacaacaacaacaaaaaacctaaatctgccgatgatggatagaacacaaaagctatcgtcctgtgcactgcatttaggaactcaagaggtgttctttcaactatgtgacgatgtttcatgagctgccatgcttcagaactacggcgcctttgttgcccccggcacctgggcaggcagtgcgaggacacagaacttcggactatttggtacctcatcataaaagtcagcagaaactgtttgcaagtttgcggcgcggcttgacctgtgctgatcagcccatgggtgtaattcatcgtcggggaancatcatgacgnttgcgcaacagcacggccttggtggacantcaanttgcacggcttctgtcncaatgattcaggaaacccagtgg

SEQ ID NO: 86824 - DNA, 549 bp, Triticum aestivum
  unsure (1)..(549): unsure at all n locations
  Clone ID: PAT_TA_86824
aaaataccaacagtagaagacacctaagtactattgctgagccaccttaccatcacaagtattttcctgagctctggtgattactcccaaggattactccaccaaatatcattactgagtgccgcgtaacaaggtgggcagcagcctcggcgcggcgatcaagtctctccttagcgcggataagtagtgccacctggccagcggcaggaagtccgccgatcatcgggatctgcttcatggacggcgcctggaagaagctcaatgaccaggccatcgtcctctccaagaggaggggccagctcaagcagtcagagtttggcgagctgtcaagattttgcttttagtcacagagataggcttcaaatgttatctacttggtangtgatcttgtctcagctggtatgtttgagctgtgcaagttaattagcgataatacacaacagcggggtggacatgcatagtgcctagttatgagcaattgtatattattatagagtttcatattacattaggatgatgaanctgtcagtatancatactantacttgc

SEQ ID NO: 86825 - DNA, 548 bp, Triticum aestivum
  unsure (1)..(548): unsure at all n locations
  Clone ID: PAT_TA_86825
gaaggaccgaaggagccggcgtggtcgagatctagaagcgtggtcgagatctctcgttcccaggctagcttatattgtactccctccgtcccataatataaaaatatttttttatactagtgtagtgctaaaaacgttcttatattatgggacagaggaagtactacaactcttgatggatacatgctgcatctataattgtcttaaagggcttaatttttataaatgacttgaattaatgtaaaataccgcatattccttccgtttccagatataagcctttttagagatattaatacgaactacatacggatatacatagacattttagagtgtagattcactcattttgctccgtatgtagtccgtattggatatcaaaaaacattatatttaggaatggggagagtacatgattccanactttttggncacngatttacntcctgggccatttanttcantggagtacaacgtttgacgtcctgattgtaacttcctccatgaantcantggtagttatttagatccgagtcaagncaacattt

SEQ ID NO: 86826 - DNA, 460 bp, Triticum aestivum
  unsure (1)..(460): unsure at all n locations
  Clone ID: PAT_TA_86826
cccaccgcttccgccccggcaccgtcgcgctccgggagatccgcaagtaccagaagagcaccgagctgctcatccgcaagctacccttccagcgcctggtgagggagatcgcccaggacttcaagaccgacctccgcttccagtcctccgccgtctccgccctgcaggaggccgccgagtcctacctcgtggggctcttcgaggacaccaacctctgcgccatccacgccaagcgcgtcaccatcatgcccaaggacatccagctcgcccgccgcatccgtggagagagggctaantctgtgcgtcgtcgtctgttatcctccgtcttaaccagtgtttcaacgggtgaaatgtgcgtgtttgtagtgtctgttcgtgccaggtggtgtatgttcctgatctgattcactcctgcttcatcataactgaaatgaaangttgtatcgtcaaaaaaaaaaaa

SEQ ID NO: 86827 - DNA, 519 bp, Triticum aestivum
  unsure (1)..(519): unsure at all n locations
  Clone ID: PAT_TA_86827
ctcaaattttgttcatttttttccaaacaaatgcgttttctatctatgagcaataattagcggttacaattatttttaaagttggtgccgcaatctttcgctagcgcctagttgctctagtggttagacaacctgcaattaaggcaaatggggcggcgggaacaaacatttagggaggtttttctaccaatatatacatttcggttgtactgcatcatgggccggctcaccaggtgcggttaagtgagcgccattcnaaaaccggcgcttanangaggncccctcntccccccctnaaantttaaaaantttcgcgggncctnntattngtgantgttngaccctctggggntacgcggaccacgcatgactanttctttcctccaaaatctaccccnaagacactcaataatactagtatatattgaagatgtaaatgttagagcataatacattacaaatttttcnaanatcaaaacactaatcacagataagtaagtgggagtaaacaggctcaaa

SEQ ID NO: 86828 - DNA, 537 bp, Triticum aestivum
  unsure (1)..(537): unsure at all n locations
  Clone ID: PAT_TA_86828
cttgaaagcgatatgtgacatacgtgtcgagcaagatgatatacgcaactacattgacacttccgtaaagcgtggttacgacctttctaccttccgtaaagaacgaattgggggagattcccttggaatctcatattggtacgaagatgatccaattcttggacatagattgtatcgtgaaattagacgagtggaacagatgaagaaggaacctgggaagagatcgaagggaaaaagaatttcaactcctccagttgtgtcgtatcattgggaaactgttgcgtccacttttgaagaatttgatgatgttgcagaaaaanattttctagtcggaacaggacagagnttcccttgggcaagaattgaagattgaatactccagagtcgaaaagatcataaaaaaaanaaaaaaaancnanggggggccggtaccaatcgcctatatgancgtataccgcgccacgggcgtcgtttacactcgtgacgggaaacctgcgtaccactaacgctgcanaatcccttcgcagcgggtaaang

SEQ ID NO: 86829 - DNA, 288 bp, Triticum aestivum
  unsure (1)..(288): unsure at all n locations
  Clone ID: PAT_TA_86829
cacatatatacacaggagggcacacagccagccatcacgtctggccatcacgcacgcactaaccggccagcacatccagccactactccaactaactccatgcatgatgctatccattcctatccatgcgccaccaacacacgccaagagccaccggcttggactcattccanggcaaactacaccgactcatccatgcactaactaacccgagtgacctgactagctagtacngtttaaacntcactaanatggtttactcaaancagggacntcgtcccnaagcat

SEQ ID NO: 86830 - DNA, 561 bp, Triticum aestivum
  unsure (1)..(561): unsure at all n locations
  Clone ID: PAT_TA_86830
aatcattctatgcataatctggagatgttctataaacatgttttgatctacatgtcatcctctatccatccatgcccctggttgcatttatagcttgctgtagcttgttcatatcttgctccaaagttgcttcataatgttgctgtcagcctgttaacatcaagttcagttgttaccatgattgttgctagtgttccataattctgtttctgccatgtttgaatctgtaatataacttgctatgttacatgggtgccatcatattttctgatcctttttggcttatggtcagtaagggaccttgatcnagcatttagtagattcatgccatcntttgtttgccangaaaantcctgtaaatgtgtttatagctctaaacattgcatcgtgatgttattttcnaaaagtcngaaattgttacacttgcatctacatgtgtgtttgancanttaanattccagagaagccagtgtcagtttgttgtattacgtaatcagtcatgcctttgtaatagttgggtgcttacatgtgtttgagctgaatagctantgcgttggaaga

SEQ ID NO: 86831 - DNA, 591 bp, Triticum aestivum
  unsure (1)..(591): unsure at all n locations
  Clone ID: PAT_TA_86831
tttttttttttttgagaaaatcgcagcagtgctttcctctacggtctctttatatattcaatagcagtatatcaaggcagagcagcaaaattaataacattatacttatcaaccttgatgcactcatcggccaggccagctagcacccatcccagtgttcgcgccctcctccgtgcgcagccatccccaacgtccacgccttctacctgatcgtcttgttcctctgcccccaagaacttccgctgagcttaagctccactatgagcgtggggagagaggaaaagggaggagaaggggggggggctcctgcacaccgtcctagcgttcangcgcacgcacatgcacatatatcacacacactatcgatcaatggctccgcctcacgcgggctggcatggggacgcancanagtagagtggaagattaagaatttgttggtgcttggattgggggggcaancggtgaccatggaacccggtgctgctcccaagaaacggggaaaggaggcangaccagtctccaanaaggcgcaagtcccaagangcacaaggctaaaacaccatatttctgnngtgttaagctcnaacntgg

SEQ ID NO: 86832 - DNA, 184 bp, Triticum aestivum
  Clone ID: PAT_TA_86832
tagcagagcgccttctcacattgaagagatgtcgtgtgtagttatagatataaatgtatgcatgctttcagattgtagtacgaagaacatgtatgctttgctcaacaagataggtatgagtttcgtccaactgttttcatgtaatagaagcggggaggtgtgcctttgctctaaaaaaaaaaaa

SEQ ID NO: 86833 - DNA, 334 bp, Triticum aestivum
  Clone ID: PAT_TA_86833
gagagccttgagttgatggaggccagtcgtgggctggaagggcacaaggatgagtatttccgggtgcctatgaagattgtcacggccagcacgatgtctatcgtgctttcaccggcagaccagacatggcaattctcagtcgatcttgagacaatggaggtgacgagatacaaaaccaagactcagggttctccaagtgtgtcttatccatgtgagcttccatggctacctgctatccatgcttgtatggtgcgctgtaaaagagggggcagtttcccgtgtactcacatttgtaaatgttgagtgattttttgttgttgcgaaaaaaaaaaaa

SEQ ID NO: 86834 - DNA, 569 bp, Triticum aestivum
  unsure (1)..(569): unsure at all n locations
  Clone ID: PAT_TA_86834
cgagttttttttttttttttttttattattgaaaatcccaactttcattccaaccacagaacactaaccatatactccctccatcccaaaataagtgactcaactttgtactaactttgtacttctcaaagaaaaccctaactcgtaaaccataaaatgatttccgtagtagtaacagcaagcaaggtgagagcagttaatcatgaaaacatggcaaattgcttcattccccaataacctccgcgatcagactcatgtctgcacaaactagagccactttgcccttttttgctgtcatcgtgataaataccatccagtccaggaaaaacgattagtttcctgactttcttattgacttttgtgggggaatgaagcagtaaatatcgccacaagcatcgtatcctcgcattactcacgccttatacaagaatctagcacgtactccaggcaacatcgctgctgcattggaaggaatgctctgcagtgttggccaagacacatacatcagcagacactcccaaagacagttaaaaccgaacgattcggccnacgaggtatgatngtctgag

SEQ ID NO: 86835 - DNA, 568 bp, Triticum aestivum
  unsure (1)..(568): unsure at all n locations
  Clone ID: PAT_TA_86835
gcaacgccgactcctgcagcggcgacgccagcgccagcgcgagcgcgagcgacggcagcagcatctccgagtacctgaccaagacgctgcccgggtggcacgtcgaggacttcctcctggacgacgccgccgtcgccgtctcctcgaacaagccgtatcagcaggtagggctggctcgggtcggtgggccgcaagaagggtacccggcgtgggcgggccaggagcagctgatcggtggagtcgttgtcgccgcgggtgagcgggccagccgcgagctgtgggtaccgcagatgcacgcgggggcggcgtgggccggcagcaagcgacctcggccgtcgtcgtctctcggctcctcctcctactggtgaaaacgtgcgctttgcagtacagtactagtactagtagcggataaaatcagataagatcataaaatgactggacatgaatttgtttcatctgtantctcacttgaaatcactgcatttttacgtgtcaaaaaaggggggccgtaccaatcgcctatatggtctataccgcgctactggcgtcnttanactctgacgggaaa

SEQ ID NO: 86836 - DNA, 576 bp, Triticum aestivum
  unsure (1)..(576): unsure at all n locations
  Clone ID: PAT_TA_86836
ggacattctgaagaaactacagttgctattcctgctatacctctgacgcttcacatgcctttgccgaggaattcacctggagcttctgctgatggacagtacaaattgttggctgcacctatcgaagcagttccaatttcataccgccctgcagaacccatcagacaaccaaaaagaagtttttgtaatttaggtccattgccaggtgttatgtctgaactgaccaggcaagaaaaaggtccacaccctcttgtgcatgctacagctcttgcttgtggtgctcgtgttgttcctgttgaggaggcagcttcgctgatcaaggccatcgagtccaagatcagatctggaggggccaaaatagcaagattaccttcaagcaggttgacacgtctagttcctgaggcgatctccatgtcatcgtctagtgaagatggcangagaatgacacagtgagccaccggcgtgaatgtcaaggcacgccatgatatagatatctgaggaaatgaantcaagtagnacagattggaactgatttgagaatgtctggataaacatgtacgcgatgcgacaatatag

SEQ ID NO: 86837 - DNA, 460 bp, Triticum aestivum
  unsure (1)..(460): unsure at all n locations
  Clone ID: PAT_TA_86837
cggtgccggggcagcagcgccacaacaacgtcgcccgtcccctcccgcggccgctgggggtgggcgccgggccggtgctggacgcgctgtaccacgaccacgacggggccaccatgtccgggcagaagcgtgccgccgtgggcggccccggggagaagacggtggagcggcgaaagaagcggatgatcaagaaccgggagtcggcggcgaggtcgcgcgcgaggaagcaggcgtacacgaacgagctcgagaacaagatctcccgactggaagaggagaacgagcagctcaggagttacaaggcattcgaaccggtggtgcactgtgtgccgcagcaggagccgaagaacaagctccggcggaggaactcggcagcttctgatatcatcatttaatagtacagtgttgnctgcccggcacaagtngccanttttaactgattacccgaaaaaatttacta

SEQ ID NO: 86838 - DNA, 570 bp, Triticum aestivum
  unsure (1)..(570): unsure at all n locations
  Clone ID: PAT_TA_86838
atccttgggttgcttgccttctggtttctcgctgcggggtcgtgagcgaagttgttaaatagaaatgggaacagatgtcaagattatggtggtgggtgacggaagcgtagggaagacttgcatgcttatctcttacacgacaaactccttccctggtgaatacgtgcccacagtcttcgacaactacacagcgaacgccgttgtcaacggtcatgccgtcaatcttggtctgtgggatacggctggctccgacgaatacaacactcttcgtccgctcagctatcccggcacggacgtcttcattatctgcttttcgctggtgtcgccagtgagcctcgaaaatgtaaagaagaatggcacccagagtgaccactcaatccaaagaccccattatctcgtcggcacgaattggtttgcgaacaaccggaaacctcaaatcctccagacccggctggagctatcccgaggaggaggataaattggcaaggaatcgcgcgtactctctgggtgtcggcctcataacaactccaantttcagaggctaactgccaacgccaatggccaggggan

SEQ ID NO: 86839 - DNA, 427 bp, Triticum aestivum
  unsure (1)..(427): unsure at all n locations
  Clone ID: PAT_TA_86839
agcaggacagatacagaagaatgcagctctctactgcgaagtcaagattgtctgtgatgacaaagaagttacagcggcgacgactgctgacccgacgccaccattttcaccttcccctgtaaataacaacaacagatctcgcaccccgacaccgccatcatctacgccaaatcgcgatagcacagaggcggttgatggcaaaaatgatagcaaaaccaaagaaagaaggaagatcccaagtttctcaggtgcctgtcatcctgattgctgtttcagtcactttcacagctggaatgctgtatgcgccatcttcaggtagaaaaaagntgtgattaaaattttgccatattttgaatttttaaactctcgtccatggtgtacaaatgagataattatcgtacctggagctttcagcaaaaaaaaaaaa

SEQ ID NO: 86840 - DNA, 585 bp, Triticum aestivum
  unsure (1)..(585): unsure at all n locations
  Clone ID: PAT_TA_86840
gtttggaaggttgcagcagctagctagtgttgctggtgatgttctactaggcaaagagaagatacagaaggttttgctttcaaggctaactgaaacggttgtcatgtggctctccaatgaacaagaattctgggatgtctttgaggacgagtccatccagctccagccttctggacttcagcagcttattcttgatatgcacttcctggttgagattgccgtatgcggacggtacccgcacagaccagttcagcagcttgtgtcagtaattattactaagagcaattgcagctttctcggcaagggaggtgacccacaaagcgctcttccggaggatgaatggttcttgagactgccaagactgcaatcaacaactcatgctaaggactctggtntgatccgacctcgaacgcctatcgcccacatgacgacggatacagaagatcagatacattagtcgtcagtataggtctgaagatcattgctcgcaaacatgatgactagaaaanctgttactcacgatctgactctaanaactggccgttctgtatcgagtcaatattcagcncgtatctgtctccggag

SEQ ID NO: 86841 - DNA, 595 bp, Triticum aestivum
  unsure (1)..(595): unsure at all n locations
  Clone ID: PAT_TA_86841
gtcgatttactgcatcttgaccattcaatttgcatttatcagcaaggtaatcaaatgtgcaatagtagttgtatatctcctgcaaaacgtaactgaacatcattgattctgattgccagattgtcgtgggaagcttcctgccaagctatccgatggagccgaagcagaagaaggcaagggtggtcgcggcaccaacccttagccaggccccccctgctgttcggctctctagtgcggatacgcacagcagcgagcaagggcatcacagcttggccgccccgagaatgaacgttgtaacttcttcagcgtacagcgcagaccagaactgggcatccacggttgttcagtcagctcctgccgaggcatcaagaagcgcatcgtcgggcgatctgaactcactgcctctggtctgaagccatcgagccaaaccgaggaataatcacagatctctgtctggtgcattccttctgacatgtaaaagtaccacaggttggcttaaaaacccactaggttctgtcggcactaagatcaatgcattcgtacagtacgtagacgtcattgtggcatgttncanctcatgtatgnncancctagc

SEQ ID NO: 86842 - DNA, 575 bp, Triticum aestivum
  unsure (1)..(575): unsure at all n locations
  Clone ID: PAT_TA_86842
caacaatgatttgccaggaagcatgcccaattttctgttcacaaatgaagcgacactagtttacctagatctttcaaataactcattagttggatcactataccctatttggcaaaaccaaactgatcttctagtagtgaacatatctctgaaccgtattgaaggacagctgccggccaatatcagttcaatgtttcccaatctgtggattctcgatgtttctcataataatatgtctggagttgtgccatcttcgttgtgcaccatcggcaggattgaaatcatggacctatcaaataacaactttgtaggacaggtaccatcttgcttgttcacgaactgttctgcattgaatatattgaactctcaaacaataatctcgggggcatgatacttgacggggctagtaactgtcattgtgttggaatatactagacacacaaattgaaggacctcctagatcgtctggatgtccgatcatggatcacatggtaacaagttcggagaacagacattcatatggatctccttatggagcttgacctgcanaatagttagtgtaatcaccaaattgn

SEQ ID NO: 86843 - DNA, 590 bp, Triticum aestivum
  unsure (1)..(590): unsure at all n locations
  Clone ID: PAT_TA_86843
ctcgagtttttttttttttttttttgtacaaactgcagcaatcactgcctttattacataattataattcgtgtttaacaaacacaagtcttaagctgccgaggacccccagctagctttacatgatacgtaataagcaaacgacatcacaacaatttacaggaaagtagtaaacagatctgaagaaaaactttgaaaaagaacacttgtgaaacagacactgaacgaaagagaaccaaaccaacctcctgtaatcaagcagagtgacaaaacagagtgatcacaacatctaactacacaccgagccactgcacggtctcgtatttaactagaaccttgatatgattggtcatggcgctcgtattcattgtctttaattgcccactgcaccgtccaatgcagggttgtcttgttcctcgagcacacatctttaaggctgtcaaatctcatgccttggtatctagatcccgtgtagaaaccactggagttccgagcttgcattgatttcccaaatcgagactcatactnatacaaagttagnaagtactganccggaatctggcattcgacantccaccantatacaagcc

SEQ ID NO: 86844 - DNA, 571 bp, Triticum aestivum
  unsure (1)..(571): unsure at all n locations
  Clone ID: PAT_TA_86844
cacgattcgcgcaaccccaaaccccctcgctccaatctgtgggcgctgaaagaatccccacgatcccctcgaccgattctcgtatccacccctcattttcccccttggaaccgagagcacggaccccgccgatctccgccgcctgaagctcctccgacgacgaactgcactgcgaccacacactgctggttcgagcaccccacatccacccaaagatcaccgccgacgccggagctccaatgccactgcagcgccagaagatgacgccctgatcgccgttgaaactaccatcgtctccgtcatcgcaagccgcatctgtacctcatcttcaccggagaacaccggacgagcgccgccaccgcgcccgaagcatcgccgtttttgccctgctcggtgagaccgcgcacagtacatctcagctaatctgcattgacacatgccgctatctacataatcgtagtcaaaatatgtttagacagtttacaatattgttactaatcctggctgtaatcaaattatgatctttcaagtcctacacagagataatagacaaatttnagttgacgccaat

SEQ ID NO: 86845 - DNA, 568 bp, Triticum aestivum
  unsure (1)..(568): unsure at all n locations
  Clone ID: PAT_TA_86845
ctcgttttccataccttcagcagcggctctggcgcctttcgcttctttcccggctctggcgccttttgcttctttcccggcagtgggcagtctttccaatttttcaacagcttgtctatttcctcgcagctcctcgtacacgggcgttttcggggttcggtttcaccatcgaacagatccttgcgtttcctccacgggtcatcatcgcgaagccaccttcgatgtcccatgaacacggttttcgaagacccaggatctctatctagctggcgatacgttgtgtcatccatgcaccttacgcatccagaaaaccgtggactacctgccccgcaagatatccgtaaccgagatatcgtgcaccgtcgtgagcatgcggtctcatagggaaatatcttctctgcggcgtccacgtattggctggcgtttccacaggtgtaagnctcttaacagcccagataagattgatgtcttcctggtgttggcctcaatacaaccagtaattactcnctcgtcaaacanggggaaggtgtatcaacaacnagntagggcaagttgctccngnngaaag

SEQ ID NO: 86846 - DNA, 316 bp, Triticum aestivum
  Clone ID: PAT_TA_86846
cgagaacccaagctgctccctccagcgtgccccctccatggctcgtcgtcgctctgtgaccacatccagctctaggcaagccttccggacagcatctctcctccctctccctccatctttatttgtctgctagcttgctacaaaattctagaactatctgattccaaaggcttctgttgaaaagtagcatgatttcaaatgcttctgctgaaaagtagtgtcaatcttcagcagaagccttagttatccatggtctctcatcctgacttttgaaaagcaattcaacaatgtctattgggatgtcaaaaaaaaaaaa

SEQ ID NO: 86847 - DNA, 162 bp, Triticum aestivum
  unsure (1)..(162): unsure at all n locations
  Clone ID: PAT_TA_86847
catcnacnccaacgcattcgccatcnagttcaccaagtagatcnatgnatgccaaccgtccaccgctcgctttgagatcgtcntcntcttgcncgccggcgntgctgcaacaacctgctgcatatgtacttcggcttggtgttngntctgtttnnaaatttt

SEQ ID NO: 86848 - DNA, 428 bp, Triticum aestivum
  unsure (1)..(428): unsure at all n locations
  Clone ID: PAT_TA_86848
cgctgcctgcctcgcttggcgcccggccgactgctgtccgcgcagtcgcgcaggcgcaccaccgcgccctgctgaccggactgccggagccgcccacttccagtgcgctccgcggccgcttcctcagccgctgatcctccggtcctccccaatccccatcccttgctcagctcaaagaggttcgatggtaatgaaaaagacacctatctgaatatgtggancctanttggagtgaggaattcattagtgttattgctattttttctttgatgtttatgtactttataattcagacaanaagtttgtaggtgtgataggcntaaagtgtcaatacntgatncaaatatgttggttcacgaacaacatagaagtgttactatctnntccacgaactcgataataattggtgttggttgcntcttcaatag

SEQ ID NO: 86849 - DNA, 220 bp, Triticum aestivum
  unsure (1)..(220): unsure at all n locations
  Clone ID: PAT_TA_86849
gcaccccatctcgctcctcgtcctcctcagcatcctcggcgcctggtgcttcctctacgtcttccgcgcgcccgacnagcccgtcgtgctcttcggccgcaccttcaccgaccggganacgctgctcggcctcctcgtctcgtcgntgctcgccttcttcntcacgtccggtcgcctcgnnaaanatctccggcntgctcntcggcggncgctntggtgg

SEQ ID NO: 86850 - DNA, 450 bp, Triticum aestivum
  Clone ID: PAT_TA_86850
cgatggcaatggcgacagggcgtttcgtcaggaaggtgctgcgggaggagatggttcaggcagacggccatggcgacattggccagtccaagaggaccagccccggcggcccagacccgcagcatcattagttgatgtcggttcacacggtgcatgcagttttcatgcaacaaattacgtatctgccgggcatcataatatatacacaagggacctgaacttcaagccgatctagcttgtgttcttgtcttgcatgctagcaaaagagaaaattttgtttttccccaagcatatgtatacagtgtatctacgtcctcgttgatatgtatgtagtacctgttactagtagtgtactaccacgttaccacagaagtacatgtgtgtgcaatgggttatatatatgttgtgagtgattctcagatgaataaatttacctttaaaaaaaaaaaa

SEQ ID NO: 86851 - DNA, 216 bp, Triticum aestivum
  Clone ID: PAT_TA_86851
gccaagctcaaggacttcttggaccacactgccatgctcgcgctcccgggtcagaggagcattgacgcggccgctccggtgggcatcgtgcattgatgcaaacttatatttgcttttctgtatagagatctcttctttctttttcttttgttctggcgtgtgattaatttctgaatgtgacatctgaaaaaactgaatttgagcaaaaaaaaaaaa

SEQ ID NO: 86852 - DNA, 552 bp, Triticum aestivum
  unsure (1)..(552): unsure at all n locations
  Clone ID: PAT_TA_86852
ccagaatatcatgccccgtatcaaggttgacaagatgaaccatccaaagggatttatggtggatgaccaccaggtacgagagagcgcaagacgcaaccaccaccaactaccagagggcgccatcaaggatgtcatcgtactgattgccaattacctacaggttaggagtatctgatgtggtggtcttgatgttgcgccatcaaggatgtcgtcgtactgattgccgattacctacaggtccatctctccccctctctcagatttcaagctcaattctctcttattttgctgaatggaagtggcctgaaagccactcgactgaaatcatgtgtgttgcgatatgccaattgcttttgatcttgggtaaagaatatcatgctgtatgtttggaagcattgattgcttgttttacatttagcgttggacaatcatgttgatgatgtttagtanaagacgcgtagaggtgtgttttgatgcttggatggatcactacgatttacaatgcacgttgtggcncatactctcancaagatctccaactgaataagaaat

SEQ ID NO: 86853 - DNA, 536 bp, Triticum aestivum
  unsure (1)..(536): unsure at all n locations
  Clone ID: PAT_TA_86853
ccgaccaggtgctctacaacgccaccgcacccgccggtgccaccgaaggcatcgttaatggcttcgcttctagccaggccgccttctttagcgccttcgcctccgccatggtgaagatggccaacctcagcccgttgactggctctcagggccaggtcaggaccgtgtgctccatccccaactaattaagaatcaccatttaatatgcacccaaatgacagcgcgcgtgcaccaacaacctgctgcggctcagagtccaaccgtatttttgctgtacaatgaaccatgtcctgttcagccccttgtttttttatttgccctttcagccccttgcggtgccacgtagtccattatttgtagccttttccgcacctattgtaaaaagaattggatccaccaagatcttcatatgttctctcttcaatctgaaatatcataacatatcacaattgatagtaaaaaaggggggccggtaccaattcgcctataggatctattagcgcgctcantggcgtcgttaaantctgacnggaaaa

SEQ ID NO: 86854 - DNA, 375 bp, Triticum aestivum
  Clone ID: PAT_TA_86854
agatcgccgcgccgccgccggcgcgctacctccgcatgggctccctcccggtccccaccgacgactccgcctacctccccgccctcctcccctccgcttccccgactgggactggagctccaaggtatcaaatgctgccactggagactgacctcaacacactccccgtgattccaaacctcccggagaaggttttcccaacggatgcgaagagtactgaaggtgacctctgtcgagccttcgttgttatagtttgatcatcaaaacaagattctaggcttcttggcagtttgtagtataaggcagcattactgatggtaaaaacatgcgtgtgctattaaaattagagggactgtctattctaaaaaaaaaaaa

SEQ ID NO: 86855 - DNA, 557 bp, Triticum aestivum
  unsure (1)..(557): unsure at all n locations
  Clone ID: PAT_TA_86855
ggccaacaaaacgggccacgtgaatcccatcctccagatcccgcgcggcgcgctattcaggaaaggcgcggccggtgactgggtgaatcacatgacgccggagatggcgcgacgccttgacgagatcgtcgccgacaagctccatgcctcagggctcaccttccatgagtgacgactcgactgagagcatatacatagatgatgcaaatttagagatctaaaactagatctataatttacatcattaaaaggtgcattttacatctaaaaacaagtaactctaacggatgatgtatgttgatgatgttaaagttcaacttcaatagatgatgcacattgaagatgtaaaaaaagggtggcgcaccaaaatagtgcacctctcgtgcgcgtcaaccagttctctctggatgaactcacgaccaaacatggaccgccgtgcttcgcttcttctcctgtcatcgcactaacatacatgtctctctgggtgaaatcaaatcccatccgacaaggatctccatgaaaaggatccacnactcactacatgggaaacacgtcaa

SEQ ID NO: 86856 - DNA, 165 bp, Triticum aestivum
  unsure (1)..(165): unsure at all n locations
  Clone ID: PAT_TA_86856
ctcanatggagcaacatcttancttataattcacccgnaagggaacataatggttgacagcccaaggtatacncngaaactancgaancancttganaagctcngcggaacgcgttacatgtttctgactcacattgatgatgtancggatcancngaaatgggc

SEQ ID NO: 86857 - DNA, 566 bp, Triticum aestivum
  unsure (1)..(566): unsure at all n locations
  Clone ID: PAT_TA_86857
ggagagcagcacgcagcctgtgggcatgagctttgcgtcatttccctcgtcgtctgcggccccgtcagcggccggggcgacggcctcatcccacatgtcggccaccgcgctgctccagaaggcggcgcagatgggtgcaacgctgagccggccgtcaggccaaggccagatggcagcgagcaccttcagcagtangcagcagcgccgccatcaccaacgtcaccaacaatgcacctgctgccgctactagtagcagcgcggcgacaagcaccgtcggcgtgggattcgggcacgcgttcgaggcgccggctcacttcggagtggaccagaggcccantgccaatcgtaatgccggcantgccggttcggggccangtagaggantccggaggccaaanaantgctcannaggattctgngtctcngnctctccagnggganatannagcanggaggttcatcctganccaantggctnggtanggngggtaatnncagggctagagcanacccatggnggtnancactcgaatagtggtacccacntgtnacgacanncngtttga

SEQ ID NO: 86858 - DNA, 370 bp, Triticum aestivum
  unsure (1)..(370): unsure at all n locations
  Clone ID: PAT_TA_86858
gtggtgatctacatttgctccttgactgacctcaccggacgcctcaacgttgatcctattctgaggcagaaatgtatctcaaggaaaagaatttcattcttcgcggattattgccatccagttcccttcctacacatttgtttatttatttattgcaacaacactcctgcatatctgatttactttgtctgttgtatgtgttattatgtgcactgcagtgattgaactggtgtgtatttgttcaggtcactctcgtattccagttatctgccgtattaattgtgtcgtgttgtgtgctattgttagcatttgttcacccaggaacatgtatttcgttcantaaaaatcaagagttgttaaaaaaaaaaaa

SEQ ID NO: 86859 - DNA, 258 bp, Triticum aestivum
  Clone ID: PAT_TA_86859
gagcattcttgtgtggcgaaaatggagcatgaccaaactatatgattttgtaaggatgaactttctttggccatgttattttgagaagacatgattgcttagttactatgcttgaagtattattatttttatatcaatattaaatatttatcttgaatctttcggatctgaacatttatgccacaataaagaagattacatagaagaatatgctaggtagcattccacatcaaaaattctgtttttatcatttaccta

SEQ ID NO: 86860 - DNA, 320 bp, Triticum aestivum
  Clone ID: PAT_TA_86860
gatcccacctggaggccttttctggtacttgccagaggggaaaccattgggaagcaatcttcatcgactttgctgcctccatgatgatgtgcgagtagtttccacaggacctacaggtccatagcagtagctagatggctctctctctcttctctctctctctctctctctctctctctctaatcttcaatacaatgatctctttggagatctatctgatgtaattcttgctgtgtgattgttgggatccgatgaattgtggctttatgatcagattattcattgaaggtgagccttttctgagatttaaaaaaaaaaaa

SEQ ID NO: 86861 - DNA, 497 bp, Triticum aestivum
  unsure (1)..(497): unsure at all n locations
  Clone ID: PAT_TA_86861
ggaatatgtatgtgcctggcttgcgacatgccacctgaactgaacatgttgcttgtaacactggtgattcagggaaaagggaaaggaggaaaggtagctgaagaagatcagattgtcacaaaccattgccgcggcgatggctggacgagagcagaggatacaatggttgcttgtggagaataaccggctgtggaaggaggcggggctggggagtaggaaggagcaacggttcatttctttaatgccttgtcgtgctcccctcctgtgtcttttatcctccccgctctcggaggtactggcaggtggaaaacatattcaggtggaaagaagnactgtcagctcccgaagatgtcctagtggtccatgcnctcatnncgtcattgaatccagtttcncgttaaacaactcacactctgtttcattganccgttcctcttcctggngctccnatccnangttttaattnaatcanaccctccaagngngtcttccncaaa

SEQ ID NO: 86862 - DNA, 536 bp, Triticum aestivum
  unsure (1)..(536): unsure at all n locations
  Clone ID: PAT_TA_86862
ctttgggactggagctgcaactggtcttgtaccacaatatttgatgtcacgtcccctctgagacaagtcatgtttaaccccaagtataccaacactttcgctagttttcaccaggatgggatggtcatggtttgtcttccaccctcgtcaacctttttctagtgcttcatttgctctccagtgtgccataaatttgttttttcattcgattttatgttcttgaaatatgtatatctacgtagatgtggagaattggccatcttcatcctattgccgtgactggaaaactgacagacgacatgtttgaccagcattttacctacattggtcatcgccatttcattgccgttaccatagggcggttcacactgatatatgatttgcagaaagaagagcatgtcacacactcgtactccacatacaatgagataacggtgcgtcattccaccaacactccgatattgcacgctcagtgaaggacatcgnttggacccttactaaagttaggaggcnaangngggtgcgaggccccccga

SEQ ID NO: 86863 - DNA, 329 bp, Triticum aestivum
  unsure (1)..(329): unsure at all n locations
  Clone ID: PAT_TA_86863
gcggcgcagtcctgagctatttcggtcccttctcagtcggcaccggagaagacgtccgagggcgctttgaagactacccaatcggtgcggccaccaggtcaggggtgtttgccgggttgtgagcgtgcttggacctcctttccctgcgaggaggcgagtcgacctcttcttcgtcactcgggtcatcgctctcntcgtcctcctctgcatcngantgcantcgcactctnggcccctgctcgccccttcctcaacattttgctcctgcactccattgggcatcnagntacatntcattaggacccngaaaagacattganncaanggaa

SEQ ID NO: 86864 - DNA, 226 bp, Triticum aestivum
  unsure (1)..(226): unsure at all n locations
  Clone ID: PAT_TA_86864
ccacgacgagatccatccaccctagaggccaagaagagaagggaggagagagagaggccgccattcctggaatggagaggtcatctttccattcgaagtgaagtaacttgaactgccgcagctcctctcttacctctgaagttgctgataggcatttaataaatgatgatgcaagcnaaactttgtngtgtggtnncggtattttttttggtnancttgngggttt

SEQ ID NO: 86865 - DNA, 283 bp, Triticum aestivum
  unsure (1)..(283): unsure at all n locations
  Clone ID: PAT_TA_86865
ctccttcgtcctcctcctcgcgcctgcgcagagaatcctctgcttcgtccttcctcacggccaagaagaagagccaccacctgttccgccgccgcgtcgggccaggctgcatctccctcgacttccacaaccttgcccgcctcgccgaggagtcccgttgctgtacttaaatccctcttcccccttccgggttcttagctcttacctgccgttctttgcanggtcatttgatcaagttctcccncccncgctccnctttgggnggganaanccnggtccccgt

SEQ ID NO: 86866 - DNA, 263 bp, Triticum aestivum
  unsure (1)..(263): unsure at all n locations
  Clone ID: PAT_TA_86866
ggaacgtatggttacatggctcctgagtacgcaatggagggtgtcttctctacgaagtccgacgtctatagctttggcgtgttagtattggaggtcgtaactggtataaggagaaattccagtaatcaaaccatgggcttccctagcctcatagtcnattcanggaatatgtggaaggaagggaagacaggggaantgccanactcatcnancagggntanttgttcaaaagatgatttttagttttgcnccaacttacnttt

SEQ ID NO: 86867 - DNA, 214 bp, Triticum aestivum
  unsure (1)..(214): unsure at all n locations
  Clone ID: PAT_TA_86867
aaaatatgcgtggataatgagctctggtactgtcttgctaaaactgttgctgaagaaacagcctgggaatatgcagaaaagaatgggctaaatgttgtcacagtatgcccttgtgttgttttaggcccacaactgcaacccgttgtcagtaccagcagcgaacttctcgtctatgttanaaaaggaggtcctaantgcganganggganatgct

SEQ ID NO: 86868 - DNA, 210 bp, Triticum aestivum
  unsure (1)..(210): unsure at all n locations
  Clone ID: PAT_TA_86868
agtctctggccttcgtgtgcgtcatcttcgccttcctcgtcatcgtctcgcaaggcgtggttgctgctagggatctcacacatgttaacagagcaggaggtaacaattacggtggtggctggtcgggctcctacggaggacgacgcccgtgacggatgctcttcgtaagaatctagcaaataaatgcagttcnggtttgcttttgcagat

SEQ ID NO: 86869 - DNA, 204 bp, Triticum aestivum
  unsure (1)..(204): unsure at all n locations
  Clone ID: PAT_TA_86869
aggagggctgcttcccgtgcgacacgcaggagtggaggtgaaagcaggctctagtaaacaaacaatcaggaacaaggagccaaagaagaagctgctggctcctcgttttggccgggctctgcaagcgcgaacgaggaaggatcacagcacaacaccacaccacaccggagatgattagtttagttanttnaccncttgacacca

SEQ ID NO: 86870 - DNA, 220 bp, Triticum aestivum
  unsure (1)..(220): unsure at all n locations
  Clone ID: PAT_TA_86870
ggaactccaaaaattctaaaataaatagctggacgtgaggaatttatctattaatcatctgcaaaattaatcaactaaatatcaccctccagtaaaaagttatagctaatctcgtgagcgctaaagtttctgtcttttacagtaagataaaaaagacttcacccaagtcttcccaaaggttctacttggcacaaacactaaaaanganaagaaaanaann

SEQ ID NO: 86871 - DNA, 518 bp, Triticum aestivum
  unsure (1)..(518): unsure at all n locations
  Clone ID: PAT_TA_86871
cccggatctcgtctccgcccccaagatcttcaccttccgatgacgacgacgaccaggagatcatgctcctctttgtccaagtgctgttaagtcatcaattactaatttaccattagaaaatggcctttactgattgaaggaaaaaattgctaccaaggagaaaacataaggtatgtaattttgaagtaccaatttagaggtgcagttttgtgtttacttccattgggcattnnanatttgttcatnaatttgcanatgctaactcataagcagaggaatatcttgtggagaaaacagagggtgtatacaaatgagttcatgctcttgtcagtttttcgttggggaattacttgtgtttttgtgtgaatgcatctctacagcttagcncttagtccacaantnggtnctggggattnanattncaacaangggggnatgccaccttgacgatcatttagatccccactngcggcgtcctggtgcgtgctcccttcgggtcagcccancatganacacat

SEQ ID NO: 86872 - DNA, 545 bp, Triticum aestivum
  unsure (1)..(545): unsure at all n locations
  Clone ID: PAT_TA_86872
aacaggcgtttatatccaattatcatgcatacttgttctgctaatctagaggctctgtctttggctttttcgggtccactctcaatttcactctttctttctttctcagctgcagccccacgagcaagggcactcggcctctgcatgctacaggtacgtactgatttcattcatcaacatccattatatgtatatatatgtaaaaaaaaacagaatatattctgggtgactagttagctccgtttaattttanttttgcaactccaccacaaatgatcggtgtctatatatgtgattcacgtttctgcatgtcattgcagctgcgtacatgggaggtgtgatcgatttcgtcgcaatcagcttcatctttaatgtctttcgtcgcantcagctccacctgcattgttgcttcattgttccttcggcgtcaagaagaattttgtctccccgtaaagaagacaaaaaaagaaaatctggtgacattgcaatgttgcgccctcctgctttgggttcgtgantcaaaaccgttaaatttgacggtcgtt

SEQ ID NO: 86873 - DNA, 584 bp, Triticum aestivum
  unsure (1)..(584): unsure at all n locations
  Clone ID: PAT_TA_86873
atttggtttcagaaaaacgtgaagcaaagggtgatgtcacaagtgctgtaaaaagttctgttgttcccctgggagcaacactcatggcctccatgttgtcaagcaacggtactgcagtattttctagaaactatttatcgagagttagtgtgtcgcatgatcttgttgagtcggagttgtacaaaaggtgcacatctctgctgggagacttgggcatagcaaatggtggccctgatgttgtttggaatggctctattcagaagaatggaaatgctggaaagataagtagagaacagggaagccccaatctgttgggtttattttatgtgaagaacaacgatgcaacttttcagagagctatggccttcacaagaatcagacagagagactgtggtcctacccaagcgcaaactgatgggaaaaggccaacacacgagataggnggacacagaaatctgaccgtacccactgagggattacgngagtacctgtcttcacacgtactggatttnanggcactgnantaagaacgggagtgatcactcacatcaagacncgggatgtaatctctcagcatcaanaan

SEQ ID NO: 86874 - DNA, 394 bp, Triticum aestivum
  unsure (1)..(394): unsure at all n locations
  Clone ID: PAT_TA_86874
cggaagtacaccttccacctaagcctgagcttcccaaagtggagctgccgccggtcccggaggtgcacctgccatctaagcctgagcttcccaaggtggagctgccaccggtccctgaggtgcacttgccacccaagcctgagctgcccaaggtggagctgccgacgttcccggaggttcacttgccacccaagccggagatgccaaggtggagctcccgcngaanccngaattncaaaagggnggagctccnaaaaaacccngnntgcccactgttcccgtgttcaaatttcaaagnccaggggcaanccatgagatgccttcanaatanancgctnttntacntcctcnaagttccccaangtttttnngcaaagggcnaattttttaccag

SEQ ID NO: 86875 - DNA, 350 bp, Triticum aestivum
  unsure (1)..(350): unsure at all n locations
  Clone ID: PAT_TA_86875
gaaaccctaggactagtccgggcaacagcgccgtcgtcgtcgtctccttcttgaaggtgttgcttggtacggcgcttcggagtgctaggagcgtggtggtacttctttggagggtgcagcggtcgccggtcgtctccgttcgttgatctgccgttgttggcattagtttctctttctttcttctctgtttttctttgggcttgtttgtgctgcggccccagcacctatcgttggatgtatcngtggttgctttgttatacaaagcangggaaacctttttcattngaaaatnaaaaaaaancccnagggggggcntggtaccattccncaaaangtggtcgtataccccc

SEQ ID NO: 86876 - DNA, 240 bp, Triticum aestivum
  unsure (1)..(240): unsure at all n locations
  Clone ID: PAT_TA_86876
ccggcacggagcccgacnaggaggatggcgcgggggccgcccggcacccggtggccgccgcgtggtgggtcgcgctggcggtgtgcgtcggcctcgcgctcggcaacctcctgctctcaaactgatcgtccttgatttgattcggtttttgtcaatcacccgacgatccantgcagtgctccagcgcttgtttgtgtgaaaatgttactaacatctactcctgtcgatgcttatcaaaaa

SEQ ID NO: 86877 - DNA, 585 bp, Triticum aestivum
  unsure (1)..(585): unsure at all n locations
  Clone ID: PAT_TA_86877
ctacaagcaaagctgtcactaggtaaccaacttaattaccctcaacctatcatctanagaagacaanccaatcaagatgagtacgcatatgatttggcaaatttgtttgactgtctttatatattgcggcatagtctgatccaactttttactcactgaccttatatcggctcgttgatcacataatcacaaaggttcacttgtgcacaagacctataaatggtttgacctanaaggtatatgatgtggtttctttgctccccgtatataggtgcaaccggcggtcnttttctcatagcacttttcgggtttgtcgttcttctccgtagagagaaacganagatnagacaattttttgngaaaatggnngcctgcactagaaaaggaanataataangatctacacaaggagacgagctcancagtnanataggcacanatttnccggcaagggttgcnatggtgaattacaaggcttcttaataatcanctagntgcgtnagaaacccattaggncatatgncanacngcanttnaaacangtcntatcagtccagtcancacatnnaatgtaggnnatngttg

SEQ ID NO: 86878 - DNA, 530 bp, Triticum aestivum
  unsure (1)..(530): unsure at all n locations
  Clone ID: PAT_TA_86878
gaccatcactcgtccctgaccgccactcataaggaanacaatcaaataaacacctcatgcttcaaatttgttacacagcgattaccataggtgcagtgctatgggacttgcaaacctcaacacaagtacttctcaaattcanaattaantcactagcatgacnctnatatcaccatcctcatgtctcaanncaatcatcaggtatcaaacttctcatagcatccaacgcacattatatgaaagtatttagtatacccatcttgggatgcncatcatattaggcngatacgtcncaacgtatcnataatttttgattgtccaatgctatattaaanccgtttggacattaatgggcnttactngacactttanaatattttggggacnngcgnttatcgggggccagccaaaaatgggttttttgctaattcaaagntcccanaatagattcaccnggggnaaaaccgatgaacctccggaanngntttcgganganntgtccanagnatggccctantaaggncccacct

SEQ ID NO: 86879 - DNA, 586 bp, Triticum aestivum
  unsure (1)..(586): unsure at all n locations
  Clone ID: PAT_TA_86879
acatgtcagagccgcagccaagctactcagccttcagggaggcgagcttcgggcacgccatcctggacatcaagaaccggacgcacgcctactacgcctggcaccgcaaccaggacggcgccgccgtggccgcagactccctctggttcaccaacaggtactggatgcccaccgacgactccttcgacgatgtctgaaacagacggtggggatggatggtccacgcttcctctcgttgaataagcattgttcgcctccagcgcgtatagagggtactacgggttagagtcgctgctcaatctgtaccccaaaactgtgtatagagaggaaaaaatgccgtacgtgcattgcgtgcgagtgagcaaggcacgcaccgtgtggattgtattagccgatcttgtatgcgcgccagtaacgattgattggaggcacacgtatttgtgcttggggcctggtgtcgagacttgttggacacacgtaatgaatgccatgaaaaatagtcacaganaanaaaaaaaccnaggggggccgtaccaatcgcctaantgatcgnttagccgctnanggcgtctttaactcggacggg

SEQ ID NO: 86880 - DNA, 344 bp, Triticum aestivum
  unsure (1)..(344): unsure at all n locations
  Clone ID: PAT_TA_86880
tttttttttttttttttttttttttggacacacacaaacacatattanatttccttgacacaggttgtttcttcaattacagaccttaattagtaccaccanatcgccaaaccggtacatgtttcattccatctccttaacggcaatcaggcagatcgcgaggaacacggtttcacataaaactgggaaaagatctgcaggcagcagacgccgaatcnacatttcgaatcncatgggantganatagatcgctgctgttggnactgngnatgggccannngacaccccgctacaanaatgtcncntcnggaggcngcactngcttgngggtctngcgncacagc

SEQ ID NO: 86881 - DNA, 414 bp, Triticum aestivum
  unsure (1)..(414): unsure at all n locations
  Clone ID: PAT_TA_86881
gccgagctcttccttggacccctcaaggccctgcttcagtgcagcgacctccgcagtacgtgcggcagcagccagcagtgaagcctgcatatgcacatagacatattctgattagactcctgagtcattatttgatcctctattcggcctttcttcgcgaacgccaaacagagcatcagggcctactgtctatgtggtaatattttcctatattttgattgcttacctgaaagcctgttaggaggctggacaagctttggttagtccatttttggtggactgaactttctcgatcaccgcactcatgatagtgcgggtgctctcatcgatggaantccgcnaancgcttcaacaagtgtcggtgccctggatgacanaggcanatcacgggggntgccctctaangggggtccc

SEQ ID NO: 86882 - DNA, 295 bp, Triticum aestivum
  unsure (1)..(295): unsure at all n locations
  Clone ID: PAT_TA_86882
cgaacatggtgttcggcatgaacgatgcgcggacgaaggcgagtgggaggacggaggtggaagatctgtgctccaagctgacgtccctgcttccgcaagactatcggctggacgcctcacagggtcctccggacattcccagccaactgatgcaggccacgacctacatcaaggatctatacganagagtcgaaaggctgaggcagatgagagatgacaaaacccaaagccgaaggatggccgggcgcactcagcancaantcctagatacaggangggcggggcaangggtccc

SEQ ID NO: 86883 - DNA, 326 bp, Triticum aestivum
  unsure (1)..(326): unsure at all n locations
  Clone ID: PAT_TA_86883
aaagaagtcgacacatgcggtgatgagcgagatcgaccagttcatcaatgaggtggccatcctttcgcagatcaaccaccgcaacgtggtgaagctccatggatgttgcctcgagtcagaggtccccctgctcgtctatgagttcatctccaatggcacgctctacgacctcctgcaccgcccctctaggacagagcaggatggtggcttgtcgcccttgtcctgggaggagcgcttgnggatcccancangatcgcgggggcgctcgcgtatctgnacncctcggctcngtcnccgtccnaacngggacntcaantgcangattg

SEQ ID NO: 86884 - DNA, 563 bp, Triticum aestivum
  unsure (1)..(563): unsure at all n locations
  Clone ID: PAT_TA_86884
ctcacgctggttgtgccgcgcctccagctcccatgtgtggcccctgctgagtgcacgtcatgtatttgctaaaatgtctcagtgcactggactactagttttcttgtgttcatgtgcatttgtagctcccttcttgcttgctaattgctatagcttacaatacttagagcatttttcgtgtgtgatctgtaatttaggtgctaaccaaagaataggcaaggttattcagatagaggatcttaactaatcatgttaatggttggtcttgctccctgtgcattttcactcactgagggcgactactgcagaaaaaaaaccatgggaacgtgctgccctcagtcctctctcgacaaatccagcagtgcaggtctcctatgcactaagtattgccagcggcgatcatccatcatagctcattgaggaaatgctgcttctgtatcatacttactgttttgtttctggaagaagnacacantgtctcgtgcaacactcaaacaaaagtcaaaacttatggctcagtcaccaacaagcctgatgtaggtcctctgcagcgcttnaaataa

SEQ ID NO: 86885 - DNA, 571 bp, Triticum aestivum
  unsure (1)..(571): unsure at all n locations
  Clone ID: PAT_TA_86885
agaaatcgcgccgccgtctcccccgcgaccgatccagtccgccgccgccggccccgctccctccgcgaccgagctctagtcctccgcctccggccccgctcctgctgtcgccgtcctccggacgccgcccctgctctcgccggccgccggacgacgccctgcttccgctccgtccacctcgacctcctcaccagccagcacctcaaccgagctcgatggatatttcaaataaagaacaagaacaagaggaatttgaatcggtcatggtagcattagctttggatgtgatgttgtcagaggagagaccgacgtatgcacgaagaaaattacacctttcgccaggtcctgaagaaaaagagaccgctgatttgacaaaattacaccttgtgtcagcctccaagaaaaaagatctcggtnaaagagacatgagatacatgacatggnggcatggcatgcaatggaccatactggtactgatgacattcanctcaaactttgtggncaaaaatacgtgattttcctcatcagggtttgcccnatgtaggctggtggttaaagaatggaactgaan

SEQ ID NO: 86886 - DNA, 583 bp, Triticum aestivum
  unsure (1)..(583): unsure at all n locations
  Clone ID: PAT_TA_86886
caccagttttgctaaggaaacaaactcctgcgccaatcagtttacaagtcaggagttgagcagggcacaatctgtggcaggaccgcactctcctactcatttgtctcaaagcaaaagaagcttgctgcctttgcctggagagagtagaagtttcttttatctaatccaagatgatctattcatgattaaaacagcgaggaaatcagaagttgagttctactaattgaagccggtgagttggtgtatgcttgaagtgagtctggttcttgcttcaatttcccctgtttcacctccagatctactcattgggagatggatccttgcagtgagaggctggctgacctgttgttgataatcatccatcctatctggacgtggacgaatacacacatgtacacgcagtccttttgatccgttgcatatcaaactcatcagacgatggactgtcctgcctactcgaaatcaaacagtgatcgtgtcctttangattaacaacgaagtgaaacaagataattgctgacactntgacaaatgtcagggaaagcagnactgcgcagacaaggaagngtacactactgtgtta

SEQ ID NO: 86887 - DNA, 569 bp, Triticum aestivum
  unsure (1)..(569): unsure at all n locations
  Clone ID: PAT_TA_86887
gcancgcgcgccccggtaattaactagtgccatatgttctgatgtcgcagtacaattcanctctttctttatgcctgcagatnaaatcttagacctancaatggccganctccactttcttcangagcatatatagtgccatcgtccttcctgcagagaagatgagcgtgatcaaggcatcaagcttgtgccatcaaatgttgccttgttctgatagaatttanagatcaatgtctatctgtctanatttgaaacatgcnacatatctcaganctcttgttcatgcataacaatatggcacatgagtttatctatctcccancgactcctccatcangcagccagaaacgnttgcanancatggncactgggaactattaaagggttcacatcactgcngaattgcacatnccctntaatggactagtatctcaagtatacagtcatcaagncaggagtatgttcatatcgctatgggaacattgcntaatcttcggaaccatgcangcacataatcttanaaanggcgcancgtnacaatcatacacggnatctaacgtangtgcccn

SEQ ID NO: 86888 - DNA, 331 bp, Triticum aestivum
  unsure (1)..(331): unsure at all n locations
  Clone ID: PAT_TA_86888
gctgattatatggttgcgtggcaagaatactgcaatgatgatgatggtgttctactgttctggttcatgatgatgatgatnatgacgacagacgcttttagttgtagctaagttgtagggatgttgttcctgttggatgatgttcgtgttcctcagttaagtttttgttaagttgtagggatgttgatggatgctttcagtttaggttttaatgtcaagaaaatatttagattatgtatcacaattggatgaagttgctcatgtaatatctactattgtaatccagcagttctatccaatatatgatttcggatttaacaaaaaaaaaaaa

SEQ ID NO: 86889 - DNA, 259 bp, Triticum aestivum
  unsure (1)..(259): unsure at all n locations
  Clone ID: PAT_TA_86889
ccgncatcctcgagcccncntacgccgacgaggnctacgccgtcagctcntcgtcttaactctggatgaantaattcncntttgntttgcatggntatcantactaataacgtagaacttgatggacgggtcgtgtaacgttggnactttggngaggttcntgncantttgtgtgtagcagtgncattnntggatttgccccgtttttaatctgtggtattggttgttagaanaaantcctcancttccccaggggggg

SEQ ID NO: 86890 - DNA, 489 bp, Triticum aestivum
  unsure (1)..(489): unsure at all n locations
  Clone ID: PAT_TA_86890
gaagcatcaatatcggatccgtgccattgcctgtttgtcggcacgggccattcgtcaagggcatcaagaggttcttcagaacgaacccgaccaggcgaatcggacagtacccggtccatccttggatgggccagacgacttgacgttgtctgaggttacctctcctggcgaaataacaagcaaacagtaaaacagcacatggagagtcctcgtgtactcagcaagtcgtgatctccccagctaagctccggcaagtagctgtttggagtttcctttgtgaacaacctgtanncntggaaacatctgcccatgtgggtgaacggatgtctgttatagattagatttccgcgggtccgatgtaaatatgagaaatcttgggtttcctgtcaaaagcacattgctcataattgactgaaaacatcaatgttcatcatgnagccacagagaattgttgtaggacacacacagtgcatgtacaatcaaacaann

SEQ ID NO: 86891 - DNA, 619 bp, Triticum aestivum
  unsure (1)..(619): unsure at all n locations
  Clone ID: PAT_TA_86891
tcccacctcatcacccatctccatccaccactccaccatcacctccatccatcagcgctgtgccacccaagcacctccaccacgcaccaccaagcaccactccacatccaactcacgcaactcaccagacagagggccggcggtgtctgatncatcgcgcgccgatgctggtgcctccttcttcaacctgctgcttcttcttcctcanctccgctgctgctgtccctgctcttcttgcgctcatgttgctgctcctctgaacccctcgtacttctgctcctaatcttctccaacttgctgctgctctgcttactcnatctccttgcacgctgctgcnggttctcgcgcgcgccaaacctgctgntgntcttccccangaatctgctacaactccaatctcancgctccttgntgatcttgctcngaactcaagttgcaatggtcctctctcangtnaaggtgngnncctctttcttcccnaaggtgncctntcgaactaagggtggcattccnaaagtggggtnctcttggctcngggctggccaatcgacaaaaatgggnaacccctattcaantngtgactngataaagnaaatcaantgggaaggttaattnatgt

SEQ ID NO: 86892 - DNA, 218 bp, Triticum aestivum
  Clone ID: PAT_TA_86892
tggatgtagctagatggcaatggcgcatgcttgggtggaagagattgtgatgtaagatggatgtacgtacgcagctatcgatctggtgtgtttcccctcatggaagaagaaaccatcaagcttcacattgcgtctgggaattttatttgtgtacagtgtactcactttgttgtttggcatggcaatcgatcgttcatttgcgatgcaaaaaaaaaaaa

SEQ ID NO: 86893 - DNA, 202 bp, Triticum aestivum
  unsure (1)..(202): unsure at all n locations
  Clone ID: PAT_TA_86893
agtaggccaaagcttctttatcctttttgcactatttaggaatgatttcccatattgcccgatgagttgttgtacggggtttgtttgttcactgaagaaattgttcatttgaaacgaattgaaaaggctggataccgattgatgtatattggtacaaagccgttgttgaaaacaaatgtttactaaaanaaaaaaanaaaaa

SEQ ID NO: 86894 - DNA, 588 bp, Triticum aestivum
  unsure (1)..(588): unsure at all n locations
  Clone ID: PAT_TA_86894
gctatgctaccagaggactccatgcatctcttcctcacctgccccgttgccaaccgtgtttggcaacggctgggcatcctacctcaagcggagggcatcatcgacctttgggacgcgccgattcctcaccaactgccacacaaggcctggccttttattctcatgtctctcctctggaagatatgggctgcgagaaatgatatgttgtttaggaacattgatcaacgttctgtaataaccctcagagccctcatctctgacctagacctatggtcacatcgtctcatggaaagatgcgacaaggaggacgtctcctcgtggcgttcctacctctctgcacgctgcatcgtgcctttgtaattctgactcgctgccccggcggctgtcatttctcagttacagcaagacaagtgttgatttctcagaagatgatgcatctggtccntggatggctcatatatcaatagacggttgaagtaatcaaaaaaggggggccngtaccaatcccctatgtgatctatagccctcacggcgtcgtttacactcnnacnggaaaacctgcgtaccactaacccttcagaatcccct

SEQ ID NO: 86895 - DNA, 357 bp, Triticum aestivum
  unsure (1)..(357): unsure at all n locations
  Clone ID: PAT_TA_86895
gctgcacggagtgcatgggtgcgccacggctgcggccgctgctgccggggcaccagagatatgacaagtggcatctgtaccgcgacgacgcctcggtcatctctagcggagctgagccgagctgagccgagcgtcatccagtccaagtccagtctagtagttgctcgattacagaaggtttacaagtagctctttctctctgtttctctcttactacgtacctactacttgtgttacacacaatatangatangaagcaacaacactaagtggctggagtaaaatctttngtgccttcaaattcagtaggattacttgtgtcaattcgtggtggtaccacattttcttgaaaaaaaa

SEQ ID NO: 86896 - DNA, 578 bp, Triticum aestivum
  unsure (1)..(578): unsure at all n locations
  Clone ID: PAT_TA_86896
tagaagtcgttatgatcacttcaagattgataataacttaacgattgacgtgtttctcccaccaaaacaacatgccaaggggactttggtattctaccatttaaatactaatcttgctgttgtcagtcttgagaagcgtatccatggcattcgtccatttgatatttgccgtaaaggggatttatctaaaccagtagtagctatagcgcgtaaaattgaagcagggtttttaatggcctcaaagggtgaagtgatttacggccagacctgcagcatttatgtcgaaaagcttatgctttccacttgtaaaatcaacaaggctgggattggaggtccccttantaactttgatggggcatttgttggatgaaccactatgatggaagtgaagtactccttcctgccaaggcgtgggattgtcaaattctgaaaggagaattaattggcgaagacaaagtggctctcatggacatactgcatgggttggtatagatcagatagaccgcnagnggctgtgctgancgtatggacagatcactggtatgncantatattaaccgcagttggagcacncaata

SEQ ID NO: 86897 - DNA, 562 bp, Triticum aestivum
  unsure (1)..(562): unsure at all n locations
  Clone ID: PAT_TA_86897
attttactagttaattatctggtcaaactttgacctaaaatacgatgtagactaataaactaagatgaaggtaatacacagtgaatcgctaaaggtaatgatacgtagattacaaactagtccaagtgacccggggtcgataccttgggagagggacctcttgacagcgacaaagggcttgatcttgatgacctcgtcgtcctcatccttctcagtcaccctactgtgcctgagctccaagtcatagcccccggagtcggcctcgaacttctcgaagtcctcctcatcgttatccagcccgagtcctctgtgcccgccttgccccgtgaagcgccaacttcactccgccctgctgaggctcttcttctcggaccaaacagtgacctcatcacttctgagtcaccgtgggaactcgactccgcgagtgacgctccgcgtcaagatggcacaanacctgtcaantcgcaaggggaagggtcnccgaattggnaatggtaaggtttntgaccatggnatagctgggttgagtggggcagcatcccataaacggggcgtntactca

SEQ ID NO: 86898 - DNA, 299 bp, Triticum aestivum
  Clone ID: PAT_TA_86898
tgaaggccctcgttggtgctttcgagacagtgatctcgcttcaaggtataaagcaaggcagacccagcatttcctgacctgaagtttgccacgtgaaattcaagtaaatgtgggggtctctggagtttccatgttagaggtttccagttggagtccttgtgcacactcctttgctttgggttcacaggcctacagataagaaaaatcaccgaataggaataatttactgtgctggtatactaaactaaactttgtttcagtttacctaattccaagagagatttggcaaaaaaaaaaaa

SEQ ID NO: 86899 - DNA, 400 bp, Triticum aestivum
  Clone ID: PAT_TA_86899
gcgcctgcagtctgggctcgaagcgcatggacagcgggcagtgtgcacgcagggccctcgcgccgtcccccgcggcgcagcagtcgcagcaccggaggcgcgcgggaggcttccgccccaggccgagccggctctccgccgtctccacggccggcgagcgccccagcgacaactaccagtaaacaaatcaacgtcgacatgccagagcaagatagttgtagtacatagtactgatcttgtggagatagaatcggtggggattagacccaatccgattccggactggtcttttacctagcccgtaggtgcagaaagaaagtgggctcgtcctctgctcactgcggtgtaaaacgaacgcccttggttttggatatatatgagtcacaaattggagacaaaa

SEQ ID NO: 86900 - DNA, 558 bp, Triticum aestivum
  Clone ID: PAT_TA_86900
ttgaatatgaggtcagtgggaatgaaagtttgtcttaaaaatgaggtctataagaagcaattaaaaatcttattcatcaccaataatgatgttgtctctagctttatataaataaatagttggtgcttgttaggtcttaaatatatgtcaactcaagacctatatgtcttttataccagacaacatgactaattcctaattgttccccctcaaactctgtttgtagcctgcctactgtttgttacagccgaacaggagcatgtttcatatcatgacccatgatcaacagcgggtgctgcctctgcttcttaaggcttgacttcgctctatggaagactcacttgcaaaggtggaaatggagagaaagttgttgatgctcaaatcacgcaatgaagtatggagcaagaagagacaaatctggaaacattaacttccattttgtgtggctatctagttgtatcgttgtggattacaccggtttttcaatactctgagttggcattgatgaataatgataagccaatgttgggttgaataagatatacagcatacaagaag

SEQ ID NO: 86901 - DNA, 547 bp, Triticum aestivum
  unsure (1)..(547): unsure at all n locations
  Clone ID: PAT_TA_86901
gttgcgtctctcgattccgatcaacccctctcaagctaccacatagatgcgctggcctcacgactaagtcctcacactaggacatctgacgtgttaattccacgacagtgggcgcccaccatgggactgcgcacggtggtgttgacttcttggagggctccccaaggatcgagaggctcatgattggccggatgaagaagaaccggcacgagacaaccatacacgatttactttggatctcggagtacaagatttgagttgatgaaaaattagggttccnttaaatgcaccganttttctgcnatggacatggtttcnccggcgtgtcaaatctttgtatgaacnccctataaccggatggttagtgtcggatccatcaantttggtcaccganggagtaatcccnaaaactcacaggcantccggntaaaacaggagtacattcacacatgaacatcagaccangattcaaagacaaggatctcaccgtacanatccagcgaatcgtttggcacccgatggtaatccacaggaaacacagagntng

SEQ ID NO: 86902 - DNA, 536 bp, Triticum aestivum
  unsure (1)..(536): unsure at all n locations
  Clone ID: PAT_TA_86902
cacaaccctctctccctcatccctccttctccacctccggccgccgcaacggccaggccggcgtggtggtgcgcctccgcgacccatccatccagcagcgccaccagctccaccccctcaccaccgaacactaccgcgcctccgtcttcactacgccatccatccaccatcaccaacgccacatcgcgcgacccactagatggcctgtctgatcccccgcgcaaccagcacctcacaccctcgctgctacttctcctccatggtcctgctgctgctcctctctccctagcgtcaccatactgctgctccttctcctttgcctgctgctactcccttgccccacgcctctgctgctcctcctcttaaaactgctgctgttcttcttccacgttcctgctctgactcgcttctaactccgttgctgcgttatctctaactcgctacgttaagctctgaacatctcaatgtctctattacaaacgaactgcgctgtcncgttttgtancgtgtcttgtttacgaacttatgttaactat

SEQ ID NO: 86903 - DNA, 553 bp, Triticum aestivum
  unsure (1)..(553): unsure at all n locations
  Clone ID: PAT_TA_86903
atctgttgtggacgtatcagcgagtctctagttcagatgcggtgtttgtcccatcttgatgtgaatgcaagtgatgagaatgaggttctctcgttgaatgtcctgctgccaaacctgcaaaggctacgtttgggtggacgactggcggaagggacgttggacgagtctcctctcttccaagctgttggggggcagaacttgcatgttctgaatctatattggtcacaactgagagaagatcccctgccatccctttctcggctgtcaaatttgacgcatctagaattcaccagagcatacaacggagagcaactagcatttctcacaggatggtttcccaagctaaagattctctatctgatagatctgcctagtctgaatcggctagagatacagcaagtgccatggcaagcctggaaagatatacttgtcaactcagcacatgatggtggtccactggcattgagtcctcatgccctcatctcaggctcttaaacacagtattcttggtnctggtaagtccgcaatcaggacacgtgcgtaatctcanata

SEQ ID NO: 86904 - DNA, 552 bp, Triticum aestivum
  unsure (1)..(552): unsure at all n locations
  Clone ID: PAT_TA_86904
cccctctccgatctgtggccgcggggagactcgtctcgattcccttgtctgattcccaacatcgccgctccagatccgcgccgatttcttgctcgccgatcttgccagagtctgccgcctgaaacttctgtagcccgtcgagttcgtcgccaaccgaggggcacaccggagcaaccagccgctgccgagccgaagctcctgggcagccgtcgtgcacgtcttcatcgccgtcgcacaggacacccccgtcgtcgtttcggtcaccgctacctccgccgctcaaagccgcatccgcccgccccttcaccctcgccggaggatcgccggagagtcgccgtcaccgatcccgaccgccgccgcttccctgcttctgagattgctcggagcatgacgagtagaattatcaggaatgtgagtgcgaaaactcatcaaacatacagatttatatacagtgatgatacattanggtacatccatatcacattgatatggtaatgatggactaaggaattattgcttcgttcatttgttgnagcaactgactagnngatt

SEQ ID NO: 86905 - DNA, 268 bp, Triticum aestivum
  Clone ID: PAT_TA_86905
ctagaactactttccggctgcgtctgcacctctgaaaaggttaaaccattgaaagcgagcacacaaagctgcagaggcaacaactccaaaggaaccagtacggtgatgtgtttacagtattcctaaaataaatgtagtaatgctgtgattaatactaacattgatggatcagtcgtttgtattgaaaaaatcgtcatactccgttaagccaggttctattcgttttgatttttagctatgcaaattgttctctgagaaaaaaaaaaaa

SEQ ID NO: 86906 - DNA, 319 bp, Triticum aestivum
  Clone ID: PAT_TA_86906
ctcaccaccagcacgctcgccggggagttcggcaagcagcagcccaccaccagcaggctcgctgggattcattcacctcttctgcactgtgaggttgctaacatcacgtcatttttttgttgcatctgctttttttcctagtctaatctcatcgctgttatgaagtaggaatatacattttttgttaactgatggatgaatggttgcatttgctcgctatgcagctacaccaatcaattttcactcaaacggagcacagaacttgtaaaaccgatggcaatttatggtgtgcttcccatggcaacttaaaaaaaaaaaa

SEQ ID NO: 86907 - DNA, 330 bp, Triticum aestivum
  Clone ID: PAT_TA_86907
ctcgagtggggggaccacctcgggcttgggccgtcgagtgcggcgactgcggtgtgctcgtcagcgcttctggcacggtcgtcttcaacggcagccgcacagaacggttctccaaatggcaagatgaggttggagccgtcactggcgctgtcaagctccacaagtgctactgcttcgacgtctcgggtgtgaagatcatggagcagatcaattcgttagatgaagcttatgacttatgtttgtggattaatttgatcatttagtgtacatatatgctcactgtagcataattgctgaaaatgtgtggattgattcatcaaaaaaaaaaaa

SEQ ID NO: 86908 - DNA, 558 bp, Triticum aestivum
  unsure (1)..(558): unsure at all n locations
  Clone ID: PAT_TA_86908
ggcttctcctccccttccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacaagcccatcccgccggtccggcgtgggggcggcggcgcgctacgcggcancgcggcgtagcggagctacgcgcgcgcgtgntacgcggcaaggcggtggcgtacgcangagcgttgcgctacgcangcgtggtggtacggcgcaacccgtgcgcggtacgcggcgcggcggcgtacgcgcgcgtgtgtacgcgcnactgtgcgtancgcgc

SEQ ID NO: 86909 - DNA, 574 bp, Triticum aestivum
  unsure (1)..(574): unsure at all n locations
  Clone ID: PAT_TA_86909
ccctgacggcgtgctcatctccaacgctgacctgctgcacttccttgtcaccaacctcaagaaatgtccctactgctcctctccaacgtttgctgctgtgacctccctgactgacgacctctgctgatcttctccaactccgacgaccaccactgcgacatatcctcnacatcaacagcggggcttcgagctcctgntggtgctctgctccgggtggctggctgaacttccgctaaggccancacggttcctccccaangccgggtcctccgctgtctatcttcgtccctgctattcntcttcttcgactgcancatatacaanctcganattgaagatcatcacgacccaatacgctctgaacctcctcttccttgtttcagttcctggatgtatnnctgtnggtctgaaattacttgctacagtgtcctttgctgaatcnccagtaccctgctaantgtgtnccttgcnggtacnantagattatttgtnaaacaanaaaaaaatcnaagggggccgtacaaatncccatntgatgttacccccattgctnctttaactnttccggaaactt

SEQ ID NO: 86910 - DNA, 543 bp, Triticum aestivum
  unsure (1)..(543): unsure at all n locations
  Clone ID: PAT_TA_86910
tcacaacttatgaatatgttgtggcaatgagggctcagagtgaacctcctggtctctctgtcaatgatgagcagcaaagcttgccatcttctcccatgagttctgcaccaactgctttcagcgggagctcgttcgcacggcactacaaaggtgcatggtgcactccaccgcgcatctttgttgaccaggacgaaatcattccacacttgggacctgggcgattaccttcaactgttgatctgatagcacagacccggtcgaaagagccaaacaacacgccaagcgccaagttcgcattaacccatggaagctggcaaaactggatcaaacgaggcatgaaaagcgcagcaaaancagagctctcatcgtgctgaaccatnatancgtccattacangccgacantgtcagcgatactcactcagacattatgatgcgaacacacaatgnatcggtctggaggatccntaaatccctatcaccacatncantcanatgcatgagcgttcnagnacacacttcaagaatccgntccgancattga

SEQ ID NO: 86911 - DNA, 560 bp, Triticum aestivum
  unsure (1)..(560): unsure at all n locations
  Clone ID: PAT_TA_86911
gcgcttacgagctcatggaccagatcaaggtcgagtccgacctgcggcatggcaagcttgccgccgcgctcgcgagcgccaagtccgaggtcatgttcctcaaggcaagcctgttcgacagggagtccgagctgcggcgcgcccatgacgcgaccaagaagctgcaggacgacgcgagaacgaacagcacggccgacgagctgaaagcgcagctccaaggcgcgctgcaggagaacgggcagctgaagctcgagctgcggcagtacgagtccgaaaagtccccgcgaagtcggacgccgacgccgcggcggaggcggcgaagaagggggagacggagccgagctaagcgtctgcnggtgcagccgagcagtgcggaagccccgagacgccatgcttctcactgtggcaaggcggaacggaagatcttggacccgcantcctggcgcggaataccggctgncacactcacacaccgngnacagaanaagnaactgnccgagttaccgatntganatagtatcccattacgattaatatctgccatntngacattncatttn

SEQ ID NO: 86912 - DNA, 548 bp, Triticum aestivum
  unsure (1)..(548): unsure at all n locations
  Clone ID: PAT_TA_86912
gtttgcancancccncgaagatatttgncgagccatcnattttatccaccgtantgcatcacaaggtggcantacttatgttcactgtaaagctggaagangacgaattcaccactantgttttgtgctatttgatcaaatatatgagcatgactcctgaagcagctttggatcatgtacnatncattangccccgagtgcttttggcaccgtcacactggcangctgttatcgtatttancactctcaccaccggacgtcntccaatacngagtacaaacctaanctgtnatctanaangcancaaancctccattcctgacacanacatcnangactgcactatggagtttgattacatgatggcggttactccgtgtcaacttatggtaacnangcaaacatccgactgggtgttcgatcagtgtcacacataacagtctggagggcaanancatacttgacactggaaggtttnttcattgactnntaccatcnanaccatatgagganacacgtcccttgnatatgaagtacacanngtatcn

SEQ ID NO: 86913 - DNA, 555 bp, Triticum aestivum
  unsure (1)..(555): unsure at all n locations
  Clone ID: PAT_TA_86913
gcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcatttatctctcacatgaagcgctacatcaagaacctctctgccaacttgaaggggatgacctagatgctttcaagaagaatgttgatccgccacaaatactcctatcaactcaaggactcattccttgttggcgaaacatgcatgatgatggcggctggtttgcctacacaangaggagctgctgatcaactcctgtacttgcacatgggctgaaagagcaatgctaaccacgtagcaaaaccaagcgtctagtatttcnctancaaggnntagtcacnccatgttgtgtagta

SEQ ID NO: 86914 - DNA, 468 bp, Triticum aestivum
  unsure (1)..(468): unsure at all n locations
  Clone ID: PAT_TA_86914
caccgaatcaacatgcctaagagaggagcgggtgctaccactggtgctaagttcaggattaccctcggtctgcccgtcggcgccgtggtcaactgcgccgacaacaccggtgccaagaacctgtacgtcatctccgtcaagggcatcggtgcccgcctcaacaggctgcccgctgccgcctccggcgacatggtgatggccaccgtcaagaagggtaagcccgagctcaggaagaaggttacccccgccgtcatcatcaggcagaggaanccttcaggcggcaggatggtgtgtttatttatttcgaggataacgctggcgtgatcgtgaacccaanggcgaaatgaagggtctgccatcactggcccgttgctaaggatgcccgtctgtggcccgtatgcaactctgccggacgttgtgtaaatcngctgcaatgcgtnccgaataaacacaannaaaaaaaaaaaa

SEQ ID NO: 86915 - DNA, 493 bp, Triticum aestivum
  unsure (1)..(493): unsure at all n locations
  Clone ID: PAT_TA_86915
gagcacaatttgccagccagtcgagctcaagaagaattccgcacagctcgctcgactggccatggccaacttcgccgcccagctgaaggagcggttcctcggcctcgtagaccgcgtcaccggctgcggccgcggtgccgcggccaaggaggaaggcaccaagccggcgccggccatgaaggagcacgtggagatccgatcgagagctcccaacgtgtcaggaggncaaggggcgggggtcaattagcacactgcatgcatgcatgctgatgcggctgaagatgtgtttgtcgttgcagattcgtttgtctggtctttcggtgcacccttgtaatttacttgcggatcctgttgttcctgtaactgtaagtgtgccgcttttgttgtgcaatctcctcctgttaattcctgggacaaacctgtgtatctcgactacccgacgtgagtaattggtgtctgtcactacgtataagtaataanggtatttgtggan

SEQ ID NO: 86916 - DNA, 179 bp, Triticum aestivum
  Clone ID: PAT_TA_86916
gcacaaacaacatgtgtgctgtcttgttgtatgcatgtggcttgtattttgcgaggtgtgagtccctgtgaccaataagttacctctgttactgcaagacatatgtgtgtacatggactctgctccggtcatgttcatgtataaattgccatctacagttaaggcgcaaaaaaaaaaaa

SEQ ID NO: 86917 - DNA, 474 bp, Triticum aestivum
  unsure (1)..(474): unsure at all n locations
  Clone ID: PAT_TA_86917
aggtagggtttccagttgcaagccgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacattggcttcatcaagtaccgttaagaatggaaacctcaaaggaagcaaggactaggaaatatcaacgaatgtgggtgctcatcgagctgatctttatcctataactatntatgaactactatattttgaacctgggtgacaaaaccgttaaaccatttaacgacgctgtttgacatgtnaaaccgatatctgttacgctgccatatggtagaaggtctctgcaccttatttttatacctgcgaaggcggcatcattgtttggatcccaattaaaaaaaaaaaa

SEQ ID NO: 86918 - DNA, 548 bp, Triticum aestivum
  unsure (1)..(548): unsure at all n locations
  Clone ID: PAT_TA_86918
atcaccccttcaccagcccgccaagatttaccggccgtcgacagttaattggagttcaccatgactactgtccgagttcttcttgcagttgccctggtcatctccctgctcgcccttggccatccccttgctcatgcccgccatgtgaaggacctgtcgtccatgccaaccggtgattcctcgtctgaaaagaaaggattacagcaagggagtaacatgaagctcgatgccgggaagacgaagaaattgaaaacgtcggagtggaggagacacctaagggatctgctgaaccaacttccggcaaccgggggancttgggtgctgatccgataangtggctgtttgctccccgtgggagaacaccaanctcaacccgaaaaaaacaactaagnactccggaagggtgaattttggggacatatncacactanccaaattgaacaactacggtgacctacaagcttgcatcaatcagcatcctaatagtgtcatatagtngcnactagctgctttagttgatctgtaaattgtancgattaatatgnatg

SEQ ID NO: 86919 - DNA, 506 bp, Triticum aestivum
  unsure (1)..(506): unsure at all n locations
  Clone ID: PAT_TA_86919
ttctcggcttgccgtacgaggcgcaatcttctgcttctactccgcttccccacttggcaactaatccgccccaagatttcctgtcgaagaagaaattaaccccgagtacagatttttcagatttcaatcaaactcctcttcaacgcagatccctctttttctgtagtctttacaggtcgttcattcgttttatgaagatgaagatccatccttttcgaaaaatgaagatgaagatcatcaccgtacatatctctttctcacactccgatttcttctgttgtttgggattagaagagaggagctcggatttttggtcgtgactaataagaagcagcaaaatcttgcaatttttaatcttctaccctccaggtaccttgttccgagcctttgttagcaattttttatttattaacaggtttttattattgttcatttgtatgtgtggaattatcangatgttattagaatgtatcatctggtatgataaataaataaagttgcatatg

SEQ ID NO: 86920 - DNA, 539 bp, Triticum aestivum
  unsure (1)..(539): unsure at all n locations
  Clone ID: PAT_TA_86920
ccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtggtgtggctgtttcagctgctgcccctgctgctggaggtgctgctgcccctgcagctgagtcaaagaaagaagagaaggtcgtggagaaggaagagagtgatgatgacatgggcttcagtctgttcgactaagttgtggggcatcttgtgtctgaagtatcatccttggcaggaaacagagtcaatgatgtttagcctttattagctgatttgaaacctggcaagnaatgtttgaaagtaatcagccctggtgctggntgattactggtgaacatactttgcatcaatttggtcttaacatgtttgatagtcaaaaaaaaaaaa

SEQ ID NO: 86921 - DNA, 541 bp, Triticum aestivum
  unsure (1)..(541): unsure at all n locations
  Clone ID: PAT_TA_86921
caaactcggttacagagaaaggaatcttcatattcgaatgccaagcttgccatccacgcaaaggagactcctatccggacacaggagagagtcttctgtcttgtatcttcacggcccatcagtccggcccacgtcacataggtcggacgcccgaggaccccttaatccaggactccctcagcaacccctgaactaggcttcaatgacgatgtatccgagcacagattgtcttcggcattgcaaggcgggttcctcctccgaatactccaaacacctctcgaacacagagaacgtgtctggctctgtaaaacaaacaccacacatatccgcagagagtataatattttcatgagtccaatctactgacaactttcatagcatgacatcacgtcgccgccagtcattattcaaaccgtttttagcctccgctccagttcaaatgtggtttattggcacgtcttgtcaaagcagagataagtcccttattgcggatccatcantanagcatggtatcaacgcncnttagacgncctgggaaatg

SEQ ID NO: 86922 - DNA, 384 bp, Triticum aestivum
  Clone ID: PAT_TA_86922
cggttatcccggcggtgcggttctctacatctacgacgccatcttcaagcaggacaaattccagcacatcctggtacgccacgagcaggcagccgtgcacgcggccgacgcgtattcgcgttgctcgaacgaagtcggcgtttgcctggtcacgtccggtccgggcgtcaccaatgccgtcaccggcctctccaccgcatacatggattcgattccgatggtcgtgatttccggccaggtaccgaccgcggcgatcggtcaggacgctttccaggaatgcgacaccgtgggcatcacgcgcccggtggtgaaacacaatttcctcgtcaaggacgaaaaaaataaaaaaaagacaaaaattaaaggttaaagaaaaaaaaaaaa

SEQ ID NO: 86923 - DNA, 288 bp, Triticum aestivum
  Clone ID: PAT_TA_86923
ctcaagaaggccatcgcgcacatcagagcaaacaagctccagtgaatccttcatttgatcttcttctttgacttttttttttgtttcttttctaattctagttatgatggtataccagtagaatgtatgtatccatatctatatatgccagtgtatgtagcagtctagcggatgagatgagaagagatcggacgacaaaaaaaattgtatgatatggcaggcatggcgatcaagtgtagatgagatggtcaagagtagcagaaaactgtactgcccaaaaaaaaaaaa

SEQ ID NO: 86924 - DNA, 502 bp, Triticum aestivum
  unsure (1)..(502): unsure at all n locations
  Clone ID: PAT_TA_86924
gcgcctccctgctgaaaccctcatctgcacgaaactgctgctgctccgctgcttctcttcttctcttcccttaactctgctgctcttgcttcttcttcttccccacgaacctcctgcttcttcctcaacatgacctgctgctgcttcttcttgcgccccttgttgctgctcctcctctgaatcccctgctgaactgctgccacctcatctctgcttctttcttctccgtgcatctcgctggtcctctccttttactgaacctgctgctgctcttcaccttcccttgccccaacctgctgctacttctttctcaactcctgctgctgcttctcctcacgtcctgcactgctcattccaatcttgctgctgttcctctctctctctctctctctctaaattctgtgacttcagaatgtaatatcagtacatgtatgttagattgatnagtgtataccacattggtcantttgagttaatataagctgatatnaaaaaaaaaaaa

SEQ ID NO: 86925 - DNA, 301 bp, Triticum aestivum
  Clone ID: PAT_TA_86925
cagaagtcagtgtgaagattgatggatgttgtgaggttggtcaaggggagatggtaaatgctactaaatcctctggtaacttgcttggtttgagaagtgtgcgtttgaacaagattgtacagcttgtatacttgtgttgagattgcagaggattgggacctctggtgttgtagcttgagaaatgattttagatcttgtttcaagacaccatttgaacagcttgtgggaagcagtcagatgcatcattacatttctgatcatcagggaagaagaaattatcagaagtttcaaaaaaaaaaaa

SEQ ID NO: 86926 - DNA, 256 bp, Triticum aestivum
  Clone ID: PAT_TA_86926
gatttgcaacaaagagaagtacactttttgaacggcaactatgtgttttgacatttcggggctgtttggtttaagccccaactagccccatcaaaaatttgctatgatcaatgtaagggcatgaccaaatttttggcaagtccttgttgtttggtttgtagccattgtaccatccccaaaaactgtcaaaatagtcctttgtgtggtttgcaaccaattatatcgtggtggtacaaacatatataaaaaaaaaaaa

SEQ ID NO: 86927 - DNA, 293 bp, Triticum aestivum
  unsure (1)..(293): unsure at all n locations
  Clone ID: PAT_TA_86927
gcaggaatcgagcctcccagnaaggcagggaacncaggctattggttggccgccggccgcagcancagnagcccgccncccgcnccggtgaccctccgcccaggcttttgagggattctatctgcagaananacctggtgggtgatatgagtgccgaggcatgcantgggaaggangaagccagaaagacangtttggagggcaccannaccgccccttcnatgtggctcccatcggcagcttgnnatgcgctggcagccacccgcaattnagacanatggcgtgattccctc

SEQ ID NO: 86928 - DNA, 380 bp, Triticum aestivum
  Clone ID: PAT_TA_86928
cggagatggggaagatggtggacgaggctgtggaggacgggctccgggggtctggtttcaccttcgccgactcaactccggccaaccgtgaaaaatgacagagtcgaagcgaacccagatcgtccccggcaccacctacttcttgttcaataatgcatgctttgtgtccttgtttttgagtccggtgtgcgtgtgcgcgcgcgatgcatattgtccacgtactgtccattcatgtatgcgtacttttctttggcttccagaactcaactcaagtgagctgaaatatgtgtgtgcttttagcattgaactgaaccgatatgctacaactattccccagctataattcaattgttactgtttgttagaataaaaaaaaaaaa

SEQ ID NO: 86929 - DNA, 566 bp, Triticum aestivum
  unsure (1)..(566): unsure at all n locations
  Clone ID: PAT_TA_86929
gccaggagggcatctaactgacgggctctgcgtggaacggtgaagtaggggctgtggctgtgcaagcagctctgagaagcaaatctataatgaagatcctgcacagggagcgagtcaagtgacatattgacgtatggacattcaattacggggattgaggaaattaacgatcattcgacttgaaaagaggcatgagggcaacaaaagttgcagtattttgatcccatttcatttcaagcatacatctttctaggtattgacactttaatcttttctggtttggggcagaccttcctgaacccctaactgactcattccttgattatctgatgaagacctgtacaggtgttggncatgcaaatggcaacatcgtgtttatgtcaaataaacatttgattggcccactttttgtctccaaacaaacgttgcagcaacactaaaatacaccaatagaacacagagacaagcatgaacacaagtagagtcatgaanaaacctttggnaccanacgcacatcaactgaatctgagactgttgattctncaggtcttaagaaaaacgttaca

SEQ ID NO: 86930 - DNA, 358 bp, Triticum aestivum
  unsure (1)..(358): unsure at all n locations
  Clone ID: PAT_TA_86930
ggtatgtgtatctgttgaagacgcacccgattgggcaacaaacagaacagaataattagcctgtcatctacagtaaacattaagccccaggcaggtgttttgaacaagggaaatcgccgaccaacacttggttgctgaagctctacctcgacctagttctatcatgtagagagcagtgtttcaacacttttgtattcttttttggcgccataggctatttattcatttcataattggtacattcatcggaggtcatcaatgcgcactttggaggaaaaaagaaggctggttttcatcngaggtcatcatgtccagcaatcttgaagtgtgctgctccatcactttgctttaaaaaaaa

SEQ ID NO: 86931 - DNA, 407 bp, Triticum aestivum
  Clone ID: PAT_TA_86931
tccggctcctcctggagaaggccgaggaggagttcgggttccggcacgagggcgcgctggccatcccctgcgacaccgaggccttcaagtacatcctccagtgcgtcgagcgccacgacaagggcctcgccgccgacgacgtcgacgtcgacggtatgttgcccgtcgtcgactagctcccgagacgcttgcatcctacagtagcagaggatggatcatttaaccgtgtgatggattcatctgtaacagtgttctgaattatgttcgtttgcgttttattttcagaagaagggaacctgcgcactgtgctagaccagcgtcgtcattcgtgattttcgtagatagtgtctgtaatgctgtaattctgtctattttctaaggaaagacctaaatataaaaaaaaaaaa

SEQ ID NO: 86932 - DNA, 547 bp, Triticum aestivum
  unsure (1)..(547): unsure at all n locations
  Clone ID: PAT_TA_86932
attattacctgtcatttagaattttgggtagctaaatgtaattctgctcttatgatttgctgctccttcttatacctgttaggaggtatcatatcttgtcattgtacgggtaaattgattgtgctgatacgatctcgtcatctttgataattgtttgaattgacccgagaatgatgttatttttttctactcttatttcttaatatttttttcatttattattgtctgactgttgctctgaattctgaaaatgagtatgacctcagtgttattgcttgtgctaaatgttctgttctctacttgggatggtgatgtgttaaatgttctgtatatgcaggggactcaactgttggtttccgcaatgaaaggaaccgtgcaaacggggaattgtgacaaattgagtgttcatgggcccctgactatagatctcctgtactctgaccanaacatggngcacaccanagaatcaagganagcactacaataaancccaaaggnggaacggagcacagccacacatggnanaaaggaaanaacatccacacan

SEQ ID NO: 86933 - DNA, 251 bp, Triticum aestivum
  Clone ID: PAT_TA_86933
gtgggacgaaaataaaactcggaacgcgacctaccaactgagacattaggagtagagatttccaagacaatacatgcatagacactcaacaaagctgtgtttatgatgaacacgtctcccctagtgcagcatcaccggtgctccctctaacttggcactgttatatgtggttgcatgttatgtgttatgtctagcttgtattgcttctaattttgttgaattccatcttcttactttacaaaaaaaaaaaa

SEQ ID NO: 86934 - DNA, 547 bp, Triticum aestivum
  unsure (1)..(547): unsure at all n locations
  Clone ID: PAT_TA_86934
accattttctccgactagtgcatgaggctcccatggcagctgaagcagctcccctagacttgtctctcacgttggcccccatgtctccttgggctgttcttccttctggcagcagtagccaccgcagcggcgccgcaagatcgaggctcttctcttgcctcttctgcgagaggaagttcctcaagtctcaggcgctaggggggcatcagaacgcgcacaggaaggagagggtcgtcggcagctggaacgcccacctctacctccctgaccatcctcgtcccccgttgccggacaccgcgacgggttaccttgttgacgacggcgacgaagacaattaccagaacttgatctaactcaactttaattaactctactcgtgtgcacctgtacggtactacctaattcgctccatgggcattgcctacgtacacgcaatttgtgtatgacttgtccccatgtttgaaaccaagggttccaatgttgtttaaaacacatggtangtaaatttgatcttccaaacggaattcattatnatcatattaagttt

SEQ ID NO: 86935 - DNA, 468 bp, Triticum aestivum
  unsure (1)..(468): unsure at all n locations
  Clone ID: PAT_TA_86935
gctggaaggacgcgaacggcagcggcttggaccaacatcgtcctgccggtgccttgccggtgagcgccacgcatggtgcagcaggcggcaggcacgactttgggagctgcgcatcgagcgacgactactgcatctgccgccagcaccaagccaagatgtagagcggtggtcgacggcggcaacctgctcccaagttgcaagtgatgttgccagatagcagtataccaagggttctaagaatttgattcataaatgtagccaagatgcancgcggtggtcgacggcggcggcctgctcccaagttgcaggttgctaatgctgttcaaacagtgcgtgcatggacatctcatgattactgattataanatctcatgattactgattatagtgancacacgtatctctctcaagtctgatgttgaagtgntgctcatnttccgttcaaatatgangaatnaaactccaacg

SEQ ID NO: 86936 - DNA, 581 bp, Triticum aestivum
  unsure (1)..(581): unsure at all n locations
  Clone ID: PAT_TA_86936
atctgataatgacacctggatcagcaggatgttaatatatcttctgtcttgacaactgatacgtggatctgatgaaaggcagttggcactcacaataaatcacaaattcacaatacactacaatgagatgcaaatgtgaatggtcggagggcaattgaaaggcaaatagactcaagaggccaagcaaatacttgcaaatgaggaactaaaatctcatactcaaacatgctttttagaaactttagcatgtatgtttatcttttgagttccaaggttttgaatgtttagtctacagttggcacaacgattcctgtcataggctcataatagaaaactaggttgccggctccctgtcatcagttcaccactccttgaccttctggcactangcagactccaacatgttgccacattattanacaaaagcgcatctgatgatgtcacaagaccgtatgattttgtgaatggaagaacataaaaatcacaacaactccaatgagcgaatgaagtgtgaggatgaactggaaangcctggatatgttcgcacaaacagcctgtagaatcacaangaggcgttgggc

SEQ ID NO: 86937 - DNA, 538 bp, Triticum aestivum
  unsure (1)..(538): unsure at all n locations
  Clone ID: PAT_TA_86937
gtcgagacctacaagatatacatcttcaaggttctcaagcaggtccaccccgacatcggcatctcctccaaggccatgtccatcatgaactccttcatcaacgacatcttcgagaagctcgccggcgaggccgccaagctcgcccgctacaacaagaagcccaccatcgcctcccgggagatccagacctccgtccgcctcgtcctccccggcgagctcgccaagcacgccgtctccgagggcaccaaggccgtcaccaantcacctcctcttagtcgctagttctggaatgcttgtattacctgggtgttgaccgtttgtctgaatctagaatgttggtgatgaatgaaattgttggtgccctggggaactctaatccnggatagaatgtgcactcccgctagtgactgttcgtaaccgaacttttgtttgcaaaagttggttacatcnagttgcnatgtgtagtgtatcgggaaaattacaatcttgtgcacttcatggcaaagacaaaataccntgttgaggtntngtcccatgg

SEQ ID NO: 86938 - DNA, 529 bp, Triticum aestivum
  unsure (1)..(529): unsure at all n locations
  Clone ID: PAT_TA_86938
gggcgtcgtgagacacccctttttctgacgcatcaacaggcgaccgattactcggcagcagcagcctttgccgcacggctgggcagcttttccttgatacgtgccgacttgcccgaacgttcgcgcaggtagtacagcttggcacgacgcacgtcaccacgacgcttgacttcgatcgaggcgatcagcggcgagtacagctggaaggtacgctccacgccttcgcccgaagaaatcttgcggacgatgaattggattcaggccacggttacgacgggcgatgaccacgccttcgtaacctgagcgcgcttgcgggtacttcaacacttcacgttgacaatcacgtgtcgcgggggcgaatcggaatttcttggcagaccgcnntctcntgctcaaggggggccggtaccaatcgcctanatgatctataccgcctcacnggcctcgtttaaagtcnnacgggaaaacctgggttaccaactaacncctgagaaaccccttccancngntaaacaaaagcccncgntcc

SEQ ID NO: 86939 - DNA, 543 bp, Triticum aestivum
  unsure (1)..(543): unsure at all n locations
  Clone ID: PAT_TA_86939
gttctgcctacagactatcagattgcaagtgaagccaaggcaaaaagaattatacggataatacttaaatcacttagggcaaacgagcttagctctcagtgttttacccagtttgctgaatccaatatactaattgtgggttcttttggtatggtcaagttcaaaaatgtcagtattcttcgaaatcttcctgcagatgttctgcttgagcgtcaaagaagcaactacatgtctgcccacaatattattttaggtttgttctcaggcaaccctcctcaaggcattcggcaccttctggatttaattgacgttgactttacgccaagagaacctttcatgttcacggatcattggtgccagttgaaaggtattggagtcgcttacaaaacatgtatgaatacatccaatcgcacccccaaaagcatatattacagcaatcttggatcacgccctatgttgatactggaagatcnantaagacaatgaactccctgatacttnaatatatcaaaaagcntcaattcatcgatgatcaaaacagca

SEQ ID NO: 86940 - DNA, 550 bp, Triticum aestivum
  unsure (1)..(550): unsure at all n locations
  Clone ID: PAT_TA_86940
ggacaattttgcactacaacccttttaaatatttccttccnagcttccaccaaaattatggggtgtcagtaggagcatatgattacattatatgcaaaaatccagggttgttctttgaaaattttgagtgaatcaacctcatcttcattctggtccaacatgatggtttgtacagcatccatatgattgcttgctctttggcccttgattctttctcctacttgtagtgctccatgctaaacccctaactccaggagcatgcaaccattggcatatttttggttcatgaaataatgccattcacctcctgtccagatttgaagttctgcaaaacttgcactagcaagtttgtgcttttcaccaactaacctcaccacctcttgtgcatccaaagagacactgatctggaagaattggcactccaagaaatgcctangtgcctgtggattttgtcaaacacctggagtgcatgatcagatttgacatgaattgttgttggattgtgaactggtctctgacaaacacctgtcctgatctccttcgtcacgan

SEQ ID NO: 86941 - DNA, 539 bp, Triticum aestivum
  unsure (1)..(539): unsure at all n locations
  Clone ID: PAT_TA_86941
gcatagtggtacattttaagaaacaagattgtgcaattaaatttgactcttaactcttaagagttccaacttaaacatgataaattgcaaatatttgtttgttacctttttatacacccgatgtatataaatttgatctagtaaatctgcaaatgtctcaaacttgatctcttcttttttgcaagaaaagtaaaactgtgaaataatatacaccacagatacaaggcttatgttgcatgcttaattctaccaaaattttacaagaacagttcatttcgagcaggaaattttggaaaatatgagcattccaaataggtctaaaagctatactaataaagggctttangtatagtgattagtgatatgatggtcatatctaactatatgtcatatcataatagttaaaaaacaaaatgcaaatgttaaacccaaacanactcctgttttgcnaggaaccacactggaccaaatgtgaataataacacaccgatataagctgtatgcgaaagctaatttgccnaattaaaaacantgatcag

SEQ ID NO: 86942 - DNA, 550 bp, Triticum aestivum
  unsure (1)..(550): unsure at all n locations
  Clone ID: PAT_TA_86942
ctgccatcaagaagaaatgaggcgtttacctgaatcccgtcnatgtctgctttttgagatctctagtagtttagtgcctattaagttttgctactgttagcgccgtgtgatatgcgccctgttgatgtgtcatttgagtactgtcgttaatttcggcttttgacaaaacatggaagcttctgagactactcatttttatcctctgctttggaatgttaggctgctacttttagtcatagctgatgtttctctttgaaccggagggcaaggtgccgctcttctggggaatcacggccgacggctgcgtcgccttctccgacgacatcgacctgctgaaaggatcttgcggcaagtcactggcgcctttcccgcaagttgcttctactggaacgctcttggaggcctcaagtcgtacgagaatccaagaacaagtcaccgctgtgcctgcagatangaggaaatatgtggtgcaacttcatggtggaagatcaccgttgtcgcgcactcagtaggagatctccgtctcgtcctggcaagcaggaacccgttc

SEQ ID NO: 86943 - DNA, 555 bp, Triticum aestivum
  unsure (1)..(555): unsure at all n locations
  Clone ID: PAT_TA_86943
ataacgatgctgtcgtaactctaaaatttgagaacacgggtgatcctatccaacttccacactagaatccggccccatttgaagagtttattgaaatgcatcaacaaattcggcatcaaccaactcacaagcagctgaaggaagatctgattgagcatcagtaggcggttaaaggggaaaaacaatgtcgggatgtaatatttgaacctttttaaatatgaactactgatgcttccatttgtgcgtctgtatcgtttgtatgcggctatttgaacgtctgtacgctttgtatacggctatttgatcgacttaaaaaatgaggaaggcggatgtatgcggctaagttggatggcggctctccgcatccgtgtccgcggatgaccccctatcgcggacagatgcgggaagaantgcgggttgccgttgggagagcttagctaataactggggacggtgggtggacggatggatggatgatttgatgggacaactgcgcctgtgtaccgggtgtagatagtaattcttgtaaactcatacccggtatagtgacaatac

SEQ ID NO: 86944 - DNA, 564 bp, Triticum aestivum
  Clone ID: PAT_TA_86944
aagaaacacactaagctgggatgaagagtacaacatcattctcggaattgccaagggcataatgtatcttcacgaggactcgagcgtaaggatcatccaccgagacctgaaagctaacaacattctgattgatgatgccatggatccgaagattgcggacttcgggttagctaggctgcaagtcggaggccatactcaaaccatgacagctagagttgttggaacatacgggtatatggcgccagagtatgcaatacatggaaacgtgtcgccaaagatcgatattttcagctttggtgtcttggtgcttgaaattgtaaccaagaggaggaactgtggctccgatgattgcgagacggacacggtgaactcctaagtgatggacgatattacagatgatgatgaatcacttgaaggacacccccgaatccaggcgctaagattatccacattgggttgctgtgcgtccaagcagacctgacgacagcctgacatcccatccatcacctcatgttgaacaggaggacatggagctcagcacggcacagcctgcattcctctcgg

SEQ ID NO: 86945 - DNA, 415 bp, Triticum aestivum
  unsure (1)..(415): unsure at all n locations
  Clone ID: PAT_TA_86945
aaaaaaaaatgactttgacatgtacagatcaaagttttaaatagccccccgctatacctgtttgagcaggtttcactaagtgtcccgctaaacctatagctgatttggaggaccgtcactattttgcagagcccgctatttaaaacactggtacacatgcacgcacatgcatatacaagaaaacacacactacctgacaacttggcatgcccgtacataaatgccaagttttacacgacttgagtgcgccgtgtgacacgcgccgaaagtggttcttcatgaccttgaagaacctcgantctgtgaggtcgacgctgcatcatccgccggcgccgccactcgaancgcgtacaagcgcggcaggaagaactnatntcaacatccgggggggccggtaccaatcgccctatatgag

SEQ ID NO: 86946 - DNA, 553 bp, Triticum aestivum
  unsure (1)..(553): unsure at all n locations
  Clone ID: PAT_TA_86946
ctgtcctccacttccagcacattgccaaggttgaaggtgcttgaaaattcatccgatgggttccacctagctaacgccgacctggtgatgcgtggccctggcgatctacttggcaagaaacagtcggggcatcttccggagtttccaatagccagactggagattgatgggagtattctgcaagaagcccatcttgttgcactaaaaattttgggaacgagcaacgacctatcgttgtttccacgtctgaaagtggagctcagcatgaggcagccgctatgccttcttgggagattgacctcacctgttcgcggaaccgacaatacaatgcggcctgccatgacggcatgtgccgtataaggcatcctagtgtgcattgtattgaaactattctggtggcaaactggcatggcatatttgttggggtgtacaacctctaaactgttgaaagngctatattgtgcgatcaagacatggtaatggcgagaggtactctaattaggcaaaaaaaaggggggccggtaccaantcgcctaagtgagtctattaccnc

SEQ ID NO: 86947 - DNA, 567 bp, Triticum aestivum
  unsure (1)..(567): unsure at all n locations
  Clone ID: PAT_TA_86947
ggaaaaccgcaaacatccatcattccgaaatacgatgttacagaaggccagccgttaaggtgttggttcaccacgataatcaaaaccggtccagataaacattcctgctaaataaggtcgctcagcgtagaatttccagccttcttcgatgctgtaaaaagtcggtcttggctttttgtcataagcactttgataatgtttagtatcatctgtaaagtaaattccgcgggttgcaaatgttgaaccttcttctgttcccattcccggctgttgtttaaactgatttctatgggcatcaatatcaccatttccgagataattgtaacccattatttcaactacagaagaaattccgcttttaaatccgctgctgatccccactgttacaggtcttgttggatcgatacttttggtaaaatcctgcattacatttgttancgttctcaataatccgccctcaatatcattctcattccaactgacaacagaaaacactnggatgattgcgtcacctcaacatcgcttaaacattaatgataatcgttaatccataacgggtcacaaaaa

SEQ ID NO: 86948 - DNA, 419 bp, Triticum aestivum
  unsure (1)..(419): unsure at all n locations
  Clone ID: PAT_TA_86948
gggccgcttcaccgagaagagcgacgtcttcgcctttgggatagttgttctccangtcatcacgggcaggagggccgtctcacaagtgaaggtaggcacagcgtccagcgatctcgaaggcctgatagatccataccttggcggcatcttctcgacgactgaagctgccaggcttgcagaggtcgctgtgcattgcacgtccgaagcagcgagccagaggccgaccatggaggctgtggttcagcaactcaagcggctgatgccgtggttcggaaccgactgatgaagatnctgttggggaggcttttgtataataantggaggacantgatgaccattgccaccaagangctgaggctttggagtaaaactgacctgctattggaacattcccattaacattaccttccggtatccac

SEQ ID NO: 86949 - DNA, 360 bp, Triticum aestivum
  unsure (1)..(360): unsure at all n locations
  Clone ID: PAT_TA_86949
gttgcttcntanagtaanccntgcttcctctcnacnaangctagctttcgcaatgncgccatngancaagctcttcctcgtgcncctcggcntaaacttgatggtcaacgntgtgcacggtggntgcggaccccactgccncatcctcctcncgggctacgtcgccgccnaggtcancatcgggtgctgcctctgcttctacaccggcttgagcaatggngatgattgcngctcgaggccgccgtggcnggacgcancctcctcaacgaccactggatncanagatctgccgcatgaccgcaccggagagttganaactcatctcntttgtcaagcacaactcgactctgcaaaagggtg

SEQ ID NO: 86950 - DNA, 468 bp, Triticum aestivum
  unsure (1)..(468): unsure at all n locations
  Clone ID: PAT_TA_86950
gttgggtttatcttccgtgagcacaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacgggccacatataaantgccattgcggtttgtcaactctgacattgctttggnttcctttccatttancttcctgttgttcctaagataagatatgtgtattccatttcccgacatgactcgagaaacagctcgtattgaatctaccgatggtattttatgcacatgcacataatatataatacatcttcgacnngtattgggt

SEQ ID NO: 86951 - DNA, 188 bp, Triticum aestivum
  Clone ID: PAT_TA_86951
cgatgagccagcttctgcagagccggcggtactgaagtgctgagagattttgattttttgagcgagcttttttacgggttctttttcactaatggttccaaggcaaatctagcacttttttttttgatcgtaaggcaaatctagcacttggtactggtaactgacctttgtgtgttaaaaaaaaaaaa

SEQ ID NO: 86952 - DNA, 525 bp, Triticum aestivum
  unsure (1)..(525): unsure at all n locations
  Clone ID: PAT_TA_86952
gcccggtgctgcgggggaaggaggagtgcgacgaactagcaaactacatgtcatctgagtacaacatcaaggtggcttccctcctgcaagacatgagcgacaagtacctggatatgctctactccttgttcgacccatccattgcaatgctcgactacttccagcgaccagaagcaaacggttacactgtggtggatgcagcgtgttgcgggctaggaggggagaaaaatgccatgtttagctgcactccggccagctccctctgcaagaatcggaccagccacgttttctgggactttgtgcaccccacggagatcaccgcgcagaagctcacggcagttgcctttcaaggatcagcacccttcgtgaccccagaaatgttgagcagctattggcactgccatgtagcaatgctgcgccgatgcacatcactgttgttttatcaaactaatgggttcaacctaactgctacatgttccataaattctanctttcatgtcactataatcnccantttagagattn

SEQ ID NO: 86953 - DNA, 535 bp, Triticum aestivum
  Clone ID: PAT_TA_86953
ctgtttctgtggggcgacgatggggagattaggctgggagtacatgtgcggttcagctagaaaatggatttgattttccggcgctttatagccaatgctcgaatcttgggacactagctaatgttgctcatgctgtggctacaaagagcatgttccagatcttctataaccccaggataacattcaccccgactgtgcagcactgcagtatggctacggtgactggcctgtgcctcaggcttacgttgatgcaaaacccgcgcgacttggtgaggctgaggccatcaccgagctgcaggctggatacatgcatgcggacacagccacggccgcagctctctgtaaaccaagacagcgacagcatcgacgggatcctcgaacaaccgcgtccttctgcctgcgtccttcccctacatgcttgcgactgcatcaactatcctgcccgagcctcctcaacttggctctggtgagctgatgtaatatttgcgtaaatcaagatgaaagtgtcaaagaactcaaagacatcctacataca

SEQ ID NO: 86954 - DNA, 531 bp, Triticum aestivum
  unsure (1)..(531): unsure at all n locations
  Clone ID: PAT_TA_86954
gaatcattcattaaaaagttttcatgcaagtccccagtttatcacaattgcaggatctacgctagtgatggaagactactttgctactgtgaccgcaaaaagttggaatggtatattcaacgggatttggcaaagttagtagaagacaatcctccgggaatcatgctgctgtttgaacctaagggtcgtcccgaggatgaagataatgaattttatattcagagcaagaaaaatatctgcgttggatgtggagaaaagagccactatatcagatatagaataataccatcttgctacaggatgcactttccggagcatctgaagaccatcgttcacatgatattgtactctgtgtgtggattgccatgaaattgctcattcagctgctgagaaatacaagagcgactagcagaagaattgggaatacccttttgtcaaaaaatatgaaccgggtgatagaatttaataaccgaccatcattactgaagataatgatgaaagtgttcccttgcgctgangacgctgcaaggn

SEQ ID NO: 86955 - DNA, 569 bp, Triticum aestivum
  unsure (1)..(569): unsure at all n locations
  Clone ID: PAT_TA_86955
gcagggcgccgccgacgttccatgcactctcctgcacttcgtggatggcgagttgatcgatgtcgccaaggccagaatcgttccaccgggcaaccccgtgttccacggtaatccgatgccacccaccgtgtatagggttcaactgggtcggatgctgccgggctgcgacgacttgttacctccgtttcgacccactggggccgacgaagatgatgtgatgaccctcagcgcctgcttaagctggcccctactttggccgaagagccagattcgtttgggggcgggggacaccaccccacagacaagaccgccagtcgtgccggcgccaaccatggcaagaccgccgcaacgctaccggacatccggacatcatatggacangattcngacatcatatggacaggttcggacaacacacacacggacatttacaactcgataatatcaacgacatggtacatgaagatcctggggtcctctcaagaaccacctgcaaaaanatgcnttanctatacgcgggaaacaatgcacagcgtatcagcttantctaggaaacctcacngcgcntn

SEQ ID NO: 86956 - DNA, 545 bp, Triticum aestivum
  unsure (1)..(545): unsure at all n locations
  Clone ID: PAT_TA_86956
cgcacaaagaaacatacgcatgatctagggatatcaaataaataatgatagttagattccatgtcttgggatgatttaaactctatttctttgatactgtgtaggtaggtttctttagaaagaccaagcattatacaaatttgctttctgtctttccaggttatactatcgtatcagtcttcacttctgagctactcttgctatgattcacgcatacttgatggaaacccagcgagtgttcaggatcccacacagaacagttcttgacagcctcctagcgcatcttgagttatctccagacgagtacgagcgtgttgttcatgaggatggcaagtccatgtaaccgtctctttcaacacctccacaattaaccttggggggaccaatcagcgacatttctgtgccaggctttattgcaccgacgatgagcgccgaggatacgctatgataaaggtatcatatcatagaggacatgacaacacgttgttagagactgaactgctcgtccaaacgacatcagcgcagccgacactccgcacattang

SEQ ID NO: 86957 - DNA, 596 bp, Triticum aestivum
  unsure (1)..(596): unsure at all n locations
  Clone ID: PAT_TA_86957
tttttttttttttttttttttttttcatgcaagtttgcagtgaagaacagggtgtaaacaagtactactaactttgcaagttaggtccaggttaagcaacatttagagcatccatcatacaatcagaaaaatcgtaatgccagaaatgaatagggcctttgtaagaaaatccaaatgttctaaactaccccgtttcaaatcctatctggagcatttttatgcatgtggcaagccatctgtatacagatgtaaacagtagctactctatgcaagcggagcaattaccattattttacaaaaacaagggtttcccccgtgctacattgaacaaacgaagcaacagaatacaagtacatgatttcacngaggaaacagactcctcggtgtatttgaagtcagggagaaacctaagctagtgagcaggacttaacaggctgcaacatcatggcataataccatgacatagctctcgcaacctanacactctcaactgganacgtatggacgcgcatgctcctcccnacggccttgaggccncggacttgtgcactgggccccccacgnnttaagccccagaaacngggctgncccaaang

SEQ ID NO: 86958 - DNA, 397 bp, Triticum aestivum
  unsure (1)..(397): unsure at all n locations
  Clone ID: PAT_TA_86958
tgaaccgatgaaattgaaagagcatggggagtatgatgatgctgccactgatgagacccagtanctgctggagatggagccacgacgacctcaatgaaccgctaatataaagttaccgtagatgctatctagtctagtttgattatgcntgtgttgtgtgtgctgtgagttagtttgcaactctcaattgcttagtttgctctgtttttgtgagcaacgatcatcacgctctgatgatctttgatgggcttgacaggtttancgcgtgtgctggctgcgtgaagtgatgtggtgcttgctcttggttgataccgaaatcaatcaaaccttttggatttcanattgtaagcggagcggagttccgcctatgtatgaacttgtgaatacaacaacaaca

SEQ ID NO: 86959 - DNA, 582 bp, Triticum aestivum
  unsure (1)..(582): unsure at all n locations
  Clone ID: PAT_TA_86959
aagaagcttactcacagaattcgtcaaaaaagagctcaagaagtgcaaacgttacttcaaaaacctgatcatgagatagatcgcatgaagctaagtgtgacgcatctcaggttgttacaagaggccagagagcgtattcagagtaaaacaccgtcaggaccatcatcctctaatcaaagcagctcccattttggagatactgacgattttgatccttttggagataactatgacaatgacagaacagagaatcatgcactagaaaatgctactaaactgaattaccattcttatatggacaaaaagacacgggccaaatggacaaaatctgacactgacttgtttaccacgtcttcganaatttggtagcgattttgcaatgatacagcaactattccagatnagtccgcgataagtacgcaaaagttaaagtgangacaagaacatccaatcaagcacgatgctatcttcatcgctccagagatacnntatttagacagtatgaacagtcacantnagatcgccannncacacatcacnaacagagtncgtactgaggaaactgaaatgttattcgaacnt

SEQ ID NO: 86960 - DNA, 471 bp, Triticum aestivum
  unsure (1)..(471): unsure at all n locations
  Clone ID: PAT_TA_86960
gcaccgcatcaacaccgatgccgagctcgctagagggcacgtccatggcttccggatgtcgctctggtacgagcacctcggcaagacgcacgacgacttcctccgcccggggagcctagaatgcatgcggagggtcaacaagatggccgatgagtactggaacctctacatcggcgacgagcttacgggcgacctcccaggccacctgctcacctaccccgtcgccttaagcaaggccggcacaacctggatgataccgggattcgaattcttccctgacacanaggcccgcgtccttggtaagccaactggacatgacgattattacatgagcacatagatggagccaggtttgctagctgctcctagctagtagtggtgtttgattaattctggcactcagcttcttagtactagtaggatttagttacattttccaaaacattccgtttcgcaactaaaaaaaaaaaa

SEQ ID NO: 86961 - DNA, 233 bp, Triticum aestivum
  unsure (1)..(233): unsure at all n locations
  Clone ID: PAT_TA_86961
gtgccacccaagggagcaatacttttcattttgctccggcgcaatgataagtggtaaaatgaatggaacctgctgcagtttcataatacttccttcgtaaagaaatataagagcatttagatcactaaagtgtacggcatctttggtgtatgcggcatctttggtgacatgtgtgccatggctgtgcgcaggtgcnctgacaaggtgaacccacggaancanccttacaagat

SEQ ID NO: 86962 - DNA, 393 bp, Triticum aestivum
  Clone ID: PAT_TA_86962
gacaccatcacatccagccaccatcacctcgcgctccctaccagactagaggtcgtggttgtatggtgccctgcgcgagtcttacctccctctctcttgttgctgctcctccctcttgcttcgtcctgctgcttctcttcttccccttgccttcctcaactgctgctgctcccttcttcccccaaactcttctgctgcatcttccttcttctccttgtccctactactactgctgaaccgctcctcctcttgctgtgactctgctgctcgctgctcccctactgctgatcccatcgacgcccaccccgaccccggcccgctcggcaggtgcccacgcgacgcgctgaagtgggcgcgtgtgtcaacgcgctgaactgatcaagtccaggtggg

SEQ ID NO: 86963 - DNA, 397 bp, Triticum aestivum
  unsure (1)..(397): unsure at all n locations
  Clone ID: PAT_TA_86963
gggggccgaaacaggtcgggccgatcgcatcttcttcttctatcggcagggaccgtgctagtcggtcgatccggtggtgagcgtcattctcactgactccttcacaggggccaagccggccttcgagagtcgggtgcacaataggcggcagggaggcacgcctctccctgcgcgagggaggcggacgattgccccgttgttccactgctcgtgggcggccgtcttgatcgcgcttgatggtgatgtgggtgcgccgtgttcgactgcggctagcagccggctcttggtctcgttgatcgcgggtgctgcctgtcngcgaccgggagtcncccgtgctcacgtaagtgggangttttggctgtacccaagttcaacaccggtgacagcctcctgctga

SEQ ID NO: 86964 - DNA, 396 bp, Triticum aestivum
  Clone ID: PAT_TA_86964
agaagagatggcgtctcacggcgcggctggcattccgtcgaacagctgccgcgcgccgcggtgtggatgtggacgcggctggcggggagccggcccggcgagcgccgcgtcgggatggcttggagcggggccccatggttggtggagaggacaaggcccgctggaccggatgggtcggccgcgagcgagaacggaacggcagattccggcgcggccggccgattgaaggggatcattttgttcgctacctgcagttgaaccggtcggtgtccacgctggccggccacggagccgacgatggacgtcaaaacgagaatttgattattggcacctacgtgtacccatatcattgatgtggcactacgtgtatgcatatcatcactattttacttgtcc

SEQ ID NO: 86965 - DNA, 398 bp, Triticum aestivum
  unsure (1)..(398): unsure at all n locations
  Clone ID: PAT_TA_86965
tcctccccctccagccccctcgcgccccagccgacgccgccgccgccgtcgccgccgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatccgacatgaacaagagggccggagagtttccgcggaggagatggacgcctgatggcggtggtgcacaaccgcnccantcaaggtccggatggtcctccaacagaaagaagactacaagacggangtctcccaagtcgtgtccaacgcctggacatgaactcaaggatgacttntaaggtc

SEQ ID NO: 86966 - DNA, 377 bp, Triticum aestivum
  unsure (1)..(377): unsure at all n locations
  Clone ID: PAT_TA_86966
gtcgagcaggacctcgacaacaagagcgacctgctcctcgcctccaacccggtgcacaagaaggtgccggtactcatccacaacggcaagccaatctgtgaatccgtcgtcatcctagagtacatcgacgatgcctatggtaccgtaggcccctccttcctgcccgttgacccatacgagcgtgccattgctcgntctgggtaagactacatttgaccagaactatcacccatgggaaanggcntcacggcaaccgagagaggagaaaccgagggataatcagatgttggcgcacccaacgctggagggtctcaaagatgtcccaaggaacctcttcngngggggatacattngtacttgnattcacccgcgggcna

SEQ ID NO: 86967 - DNA, 386 bp, Triticum aestivum
  unsure (1)..(386): unsure at all n locations
  Clone ID: PAT_TA_86967
actgagttgtgatgtagtacgagctaaatatattgcttcattataataaaagggttgatatcattttgttgacatttctaaattttcctactgcatttcctatacttaggttgtggatcagcgcgacaaggaatgcttgacattaattttgcacaaacacataaacgaaggaagattcacagcagcactggaaatccgcagaacaacaagcagatgaaaatacacantacatacatgggaaactgaantggtttcctgaagaaccctttgaantcattctgtacttaagtccttacnctgggcanttcctccccgttacctgttaagtgtatacctgatgtgttagtcctggtanccatgtatgattccatcattgtttgggcgtt

SEQ ID NO: 86968 - DNA, 279 bp, Triticum aestivum
  Clone ID: PAT_TA_86968
ccgactgctagatccacccaccctcccaacatctgtcctcctcgtgtcccggccccggggtgggttgatgatgcatgcggtgcaaatggcaagagcccggaggtatagtatacatgtactgagccgtatatacatgtgctcatcttgtcgtacgtactacgtatctgtcggtgtgtgaaagtgtgtgctgccacgcatgtcccctcttggcagtgactgtgtccgtgtgtaacattgccactacttcaaatgtgtgcactttagtacaaaaaaaaaaaa

SEQ ID NO: 86969 - DNA, 399 bp, Triticum aestivum
  Clone ID: PAT_TA_86969
cggaggtccaccgtggacagcggcagtccagcaaggtgtccgtcgctagctaactggccggtgctctaacggcagtccagcaagatgaattctgaagaatacagcatctcaattctgaagaaccatcgacgtctccttctctctggccggtgctctagccgggaccggtggaggcaccagatgcagcttggcgtcgccagcggaaggcaaggcagggcagcagcatcaggcggcacgaagcatagctgcctgtagcttcccacatgtccatgtcaagctaattaggttgcccgtgtcggaggaaattgtacctgattcttggtcggtctatgctgtgctttgccgatgaattgattcgattcgaaacgaaatagaaaaggcatggatcaaaaggggggg

SEQ ID NO: 86970 - DNA, 417 bp, Triticum aestivum
  unsure (1)..(417): unsure at all n locations
  Clone ID: PAT_TA_86970
cccacctatgaaactcccaaacctttccggttatgcaatcaggtnttgggggatacaggggaagcataatatctcacccaaacctagcaaatcctacatccagctgtatccatccttcaacacataaccgagaaaaacttcggaaaccatctacctcaaccttccaaaagcatccgttatacaagttatggcgatactcccgaactcccgccccagtactgggtggngtcgaggttatctcaccagangaactgcataaaagagattttcgatgtcggngttactaaactcangtattcccaganctgcaacantagaattatgacgacaacacctcnagnagctcanctccncggggacacttccacataaccccctggacngggaggcaccaaagacaatgttcttaattcatta

SEQ ID NO: 86971 - DNA, 474 bp, Triticum aestivum
  unsure (1)..(474): unsure at all n locations
  Clone ID: PAT_TA_86971
gagagtcctgttcctgaggtacgaagagatgctggccgatccggtcaagcgccgtccgggagctcgcacggttcctcggcgtgccgttctcggcggccgaggaggcggccgggttgccgatggacattaccgcgatgtgcagcatcgacacgatgagaggcctggacgccaacaaaaaaggaagcagtgggacgttcgtcaagttcccgcatgaaaccttcttcagaaaaggggtcgtcggggactgggtgaaccatatgtcccccggagatggcccgggcgcatcgacgccatttgtccgaggacaactccgtggatnccggcctcaccttctcgtcctgatctcacactcctcacttnggcaagaccgccctatgatcaagttngagcccaagggctttggtgtgtgctcatcgtgtttggtatccattttgatccttcaattggaancnaataaaatcatcctgggcaaaa

SEQ ID NO: 86972 - DNA, 606 bp, Triticum aestivum
  unsure (1)..(606): unsure at all n locations
  Clone ID: PAT_TA_86972
atagaggtacaatttggtcatatttttcgacgcgagtacctcacctagatgccatggctaatgcagtttgacaagagtcgtaataaaactaatggataatggtgtttcttactccttggcctcatcattgtgaggacaagagcctaactggacatgcgtttgagcagctgtatcacagaacttcacaagaggtactcagattcatctcctcgacacaccataagccagttgtttctcttcaggactttgggcgcctgatccactttgagaacggtgagtgattcagcggtgggaacctgcaacagggtattgccttacaagaagggagagtacagtggggaaatatgttgggaacgtttcatgacggggattgacttccatgattccaacgaagccataacagcggtcaatatcctattcaaagggatgttggtgaaactgaactcctggggcactttcaacatttccnccatgaagcctgatggccatgctggcccttngcanggtgttccatacattttcacagggcaacaacaaagattgcccatcggtcaanaatgaatgcctgcatnggtgcgtgccaacgacgcccggatgatcgatann

SEQ ID NO: 86973 - DNA, 341 bp, Triticum aestivum
  Clone ID: PAT_TA_86973
gttaggtccatttatgggccaaaaaagagggccccaggaagcaacacaacacgtcgagtgttcgaagacaatggcacaccaaaatacaggggcgccgcacacccactatgtttcaccgatgaggtgctggatcatgaatttccagcggggttcaaacccgtaaacatagaggaatacgacagaacaacagaccctggagtctggattaggattacatcctccacatacacatggccagaggagatgatctccacgccataaaatatctacccctcaagctcaaagggccagctcggcattggctcaaaagcctcctagaaaatactattggaagttgggaa

SEQ ID NO: 86974 - DNA, 459 bp, Triticum aestivum
  unsure (1)..(459): unsure at all n locations
  Clone ID: PAT_TA_86974
agagatctgagtttcgaggttggagatttcatctatctgaaagtgtcaccgattagaggagtcagaagattcggagtcaaaggcaagctagcaccccactacattggtccgtatcagattctcgcaaggcgtggagaagtggcctatcagctcagtctgccagaaaatttgtctgttgtgcatgatgtctttcatgtgtctcagttgaagaaatgtctgtgagtgccagaggagcagttgccagttgaaggtctggaggttcaggaggacttgacctacatagagaaaccagcgcagatcttgnagaccgcagacagagtcaccccgaaaggaagaccatccaaaatgttgcaaagtcnagatggaatcatcactctaaaggaagaagcaacctaggagcgcngaagatgattctggatggccaaataccccngacccaattgctnancagccctgaat

SEQ ID NO: 86975 - DNA, 580 bp, Triticum aestivum
  unsure (1)..(580): unsure at all n locations
  Clone ID: PAT_TA_86975
ctcggaaggtcatatcttggtgttctaaattgtgattcaggctcagtttcattgctcgacaacccctttctccgatttgtccaatgtggttgctggaaatgattacttctanatcnaaggtgcatctgcaagtgccccaatgtcaattgcaaaggtgactttggataagaacaaaacaaaagcaattagtttctcaatagtctggtcttcctcaccagatgctgtgcagtatagacctttcttcagcaccccagaatttattgagttccctacatccagccctgggcagaaggcgtatgcctatttctacccacctttgnaatcccatgtttcaaggtttaccaagatgaaaagcctccattgctggtcaaaacgcatggaggacctacngctgaaacacgtnaaattcnagaccttagtgtccantaatgggacaaatccnaagatgggcatttccttgaatgtnaaactactngaggaagcactggatatgggagaagataccnananaattattgggggaaatggggtattgtccaagttnaatgatggtngcntccggtnaagatnctgntccaaa

SEQ ID NO: 86976 - DNA, 318 bp, Triticum aestivum
  Clone ID: PAT_TA_86976
gcgagtttgatataagcgaaatcgatgtaagcacaactacatcgcctcaatgtatcatcgaaagcacaaacttggacagttctatgtaagtacaagcaattgtaacacagaaattaagcacaatcaattcagaaaatgtagagagtaagactaattggcagcaagcaaacatcagacgaactaggattctcggtgttctcctccatgccgatgttctcttcatcatcctctttcctcctcttcttccttttcctcttcctcctcctcctcttcttcctgcaccatcatcggccgctcaaatggggaccgccggaccca

SEQ ID NO: 86977 - DNA, 582 bp, Triticum aestivum
  unsure (1)..(582): unsure at all n locations
  Clone ID: PAT_TA_86977
cccagcttcaactaaggaatctagcacctgcttaactaataacagggaaatgggtcttgcaactcctcgggataactcgtcaataacgtcgaacagagaagactctaaccaagatcatgtttttttggcatttggtcgggactcatcagactctcctatttcggttgcctcaactatgtcttctccagttgctttgaatggttcaagaaatgaagagtcaggaccaggccaatcgaccgtaaaggttaggacacttgaaaagagcatgtctgggagctcaaatcaggagacgaagtcgatgcctccagctagagaaggtgaacagttggctaaggagaagttgtattgctgctcttgtcgtgagagcatctccagggagcctcacttagaccatgatagttcaacagccaagatctggacacttttgctagaaaacaagttccacaattgcacatgggtttacggacatcatcatcttcaacacataccaagggaacaggacacannttcaaanccttactnagattcaatggtcagctataacnggcaanntttactgaatctccaagacccccgtctang

SEQ ID NO: 86978 - DNA, 605 bp, Triticum aestivum
  unsure (1)..(605): unsure at all n locations
  Clone ID: PAT_TA_86978
tttttttttttttttaggaaacacatgttgaaatcccatccggaaatttcatccagccccatactgcacacacaagctgaagctaacacattggcgaactacaacatccaacacacaccacccatggtacaccactgtctgtctgaaccttccgaataatatccctctacccaacacactgagttcagcattcaacttaacaaaacgcgtggctgaaatatcatacaggatgcagaaacagtatatccaagagagcgagttatagtagtgcaaatcagaactaggcgatacgactaaaatcagttacatcatgttatgcgaccgaaagacctccttccataacctaacacatcacgagcaagggcattggacngcatagattgtggctcgtgccgaattcngcacgaggcgancaccacgcgtacaaggttcaaaagccctcatggctcantgagatcagcgagacaaggttcgtcccatctanccggtcagcgctcgtaccctgcatcgacagattcactcgacgttcgtcgtcanatncgcacatgtcgacggcaantgttgaggacgcctcctgcaacactcctccgggatntggaaggagg

SEQ ID NO: 86979 - DNA, 620 bp, Triticum aestivum
  unsure (1)..(620): unsure at all n locations
  Clone ID: PAT_TA_86979
ccggatcgtgcacctcagcggccgcgtcgacgagtacggccgcgccgtgctccccggggaggtcctggcggcgcacccgaaccacgtgctcagcaggccctgcgggtccaggcagcagggcgggccgcggatcgtcatcatcgtgtcgcccgaggccgagctggaacgcggcgagatctacttcctcctcccggccgcctccgtgcccgccgacgccaagaagaagaccaatgaccaagcgcgagccgagccccggcgccgccgccgtcgaggagggccggcgacaccatcgccaccacgtccggagcaagtcggaaggcagcgcggccacgcngccgtccaaagtcgncacctggnacagcagcagcatccggaggccattatcaacggannccngccacgtcnggnatccgcacctggcgcgcatcgccnangaccctgatcagctctggctcccggtcntcccgtaatgtccttcngcatggatggtcnnntttcctgtctgatccgtggnaanagcctgntgntgtctanatttatantgcnttgtaancaccccaagnttnantggatcanttgtccntggtnaacaaaaagcncnaacgtggnaagtttctttg

SEQ ID NO: 86980 - DNA, 609 bp, Triticum aestivum
  unsure (1)..(609): unsure at all n locations
  Clone ID: PAT_TA_86980
ctatggcatatagggaaccattggcaagtgggtaagatgcagcagtgaattcccctatacacacgacgtcccaagtagcatagggtaccagttcaacctcaccaccaggggctaccgtgcgcttgtattcaggtgaaaataccaaaggagaattccggagttgtaacacacggttatattttctcttgcgagaggattttcatatgctagttgtatatttttccatgtcttaaaatcatgacccgtgcgcgcagcggagaccatgatcttttggtaccatttttgggaacacatgcgtggataagatccttcaacttctccattgttgataactgggagagcatggcatgtgggatgggccagtctgcagggttaagtctctctcttcttgattttgccttccactttagaccaagtttaaacattgctaacccttcaatgggattacaatccgactgaacatcctcactccggaaaacaagagttacatcaatcaaagcatataaaggacacaatgctacagcatgatggaattacctatacacacatagancctgcaaaagagaattcaatgcatatagtttacaaattacgttccgttggggaatg

SEQ ID NO: 86981 - DNA, 576 bp, Triticum aestivum
  unsure (1)..(576): unsure at all n locations
  Clone ID: PAT_TA_86981
ggagtttacaaccgcacaaattcatttaacgcaaagtacaagttacaatcaacagcaactacatgagcaattctgttgggaagttgcgcattccagttatcttctgttccagagacaagtgcatgatctgcaacctcatgtgctaattcgctttggtctcttttgatttggtgaaactgcacctggtgcttcttgccggactgcacagaggatataacctaggctggagtgactgtatgcctctccctgcaaaggagaaacaataaaagcagagtcattttccaatttattttcaagtgggcacaccgacagtggaaggatgaacagaattcagaacaaactgggctgaatttacacacangtaacatgtgctgtcaagtgtcaagttccacggactgtcaagactcaanangaggcaaggctatgttggnagacctaaatattttgacgaaaggcctccaacataatgttcagagttcagactgctcctcaanttctcccttgcaagtccncatattttcactaaaatgagatagatgcttccccggancaagnttcataatattcagtagttgg

SEQ ID NO: 86982 - DNA, 457 bp, Triticum aestivum
  Clone ID: PAT_TA_86982
acagtccacacccacaccacaactaggtacgacgagctgtgagcgattgagtgcgccggccggatggagtgagtgaccaacgatgatctcctccgcctcgggcagctcgagaaccacggctgagtcattattggattgttcgattcctagctccactaaatttggagctttacgccagcgaccatcgttcttaaagctccaaacttagtgagctaagagttggaaagttcaagtcttaaagttcttgaatgtatgtaataatctcctgatttttgcaaccttgtggtatgtatgcaagtgatggatgttgcagttgcagtgtgcacatggttcaggccagggtatcttaatgcatggacctccaactggtttctgtacattgtggtcaagatcatagctgtttttccgttcctgtcatgtacggtttcagtgtttaatttcttctgctcctctgtcc

SEQ ID NO: 86983 - DNA, 284 bp, Triticum aestivum
  Clone ID: PAT_TA_86983
gcgacaccatgcccgtccagctccttcccgctgttgcttgtcactgtcgcatgcaacacgcattgctaccttttctgccataacttttcacttcttgatgtacaaaatactaaactgtctgatccccagggtttggtccattggcccctacatgagatttgttgtaatcccatgtggagagggtcatgtaccagctgtgaatattggttttcttatcgtacaccatggggtcagtagggtaagctaaagattgcaagaatattcacttcgttaaaaaaaaaaaa

SEQ ID NO: 86984 - DNA, 214 bp, Triticum aestivum
  Clone ID: PAT_TA_86984
gttacgagaagcaccaccaccatcgccgccacaactacgatgactaagcatccagcatggtcttgacctgctgccatcggccccacatctcgctactacacgaataaagattggtcttgtttcccttgttggtgctggatcattcccctcttttatgaacttgtatgactgcaacctaaagtgtgttatgtgggtggtttataaaaaaaaaaaa

SEQ ID NO: 86985 - DNA, 271 bp, Triticum aestivum
  Clone ID: PAT_TA_86985
ctgcatctaccgttcgccgtcgcatctcctcaccggtgccaaggataaagaagaactagagatcagctagctagaggaagaagaagaagatagacaagctagtttgttttgtatttgtgctgttgggattaagagatcagctagctagagtagatattatagacagtaaaaagtgccttcagagctgttctgtgtatgtatgcaaaatattggaccttgtgaatgttgacaatggaatacacagaagtacatcaattttaaaaaaaaaaaa

SEQ ID NO: 86986 - DNA, 563 bp, Triticum aestivum
  unsure (1)..(563): unsure at all n locations
  Clone ID: PAT_TA_86986
ccctaccccacgacttgactaccaatctgtctccattgcttctgcagcagcatcatcgtttttttttgcatcatagggggattaggtgattccgccacaaattctgcatttctagcagcatgttgtgtacagtactgtgacacccaagtttttatttggatttttcaaaaagatttttatttgatttgaagggagtgatttaaaaaatttcttcaagaggactctcactctcaaatatttttctttatggcaagaattttatttgaattcaaccaagatctgcctttgaccttgggggttcttgctcttcatttggggctcaagacaaaatgtttttcatttgagaaaaataacctttgaaatatttttgagaatgcactatggcttttggaaagtcctttgccactttcaactattccttcctnccatggcattagtgnaaacctctctcctaanccttccctcactttgggatcatgatttgcatcaaatccancaagttgnaactcctcatgtgatcattccaatcaaaatcaatcaaataattcggtctcccgnagngg

SEQ ID NO: 86987 - DNA, 414 bp, Triticum aestivum
  unsure (1)..(414): unsure at all n locations
  Clone ID: PAT_TA_86987
gcaccttctcccgcgtcgtcttcgcctacacctacatggacgacatcatcgtcccgcgcggctggtacaactggggcgaccccagccgcgagctgacggtgttctacgggcagtacaagtgcacgggccccggcgcgagctactccggcagggtgtcgtggtcgcgggagctcaccgacgaggaggccaagcccttcatctccctcagcttcatcgacggcaccgagtggatcaggatctgacccaggtcgcgttccatgtaacacgcacacacgttcatgtatgtaaaaaaagagacaaagtgaatccataaagattcttttgcagtcttcaaaaaaannctcaaaataaaaactcnaggggggggcccgggtaccaaattcccctatangtgagttcctattacgcggctca

SEQ ID NO: 86988 - DNA, 516 bp, Triticum aestivum
  unsure (1)..(516): unsure at all n locations
  Clone ID: PAT_TA_86988
tttttttttttctgttctttttctttttcacttctcattttgcatcttaagcagtcaagctcancgagcanaanaaatatgcacatgtaattgcanattcatagccaatatctgaacaagtagagaactgaaatcacttggcctaaccatgttcnattttctcgataggtgttctaaaactaagaacaattcccgagctgtatcacgntactantttacaagttaantanttttgcnctacttgaanaaacttatcaacaannatatacaccaaatgctacactacctgntatganntctatcantggtggtcncctancacttcanacaantttagctgcnctgtcanatcagtnttcacaaaaatcnggctgggncnacnggctgtcaaatactggcgnaaaccgngananggggngtcaggcaanttngctctaacccccctcaatggtcagcntccagaacttggcattgatntttcaanggggngtcccgtncccaatttntccccaanat

SEQ ID NO: 86989 - DNA, 593 bp, Triticum aestivum
  unsure (1)..(593): unsure at all n locations
  Clone ID: PAT_TA_86989
ctcaaaagagactctagatactgttcataggtacatatctactgcccctggatgtttctgcgataaagaactctcaatcaaggtatcacgctgcaactctgttgaagaaaacatgcttgaaacgtctttcccttggcgaagttcttcaggttttgtatatcgcaaccgataaaatgaagtggtttgttcctcactcttcaggctggcagcctctctcatggaacgtgatagtggctgatactgctccagatgctagtggaaaatcctagcctgggctacatttctcttctcacattggatggacaatttgagttctggtaagttggtacaaactcttggaaaggctgtggtctggtgaggttaagaactaatatggtggcccagtctacattttgccaagtattcccgtttcaagaatgatgtcccgggtaagtttaaacntggggtatgagctccgggttcactaatggtagaatgggtacttctgtcaattaagttggttttgcaattcnaaagacaccggagggatacaganggtcaagatctttgtcaaggtagtgcaacaatgcctgaatttaanaggtatgatctgg

SEQ ID NO: 86990 - DNA, 545 bp, Triticum aestivum
  unsure (1)..(545): unsure at all n locations
  Clone ID: PAT_TA_86990
gacagagataaataagatgaaatcccagtgcgccaagttcaaggccaccatgcaagaacatgcagtcgaagcgaagaagctggccatgcaacaaacccaactgaagaaacggaaggaggccctccagtcagagctggagaaaatcgagtcgaggctgaaggatcttccagcctccatcgcccaggagaagagcatagggatggcggcacaggctgaagggataacactagcggagcangtgctaaacgaagaagccgagattgggcgacacgtctgctggatgaagcgctgctagctcgggtgcagagatccaagaaagcgtntgcgcccagctgggagggtatcctccaagaaatccataaaccggccggctacaccttatctgctgtttcaaataaatctacgggatttgcttttaatcattgtcattgatttctgtgtgtattgaagtgaaacttttaagtnanaattatgcagctacctgctacagtacaattaaaggtttccatttnntatgtgatanttttaaaggncattctacacaa

SEQ ID NO: 86991 - DNA, 462 bp, Triticum aestivum
  unsure (1)..(462): unsure at all n locations
  Clone ID: PAT_TA_86991
gccaggcgcttcatcggctccaaggagaagagcaagaccaaccctgagctcctcaagagctacatcctcggaggccacgtttccaactacatgcgcttcctccagaagcgggatgatggttcctacgagaagaagttctcccgttacatcaaggccggtctcgctgccgatggccttgccgacaagtggctcgctgtccacgagagcatccgcaagaaccccgtccacgtcagcaagcgcaagacccttcctgctggctttgtccaagaacgcttcaaacgccaagcgaagcacccttgaaggaccgcaagncccgcattgccgttgctgtccgcccgctcntgatgctgccaaaggccaaggagtaaatctccccaagtttggaaaattgttccccaaaactttggatacctttggctccaaaaaaaactaanaaaaatttnagngagcaaaaaaaaaaaa

SEQ ID NO: 86992 - DNA, 607 bp, Triticum aestivum
  unsure (1)..(607): unsure at all n locations
  Clone ID: PAT_TA_86992
gatttctgtcattggaaccttgatgatttatctcatttcaacgtaatctaacccctctgatttttgtcagtacatgattgtatacctcctatgcccgcttaattctgtgttcattttgttaatcaagaaacatctgattttatggctggcgtgctgctccagcgcgaccgcttcgtgtgttgcctcgagtcgcgtggccactactctctcgccaaggcggaggcagcttccactctcgacgccctctgctgcgcgctctcgcangcggcgttccgcaaagccttggtcacagcgctgcaagtgttgcccccctcctccccaagggcaaggtgaaggaangtgcctgtgtggtcctcctgcanctcncnggcaaaggattgttgtgtccaaacctacatnagaatgccaagaatccctctcnggagatgattaaggacatgttcctccaactacaatgggagtttggggcggctcctttggggcttccaaactggaaanattgtttgaaagtaatttantttttggtggggntccaaagcttccacnagtncaaccccttanacctttagattctaaagaaccaaatgaanaaggggggaaggccnnn

SEQ ID NO: 86993 - DNA, 593 bp, Triticum aestivum
  unsure (1)..(593): unsure at all n locations
  Clone ID: PAT_TA_86993
gtcaatcgacccagaagtgttccactcaactgactcgaagacactcgaccatgaagtcaaccactcgaccatgaagccaaccacttgacagccagaagatctaaagtcactctgcaagctaatggtcggtcattaagtagattttatggtcatcacaacactttatgtatagcgttaccagtaacgcccagccttaatgtatcttaaacactgcataatggagggcgggaggggtctggcggactctatataagccaccctcctcctcagtgtaaggggttcacacccctgtaactcatacgcatataatccaatcaaccgctccgggtccgagacgtaagggtgtttacttccctccgaagaagggctggaacttggtaaacccctggngttatacaactactcccaatactaaaatctgcctcncccgtacctaaccccctacactactgtcaagacttanaaccaagacagttgggcgcccaaccgtggggggaccccctcaacggactttaaantncatcagcaagcacnaagttncatagggaatccacaagggcctaaagagttgagtgtcctaatacaangggata

SEQ ID NO: 86994 - DNA, 624 bp, Triticum aestivum
  unsure (1)..(624): unsure at all n locations
  Clone ID: PAT_TA_86994
gtggcacatatcacaaattataatatcgacttgatctacattctgtcaatggattctgcatctattttggttggtactacgagtaacttactttctccggaacctaaacatctccatggcgtgactgaacgacgagtcctcccccgccgcctcggcccgggccctggccactctgtcgatgatccccttgacggcgacgtcgaaggcgtccttcaccgtctccagcttcgaccttgggtccgcgtacaccagcctgggtatcagctttatcacctccgtccccgcatccgctccaccgtctcccggcgggatcnccccgaggaaaacaggataagagcattccaagctngagcaaaaccgcangatntccaangacagagagtgtcaaaagaaatgtttgccgccangcaaaggtcccatnangatttnccggatcccaactggttccagacctgngatagtccgacacctacacaagcttgctgttgttgcaactgcngnaacgtgttcgtccacttcaanggctanaaggaccaatgaaacngaancctncgaagcaatctcnaaaaaatccaaggttttgtgcacaagggganncaacncaagttatatacacntgtcctg

SEQ ID NO: 86995 - DNA, 566 bp, Triticum aestivum
  unsure (1)..(566): unsure at all n locations
  Clone ID: PAT_TA_86995
gtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggaccaggtgctcttcaacaacgacaccaccgacaacactgtccgcaactttgcgtccaacgcggcggccttcagcagcgccttcacgacggccatgatcaagatgggaaacatcgcgccgctcaccgggacgcagggccatatnaggctcagctgctccaaggtgaactcgtgatggacgtatgcntctgcagcatgacacgttgaatgaataaggccccanaacagtgggcactacactatcataccagacttgatcgtgnatttcaaagnatttcaacagcaatcatncatgcatcanctnagtaacgaacggttgatccccaaannttaaaataaaaaaaagggggggcccggaccaaattcccctanannatccgtntaaccccgccaanggcctnctttt

SEQ ID NO: 86996 - DNA, 482 bp, Triticum aestivum
  unsure (1)..(482): unsure at all n locations
  Clone ID: PAT_TA_86996
gcgtgaagaagccccaccgcttcaggccgggaacggtcgccctccgcgagatccgcaagtaccagaagagcacggagctgctcatccgcaagctccccttccagcgcctcgtccgtgagatcgcgcaggacttcaagaccgacctccgcttccagagctccgccgtctccgccctgcaggaggccgccgaggcctacctcgtcgggctgttcgaggacaccaacctctgcgccatccacgccaagcgcgtcaccatcatgcccaaggacatccagctcgcccgccgcatccgaggggaagagggcctagttctgggtccccggtaatactggctaataactgttcttgtcctgtgatccggatgtgtgtccnggtgcttctgtttggttggtgttgatatgattgtcgtcctatcctaatgtattgtgatgcttgaaatgaaatgcaatggaaaattcaattatcgtgccaaaaaaaaaaaa

SEQ ID NO: 86997 - DNA, 386 bp, Triticum aestivum
  Clone ID: PAT_TA_86997
ctgatatggtctggctcttcccctcccgctagccaccctgccttttccatgcccccaccgcgagcgcgccgcccgctgtgagcctccaccgtaggcatccccctggccgtcctccctagttcatgccagtgagcatgagtggtgagcaaaggaaaagttccctggatgtctcttggagcttcaaaattatgtgcagttcaccgtgatgcattttctttttttttatgtgcaattgggatgcataattatcactatatgcatttgtatttcctggacaggtttcctacatgtatttccgtggtgattgataagagattcaatccttgtttaatatataagttcaaaatttggaataaaatgccggttccatgtttaaaaaaaaaaaa

SEQ ID NO: 86998 - DNA, 309 bp, Triticum aestivum
  Clone ID: PAT_TA_86998
acctgatgcaaatatatcaaatcctccgtattttcatatcattatagtactatattaatagagcgacatacgaacaataacttagcctagcaaccttccacgggtacagggctcgatcgagtcgaacgatcggatcgcgggtcgccgtctagggaaaaatccaaaacaaatctcagcggtagtgctgcagcagctggtcggcctcccgtacgccgctcaggtaggccgcgtgcgtcgtcgagtagtgcgtccggtgcgtcgcctcgcccgcgaacagcacgcgtagcggcgtccgaccggcctcctgtc

SEQ ID NO: 86999 - DNA, 594 bp, Triticum aestivum
  unsure (1)..(594): unsure at all n locations
  Clone ID: PAT_TA_86999
gcgaaagatcacaacatcagtacaagtataaagaattgaaatgaatacaggataaggtaaattatcattaccctggagcggtcttaaaagccggcatgttggactgaagcgagtcgccggaggaaggcgaagtgtcctggtaatttgagtcataagagttgagtggttgacgagtgagacccgccaaaggataaaaaggagttaagttggaggtgacctcgttccgacgcttccttggtgtgtttggtaagccagaggagagttctgcatccttactggtccaggtcnancttcggctctcatgaatctgtcgcttcaaaanaaattgaggatcttnanaagctaaaggatgtnaaaatcntactttctgggttactcttcagattttcctgtcctgngcaaatgctccagagtccgangaaatnagnnttacctcctcatccactccgtgactcnttcccgtgtcctccttattanaaacnantgtcaataangggggtnaanaaagagcccnacangancaangggctaccncgnactcagagatacttctagtcgaagcantccgaagcccgccctgttcccttcntcttn

SEQ ID NO: 87000 - DNA, 595 bp, Triticum aestivum
  unsure (1)..(595): unsure at all n locations
  Clone ID: PAT_TA_87000
gggcattctgcaggccctagtcaacactggggcatcaaccagctgcatatggattgttctggtgacctgcagttgcccggggttctccctcaaactcaagatgggggagctattgtccctgctccacgtactgctgcaccagctcctgagggcactcagatggatttcactcaggctatggcgccaggttcttaagcgccatgggagctatgaggctcgtcttctccaactaccgaggggccttgccacctcggcagtaacaaaatggactaccatgctaaactaacctcaagttttccacctaatctccggaccattcgcacttaatgttccataatggtgggcaatgggcgctgcaatggctaatgcatcgacattgaaccccaacgttgtgtttgtacacnatgggttaatttcctggcgtgtcatccgttgcntgtgggtttccggggcatngatgataantngcaagcaaagattctacgttttgganaaaaaananaaaaaaaancnaagggggggcccggtaccaattcccccaaantgatcgtataagcgcgctcacgggcgtcgtttaaaacgtntgacgggaaaa

SEQ ID NO: 87001 - DNA, 381 bp, Triticum aestivum
  unsure (1)..(381): unsure at all n locations
  Clone ID: PAT_TA_87001
gttgtgtttagtttattttcagtgccttgcaagttagtggttcccanangattgtagcctaccttattagcgtcgactggcatatttatctttcaatgtcattgcttaaccatgcctggctgactgctatatttatatatgcacaaagtgcttattcctttggtgcttccagattgtcaaggtatgagcagagcagcgagggatgagaaatggggtaacttatcgtanacatacagaaacgaaaataaagctatgcacagagaaaagtactatgatccatccatcattgttggttcaccattctaaaggaaatacacaaagtggtgcatctangacgaagggatctannagacnacgatggacaaancaatcctgcatagg

SEQ ID NO: 87002 - DNA, 238 bp, Triticum aestivum
  Clone ID: PAT_TA_87002
ggaacatgagctgaaaatctgctgttgattagtccagctgaaagtttttgtgcctgaagttgcggtagcggattatatgcactgcactagataacagaacattccttttgaggccttgtccgctttgtaggctgtagcttgttggctgtggcagtcaaactttttctatattttagtatatggaaattttattttatggtcaatataatgaaactaatttagccttaaaaaaaaaaaa

SEQ ID NO: 87003 - DNA, 582 bp, Triticum aestivum
  unsure (1)..(582): unsure at all n locations
  Clone ID: PAT_TA_87003
acccaaccaacccaccccgcacgcaccaaagctcccagctttttccccttccgtccttcgtcgccgccgctctagggtttcctcttcccgatccccgatccagcagcagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggccgccgccggagcctcggacgccgccgcccccgcccgcccccgcggangactcaagaactggggacccgattcgtcaaagtcgacaagccacctcntcgactcatcctgggctgccaatacntnaacatcaaggggctttgggacctaactgtcanactgttgccgacatgttaaagggcaagacccggaggagttcgcangacttaacatcaagaagaantttt

SEQ ID NO: 87004 - DNA, 588 bp, Triticum aestivum
  unsure (1)..(588): unsure at all n locations
  Clone ID: PAT_TA_87004
gacagggaacgtgagctgggtttagaccgtcgtgagacaggttggttttaccctacttagctgggaattgcgagaaatgataatcgcgcaaagcgaactggggccgttcttgggcctcagacaagcggcatatccttgggagtgtcgtttaccaaaaaattaaaataaaagtgaacttttcaatttcgaaaacatttttgagattgtgaagggatctcgcaggtatcgtgagggaagtatggggtagtacgaagaggaactcccatgccatgcctctggtttctggagttcgtcgaacgacgagtgctccgatgctaccgcatggtggttctccngctgaacgcctctaagccaagaagccaatcccaagaccaagatgcccaacaaaaaagaaacttgtaaagctcctccgtagttttataaatcctcacttttaaccctcctatcgggaagtaacctcctgcggcttgctacgcnggaaatgggccaacacnacaaaaaaacttatcgaatcgccaatcaagaaataggagacaacgtctccctcnaaggngcaantaaaacatatgatcacaaggattntgtttn

SEQ ID NO: 87005 - DNA, 181 bp, Triticum aestivum
  unsure (1)..(181): unsure at all n locations
  Clone ID: PAT_TA_87005
actcgatcctctccctccctccctccctcnctccctcgtcctanccccaagtannggcaatncgcggttcttgattgctcgnggccgggccgtcncgccgaggcacggatgtcgtctcagangcaantgccgnggcagnatnggacctcatnagagctgtatgatgagcgactaccaatgg

SEQ ID NO: 87006 - DNA, 592 bp, Triticum aestivum
  unsure (1)..(592): unsure at all n locations
  Clone ID: PAT_TA_87006
gtagtctgcagaaatgggaagaagcactgcatgaagtaggccggcacccagtacattcgcttctcccacaagctagtaagtgtctcgttgtctcgtacttggtatgtttcaatcatagccttccaactctgttcaaactcctccaccatcaagctgtggtccacgcacaactcgaatgccttgtgcagctctagacggccagcaaagaatggtcctagtgtctcctcagccttcttaataatatgccacctgcagtgcctgtgcactgccaacggaaatacctcctctatgcctgcacacatgctaaaatcctggtctgttattatgttcatccggagcaagtccacccaacactccaagaaggttttngaacaaccaagtggtaaccatccatatcttccgttccgaanagagtccacaactgaactgcaatgacngattaatggtatttaatccnatnaaccggagcgcaaggcatcttgtacttaatannggagatatgtcgcttcgaacgaaaagcatcacgggaatggttgtaggccctcctncaacaacaatcaaccaatacatgtttctgaaangggcccatctg

SEQ ID NO: 87007 - DNA, 305 bp, Triticum aestivum
  Clone ID: PAT_TA_87007
gtcgattctctctttgtctcttttgaccaattctcagaccgcttgtcttcgttaaccgttctgaggcaaaccaaccacttgcacgcgatcgccgtgttcctcttcacagtgcacagacccctcatgtgcgtgtccgaaactgccccgaacccgaaccggtcggtcgtgaccgatgagttcggatcatcccctaacgtctacaaaacatctcctttttgttaattggactccataacctgtttattcccgacagttcgattttgatcggagggtccgttttgccctaagctagtccacctagctat

SEQ ID NO: 87008 - DNA, 229 bp, Triticum aestivum
  Clone ID: PAT_TA_87008
ccggaggcattcatatagagtcatatcttgttctaagtttcgagttgtaatttttatgttgcaatcaatagaagtgtgatgatcatcattattagagcattgcccaaaaaaagaaaaaaaagaagaaaggccaaaaaaaaagaaaggcccaaaaaataaaataaaataaaagagaaaaaaggggaaaaagaaaaaaaagaaaataaataaaaagggcaaaaaaaaaaaa

SEQ ID NO: 87009 - DNA, 261 bp, Triticum aestivum
  Clone ID: PAT_TA_87009
cttctccttacaaacttgatggggtacaaagttgctttctccatgacatagtgcaaccgtggttcttcctctacttgcaagctatgggtgctcaaatggagctgggcgcaagttttttttccctcagagaactgtacaagatttcatactctgtggaatgtccggtgatttatctcatgacaaatggctaattgaaaaaaaaggttatcataaagcaagcagccacaagactcactcatcgcaatcctcaaaaaaaaaaaa

SEQ ID NO: 87010 - DNA, 589 bp, Triticum aestivum
  unsure (1)..(589): unsure at all n locations
  Clone ID: PAT_TA_87010
gtggtgtctcggcacgacgaactgttgcaacggtgcctactcagggaagaacacttataccttgaaatttagtgagagatcatcttataattctaccgccgaactaagcaaaataagatgcatataggataaacatcacatgcaatcaaaatatgtgacatgatatggccatgatcatcttgcgcctttgatctccatctccaaagtaccgtcatgatctctattgtcaccggcatgacaccatgatctccatcatcttgatctctatcaacgtgtcatcacatggttgtctcgccaactattgctcctgcaactattgctatcgcataagcgataatgttaagcaattattttggcgcctgcnacctatgcaataaaagagacaaccataaaggtcccgccanttgccgataactcaataaaacatgatcatcctcatannaaaaaattatatctcacacgtcttgaccatatcacatcacaacatgccctataaaaacaagttagacccctccaacttgttgttgcaaatttacntggctgccaagggctttcaagaacgttcttactaccatcaaaaacacacacg

SEQ ID NO: 87011 - DNA, 202 bp, Triticum aestivum
  Clone ID: PAT_TA_87011
gccccttgaggctatagccacgccagtttgaatgtaatcatcaaggtactttgcacctgacctcgtggcatgggaacatcatcaacatgcatgcgtaaataaggagtaaccaaaagagtttgctttatactgctactagtgaaaaaaggttgtatggtctatttcagtacatgtgcttgtgttaccgactaaaaaaaaaaaa

SEQ ID NO: 87012 - DNA, 435 bp, Triticum aestivum
  unsure (1)..(435): unsure at all n locations
  Clone ID: PAT_TA_87012
gcgagtccctccaggccgacggcgcctgcttcaagccggacaccatggacctcccacgcctcctacgccttcaacagctactggcagcgcgccaagtccaccggcgccacctgcgacttcggcggcaccgccatgctcatcaccaaggaccccagctatgataactgccattacagtgtgatgtgaagaacagaacagcctcccaacagatgccatcagtggcgtatggttctggaagctggacaccattttctgctcaagttcagatgaagtagtgcagatatacatacagatatatatacatgtaggctgttttgaatgtgancatgttcattttgtgaatgtacccatccaacttttgcttccttttggcacatatatnttttgtaaaattcaagnataatgctatatgtaatgtaattttcccatccaaaa

SEQ ID NO: 87013 - DNA, 295 bp, Triticum aestivum
  Clone ID: PAT_TA_87013
gatcaatggcgcgagcaagtgattgacgaacacggagggcagctctatgtccggagatgaacttgcagagcgtgagtgttcccgtccagagtgtggctgcatgttgcggctctttccccatttcgagttctctctctttgggacttgcgggtggcttctctccggttattttcccgttcttgttcgttccattaccctttctcctgacctggtctggtaatcatgccaacatatcgttgacctgttctgtttcccaataaaatcacctgccatttgtttggtcaaaaaaaaaaaa

SEQ ID NO: 87014 - DNA, 278 bp, Triticum aestivum
  unsure (1)..(278): unsure at all n locations
  Clone ID: PAT_TA_87014
tatatttgttgtggtttactttgatgacattcntgtgtttancaaatccanccaagaacaatntnacccatgtccgcaccgttttgcaaactcttagaaaagagcgtcncnatgctaatatggagaaatgccnanttggtgttnataanctcnttttcctgggttttgtggtcccttcnaaaggtgttcaantttatgaatcnnaaatcaangngattaaaacttggccccaaccaaccaatttgcaacaagtgcgtagttttcctggnttaaccggt

SEQ ID NO: 87015 - DNA, 189 bp, Triticum aestivum
  unsure (1)..(189): unsure at all n locations
  Clone ID: PAT_TA_87015
ggatgcgttcctaggtaccggatatatgctacccggtccatgatgatggttccgangccaagtttgttctcttcgacacggtccantattgctttgtcgngttgatccccaataagtgttatccaaacnancaaggaggtaccgtccttccanngttcacatgactgatgcacttctaggcctacagcc

SEQ ID NO: 87016 - DNA, 352 bp, Triticum aestivum
  Clone ID: PAT_TA_87016
ccaaggttggatctccctctctgttctcttctgtttcacgttccccagatctggtcgaaaaccgtttcttatatcccgggagatccgtaactccgattgcgctgaaattttaacacgatttttcctggatataagcttccttgcacccgaagtagagatccaaccgacataggaggagggcacaacccaccagggcgcgcctggcccctggggcgcaccctgggtgtcttgtgggggctgtgggcccccgttcgcgttgattccaagtcccaaaaatcacctatattccaaaataattctccataaattttatcgcgtttgggacttccgtttggatatgggatttcctgtg

SEQ ID NO: 87017 - DNA, 321 bp, Triticum aestivum
  Clone ID: PAT_TA_87017
gcgaggcaaggcaggggcgcgaggcaggtgctcacagagggatggcggagcacggcgggtggcgtcggggcgcggggacgacggtgaggtggccttcgagggcggcgccgacggcaaagttgagcagcctgacggcgtcggaggcggcgacgacggtgaggtggaccagcctgacggcgtcggaggcggcggcgacgacgaggtggagcagcctgacgcctcggcggcgacggcgacgaggcagagcagcgggcgccgggcggagaagaaagggatggattttggagaaactgctaagtgctgcttatatagcaaaccttt

SEQ ID NO: 87018 - DNA, 633 bp, Triticum aestivum
  unsure (1)..(633): unsure at all n locations
  Clone ID: PAT_TA_87018
gaagaaccgagctttcttcgcaataaggattggtgctttttgcaagtatagggaagcgattggacaactctatgcttagcatacgtaatcgatggattcaaattcaggaagtgccgtttaagtctcaactgagcaattcgtaagcgataaagcacgggaaacaagcttaataacttttgcttcatcccttccaccttcctttttcaaccaaaaatgggttcatcctgcaagctaatagatcactaatagatcactaattaagatgttccatccatcgattcggttcaataactgagagtgtaattttcctaaggacgaagctcgtaaaagatcggcgttacctcactaccttcatatacatgcaaaatatggttcttaatatgccttcatatccggataacgtcgcgatcaagaaagcgtgtgaggcagtcccttcctctatcacaattccaagtctcagcccttggtctcttccctcnatttntgctcaagtccctccaaccctcaaccngctccaaagttacataggcaaaacgtcccaaggngcaacacctgtccaacttgcgggtnaatccagttncnaatccgaagtccatgaaacaaagctatnttcaagggctgcccggaaaancc

SEQ ID NO: 87019 - DNA, 651 bp, Triticum aestivum
  unsure (1)..(651): unsure at all n locations
  Clone ID: PAT_TA_87019
gccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggaccaggtgctcttcaaacaacgacaccaccgacaacactgtccgcaactttgcgtccaacgcggcggcttcaacaacgccttcaacgacggccatgatcaaagatgggaaacatcgcgccgctcaccggggacgcaaggccaagttnagctcanctgctccaaggtgaatccgtgatggacgtatgcgtcggcagcacgacacgtggaatgaataaggccccaaaacagtggcaattacacttatcatnccagcacttgaatcgtgtatttcaagcattgcagcagcaaatcatcatgatcaacgtatttacgaaggttgancncaattcccatcaaaaggnaggngaattacacnanctacn

SEQ ID NO: 87020 - DNA, 498 bp, Triticum aestivum
  unsure (1)..(498): unsure at all n locations
  Clone ID: PAT_TA_87020
gcaggccggaggggcgccattggccgcggcgggatctgggcgcgcgcgaaaaaatcaagatgccaagtgacgacgacctgctaccgtggagtttgaacgtggcgctggaaggaattggcgtctcgcctgctggtaggatcgattgtccgtcgcctcttgtgccgattctttagtccgagcttggagaatggagattagtggactactggagtattaattagcatatgatcactgcatattctatgggagtttaagtttgggatccgcccagtcatgtccaaggcagcacggcgtgcataccggcggtccgtctcttttgtcttctccgagggaggaggcgtgatgaaataactttttcaacgggtctacttcaatccggagacagagcaacgatagaaaatgttatcttggtaaaatatgtnaattgggncgaccaactttgtgcaacaagggcaataacaatagattagatttaaggacaannanaaaaaaaaaaaa

SEQ ID NO: 87021 - DNA, 597 bp, Triticum aestivum
  unsure (1)..(597): unsure at all n locations
  Clone ID: PAT_TA_87021
ggagtcccagcaaggagcgagcaagccaggaagatggacgccagcaagctgaagaaggtggccgggaagaagttcggcgggccgaggaagaagtcggtgaccaggtccgtcaaggccggcctccagttccccgtcggccgcattgggcgcttcctcaagaagggccgctacgcccagcgcgtcggctccggcgcccccgtctacctcgccgccgtcctcgagtacctcgccgccgaggtgctggagctggccgggaacgccgccaaggacaacaagaagacccgcatccgtgcccaggcacctggctgctgggccatccgcaacgaccaaggactccgggaggctgctgtccggcgtcaccatccgcccaacggcggctcatccccaaacatcaacccggtgctgctcccccaaagaaagaccgctggagaaggcccgagaagaccgccgccaaatcncccaaagaaggcacaaatcccccaaagaaggcacaaggctaaanngtataatgcggttgctnatggtcaaatgtggtanattnnaaacggttaatccgtaccctgcgccccgatttatnggancaagggaaccgcttgn

SEQ ID NO: 87022 - DNA, 326 bp, Triticum aestivum
  unsure (1)..(326): unsure at all n locations
  Clone ID: PAT_TA_87022
caccatcggcgtgcccctcgccccctccaccgccaagctcgcctgatccgtcagattcaggaggggttggtggctagagctcgaagggcgctgtgctcgcaaggatcatgaatgttgttcttgtatgaacgaaacatctgtttgaattcggcataaagttaactctttctttcttggtcttgttcccctccgccttccctcctttggttcaagtttaagtttgatggaataaggaaccagctgtcttcctatacnctgacnantgaaatggnaagcttgaagttttgaatgcantgcatggcctctgcttttgcaaaaaaaaaaaa

SEQ ID NO: 87023 - DNA, 325 bp, Triticum aestivum
  Clone ID: PAT_TA_87023
ggacgccggcctcatcgtgccgcatgtgcgccactgcggagacctgcccgcgggactgaagctagtcgaccgaagagaatggtagaaacaagacaaaaatgaccatatttctttgatgaaaaattctgaatgcacatgcgttgtatcgagatccagccatagtgtgttgtacgaacatttctctgaatgcacaaacaaagagatggtgtatagaaaaccagccatacccttgggctggtggttactttctgctgctgataatgttttttttaaaggaacgtcggcctttattaattaagcaaccaaattacacaaaaaaaaaaaa

SEQ ID NO: 87024 - DNA, 626 bp, Triticum aestivum
  unsure (1)..(626): unsure at all n locations
  Clone ID: PAT_TA_87024
gatgcaatagctttgtatttacaattaacttacagcttgactgagggctggcccgtttgcgggcatggcacggtgaagacgcccttcggggcagggccccctggtgaagttttcttcccttgtctgggcacctccgtctccaagtctttggaggcggctctcttcttcccgcgatgggaggagaccttagattcccctccccgactatcctccttcggagaggtagcaattcccccggtttggatgtgcaatgtgtgaagttctgcttctctgttcttcccttcgtctttccccgagggcacttgacttagcacatgaccaagcatcttggctatggcgggactaggcgagccttcgggaagtggcgccggacacctgattctctccgccttgctgagccattcctaaccacgggagggttttcaagaataatgttatgacaaatataaatgaagtgttcggtttccngggttaactaacttgggtatctgggcggttgcantcaaggccgcaataatcggtgggtgtccgggacactttacttgtggtccgaagaataactaaanatcccttcaagcgtcatgccgaaaaaanngaaaaaaatccgcggaccttcggatgaactn

SEQ ID NO: 87025 - DNA, 458 bp, Triticum aestivum
  unsure (1)..(458): unsure at all n locations
  Clone ID: PAT_TA_87025
cggaaggtgctccgggacaacatccagggcatcaccaagccggcgatccgtcgtctggcgcggcggggcggcgtgaagcgcatctcggggctgatctacgaggagacccgcggcgtgctcaagatcttcctggagaacgtcatccgcgacgccgtcacctacaccgagcacgcccgccgcaagaccgtcaccgccatggacgtcgtctacgccctcaagcgccagggacgcaccctctacggattcggcggctaggccgcgctggtccaagccaaggaggatccgtcttgcaccaccggattaagtgctaagtactacgccgttgtctgggtggtggtgttcatgtcctcngtgtaatggctgcatctcgctgctgttcccgctgggacttgtttgttgtttggggtgttactgacngaatgggaaacgcaacattttaccccctgaaaaaaaaaaaa

SEQ ID NO: 87026 - DNA, 336 bp, Triticum aestivum
  unsure (1)..(336): unsure at all n locations
  Clone ID: PAT_TA_87026
tggcgctgtgctgatccttgcggcgcatgcagatgaactgacgacagactgcanggcgaagctgataagcagacagaaatatcatctgataagacatttgaacatgttctcttttcgttctaatcagtaattagttatcgtcgtaattactgagtgtcatccgtcatgtatgatcaattcctggcctctgttgattgccaacttgtatgatcgatccgtgtgttctgtaatgttatcaagtcttagggccacttgattaagtcgtcttgtaaatgtttgcttccgttcctcaaatgcattttctgagcaacaagaatatttgtgaaaaaaaaaaaa

SEQ ID NO: 87027 - DNA, 577 bp, Triticum aestivum
  unsure (1)..(577): unsure at all n locations
  Clone ID: PAT_TA_87027
gccgccgatgttacaacagcaaaggaactccttgagctagccaacaaggttggtccaagagatttgcatgctgaaaacccatgtggatatcttgtctgattttacaccagattttggtgccaagctccgttcgattgctgaagagcacaactttttgatccttgaagaccgcaaattcgctgacatggggaacacggtaactatgcaatatgaaggaggaatattccgcatatcagactgggccgatattgtcacagcgcatgtagtccctggacctggaatcatagatggcttgaagctgaagggtttgccaaagggaaaagggttacccttggttgctgagatgagcgcaccgagcaaccttgctcatggagattacaccacggcagccgtgaatttgccgagcaacattctgatttcgttatcggttcttgtcggtaaacctgcacctggcaactccaagcgccnacccancgtncgtccacgttgtcgataccgganttganttgtccccggggganatcncctggncagcanttnaaacccccanttgggcgtaaacaaccaaggngcaact

SEQ ID NO: 87028 - DNA, 431 bp, Triticum aestivum
  Clone ID: PAT_TA_87028
cgacgacgctggcggcgcgtacggggtgctggaggagctgttcgtggccaaccccagggccatcctgccgtgcttcgtcgtggtctaccgcgtcgacgtcgacgcccagtgagatgcatgcaccgcagcagctatatttccctgtgcacctacctacatacacatgtatgtatgtatattaatttgtacgtactacttgtctacttgtatcgatcaattgtgtcggcttgaagatatatagagtagtatgtgtgtgtcaacgtgtgtacccaagaacacaacagtaatattgtgtacaattgttgcttacatgcatggatgcacacctggtccgagtatgtacgtgcgtgcgtagactgattttgatgggattgatggcttccatgttactattaaacagatttgcataaatgcatgatcgggttccgtgc

SEQ ID NO: 87029 - DNA, 327 bp, Triticum aestivum
  unsure (1)..(327): unsure at all n locations
  Clone ID: PAT_TA_87029
ggactatctttgacactgtactatataacatgctagttgtatctgacataggcaggcatatgaaattcccacacacgggatttatccacaacgaaaattactatgagggtttttttcctccaaggaaacataagttgtggcctcgtaggcattgtttgttctgatttttacaagatcacgtcgacagggtagggatctcctcnacatttgtctatagaaaggccgcccanttatggggaaaataccaggccataanccatatanattgtggttgattgagggacagctgtncacnncctcaaatnatnaaaacatgttgccncctcc

SEQ ID NO: 87030 - DNA, 342 bp, Triticum aestivum
  Clone ID: PAT_TA_87030
caggatagaggcgtgaaaacatgatatacctgacaatgtaaatcaatcaggaacgtatgttgttcaataccggtgttgcaatttgttggtttgtagtgtgtattttgtaggatttgtagcgtgtcagcttgtgtgatccttttgttcttcttctaaagaaccaacacataagagctagtggcccttgtgactctgttttttttttttttttttttttttacatttctcatgaaatgtacatagggttttcagagtgtgagagagtggtgttgtattcaaatacagcttgcgcatgccgtgctgttataatatcaggtcatgttgttgatgaaaaaaaaaaaa

SEQ ID NO: 87031 - DNA, 567 bp, Triticum aestivum
  unsure (1)..(567): unsure at all n locations
  Clone ID: PAT_TA_87031
gaagaaacagaagaanaaggcgtttaccctcccaacttcttcttgagcaacttctcctttaccttcctcttcgttgcttcctctgccttcctctcgtctttcacaaacgctgctctccctcttttctcataccttattcttcctccacttcctgcctcttcgcaagagcctcctgcatctcccggacatgctctgggaccttcttcatgtcaaccttctctttaggcgcctctgcctccttttcctcctccttgacctgtcccattaggtgcaagactgatcaataaaacagtcttatatttgtaagacatatagaggtatattaatgctgggcaatgtgcaacacaatatttacctaanggccacgcttggattactgggttgcaacaatttccaagcataaagatgttcacctggtaaaattataangtgtggctgggaaaacaactacttggttggncgttcagattcaaaaaaaatggganctttttcanatcacggggggaaaatatcatcctttaannctcgttcctttccgccggatttanaaggnnccctttaaaaaat

SEQ ID NO: 87032 - DNA, 540 bp, Triticum aestivum
  unsure (1)..(540): unsure at all n locations
  Clone ID: PAT_TA_87032
catagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccagctgcggctgctcctgctgcagctgctagatcgatcatcgaccatatgcatgcaccgtgccgtgcgtgcatcatcgatcatatcgatctactactaccataccatgtnaccgcaacctgatcgaagggcctttatctaatgcacctgacctgcatcaacaatcaagtgccatgccatgattgttaacangcccccctaaataaaatttcccctgattaactatacatgtgtttgtgttaagtactggtaataatcatcacttcctttttctaaaaaaaaaaaa

SEQ ID NO: 87033 - DNA, 594 bp, Triticum aestivum
  unsure (1)..(594): unsure at all n locations
  Clone ID: PAT_TA_87033
gtcaccgtgagcaaatctgggcagaactctccccccgctccctcccggctttaaaacggcgtgatcatggcggcctctgccactgcaaccaaagccaccggccggagggaagagagaaaagagaaagctagccgcctttgggccatggcggagttcaagcacctttgcatggccaagttcaaggaaggcgtcgtggtggacgacatcatccaggagctcaccaagctcgccgcggagctcgacaccgtcaaatacttcgggtggggcaaggacgtgctgaaccaaggaggcgctcacgcagggcttcacccacgtcttcgtcatgaccttcgccagcgccgaggacctggccggcgtgcatgggccatgaanaagcactctgcgttcgcccgccaccttaatggccgcgctcnacaangtcgtcgtcatgggacttccccttggtcttcgtcaagccaacgccgcctgcctgatcgcctccantatctctaccaagcatggatgtgcaactatccatcnatctgcngcaactcnggtgttatgtnngaataccggaccncctctctcggcttantgtttaannggggaagngcc

SEQ ID NO: 87034 - DNA, 569 bp, Triticum aestivum
  unsure (1)..(569): unsure at all n locations
  Clone ID: PAT_TA_87034
ggttgtcgatcatgtcggctttgagaacaaagggacggcgttaaacctcccgggaattcctatcgcgattggactgtacggttactgctactcgggacatggggtgttcccaaacatatactcttctctgaagaatcgcaaccagtttccttccattcttttcacctgcattgggttctctaccattttgtttactgccgccgcggtgatgggatacaaaatgttcggcgaagccaccgagtctcagttcaccctcaacttaccaagagaatttgggttgtttccaagattgccgtctggggctacggtgggcaaatccaataaccaaatatgcattgaccataaccccactgggccatggatccggaagattgctgccgcgaaccagcagaatactccaacataattttgcttaatcaaccctggtgggtgtcaaccctcnacatgctccgtcattcccttctttgcgcttgtgatggtctgatgggtctttaatccgcatgcttgtgactaatcctccttgcgcctgcttcgggcatctcaaggcaaaagcgactgggtncagacgg

SEQ ID NO: 87035 - DNA, 416 bp, Triticum aestivum
  unsure (1)..(416): unsure at all n locations
  Clone ID: PAT_TA_87035
cggggacaagggcagggagatgaggaagagagcggccgagtggagggaggtggctgtccggtccatggcgagatcgttgactaatcttgattcgctcatccatggtgtgttgctctctggcaagaatagttagcttctcttttctttccagctcgatcgaccaatgatcgagcaaacatgatcgggacacgaaaattttagaattttttatttttcctaagtatttatttttaattttcctatgcattttccgggtttgcacgctcctaacagatggatgggatgggatgtatccgaaatgggattccctaatggtttccgtactgttgtagtgancccattttcttaacgaaaaccggggccgtgtgggccgtccaatcaaaagataaataaaatcagttttaaccaagaaaaaa

SEQ ID NO: 87036 - DNA, 470 bp, Triticum aestivum
  unsure (1)..(470): unsure at all n locations
  Clone ID: PAT_TA_87036
ggaacgcgaaaggggcggtcgccgtcgtggtctccatcctgatattcaagaacccggtgaccgtcatggggatgctgggctacggggtgaccatcgccggcgtggttctgtacggcgaggccancaagaggagcaagtgagctgcgccgccgtggggaacaggcctccagaagatatgctgactgtcacattgaccttccgccggagctcccatgtgttgatccaagttccggcagangtcctgatggtggcccgatgaagacgaccaacccatttgtntatttattcttgctccangtgcaatctgggctcctcaagtgtaggacttggngatgttaaattancacaanccgttagatcagatgcattcatgcntgtaaattggtgtgtaatgctgcactactactccctccgttcctaanntataagtcctttnngacattcaaatggaantacannatacngctctc

SEQ ID NO: 87037 - DNA, 578 bp, Triticum aestivum
  unsure (1)..(578): unsure at all n locations
  Clone ID: PAT_TA_87037
aatgaaggaaatcccagttttagtttgcgtcatcttaaccaattagcctctattcattgtactcggacacaaaataagttcaaagtaggctattcattgccatctgcacatattttcagttgtaatattttttgtatttgtgcagtgttggatgcttacatacattatgtacacttatgcagaagagaagggtcccatcactctaggctgggtgcagcctaatattattatgccacattatccggtctggaacatgtcgtacaagattaaacttccgaattttgcttcagtttcaaatttttccatatgtcccgaattccaaacaagaattttataggaattataataaaaactctatgatatcgcttcgggcactaaataacttttgggctcagctaaataacttttctcctaaaccccgcctttattggtgcaactgaatcaaggtgggacaagtggacaaaacaatggatttttggtggcgagagcaaataaccatgttgtgaacaaggccttcctacagttaactanaaatctgaacatgttgatcccaattggnaagaantgtgacaaattag

SEQ ID NO: 87038 - DNA, 422 bp, Triticum aestivum
  Clone ID: PAT_TA_87038
cgggatacaagggtgggcccacctcaattcaagggtatttagttgaatacccattatttttggcaaaaaactaagtatatatactgtatattctgtgttgtataatgaaaaacgttactcatactctagaacatgctagttaagcattttagcccaaaaacaatggctagcccatcatctattcccccctgcaccacgacatggccaatttattgacccaatcgctgccgcacgcacatagccatcatcttccagaaaaaagtccgatgcaacaggagacgaaccaagaagtgccatgttccgccagatctcttccgcatcatctctttgcatccgtacgtggacgccgaacccgctaggcggccaaggaccgggcggggctgttgccgtccgcctgattcggcgatcaattgcaagggtgt

SEQ ID NO: 87039 - DNA, 574 bp, Triticum aestivum
  unsure (1)..(574): unsure at all n locations
  Clone ID: PAT_TA_87039
gagagaactagtctcgacctatcttgtttttttaaatatgattagttcatcattcctaattcagcctattatgaatgaaacatgtttgcaatgacaattagatattatagttattcattccatgcttaattagctaggagtttataatgggttaccttgcatgcttttaaaatggttgtgatgtagaatgataggatggtatcctcctttgaatgattccgagtggcttgacttgggcacatgttcatgcatgtagttggaaacaaaatcaacatagcctccacgatatttatgttcatggtgattcatatcctaacatgcttgcattcaaatgttggttaatctccaatgcatgtttaatgactggttgtcgctctccaagttgggtcgcttcccancctttttccagccttcacttggtactaagcgggaatactgcttgtgcatccactccataaacccaaattgttccatatgatccaccataccttcccaaaagccgtatttacctgttgttccaaattaaattnncaantgccaaaactctaaacctcaaatgntaaccaatttgttg

SEQ ID NO: 87040 - DNA, 363 bp, Triticum aestivum
  unsure (1)..(363): unsure at all n locations
  Clone ID: PAT_TA_87040
aaganctnatcgggngnggacncccaacgtggcnctcctgaacggccncccgctcatgggtcgaggnacntccgncgcccncntcttcngcgaccannagcagnagcaacccnacggcnccnagtantgatcgcccgtcgacgcaccgccgnnccgcgggtcngtgccagtttcaccatcttgcttatgtngggatggagtttgttgacggggggaggaagaaacatgtcaaagtnacagcagggataccggaaatgaatgnatgaaaccggggaatatacaccagtcatatccactgtgtagtttcgtacgcgtcatgtnncangggtgaagtagttaggcttcggtttgctcgcattcttc

SEQ ID NO: 87041 - DNA, 249 bp, Triticum aestivum
  Clone ID: PAT_TA_87041
cggtcgagttgggatccccaacaacgagcgcatcattgtcttcttcctctgcccgtcggtgatctccttcgatccgttgccgttcgtccaccccagcgtccatgagccatccgcaggacctcacggtgagcaccatagcaaaaaccccatgtttcctattcaaattccaccccgtagctgccatccccacctgtagccgaccctgttgttcaccatggacgctagctcggccgtgtcgagctcggcgag

SEQ ID NO: 87042 - DNA, 520 bp, Triticum aestivum
  unsure (1)..(520): unsure at all n locations
  Clone ID: PAT_TA_87042
tacacatgcacacacgcaacactcgcacgccttcatgcacagagcacacgacgcaagacacatgctcaacctatacttgcatgcaccctttgttaaggacatggattgttatgggtattaatcattcttatctatgataagtagaacattgattttttccagcagtctttatggatcacaacgtattgattttttccagcagtctctatcaacgtatatatgaaaaatttaaaattctcttacattcgatgaataatcatcggtttgtgaaatgcccgcttcgcacaaccctggcncaccaaaagctcctctgctatgcgctgcctgcgttgggtcactgacatgctgggccaggtacccaacgagcccacacgtcaagtgggaagaacgacgtggtgtccgtacgtcagagtccganggcgccgcttgctgcacgcccggctgaacatgcctccttgccgcattcaaacgcctccaatgaaaccaagtgggaacccgagaaaccactcgggacacacgt

SEQ ID NO: 87043 - DNA, 424 bp, Triticum aestivum
  unsure (1)..(424): unsure at all n locations
  Clone ID: PAT_TA_87043
aattaattattttaagacaggaaagaaagagtaaatttccattagcaaaaacatgttggtgggccatttcttgagaatgtcgaatgtgcaagaatttattaagtggtggcatactcatgttctaacgatcaaccactgtgaattcattatgctatagtatatgattaagatatttgcattagagtacgaaatatagaagaatgcttacttagctttttattttgatcatctactcttgaaacagggcaaacttaaagggataaaaaacagatagtacgccacctagttttccaatgccaaatcaaacagacgaacccatcctgggctccctagagcgagtggatgccgagaaaatattggaacccatcactttatccaaaagtgtttgtgattgcnatggtttttaantgttaaaaaaaaaaaa

SEQ ID NO: 87044 - DNA, 513 bp, Triticum aestivum
  unsure (1)..(513): unsure at all n locations
  Clone ID: PAT_TA_87044
ccacgacctcctcggcaccgacaaccgttcgtgtgggtcgttggggccaacggcggggcgcagctccagcaccgcctctggacacggcgaccgtggtgagcgacacgctcatatcatcgctagacactgtcggtttcagtttgccgagggtggcgttagtgctatggcacgaccaacggtatgtttggtttgtgcgcaaggttgccccatcaaagcattgggtagccaaaattttggttgaggtattggttgctcatgatttggccgacattggcaagaaaaatgaacttgagttgtctagagttcattggcatgccaaagaaatggcaaccatccaaacaaagaccaatctttggggtcatgaccaaaatttggtttaggtattggttgcccatgatttggcccgacaatgggcaagaaaaatgaactagagttggatagagttcattgggcatgccaaaaaaatggcaaccatccaaacaaagacatcntttgggtcatgacgaaaatttg

SEQ ID NO: 87045 - DNA, 395 bp, Triticum aestivum
  Clone ID: PAT_TA_87045
gcttgatcaacttgcccatgttatcaatctacagtgggttcagtttaccgaagaagtcgcggtgcttcaagaatttggcagcaggtcacgtggaatctcacctctctatagagacccgcgtctaaatgtacaagtggttcctggagttttgcagagcatattactttcagtagctgcatgaattagccagaaaaacaaactgttgtgggtttgttatttcggacaagaatggcaggaactgaatgcaatttcaaatagagcgccctagtttgcttttagcgttttcgtcttcaagtaggattagagtgtattttgtttaggattttgatgacctgcgaacgtttgctggcacgacatatggcaaatccgaacgtttccataacaaaaaaaaaaaa

SEQ ID NO: 87046 - DNA, 474 bp, Triticum aestivum
  unsure (1)..(474): unsure at all n locations
  Clone ID: PAT_TA_87046
ttgttgttggcaccaaaacatggcccgttacgaaaatgacgaatgcaatctggaaacagtccatttcttgaaactttagaattttgcatatcactaccattttttcatttgaatatagaatatacatttggtgattccccgtagattctttggacagtataatatagtatacacatggtgacttggtagcttaggcagactgtacttgatgaccccaaataatccaaaaagagcaacgagaatgtaaaatttatgcacttacatcgactgaaatttggcagtccctaaattttgacttgaatgcatttgggaaggggaatatttgttttctaccatggacgggaccaaaataaggcagtaacaaaagtaaataagtgctctgaaaattggttttgctccgtatgtaacttctgtttggtcaactagatcatccagtggtatctttaagtcccagtcccaagtccncgggtccta

SEQ ID NO: 87047 - DNA, 463 bp, Triticum aestivum
  Clone ID: PAT_TA_87047
cgaggacaccgtcgcgcaggctttctttgacctggagaacggcaaccaggagctcaagagcgacctcaaggacctgtacatcaacactgcaatccagatggatgttgttgggaacaggaaggccgtggtgatccatgtgccataccgtctgcgcaagcccttcaggaagatccatgtcaggctcgtcagggagctcgagaagaagtttagcggcaaggatgttgtctttgttgcaacaagaaggatcgtgaggccacccaagaagggttctgctgttcagcgccctcgcaccaggaccctgacagctgttcatgatggtatcttggaggatgttgtgtacccagctgagattgtggggaaagcgtgtcaggtaccgtttgggatggtgccaaggtcatcaagatctacttgggacccgaaaggagcgcaacaacactgaagtacaagctggagaccttctcct

SEQ ID NO: 87048 - DNA, 378 bp, Triticum aestivum
  unsure (1)..(378): unsure at all n locations
  Clone ID: PAT_TA_87048
aaatatcaatattgattttgattaagcactagagtgagcaatgatactattgtacgtactacatactgtacaaggccagccaattaattcctgcaccggaatacatggaacccaagagaaagaaagaaaaaaaacatatgcatgcacaaggacgtgtacaaagtccatacaggaagaattttttgctcgaccggccgtcagactctgagcaggtagatgctgagctcgggccctccgctgccgtccggggttcatcatgtagaacgcctccgagtccctccgatccgacgacccgctcgaacttggcgcgcatgtacatcagatcgccctcgccggcgccgcctgcggcaccttcgtccgggnagcaccccggcgccg

SEQ ID NO: 87049 - DNA, 164 bp, Triticum aestivum
  Clone ID: PAT_TA_87049
gttccgggacaaccgggagaactacatgcagacggaggcgtgcacctacaacaccgcgcccatggtggggatgttcgccaagctcaaccggatggcgagggaggagagggagcagagagctgccacggcggccgagatgtaaatggattagataggttataggt

SEQ ID NO: 87050 - DNA, 479 bp, Triticum aestivum
  unsure (1)..(479): unsure at all n locations
  Clone ID: PAT_TA_87050
gcgagacgaaggcgatggtggagcttcagatccgcgacgtggggccggcgacggtggagcttcagatccgcggcggcgggcgtccagcggccggcggcgcgaggagggctcgacgggcgcgtccagcagccggcggcgcgtccaggtgaggaggggaaagaaaggattaggtctcccgcgggatgaggcatcatatttatactcccccagttttttgagtcgttcgactcgaacatgtcgactagtctggactagtcgtcgactaagtcgatgactggctcgactcgtacaagtagtctacacgagaaaccgagtcgacagccagtttgcgactcatagactagtcgagcgactagtctaagactagtcgttcgactcgtaatcgttggtgttatgcacttcttgcanggcctatgccatagttcttgaaacanaacaataagtcctgcatgtttgcttcatgaccttancattgtgtt

SEQ ID NO: 87051 - DNA, 379 bp, Triticum aestivum
  Clone ID: PAT_TA_87051
cttcggtcccccgtctgtgttcggcagcccgccatcgacgtttggcccgcctgggagcttaaacgggagcgggagcttcgggccgagcagcaccctcgagccttacggcgtcgggtgccgccatgtcacctccttggctgtctccacccttctctccgccattgttctcgcccttctttgcgcgtcacccgatctaatgtaaattttccgagtgtgaatttggattagctatacagagctaacactgtcgttagctattactattacatcgtatgttcttggtcttgtagatgtcagattcaatgtttaggaatccgtatccgtatgtatatatatatatatgatttgcagagtatttgggcattgcaaaaaaaaaaaa

SEQ ID NO: 87052 - DNA, 489 bp, Triticum aestivum
  Clone ID: PAT_TA_87052
agttctctataacaaagataatgcaaaaagaatcaaatcatttcgacttgtggtttagaaatggtggctggtcaaagtttagtcaaatttctgaataaatttgaattaaacagaaaatcctggggggagggtgatgtcgaaggcgtataacagaaatacgcctccactcgtaccacttcgggcgcgagtggtgagatcgacaggtgggtcccacgcgttaggagagagagggaacgagtcagaagggaggcggggtttcaccgggagctcacgccggcgacgaggggtttggggctaaacgagaggggtagatttgaagcggggctccgaggtgcactttccccgttaccccgtggcttggcgagaggtggccggggctgggtcccagcccgaacttgcaacttcggtggcggacgggattccccgaagacgtaggagacgacggctagaggcggctcccaaaggctttgcgggtccaaagcaacacca

SEQ ID NO: 87053 - DNA, 478 bp, Triticum aestivum
  unsure (1)..(478): unsure at all n locations
  Clone ID: PAT_TA_87053
aagctccgtgggtactgttcatcttcaacaagacaatatttcaggcagaaaaagaagtggacaaagttggtatgctgggctatccgacgagcggcaggctgagtagataaacaaacagaagatggcccgactcgcacggaaagctgcctctgctggggtgaatgtccaagtgcctacatcatctgccccacaagcttgatctgctcatacctctggtcgggctaactatggtggtcgtgaacatcaattgcaggaaatagtaggacaatgcatcaaacagaatggtgcatgcaactccaaccgacagcgggtcaaatttggaggtagacggttcaagatgattggttgcacagtaatccaacttacatacggcgagcgatgttggcgaaacatgtccgaaagatactctgttcctataagttttatctcccgggacgctccaattgaacattangtataacatacatatactttacat

SEQ ID NO: 87054 - DNA, 475 bp, Triticum aestivum
  unsure (1)..(475): unsure at all n locations
  Clone ID: PAT_TA_87054
agcacctcagcctacaatcatggatcctgctcggctcctcacctctaagtttacattcacttgttttcagcccagcaattatgaaaaaatggttgaaatatatantactccctctgtaaacttttacaagacgttttaggtcacttcatgatccttttttccttgctaccacttaccagtggtgctgcatataatcctaggtttgtgatatacttagagctcctttgattcaaagttttttcanaggagttttggaggattagaatccttangattttttcctgtggttgngttgtttgattcataggattaaatcanatagtttttttttcctaaggacttctttggactacttcccatagtatttaanatnatccantcaaaacctcttaggnaaagaatcctttggttttcccggngatgcaatcnaacagcccaaaatcttcgcaatttttgagacgggcaangacattcn

SEQ ID NO: 87055 - DNA, 464 bp, Triticum aestivum
  Clone ID: PAT_TA_87055
ggaacgtatgccctgttgcagccttgcagcttaacattcgacacttccttcaaaggggtccttcagcctccaaggagaagggaagtgatgtctgacagggaaagaaactaggcgaagctctggatgctcgatcggacatttgatgtgtggtagtacgtgtgtgatgaagcatggtgtagtagcaaactagcaactgtttctgacatacatggatttctttctgcctctatttgatgctcggtggtgctgatccgaagtgttggaggtgttagtgcaagattgtagagttggaaagtatagtaaaacgtcagttgggtgcagggacttggtgaagccatcagcctccgactgtgtctgcttcccccgatgggtttggactccggactaagtgatcctgatgcatattacttgatgatttggccttgtggcaacttcaatttggaactggcatcaatggctcatcc

SEQ ID NO: 87056 - DNA, 464 bp, Triticum aestivum
  Clone ID: PAT_TA_87056
acgcacctgaaacccgcgtcgtcgtcgtcgcctgcgccccagcaggtactcttccactccagtttcaaggtcccaaagctgaaggcccccgcccctcctccccctcctccctcgtagtagtctgatctaacggtctcctgacatgtgcagctgctgttagacctccatgatggctgtgtttaggtgtgtggagttagcgatcaggtttatgctttatcttgcgccgcgtgctcactggaagcggcgattgtgttttgtaaccaacatcctcgcccttattttggaggcccttttgtaaaatattctcgggcgccgcgcgaaagggggagctcactgaccggtgtatgtatgtatgtgtgtgtgtgttaaccatgtggtgggtgccctggggccggaattcgcgaagtgtttgagatgtgacgcaaactcccctgagttattgtgtgtgtttctgccgttggtgt

SEQ ID NO: 87057 - DNA, 214 bp, Triticum aestivum; identical to SEQ ID NO: 86984
  Clone ID: PAT_TA_87057

SEQ ID NO: 87058 - DNA, 304 bp, Triticum aestivum
  Clone ID: PAT_TA_87058
ggctttcgccccgctttataaataaagcaaaccgccaaagagcacacatacaaagtcaagtccacacacacacacccaggtcccacaacaaagtacagaagttctgctgagggcacagctcaacaagcccaaagaaaaataaaggaacagaacacgccggacgaagaaaacgcctagtctggtttcggcggcggcggcgggggcggcggcgataggcggacgaccatcaagcgaagatcggcgatgaaggctgagatggcgtcgcggtcccgagggcggctaagcggccaccaaagctgcaaga

SEQ ID NO: 87059 - DNA, 478 bp, Triticum aestivum
  unsure (1)..(478): unsure at all n locations
  Clone ID: PAT_TA_87059
caagggcaacggcaccggcggcgagtccatctacggcgagaagttcgccgacgagaagttcgtccacaagcacaccaagcccgggatcctctccatggccaacgcgggccccaacaccaacggctcccagttcttcagtctgcaccgtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgcnggtcgcctgtcgtcgtcgccccgtgtcccgtgtcgtcgatcnaaatnanagaatcgtgnggtcgtgtcgtgtcttccccttntcngtccgatgagatctccgttggttgggttnatggccggnttttaagtgggntnctttttgggacggtggatcngtgtccnngcngg

SEQ ID NO: 87060 - DNA, 295 bp, Triticum aestivum
  unsure (1)..(295): unsure at all n locations
  Clone ID: PAT_TA_87060
gcaagacggagaacgagngagaaggccagngcggcgttcctggtgaggtgcaacgncaactccgaggccaccctcggcacctanaagggcnacgccaccctcnctgagggcgcctccgaaagcctccacngtcaaggacnacanctactgattgatctgccttcggtgctgtgnncccgtttgggcgtcccgcttancagttatcattgntcantgtttggtttcctgantcctgatanatcctcggcctatcnaacatngttttttaataantatngaaactnngttttcacaa

SEQ ID NO: 87061 - DNA, 574 bp, Triticum aestivum
  unsure (1)..(574): unsure at all n locations
  Clone ID: PAT_TA_87061
gatgaaaaagaaacacacggaagctaaagaactancagttcgggctattgttaacaacaatatgctgttgatgctaaaccacccaatgtttgaggagaaactttctgctcttcagaaatacgccgacagcatgagatccaagcacttacttgaggaaattgtcacaatggatacttattgatgcgggagtactgtgggaaagaagatgattcaccctgnaggaacacgggtaatgtaaatgcaacaaaaggacatatataggattcangcatgtacttaataccgagacgaagttcaaacactactgaatagctaatgtagtcacattanttgctcctgtagaggtactttgcttgcatgttatagctagcagttgtttggagagtgctggaatcagtagttgggtcgattccactangacaagacctggagtactcaaatgggatgacantccaaaganggcatgtgctacgaagtttagttcaagtgactaagtcaaaccccgggtgccatctgtggttaaaatcctggtatcaaatgcaaccngaaaagaaatctaagtttcacattgggt

SEQ ID NO: 87062 - DNA, 584 bp, Triticum aestivum
  unsure (1)..(584): unsure at all n locations
  Clone ID: PAT_TA_87062
gccaaactaaatgataactagtgaccagggcaattatttgaaacatggctgattaggcactgccagcttattagatgagtattaactaaacaatgagcattgacattcagcaaaaaataatgataaatcattggcactaaagaattaacacaatacaatctcaatgagcagcaaacggttaacaatgaccacttcacagtcagccaccttattaaactaatggactatctaaacaactaaacaccggcagtcaagcacttagcttataaacaattaacaaagtataaatctcaattagttaataaccacatgattgcaaacatgcaacacatggagcattacaatacatatatataccaaactaaataaactaagaccacacttagcaaaatttcctaagcaaacttaangaaatataaatgagctccgaattagcacaccttttcagcacatcctgaaggaacctcccggccggtgagaatcccttccaaatgcaatgttatctctccgncgggcttgccctgggtcacaatanggacacccngatatnggtcaatgccggtgaaatccacatcatgcatggg

SEQ ID NO: 87063 - DNA, 235 bp, Triticum aestivum
  unsure (1)..(235): unsure at all n locations
  Clone ID: PAT_TA_87063
cnnaancatcccccannccctcangaacntgntccaacngtggncgggctacgcgcacgnncatatcaaanttaccttganccccagggagntcatcagtcaantcctnaagcacgngaccncactcatgcatgatcanggcgtgggcgcaactatgaaattanaagtctcaggcacactaggctccgtctcttccacgcacgaaganagatcncatacacagttcacatctctg

SEQ ID NO: 87064 - DNA, 472 bp, Triticum aestivum
  unsure (1)..(472): unsure at all n locations
  Clone ID: PAT_TA_87064
atttgctcctaggtttgtctccagtacccgactactgggtctgttttgtcttggttgcagatatctgattcaagcaggactcaagtggagaaaggaaggagtttgtgctagcacacaccatgccgctctcctcttgcgccacactcatcatgttactcatctgtatccaggtgtagcaacagcatgcttttctcctggtgactgatccataatcttctattatatatctttgttctagctttgtgcgagatcttaaaagtagcaacgggctgaccatcgaagcaaaatgggttctcaaggtgataaatattgatccatattattgacgggtttttcctcattgggagacaggctttggaaggtacagacttgtaatcaactttacatcaatgaatgaagaacaaggagctggtgggttcacaaccatgtgtgcccaacaantgcgtccccggggagaacctccatcctanaa

SEQ ID NO: 87065 - DNA, 538 bp, Triticum aestivum
  unsure (1)..(538): unsure at all n locations
  Clone ID: PAT_TA_87065
gctttgtctctcgtgagtctcatcacacaatctcacacaaggccgccgtggcctctctctctcagcaatggtcagtgatccagccgcatcccgtccgccggcggaaagggaggatgtgcatcgtctctctgttcaacggtgtttaggcagctcgtcccgatctgcggtacccatcgttctctctgaccaagctctggcgtggtatggccttcgccactttctcgctgccgcagtatgggcagatcccggccgccggcgccctcctaggtaacatcccgacgaccctcangtacagcttcctccggccttactccactgcccatcttcccacgttngctgcatctggatcttctttacttgtttacttaaatcgtatctcgggctancgntacnttccatcttgcaantcctangtcctcnaaccatttttgataanaccanccatggtggctatcctttcccatttnttnnatgggaacaangcctcccttttttggtngggcgtaatgntgtccttcaaactcgtggttactnggtg

SEQ ID NO: 87066 - DNA, 514 bp, Triticum aestivum
  unsure (1)..(514): unsure at all n locations
  Clone ID: PAT_TA_87066
cccacaccacgctgggccgcgacgccatcctggcggccgagcgcgagctggggatcgaagtcgattttttgaagtacgcgaaagaaatcgcctacagccaccatgaaaaatgggacggcaccggctatccgcaggggctggccggcgaacagatcccggtctcggcgcgcctgatggcgctggccgacgtgtacgacgcgctgatcagctgccgtatctacaaggacggcatgcgccacgaagacgcggtgcgtatcatcgccgaagggcgcggcacgcatttcgacgccgatatcgtcgacgcctttttgcgcatccaggaccagttccaggacatctccagccggctatgccgatggcgtgcgcgagctcgccggacaaacagcggcaatcgcncgctttaccgcctgattgaaaaaanaaaanaaaaaaatccnagggggggcccgggtacccaaattcgccctaatatgantcgttattnacnccgcgctcaactgggccgttggttttn

SEQ ID NO: 87067 - DNA, 216 bp, Triticum aestivum
  unsure (1)..(216): unsure at all n locations
  Clone ID: PAT_TA_87067
gaggccnaaanccctatcgtaagcccccggtcaccgccccgcctcgccgcgggcanccgantngtcgnccgccgtcgtccattggncantggcangcgactgaacgagcccggttnaggctcttcntcttcgacctcgccggncaagcaccgccagagtccacctacnnngatgaacccgctcgnacgccgagcaacctgacgcgtanggggcggc

SEQ ID NO: 87068 - DNA, 377 bp, Triticum aestivum
  unsure (1)..(377): unsure at all n locations
  Clone ID: PAT_TA_87068
agtccattccccgtcgccctcacgctcttcgtgctcgccgcctcccttcgcgtgctgcctcatggcttccatcgccggatctgccgtgtccttcgccaagcccgtcaaggcaatcaacacgaactcactctctttctctggtgcaaggaggggcaatgcatttcttcgcttgcagccatgtgccgatgagatttgcngtttgctgctcagcanagcaggattacagtgagnanaaggtttgtgaaattgntaaggaagcagcttgctgttcctgaatgcactgangtttgcgngtaccaccaagttttctgaccttgggaggcnganttcacnnggtncacggncgagatngcgatggggcttgaggaggagttcca

SEQ ID NO: 87069 - DNA, 340 bp, Triticum aestivum
  unsure (1)..(340): unsure at all n locations
  Clone ID: PAT_TA_87069
gtgggatcggttgctgccctcctcttgctatctcgccattcgncntgccgtttacncananccagacgcagatgcgcacggnacaangctgccatggnngaagacgcngggccgctgntgggaggcatcagtnactcgccnatggggcaanaanacgacctcnacgtcatcgcgctcgcccgcttcgtccgtcnccgangcacaacaacaaggccaatgccctgctggaggttcctnaatgtggtgaaggnnaagaatcanactggttgctggnacnatgcactagattacantccggggtcatcttaanngtgtgggccaacaancccctacttaacgc

SEQ ID NO: 87070 - DNA, 524 bp, Triticum aestivum
  unsure (1)..(524): unsure at all n locations
  Clone ID: PAT_TA_87070
ccagactgcagggtgctgctgatgctgctggcggacgggctgcgcggtcacctggccgacctcgcggagctgacccggacggccggtcagctgtacgccgagctccacgagtgacgacgacgacctcgggcccgcacgcgagtcgccggccggcggggcctctcgtgctctccgcgcggaagattcagcggagaaaagtatgcgcgggaggcgctgctgttctttgactgtttcaggccagggcgcacacggatctgcacgcatgcctgctggaaatgaaattgttctcaactcttttagtagcagttttgtcngtcgacagcgacganggcttaaaggataagatccaactgtacagggtgattcntgtctctccgtctcccactgtttcgaattaccngtccgcaagaaatgggcccgggctgtaaantaataacgcaagttngatctttgggacaagggaacacattttgtgctttttccaaagtccnccaacangtgcntgcntggtaaaanaaaatgag

SEQ ID NO: 87071 - DNA, 277 bp, Triticum aestivum
  unsure (1)..(277): unsure at all n locations
  Clone ID: PAT_TA_87071
cgaacgtaagatgtcgcgggttgttttatggagtctgctgctcggtaaaggccttgtcgaagaggttgctctgggagatctcttgggcaggaatgttccacttctggctgagctcanagatgcactcggcgttgtacgaggcagtatcaactggatgacgagtgaaagttgtccagtaggtctgctcttcagaggcagtgtaggagctgccgactgtcatccagccgctgagagtgtcctcatcagttgcgcggaaaacaaagggggggcccggtac

SEQ ID NO: 87072 - DNA, 520 bp, Triticum aestivum
  unsure (1)..(520): unsure at all n locations
  Clone ID: PAT_TA_87072
ctggaccctccctcataaactcaccttgaggacatctattttatttcctgaaacacaaactaggtgtgccggttttgtatgtgaactatcatcagtttgtgaaaaacacatatgacagtactatgtgtgtgtgtgtgcaaaataaaaccgagtgtttttattgtataatagttttgcaccaaaaggttattctgaagcgggtggctagtgttgcagtagttcagaatgttgaacccacattgatgcagccgctcatgagtagaggcaggcgcacccatgagcattcttccaatgtggtgttcgccgccggcgccacagtccgttcacgcccgatanccgaggccgttcaatgacacaacgacaaggtctggccttccccgttcctccttttcangttgtggcattaancngaactcgtgtaatgactgaatcctgntactgctggttgggttngcattgggtgaatgctttttacaaagtgttgggaaacaaaagntaatgtccctaacnttggcntgtt

SEQ ID NO: 87073 - DNA, 498 bp, Triticum aestivum
  Clone ID: PAT_TA_87073
cacctgtgtgacatgaagcggaggcatcactatggccacgtacagagtgttgggactgcaacaattcccacggtccaaagcgtagaggatgtgcttgtgagctgtgatgttctgaacttgtgatatatctgcggcggtgagaagcagacccgttcatgttcctccatctcccaagctaagttttctgttgtttttgatgttattcctaaaagaaaatcgtttatacatggccaatgtgaatgtgcagtatggtgtatgtgcaaaagaacagtcacgtgtgctggttaattagctgagcatgcagggcctgtttgagctttatgtggagaactagttgggatactacggtttttgggaaaatcaagttgttctttctttacatgatttacaaactcgcattgcattctcccgttgctttactcttccatctcaatatatataatgattgagttatcctaaaaaagacttctgttccctggctatctacagagatacatt

SEQ ID NO: 87074 - DNA, 267 bp, Triticum aestivum
  unsure (1)..(267): unsure at all n locations
  Clone ID: PAT_TA_87074
ggngttcaanggattactgnccatcagntaaganaggtgngtcatcaagntccncaancccgtgaggaacaataagataacnganggaantaancgacacatcataacttagntggnggacctaacattataaagctactcgnngtngtcaganatgaagattcaaagacacccagtctgatcnttgaatatntcatncaatactgacttcanagtgctctaccccacactgctcggattacganatcattatactanatatttgaa

SEQ ID NO: 87075 - DNA, 497 bp, Triticum aestivum
  unsure (1)..(497): unsure at all n locations
  Clone ID: PAT_TA_87075
gcaaggtcaacttatcgatggttgtgtgctgggggtgtcacctccccttttgctgcctgtatttggaagagttgggcgaccctaaagtgcaagatctttgcttggctggcggtccaacatcgcttgtggacatctgataggagagcaagacatgggctccaagatcatccgtcaccttgttacacatgcttgcaatgcgaggaaaatgttgagcacattctaatccagtgcatgtatgctagggaggtgtgggaaggatgtctctctgcacttcacttgaacatccctcggccaagcacacaagacaactacctccaatggtggttatcaagcaggaagcactaccagaaggcacagaaaagaggattcgacactggcaattgtgggtggcatggaacttatggaagcagcgcaatgcctanggtcctcaatccgggaaatcaagtgctgccnagaaggaccttatcacaaaatcngcaaagagattgnngagtggn

SEQ ID NO: 87076 - DNA, 513 bp, Triticum aestivum
  unsure (1)..(513): unsure at all n locations
  Clone ID: PAT_TA_87076
ggaaagcgaccatggctagcagcagccgcatcccagccatgagccatcaccttgggcgagatctgtgttgcccagcgtgcggactggctagcggcggtgctggccattggcacggcaaacccgccccactgcgtgccgcagggcatcggcatgcgtttcttccacacaccgatgaactgctcgccacgcacccggacttgtccctcgacgccacctcggctgcggtgaatgcaatcgccgagtggggctgtacggcgggcgacatcacccatctcgtcgtcatcaccaacgcgggatngcatgccctgggcaccgacgtccgcttggtcttgccctcctngtcttgccctccgcctcggcgtcctgcgcaactgatggtttatttttgnactaggtacntnatggtttatttttgaactgtaagtacctgatggtttaanngtggtngttatttcnntgaatttgctcctgtaatgcccagtgggatttacactgtatgcctaattggttttt

SEQ ID NO: 87077 - DNA, 322 bp, Triticum aestivum
  unsure (1)..(322): unsure at all n locations
  Clone ID: PAT_TA_87077
caaccacttgctttcggattctgcatctagcatnatgactgntatgttgnggctcatcagncgggttcangttcaacccggtgggcagcnatngcaccgtagtcattcaccggtgacacanngtcaatggcacgagncagcgagggcaaatgnacgngncttanggccaanttgcaccagtctaacaggtaantangnattatgatcantacggtttgtatcgtggctagntttcagctcacacgnagcatgcgtttttttttggggaggtaacgctntgagcnngctnatatcagnaagagaagtaagntntatangtcgc

SEQ ID NO: 87078 - DNA, 501 bp, Triticum aestivum
  unsure (1)..(501): unsure at all n locations
  Clone ID: PAT_TA_87078
gaagagagagaactagtgaaaaccaacacactatcaaccaataactttcataaccacactaaattaatctaaacaaattgttagcagaaaataaaatctatttccattaaaataacagaaataaattatctaaaataatttctagcaacaataactacaatactagctattacatacactatatactagctatgctaaactgaaatcctaaacagtggcaaaactaataaaaataatttctaaaattatgtactgaagtctaacatatgtatatttcaatcaacaaaactttgcgaaaagaattaattaaatcttaacaaaacttactaagttacaatcaaaacaanactacatangaaaatagtactattttttttgctaaaaccctaatttaaataaattangaaaatangtccagtanaatctactggataggcaaaagtcctagttacnagggncangaaagaacanctgaaaatatactttcaaactcaagttagg

SEQ ID NO: 87079 - DNA, 496 bp, Triticum aestivum
  unsure (1)..(496): unsure at all n locations
  Clone ID: PAT_TA_87079
gtttgttgatgctcaatccttggcttctctctgtatttataacggagcaatggcatgatgggtagagcagtcgacagcaggaatctcatccaactaacctccatacgtgttaaggtgatctgttgaaagaaacatggccacccaaagcccaatcagacaaagctgttgcctacgtgtttttggttagcgcagcaagtgtgaatcggtgagcttatgtgcctggcatgtctaggtcattggtgacacagcgcactgcacgagtgttcaagtttgatctcggatctgggatacgggttatatgtgatcacggaagattagccaaggaaatgcaatgcgggtttccgtgttgctgcaatgattagtttagtcttgttctccgctggttctccaaacgttaaggtgagttgcactgcttgcacaagcagcgctggtgtgtttcaagctatcccacaacaaaaaggacagccatggtaagtgggatgcacattcctcgacn

SEQ ID NO: 87080 - DNA, 504 bp, Triticum aestivum
  unsure (1)..(504): unsure at all n locations
  Clone ID: PAT_TA_87080
ccgaggtacaggtgaagggagacgctgggtgtcaggtcgagcaactaagggttggggtggctgtgtgaagaagagagaggtaggaaaggaagtgttgggctaactgatgctaccgggatgaatcagggagattagaggagagaagttgagagagatttcggcgatgttcaggagaagaggatttctctagctatgccaacccaagatgtgtgatgctcaagaaggtatgtgatgctaacgcatatacaaagaacgaggtgtcttgttaatttggtggacagtgcccttcttaaaataaatatgtggtgccgttagacaactggaagaatatcacttatagttccgttaggtttgttacctccgttgttccggacacttaaatgtttcacctgaggattttttaatccatccgggcatcagcttatacctggatgtaccttcaagttccacaaatctattaatttatcataggacaagcagacatggnagtatatagttcctgaa

SEQ ID NO: 87081 - DNA, 463 bp, Triticum aestivum
  unsure (1)..(463): unsure at all n locations
  Clone ID: PAT_TA_87081
ggtagatatcaagagaatctaggcctagagcactggaagatggtaaagaaaagcattgcgttatgcgcaaggcacgaaggactacatgctaatatacaggagaagtgattccctagagataaaaatgtattcagacgcagattttgcgggggacatattcaccctcgctgggggagctatttcgtggaaaaactccaaacagtcgatagttgcatcatccacgatgtatgcagaattcatagcatgcttcgaagccacggggcaggcgatatggctaaagaaatttgtacccgacttgaaagtggtagattgcattcacaaaccactaaagatgtactgtggataaccagcccgcaagtattcctatgctcacaacaacaatcaagtaatgctgccaaaacaatagagataaggtattatgttgtgaaagatgaaatccaaggatcaaactataatctcnaan

SEQ ID NO: 87082 - DNA, 221 bp, Triticum aestivum
  unsure (1)..(221): unsure at all n locations
  Clone ID: PAT_TA_87082
ggaagcatcgccggagcangccgccgtacgccnagaggaccaacgccccccttgccggagacgcgccgcancatgtccctgccncgcgggaagctcncgcccgtgtganccttcttcctggcttggctggtttgtttagccattctttgattgttgtgacggtgtcgtgcccgtccggtctgcangttggcttcnacggntgggtagaagcatgtggatcc

SEQ ID NO: 87083 - DNA, 484 bp, Triticum aestivum
  unsure (1)..(484): unsure at all n locations
  Clone ID: PAT_TA_87083
gctccgatggagtccgtctgcggtttttggcccgggtgtgactaggcttgtcacgtccaaatgtatagccgtcacatgtcggggcacgtcctcgcgatccgtagatcgatctggtatgtcctgctctattgtccaggtcctgccgaaggtcgtaggtgtgtccccgagctgttttatctctgcctttacggtgaggtggggcgggctggtgttcggcttgagtcgccgctttgtcccgaccacgtggtggtcggtcagccggactgcgcgatgatggaatgggctccagcgcctcatcattgaactgaggtagcaatttacgcttcgggtaacttttgactgggcgcttgaggctgtattcctcggctgccaaggacatcagtccatctgtcattgagcagatcttgatcagcttgaagctgctgctgcttctttttcaaggctccttgcagtgggctaatagtcgacgcntgaagcgctcctg

SEQ ID NO: 87084 - DNA, 586 bp, Triticum aestivum
  unsure (1)..(586): unsure at all n locations
  Clone ID: PAT_TA_87084
ctcgttttcagattttgattcagatcaatcaagtatagaaagtgtaaagtcgatgggggcggttaaacgggagcattaccagcaatcggtgccgccagagaagcacgtcgtccgggccgggacagcgcgcccgcccagcagctcagacgcgtgcggccgaggcgctgttggattgcttagatccgtcccggcgcattgctcgcgccggcagctagctccgtcgtcgtcgccggcatctggattttggggagaaggagcaaacctcgatcgggtgaaacgaacaggcaagagagcagggcgaggaggaagtacaccacgcaggatgatgggctggctgagatgatgacgtggtcttcaagggcgaaatcagcccaagctaaaataaacaagatggcaacacttaccggccagttcgacctttccggcgctgcttaagtaagcttcctccaaacatcaagttaactctctgggcgcggcgctactgggcctaccaagtcctgtaccgccgagagatttttgttttggtttcctaatactggntttccttgttgcattagtttcactaactttaatcacgtcttttgtt

SEQ ID NO: 87085 - DNA, 504 bp, Triticum aestivum
  unsure (1)..(504): unsure at all n locations
  Clone ID: PAT_TA_87085
gctacatggcgcccgagtgggtgatccaccgggagcccatcacggncaaaggcggacgtgtacagcttcggcatggtgctgctggagatcgtgtccgggcggcgcaactacggcttccggcaggagtcggtgggcagcgaggactggtacttccccaagtgggcgtacgagaaggtgtacgtggagcggcgcatcgaggacatcatggacccccgcatcctcctcgccgtcgacgacgacgccgacagcgtcgccaccgtcgagcgcatggtcaagacggccatgtgggtgcctccaaggaccgcgccgacatgcgcccctcccatgggcaaggtcgccaaagatgctccgaagggcactgtcgagatnnaccgaccccgtccaagccaaccatcttctgcgtccaaggacgactaactaacaagtcttctctctttgctttactttantcgtccgtataatataaaaacaaagccaaattgttaagtacgtgtataatactaa

SEQ ID NO: 87086 - DNA, 460 bp, Triticum aestivum
  unsure (1)..(460): unsure at all n locations
  Clone ID: PAT_TA_87086
gcgttgaatgtgtctggcatgcagcttttttcaaagaactaacgcatgcatgcaactgctaagaaaatcttccgcatggagggtcgttcggatctactccctcggttcctaatatttgtgtttttagagatttcaaatgatctactacatacggatgtatatatacatgttttaaaatgtanattcactcattttgttctgtatgtantcatttgttgaaatctctagaaagacaaatatttaggaacggatcagaaagtttgatggatataaacagcccatccttttttggggtggaaaaatccatatcaatcanttgacannaaccaatattgtacaagacagaanctccacacccccctangttaganaagagtagtangangggagctattgcannatgcagagcancccaccgtcctcggntcggtcgggccancagagataaggtcatggcctg

SEQ ID NO: 87087 - DNA, 567 bp, Triticum aestivum
  unsure (1)..(567): unsure at all n locations
  Clone ID: PAT_TA_87087
gtcccattccctccgctccccactccgcagcagttccgcacngacgccctcgccctcaccctccccaaagccctaaccgctcgcccgctccgccgccatgaggtccaaggccaacggagacaccgcgttcaaggcctccggcaagaacaagacggccaccggcggcgtcgccaagccgaagcgcgcccccacccccttcttcgccttcctggctgagttcaggccacagtacatggagaagcaccccnaggcaaagggcgtcncggccgtcaccaatgcggctggggagaagtggcgcagcatgtcggntgangagaaggcaaagtatggcngcaagaaggcagatgccccagcangcaaagcggtgaacangaaggagnagcactagctcctnaangccaagactgacctgacgaagaaggtctgacgttgtngatgatggcanggaggacnaggagtaatagngcatgaaggancagcagtggtgcaaataagcgtttgctgcttgggtttacttccattcnangnctcattagtaaggttatntagganattttgngcctacng

SEQ ID NO: 87088 - DNA, 591 bp, Triticum aestivum
  unsure (1)..(591): unsure at all n locations
  Clone ID: PAT_TA_87088
tttttttttgaatgcaaccgcggtttgcccctgtttttctgaaagaaaaggaagtgcagaggaagatggttcagtggagttggctctcttcttcagattcgtctggtgtgtgtggttggttcgatatttctaactgttctctactcgctaatccttggcaacacccttttacccaggtgctgtacatcgttggatacgcgcagcccacacggtggatggcgacggccgacgggagatgattccacatgcgtgtggttggttcatcatcacagaggtaaactttgttcacagttcatcatccaacataaattcccgaccaaacgaattcngtcatctccgtgttcacaattcacttcaggcgattgcnacngctcnggaggccggcaccggcgagggaggcaagcgcgagctgaagtttctgtgccggaangcgggcgtcctccgngtcngcgtcgccgtcgtcgctgcngccgccgtcgaangttgagcgcgtagctgagcgancgattcgcactaacgtnttcnagtanggactactagtncangtgaagccatagncaacacggggagatcatnacaataaggcgctcc

SEQ ID NO: 87089 - DNA, 279 bp, Triticum aestivum
  unsure (1)..(279): unsure at all n locations
  Clone ID: PAT_TA_87089
gatggagtgaggcggatcagagacacagagattgaccagtagtaggtggcttgttgcagcattgcccggagaattgcagatgaaattaactccaataattccttgatatgagcaccagatcgatcgttgtttacgtgttcgtgtcatcgtgtcgcggggtttgcatacaagtggctgcttgatcatcgaattcgatagatcctattgtagtagtatttgttgtntaatatataagtagtataataaagttaagctcagaagaacanaaanganaaaaaa

SEQ ID NO: 87090 - DNA, 492 bp, Triticum aestivum
  unsure (1)..(492): unsure at all n locations
  Clone ID: PAT_TA_87090
gtcttcccttccgctcctcctccgccccatccgacancctccgccccttcgccggctcncgtggcgtcctcgccgcaccctctancggccgccgcctccccccctcctccctcttccagaaaatanngatgaagagaatttcacggancatggcattggggaactaactcaanatcnttacgacnaagaacaactgaactctttcancattacggcncantataatgaanatcctgatggtaactcatacaacnaanagcctggaaaccantatgacgaagganctggggatgcatacaacgaggtgcaagcaaatttgctcancgaanaaccaganactcaagtacantnatgaaccatcaancgcttancangacgannatgcatacaatggggaagtgnancaacangnaaattgcangtacangganatgataanagtggccanggttggtcanggagatagcgttttcngtngactggtccatccca

SEQ ID NO: 87091 - DNA, 570 bp, Triticum aestivum
  unsure (1)..(570): unsure at all n locations
  Clone ID: PAT_TA_87091
agatggtgatgacattgatgaaattccttcgaaaaagccgaagtgccctcccccgcctccgcggaacagggcctcacctagttctcttttgcttgcctgcaaagatatgcctcaagacaggcaagatgccattgatgagatggacttcacaagccttcagaacatcaagtgcggccatctttccaacggtctcaatgtgtggcttgccgggttggacgaccttgaatcccgtgaggtggtcgttccagggcggggcaggcttcctgttaaagaagaatatgtccatcgtgtgatgggcgtgccacgtggagggaaggatattccttacaacattcctactaaagctgatatcaagttagggcttgatatgtttggtgaatttgggatatacccataaaatgacagagcttctcgatntcatcacgagttctgacaactctgacaccaatttcaagcggatgttggcttatgcttgcgggcaatacgtcaatnccccgacacatccaagaaggtaancccaagtgggaagttgngttgcnancattccaagttaaaatctaancggggcag

SEQ ID NO: 87092 - DNA, 559 bp, Triticum aestivum
  unsure (1)..(559): unsure at all n locations
  Clone ID: PAT_TA_87092
agaagagaagaagaagaagaagaagaagatgggtcagagccccttgatccggctgccggaggaggagcaagttcagctacttgtaacgacccatggcagcaataggtgattttgtgaaaagctatgtttacgcaccagaatgagctctagcttgtgctgcagctaatcgtaaagtgaatagatgtagcactaatgacgtgatcttcttcctgtttactagttcgacctgtgtatgctattactgtcttcaaaacctcgagtggatatatgcttttgctattaaacaaaatcttgattagtattaaaccgttaattggcccctgaattaacactctttcantatggggacatttttgtgtgttcaacgtgcaagaangaacagcttggcaagtctncaaaagctacatncagntactncaagtaactcanagcaaggacgatctagttttganggggaacactagaccaaaccnctagatngggatgaatcgtgatnaagngacnaanggancangtagttttaatgccaggttttanccagnaacgttnattctgttca

SEQ ID NO: 87093 - DNA, 390 bp, Triticum aestivum
  unsure (1)..(390): unsure at all n locations
  Clone ID: PAT_TA_87093
gtgtttagctacaagtcgtcgctcgacggatgcgcgcggttgctcgccgtcctagtgggccccgtcaacttcaacgtgctgggaggaacagaacaagagttaactacaccgtcagtacatagtgcgttggcggttttggatggaacaacgtacanaaaaatgctggcatgctcttgcactgcntncatacnacatggngcgaaagtgttgtttttccatcacgtcaaaggatccaagtccaattgatctggagttcanctancactaccacatncacacacgttaagctagganatcagtggggcaagagacccgnccgatcagcancgcaagtcgcccgccgacacagctgnttctgcnatctctgcggtctnagccgccgcctttgtc

SEQ ID NO: 87094 - DNA, 372 bp, Triticum aestivum
  unsure (1)..(372): unsure at all n locations
  Clone ID: PAT_TA_87094
gacgcatcttgtcaaggctgctccggtngacaagtcggganctgctgtgcnagaacggnccngagctgtgtgcngtggtgtcataaggancctatccatctccactatcaattagccnangtttcacttcacagcgntgatgttgtgttacctttttcccgtcattgtccngctatancggatngcggctccctgttggcgccgccgccgagnggggatnccctaactggctgatggtgtntgtcctctttccgctgggtgcccctgcntgtactanattgntactcntncttncagtgttcaccggctaanattgttntaattatnatcctgggctantgttacnnttacatcnattgtccctccatccac

SEQ ID NO: 87095 - DNA, 630 bp, Triticum aestivum
  unsure (1)..(630): unsure at all n locations
  Clone ID: PAT_TA_87095
gcagaacgcgatcactacagtgcctaaagttgccaactacaccatgtcttttttcagttactggagaatgatctctggccatggaccaccacacacagactctcatggaaaacagagtaggaacttgacaccattttcagcactctatcactacaagaaccatggaaggcaaccaggtaggctaattcttcagattaaacacacccacggtgcataactccttgcgtcgaagatttcagttgcgatgcttgggcagctccgtgacttgtgctggcgcgtcgccgggcctgcaactggatgccgcacgaatgcataacaaaagacagcctgattaggatgaaggagtaagacaagtggtcccaacaacatagcagaacggaaggaacggagacatggtgaaagaaattnaagncatatatcccaaatgcaaacttatggccttggcaatgtgttgattttgccaantaagtgaagcttatacataaacggtaccccttccggtcccanaatgttaagacgttttaacactantgtaatgtcnaaaaacatcttacattttgaaacgngggannaattnatggccgtaatttannggcaattaccaggtaattcttgcaatgtatagggtta

SEQ ID NO: 87096 - DNA, 304 bp, Triticum aestivum
  unsure (1)..(304): unsure at all n locations
  Clone ID: PAT_TA_87096
gggataccggttcagttactattattggtaacttgactgcanncgctacggcctaancnaanactggctaanggtgaggtgncgatgtgtgtcggaagtgtttccaaagttgatgagatcaccatcgcacgctccatctgccttcgggattantattgancctanatnaatgttatcaggtgtctacnttgagcatgantangattacatcatgttcatngcantncggtcagtcatttacnttagngnatcatggntattcngtttacatgaccgagtaccccttcagggttcntgcacccta

SEQ ID NO: 87097 - DNA, 461 bp, Triticum aestivum
  unsure (1)..(461): unsure at all n locations
  Clone ID: PAT_TA_87097
gagagctacagcngcgganaatcatggcgattccganctcttcctctgctcgagcttgatttccgttctgctgctccgtgggtttggatttttgaaatgggtaggctatggaaggtctctcacaaggacgttcctgtagtttcatcttttagcagtgcatattctttggatgaaccctttgtgcctaatgactttgcggnagatgattcatatcctatgtcaccggaactatcagaagatgacggcaactttgacagagctctantcnagttctatatgaatcatgagctccgaanaagcttttgtgaccttcnangattttttgcttctttgcttgttcgcaanttcaatcatgcagatnagtatgcnntgtttaccttgnatataatctctggattgtaggagctctgtcaatgaaaatgttgcctgaaataaaattttgtangnttcaaatggggggg

SEQ ID NO: 87098 - DNA, 484 bp, Triticum aestivum
  unsure (1)..(484): unsure at all n locations
  Clone ID: PAT_TA_87098
gctgaanaagtggaacaagtttactaccaccaccaccangctactacngctgctatgcaccaagtgacaggtttgaattgacccgtggaaggnaaaganaggaagtggggagatcccttgttccccagtcaatcttccatccacccatccatccatccattcatcnccccttttctttttcttgttttctcccctttttgtcttccagaaacaccatttgatgtacggcggcaggcatgggtganngggaggattcatgaaaaagagagggggaganagagctagacagagagacagacttgtgtangtatgtgtcatgtctgtgagtngagtgcttcagtggnggccaanangaacctctgaanctgatgtatcctcnnctgcctgctcangaancatccccatggggattttgttcnctccccnctctcctttatgtacagttctactgctggtcgagctcatncantcaagttggggtggt

SEQ ID NO: 87099 - DNA, 480 bp, Triticum aestivum
  unsure (1)..(480): unsure at all n locations
  Clone ID: PAT_TA_87099
atcattgtatccgaatgcaatgattccagtacaaacttgagaatcactcagtatctgaccagagttcttctttttgtttctctggatcattattaagaggataagtgcaaataggcctaaaacaaaaacgcctgtaccagttacaattccaataacaattcctcttctgttgtttttcaaactttgtacatctttagcagaaagacggaggtaaagagtttctccgttagaattggcagtgccactacatggtaagtgctcttatgttgagcaatttattatgccacatagaacatccattgttgccaaaggagtaggctgtgcaagagcaattattcaggaaaacttgtgcgcactcacttgcacttgcagcagcatctacttcctggggcatccttggggcaacttaacacatggcatagaatagaactgtctgtggtatgcgttgtgcctcnattgctaatgcagtctaacttagct

SEQ ID NO: 87100 - DNA, 388 bp, Triticum aestivum
  unsure (1)..(388): unsure at all n locations
  Clone ID: PAT_TA_87100
gtcccgtcccgccgtccgccgcgcgcagctcgtgtttgccgcggaaagcagaggcggcaacagaagaaaaagaagatgatgaagacgacgatgtgggctgctgctgctgctgctatggtgtgcctcgcggccctcgccatcattgttctggtgctgggtgtgaagcgtangtaaatacagctagagtttattcggtgtattttctttgaaatgagagttgaattcaggtttatctatgcgtgtgtggttctccaaagtgaaaaaaggaacaccgccacaccacgactttatccgtcttttttgtggttccgctgaaatttcttcatgatgttgtgaagtgaagtgggtatttttttttaaatcgggctaaacgaatttccattataaa

SEQ ID NO: 87101 - DNA, 395 bp, Triticum aestivum
  unsure (1)..(395): unsure at all n locations
  Clone ID: PAT_TA_87101
gccgcctcnccgtcggccactgcaacacccctctctgcacgtnagttcatttgccccccaacacgcagctctgctcactctcgcatcnaaacaaattganntcatgtctgacgttgcaatggatcttgtgtgatcatgcanggacttcaagctcaaggagcaggaacaagggaggccgtgtcggcttcggtggtggncaaggnccgcgatcggcatcgacggcaggtgggggcttcttgtgaacaaggtgaangctgtcacnggcatgtcntccctcgnncaagacaaacccgccctcncagtgctgctnnagactctcancngntgctgancctgagcgantgnaangtagnttgccgnagatcctctcaaganctggatcgantattgtgcaa

SEQ ID NO: 87102 - DNA, 498 bp, Triticum aestivum
  unsure (1)..(498): unsure at all n locations
  Clone ID: PAT_TA_87102
ccaagaactaagtggtctatttcaataccttgctgctgtatttgcaacggacttgcactcgagcaacttttctgcgcctccctaagaccctgggagtggatttccgtgcctcatgtttctgccacaanaagactattgacatgggatatgtttgttcatgtttgcttatcaatattctgcaagtaccatangaaatgttcgacctgtgggtcagaattcagccgtgtcagcatgccggatttgaattccttgccagatcaaaggcagtagtantctgtcgacagggaactgccaaactgcatactgggcctttcagaattgaacttcctttganggcttacaantatcnaatctcgtnccatcatcgnntttctacangctgaatcnctgcaaggaggggatcgcgtgtggtatattcgaancggctggtcaatgtnttaacnnacggaaaactggagtgcaactttntggacaattatcctcactgagaaatgcaca

SEQ ID NO: 87103 - DNA, 391 bp, Triticum aestivum
  unsure (1)..(391): unsure at all n locations
  Clone ID: PAT_TA_87103
gtcgtcttgccattcccttggatacgccgggtgtcctgccgatcttgccggtgcaactgatcgtcctcgacatgtgtggatatgttgttacccaaatttgatgatgtttttgttgtttcttcttcgggcctttgatgtgctgggcgtcctggggaggcgtcgaccttgccgatgcaactggttgtcattggcttgtgtcgatctgccttcaatctgttgtgcgcgtgatgtgacctgtgaaggcgcgtgttgattgctaggcgtgatgtcntgtatgttttgctcttctgggcgtgtgcccacctattcatatactantagaatgcccgtgcgttgctacgggctacagtgcatacaantgaatcaaancagtggntaaggtccaaaaaaa

SEQ ID NO: 87104 - DNA, 626 bp, Triticum aestivum
  unsure (1)..(626): unsure at all n locations
  Clone ID: PAT_TA_87104
gagagagagagagactagtcgagctatgacggcacggaagtggccatcatcgccgactatcccggcctcctccctgcctcggatgtaagtgatcaagagacaccttcttcaaaagagcttcctcattatggctcacccaccgcactatttcgtgctccaaaggggaggtgcccgacgcctcaacgtgcgccagaggcatctcctaagagagcggcgcccacgccaagcaaatcttcgaagaggaaggcgaacgacaacacggaagagccttcatcaaagaggtatggttttttgatcatgccccctggcagtcgcatcaaactgtgacattatccgctgtgtcttgtcaggaaaagtgttcgccagactatgtccggggattctgccggncgcgcttccacgaatcaggtcccgaccccgccttaaaggcgaaggctgatacgagagtgacccggatttccttcgatagangatcaagatgatgtatctgtacaaactctgaanttgcaaagcgncatgaatcatcngcgctgggnggccgctcttcgtggcccggntttacaaaagaggaatcaacgccttagctcggtgagcaanatcnagctnctcanggggggccgtancaa

SEQ ID NO: 87105 - DNA, 627 bp, Triticum aestivum
  unsure (1)..(627): unsure at all n locations
  Clone ID: PAT_TA_87105
ttccagctcgccggagaggtagcaagcaagatggccggaaggaagggaggcgacaggaagaaggcggtgacccgctccgtgaaggccgggctccagtttcccgtcggccgcatcgggcgctacctcaagaagggccgctacgcccagcgcgtcggctccggcgcccccgtctacctcgccgccgtcctcgagtacctcgccgcagagatgctggagctcgccggcaacgcggccaaggacaacaagaagacccggatcatcccgcgacacctgctgctcgccgtccgcaacgaccaggagctcggaaggctgctcgccggcgtcaccatcgcccacggcggcgtnattcccaacatcaactccgtgctgctcccaaagaatcccccgccgccgccgataaggaggcaagtcgcccaagaagaagactccaccaaagtcnccaagaagaagtcgccgccaaggagtagccgccccatagactacaatcgtggacatgcttagtcatatcaaggagaagatgagagttcggtnggtgatcctgtcanctgnngtaattgctaaccaactaaggntgtntcatcccnactantccgnanactaagatgnntcttaatcaaaggggggcng

SEQ ID NO: 87106 - DNA, 628 bp, Triticum aestivum
  unsure (1)..(628): unsure at all n locations
  Clone ID: PAT_TA_87106
atattgaatctgctgactcgttggatgagccagatctgccacaagtactcagggatgatgatcaagtatttctattgactgatgaagatatacagctcgtgaatgctgcatttcctaatgaagcacggcagtttcaggaagcacagaggctcaaagaagcaaaatcaagatcacggaaatccaagctgagccaagcagagagcatgctggagacaccaaagggtccaagacccagcggggttcagctcagcatcaaggagttttaccggtcgaagaaagcggcgggagacgaagccgggaagaagccggtcatcgagggcgagacgtctacgtcgagagctggctcnagaaatcaccaccggtggacctggacaaaaaggatgcccaatccctgcgacgaccttgctcttcgactgagacagcccgcanttgggttgtcctgacggtactcctgctgccactgctgtacatgctctcggtgaatgtgttantggttctcctgggccccttnnatgtaaattagtatgtagtgcatcctcggtaagtgaagaccgatnttattaatgtggaggaagaaacaagcttttgttttaggaaanttactgagtgtgcaacctctgtgngntgn

SEQ ID NO: 87107 - DNA, 609 bp, Triticum aestivum
  unsure (1)..(609): unsure at all n locations
  Clone ID: PAT_TA_87107
gcgaattggcagtccttgcaaatgagggctgataatttgatcaggggggataaccctaggttggagtgtggcataaataaggagatgcgtgagatgttgccagtcgtgatcttcaaggagagcttcttgatcagggaaacacagtgctcggtctgcttagcagactatcaagcagatgagcggcttcagagaatacccccttgtggtcacaccttccacatcgattgcattgaccactggttttctaagaacactacttgccctctttgccgagtatcgctcctgactgcccccaagagctgcaagcgtcgctccaaccgatctgggaaacacaagccatcnaaagaggactgctcttcaaatgcgcagcatcatgtggggccttagagatgagcacacgcgaccgggaggatcangcactggacggcaagatcaatgccgggccatcacaagcaagactaacgtggaagcatcagttgttgtantcatcgcgcccaaacaacanggtcnccaagttcntgccacttgtctgccgtgtaagcaaaagaaataagnntttacggcctggtgtngtttaccgctgtagaaggatataaaggccacaaagtt

SEQ ID NO: 87108 - DNA, 601 bp, Triticum aestivum
  unsure (1)..(601): unsure at all n locations
  Clone ID: PAT_TA_87108
cgctcaagcccccagacgccgcagcgccgccactccacccgcagcggcaaccatggcggtcggcaagaacaagcgcatctccaaggggaggaagggaagcaagaagaaggccgtcgatccgttcaccaagaagcagtggtatgacatcaaggcgccgctgctgttcaccagccgcaacgtcggcaagaccctcgtgtccaggacgcagggtaccaagattgcctcagagggtctgaagcacagggtgttcgaagtatctctagctgatcttcagaacgatgaggaccaggcctacaggaagttcagactccgtgctgaggatgtgcaagggatgaatgtcctcacaaacttctgggggcatgggacttcaccactggacaagctcaggtctcttggtgaaggaagtggcaagacactcaatggaggctcatgttggatgtgaaagacaactgacaactacatgctccgcatgttcgccantggcttcaccaaagagaccccaaacaagtgaagcgcactgctatgccaagcaagtcagatnagacagatcgcncaagatggtgagatnatggncaacaagctcaagctgtacttaaggagn

SEQ ID NO: 87109 - DNA, 238 bp, Triticum aestivum
  Clone ID: PAT_TA_87109
ttctcctttcgtcacttttccttaatcttttctgtgaataatagcatagctacaactagaactccagttgtgcagtagaccagtagatagttgatagagagagtagaagactccaatccaatccaacggatgatgtacaaagagtccaagattgtaacattattatttgtagtggtagcgtgtaaaaaagatgtgcaggaattggaaagagtagcactcagatgagaaaaaaaaaaaa

SEQ ID NO: 87110 - DNA, 581 bp, Triticum aestivum
  unsure (1)..(581): unsure at all n locations
  Clone ID: PAT_TA_87110
ccaattcatctcaaaataatgcaaacccttgcaaactgctcaggtagctattgctcctaatcaaatgacaatttatcctttgaacttgttcacaaatgcaactctggtcgctggcttctacatatggaccatgtggagtactctgtatattcaatatagtgattttcttttgcttatttgatttttggattaatttgtatattcaacatatattgtggaaatcttgaattttattgaaacctctatacttgcttgaactgatgttcaggaagtagttgagcacacctatgtcatcggttgtaaatagctggactaaaggatctatgcacatatctgcaccccaagtgcatgtttattgctgggagtgtggaatagtttgagcacgacagtcaaggtaaaatgacaaaactgcatgttacacaaatcttctatgattacacaaaacggcatgttcacaccaaccctgctgtgcctattctttacaagtgcnaanttacagtaaccgaataactaacagtaacagatccggtacgggttgtcaaatgtgttgcgtgtcgtcattgcagaacnaaatnaaattg

SEQ ID NO: 87111 - DNA, 254 bp, Triticum aestivum
  Clone ID: PAT_TA_87111
cgtcgccgcagctggtcgccggcggtcgtcacagcagcagcagcagcagcaagaggttccggtcgaaatcaaaaatgggaatacaaggagacagcgcgtcactatcactgattaagttagaactccgctaggtagccagcttcaggatatgaatatgatactacatacatatctctggtgctgtgcgtgttgtagaaaagattgaatatgatactaaccaatcctcagtcatactagcattcaaaaaaaaaaaa

SEQ ID NO: 87112 - DNA, 603 bp, Triticum aestivum
  unsure (1)..(603): unsure at all n locations
  Clone ID: PAT_TA_87112
ccttgagttgcctgtattttggacaccattacgtcaataccggatggtcagtgcttttcccaacaaattgtgtctggacaacaataatttcactggtgtgattccccctgagattggtcagctaaaaatgcttgacatccttaatttaagctccaacagcttaactggtggaataccacaagaaatctgcaacctcacaaacctgcaaacactcgatctgtcgaacaaccagctcacaggtgcaataccatctgcactgaatggtctgcacttcctttccaaatttgatgtttccaacaacaagctagaagggaaagttccaagtgggaggacagtttgattccttttcaaattctagctacagtggggaatccaaagctatgtggccctatgatcaataatgactgcaactcaacatcatctcagcgtccccaagacgtggaacaaagaagaacattactgccgttggataagtgtgttcctcggggggcntgcaatccgttcctgctgggactctgcntatggnctcaaaagacaaactctgtcaacaaaacaaggtacaacatggnacataaagnaagttaattacctcgcacagatatg

SEQ ID NO: 87113 - DNA, 407 bp, Triticum aestivum
  unsure (1)..(407): unsure at all n locations
  Clone ID: PAT_TA_87113
gcaaaacctagctaagaccanaatctccaanancaatccactaggaaaacatataccatcatccagggctaatgtcacanngcattggttccagcantgctgcttgtcctggtggtgtccctcaccgcgatanagggtgttcatggcatctgtggcatgtcanatgacgaattcaagctttgccagcctgcggctgcagtggcaaanccaatagacagtccgtcngatgantgttgtgccgcgcttgggaangccaacctatcgtgnatttgccgctacanaggcatcgccggnatattgcctgatgatgtnccacatctnattcgggancgtnctacnggagctggcnccggaagtgccggctcattgtgcccagnaanctgttcctnactgatngggtngcacta

SEQ ID NO: 87114 - DNA, 611 bp, Triticum aestivum
  unsure (1)..(611): unsure at all n locations
  Clone ID: PAT_TA_87114
gaacttccagctgaggtaatcataacagtttatgactgggacaatgtatgcaaacgcaaagtcatcggatctgtaactgtagctatcctcgccgaagatgaaacaggagccgtttggtacgacctggacagcagatctggtcagatctgcttgcgtattagctcaaagaaagtgtcgtcgacttctgacagcttctttaagcagtatactggagccaagtcccagagaaagattatactcgctaggcaacggttggcaatgactgaagacagtagtcctctgcacgctacaatcgaattccctcatgatgaaattgttcaccacagttattcttgtgctccggagaggtctttcttgcgctatgggcgtatgtgcatctcctcatggcatctgtggcttccaagtcacacntattctccaagcaattaaatgtgatcattccgttacangacatatananataangaggagcagnactcccttatanaccaagctattacgaaatttcttcatactggcgcaagtgggcaaggggtatctcaattgtgctgccaaaatngnagcttaggtnaagtcanatncttcnggaagaaaccgtaatttcngccnng

SEQ ID NO: 87115 - DNA, 628 bp, Triticum aestivum
  unsure (1)..(628): unsure at all n locations
  Clone ID: PAT_TA_87115
ggaaagggcttaagcccaccttaccacaatctgctaggctttcgttcagaagtgattttgtcatgtcatcaatgacatggtccggtaagtcgtcagagctgtgccacagagggtcatctttcttgcccatgtaggtacacatcagaccagggcggtggctcaacggaatgatccgccaggcaagccaaacccagaccaagtcaataccattcaacccattccccagaagagccttgattttagctagggtgggggcgagcgtcttgtgttttgcggctgttatcttatcaggaagtggatgcttgggactcaagacgcaggagcatgaaagccaggcaagaggattctcatcagccggagaagtgtcttggacaatagaaccatgtctgggttccaatcttttggggatgactngggtggggttggcataaggnaaaatacctctcctccgatgttggatcnagacaccaccaagttccaaagctttgtcccgttggngcactaattctggcgggtcaagtagaatcactctctaaagagtagtaagttgggctctctccaagaatatacctcactgaanactganaatgcaaatatnnacatggaattgggtcgatntctgagangg

SEQ ID NO: 87116 - DNA, 399 bp, Triticum aestivum
  Clone ID: PAT_TA_87116
ggaacctcgtgatatacgactactgcgacgaccgcaagaggttcccggccgtgccggaggagtgcgcgctcaggaccaagactagctagtagctcctcatggatgggccgccctaggtctcgcttcacatgcatcgttcttttttgggggttcgatcgagtacgtggtgtggtgtagctatcaattggtggatggatttttttttcttttctcttctcttgttttgtgatgatgagatgcacatgcggacgtgcatgtgcacggtgatgcggcattgattgcccggggtggctgtgctctcatgtgagtgataccctttccggaggaaaatgatgacattttgttcccgatgccttccatgctgcacgacacgagcatgggatggggcaaaactcacgg

SEQ ID NO: 87117 - DNA, 497 bp, Triticum aestivum
  unsure (1)..(497): unsure at all n locations
  Clone ID: PAT_TA_87117
gagaactcgagtcatccgacaggtccatgcaccgcggtcgggccatacgcccgagcaaagtaggatctccaaccagcatcagcgcagaggaaggagaagaacagcagcagcaaatcataccaacaaggaagaagaaaggtcttcatctccctgcctccatcgcccatctgaggatccaaacggccagtgccgatggaactccaaccaccatagcccgcgacctcnacnagatccggggatccccaacaccgctggcttctanacgaaagcaaaagcctcgcctnaccgtgaacggaacccgggagaaactcataccnacgcgacaccaccgcaacancctcnggcaagcgtctctctcaaaccctaaccctaccacacacccacctagtggancangacccgaggttcccctccctccnggcggnggngcggccnacnggagagggaggaaaccgacggngtcacggnnggcgcgcangggaccctantcgcctcct

SEQ ID NO: 87118 - DNA, 438 bp, Triticum aestivum
  unsure (1)..(438): unsure at all n locations
  Clone ID: PAT_TA_87118
cttctctanaaagtttccaaatttagcaacaaaagtttttccttcggatctgtgatagaaggtgtatccaatagtttcctttggatatcctatgaagacacatttctccganttgggttcnagcttatcangttgaacgctttttcacataagcatcgcaatcccaaactttcaggaaacgacaantttggtttcntgccaaaccatagttcanaaggcgtcgtctcaacggattttgatggtgccctatttaacgtgcaatgcggccgtctcnacgancataaccccaaaacgatagcggtaaatcagtaanagacatcatagatcgcaccatatctagtaaagtangattacacgttcnggacacaccattacgctgtggtgttccggggggcgngagttgcnaaacaatncngcaangtntcaaatgtncacana

SEQ ID NO: 87119 - DNA, 587 bp, Triticum aestivum
  unsure (1)..(587): unsure at all n locations
  Clone ID: PAT_TA_87119
acgttgtgcacagataggtatcggacctccagcagttacctgatgtccgacagttaccggtcgtccggtgtcttgcgggggttcggtaaaagtgtcggatttccgacgttttggctctgatgggcgtctatcggatttctggtcgaggtcggacatccggtgcgtcggtcgtctggtggccttcggatttctgatgttttcatgctgactggtggcaacggtcgtccagagtggctcggttgtccgggcgctgggagggtccggtccgtccggtccgcgtcggacgtccgaccgatgtagcgttcgctggttgggacttgtctggctgggctattctcccaggcgtcgggcgtccaacaagtaccgatcgtccggtggntggtacttcctgctagtcttcctcttggtccttgtacttggtgtcctccgtcgtcttgtccgttgggtgtagctgcccgtggcttcctccaagtacctgatcacacatagggtctccgcttgaagtantagcaaggctcatatgtagaaatggagtttggacaagagcaattaacctantttcatagccttctcaaggggggccggta

SEQ ID NO: 87120 - DNA, 543 bp, Triticum aestivum
  unsure (1)..(543): unsure at all n locations
  Clone ID: PAT_TA_87120
agattgaagtaatgttgtatgatcagcctgccgacatggtacagaatgataagttaatgtcttccattggcgagtgcgtgaatcttgaatatctgattatttatggtgactacaccccaagcaacgaacttcctgtatccccctattttcgttcacttgagagattgaaagtggcaggaagatttatgaaagttccccggtggcttgcagagcttaccatgctcaggaagcttgatatcagagtctgtcagctagaccaagatgatcttaagatacttgggagccctgccatccttggagcactctccgcacttggaactggatttgcattattttgaagaaagatgtaactatcacgaagcaattgcatcctgaggaagaaacaatcccagaagatgtttccccgaagctccaaggtttcaatttcnatgtcatgtgccaagggtcacctttcagcaaggagctatgtcgacactgaaacactccaacttgaaagcctatgcntgcccagattataaattccctcagggatcacaaccttcc

SEQ ID NO: 87121 - DNA, 600 bp, Triticum aestivum
  unsure (1)..(600): unsure at all n locations
  Clone ID: PAT_TA_87121
accagttcctccccgcccccgacgccaaaatctggaaactcatcgaggtcttccagagccgcggcttcgacaggaccgacctcgccgcgctctccggcgcgcacaccatcggcaagacaagctgccccaacctcgccagccgcactggggacgccgcctggttcgtcgaagctatcaaaatgaactgccccggctcatgggacaagaagcaggtgctcgacgtcgacacccccgacgatttcgaccacaagtactacaagaacatcgtggacggcaagggggtgctcaagcaccgacatggagctcctcaacgaccccttcatcaaagatttggtccacaagtgggctaccgacaagaactttttcctttggnaattcggcgaaccatggcaaagatggcgcgtttgcccgtgggcggaccaagtgagtaccgcgaaaatgcttcaagcgcaactctatganggagacantcaactcaacggccaaggttcgcggctcngctnaaaaattatcaatgggtaaccgcatacaagccgacgnangcctggcatgcatatatattnnttataaganataactaactactttgctgatnaattg

SEQ ID NO: 87122 - DNA, 406 bp, Triticum aestivum
  unsure (1)..(406): unsure at all n locations
  Clone ID: PAT_TA_87122
gtcaaggcgaccgagcacgtcgtcaacatctctaagctcggcccggcggcggccgccgttgagctgcccacggtgaaggagggggcggccaagaagagcggcgtggcctccgccagcgacgactccaaggggacactcgagaagcttgacaaggcaatccatgtcgagcaagtctaggcatgcatgcgttcatgacacacggatgtgtgtatatgtcgtgcatccaaataagccatgacggggatcaagcaaacaagcggtgggagaatgcatgcatgcatgcatgggggccttgtaaattgtacgtagtaatttctactgtcgatctccantcgaattcaagtggtgattcgtacctagtactaactccgttgcaaagtgttcctaattttaaaaaaaggggggg

SEQ ID NO: 87123 - DNA, 404 bp, Triticum aestivum
  Clone ID: PAT_TA_87123
gtttgcctgggatctagctttatcaccggcacgtggaacagcaaccgtagccccttacaactagcgactgtcgttttcatccttgcccttaacattgtctacctgatgttccatcagattacggaaaagtgttctagtataatcctaaagcttcggggatcctcctaatcagtcgcttaaaggtccggttacagttacgaataagtaacggcaaagaagaagatttgcagaagaaacaagaggaaaaatccttaacagtctgtgtgcaaacttgaattatggcctcatggagtcaatgataattgtagcgaaccctgggtgtgtctattgtatttgtaactgcgcgcgtgagaacccagcttctgcgactcattagtaacacctattttgtcaaaaaaaaaaaa

SEQ ID NO: 87124 - DNA, 323 bp, Triticum aestivum
  Clone ID: PAT_TA_87124
tgaaaatggatgcaccttccctcaacccctgattcccgtataggtttgctgcgtgatttgatttgtaatggtatttgttgcttatggttcagatgaatattcagactttttctttttcttttaagagggagaggatgaaatcagaccttttgcttgagcagtttgatcgcaggtcgcagtagaagaagtccgcagacatctttacgccaactagtggcaaagtcttgatcgtctagtaagggatgttagctgttacccgttgaattgagaatctatttttcgttgcatgccgtccattgaattgaagagagcaaaaggggggg

SEQ ID NO: 87125 - DNA, 592 bp, Triticum aestivum
  unsure (1)..(592): unsure at all n locations
  Clone ID: PAT_TA_87125
gataaatgctcatgctcatgctctacttttagcatcatttcatacacgtttagttcttatcagaaagtggaaataggtacttttggcaatcatgagcatcctctacttatagcaatatctaatgcatcatcagtacaaagcttgatttggcaataggtggaatcggcaatcatttgcatgctttaattatgtgaagctataatcatgttgagttatacactaaacataatcatgccaagctataactaccatagtcataaaccaggcttttcttaagcacaggtgcttatttgtacagggtagacgcataactaggcgtctctcctgtagaaataggcaccgatgcttcaagaaaaaccctatttatttttcctaagcaccaccctaagcatcctagcattgtacaaggcttaacatgcatcaccaaaatagtattaacaacttgggnacactaaaccagagtagcagcaaactcttaaagataaacggcatangtcaagacacaccaataggacatcaagttttagagtcgaacaacaaagaaacatagatacataagaggacacggggggtccggggnancaacactcnn

SEQ ID NO: 87126 - DNA, 598 bp, Triticum aestivum
  unsure (1)..(598): unsure at all n locations
  Clone ID: PAT_TA_87126
attaggagtcactggcagccctaaattctctgctgattgggaccccaatcctggacgggatttggaggatgctgagggaggtgaagagtggcagacacagcttgttccatccacactgcgtcagcttatgacagatgacatagcaggatttcttgctgcacccgtctgcaaatttctctcttcctccctcaccatgctgcaactttggggggattggtgtgaagggatggagtgcttcaccaaggagcaagaggacgcccttcaactcctctcctccctccaggtactacatgtttgttttttcaagggaccttcaacaactccctgcaaggctgcataaccttaccagcctcaagatattattagtccacccctgtccatccatctcattgttgcccattgatggctccctggatcactgcaagagctaaatgtcgaatactgtggcaacaatgagctaaaacaacattgcaaggggttantgggaacatccctggaaatcacattatagagtgatcaaggngtttttcaatgttatgggcttctccaatancactaanttgggtatngcaatcantaanacgngtagncactttca

SEQ ID NO: 87127 - DNA, 538 bp, Triticum aestivum
  Clone ID: PAT_TA_87127
gtttaacaaactttttttacatgatggttgtgtggttgaatagctgtttcatttgtgtatgtttcatcaggaattcattttggttaagttttattttttgtactgaagacttatatagtagttgaactgaaaacactttttttcaagtgtatttatgagttgttgctgagaaagtgagatttatttttatttttatgtgattccatcctaagttggacctttatagtttctgtactctcgttttcttgtacttacgatataattctgttagtactgacttgtaatctcattcagcgtaaggcttttaatattttggtgccaaatttccgtttgaacttctttgaactttagtagttcaacttcatagtaaaagtaaagtactgatttaaattagctacgtttaagagatagcctaataagttcaaaactattccttaacaaggcattaaatgggatcatcatagcacttaccaaataaactaagtgtactgagattcaaatgtgcaatactttgagaatactaagatgtatataagat

SEQ ID NO: 87128 - DNA, 597 bp, Triticum aestivum
  unsure (1)..(597): unsure at all n locations
  Clone ID: PAT_TA_87128
ccaccacaaagtatctacggcgaagcatgttcctggtgttgtgccgatccgagagtaataaccatgtaaccatcttcagtttcatcctacagctcgatttccagatccacttgtaagaatcatgcaccaccaccttctgaagcagaagtgataaaacttggcggatgtgtacttgttgccccagctataggaccatgcatcaccagtcgcggtgttgatgtagctatccgccgcgacggcctggagctgggccacttcctgatgagcttgggcagacaatggtaagcagaagacatcgttcaaagagctggtcaagaagaaattcgcgggacagaaatgtcttcattagtggtgaaggagaaggcccttggggtatttttccgtgaagatttgaccacacaagtccttccaagaataatgtcgtctctccactttcaaacaagagacagaggagatccctccggtaaaatggcattaagtgggatgagctctcgccaccaagaaagttcacaaaggcctgctgcatggggaatgttgccattgtagtaacgtccanattgttggangttgcnccctcaanccataaataagtgactg

SEQ ID NO: 87129 - DNA, 579 bp, Triticum aestivum
  unsure (1)..(579): unsure at all n locations
  Clone ID: PAT_TA_87129
aggacaccttctactactacgtgccgctggtcggcctctcgctcggggccaagcggctgggcgtgccggcggccagcctcgcgataaagcccgacggcagcggcggcaccatcgtcgactccggcagcacaatcgcgtacctcgcggggacggcgttcgaggccgtgaagagagccgtgctggaggcggtgaggctcccggtgtttaacggcaccgtcgagggctacgagctgtgcttcgcgctgcctagcggcgcggcaatggccgcggtcaagacgccgccgctccgtgctccacttcgatggcggcgcggccatggcgctgccgcgggacaactacttccaaggagccgagggccgggctgatgtgtctcgcggtgggccagtcgccgggaggacctccggcgcgtccatctccgtcatcggcaacgtccagcagcagaacatcacgtgctccttgatgtgcgcaaccaaaattctccttcgcgcccacaaaatgcaacgacatctgatcttatctcaatgacaataagtgcaatgcaactttcaaacactacaataactccctccttctaaaacn

SEQ ID NO: 87130 - DNA, 237 bp, Triticum aestivum
  unsure (1)..(237): unsure at all n locations
  Clone ID: PAT_TA_87130
ttgtagtgtcagcaaggcacataaatttttgggtgcactaatttatggccagccggggagatatgangtggtgggaattcccagctggattgtgcttgtaaacatggacttggaattcggttgtgttcgcctcgctccatgctgattcgtttgtttcatcttcctttttctcctctgtaatctgatataccaaggtcttgtcctcggcgacgaaaattttgtgccaaaaaaaaaaaa

SEQ ID NO: 87131 - DNA, 658 bp, Triticum aestivum
  unsure (1)..(658): unsure at all n locations
  Clone ID: PAT_TA_87131
gtcactcgcaagaatttctgccggagatgatactcaagtgcaggtcatagtagaacagggcattcttccttgcttagcccagttattagcgcgaaattatccaaagatcatcaagaaacaagcttgtctaattgtttctaatattaccgctggcagcaaggatcagattcagtcattgatgctgatgttatgaaccatgtcattgttctactaaagacctcagaaactgatttaaagaaggaagctgcttggggctatatcaaatgctgcctctggtggttcaagcgatcaaatccaatatttggtgagccggggatgtttgggaccactcctgcaatgtcctcaagtaccaagacgttgtcttgtgtatacatgtccgggaaggctccaaaaatatactcnaagagggtgacatcgggaagcagcgcaatgaaccgcgatgaaccgtatgcgcattaatctggagaatgggggctggcaanttggaggatcgcangattcacaatgacgcggttaaagttagcataagctctcagagtaatggacaggantagcatgccaacttangctcaagacancggaaaactgaaagngaccgaatacgaaacccgnacantcattgggaccatgtcnanacgatccncaacctttcccagaa

SEQ ID NO: 87132 - DNA, 537 bp, Triticum aestivum
  unsure (1)..(537): unsure at all n locations
  Clone ID: PAT_TA_87132
ctgcgcctccacttccatcgcctcccaagatcgcagatctgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctgggagaagaggagcgtcgatgacctcatcttttccgtcggatctgggtggaggtgggtgctccaagctgctgctgctgctgccccggctgctgggtggtgctgctgccgctgaagagaagaaagaagagaaaaaggaggaggtaaagaagagagcgatgatgacatgggcttcaacttgttcgactaagcattcaaatccaattctccgggggatctttaagcnaaggatactatctaagtgctttangtcaatttgcggattaanaagttgagactaantacngtcaatgatacgnaaacacttgganggcctttagaaaaaaaa

SEQ ID NO: 87133 - DNA, 365 bp, Triticum aestivum
  Clone ID: PAT_TA_87133
ttttcttcttcttctctccccaaaactgctgctgctccctctctccacgtccctgctgcttctctttcttcaatcttgctgctgcttatctctctctctgaattttctgtaataggagatgtgtagtacttgtaaggttcagatttgataagagcttgcaacctgttaattgtcagttcagatttgtgcttgtttaagtaagtactattcagttgatttattaagtactaagtacacttgcttgctttgtcctgctcataattgtactgcttgcttcaagaagattgggcctgtattcttgtgtcctcaagtacctgtggtatataaatatatgttcctgttgtggaaacattaaaaaaaaaaaa

SEQ ID NO: 87134 - DNA, 458 bp, Triticum aestivum
  unsure (1)..(458): unsure at all n locations
  Clone ID: PAT_TA_87134
ctcaaccctcactggtggtcgccgccgcacgtgagcccacgccactactgccccctgacgcagcacgactttctttgctgcgggttgtatgaattacagtgcggctcagatcgtaccatgctgtttggagcatgtgagcatgcagtgcaaaatgttgcattttgtttttgagtttatgtataaaaaaattaaagggactttatttgaatgtgcttagaaattgcagtttggagtatctgcacatgcagtgtagacgctacttttgtgtttgtggattttttttataaagattatagggactcatttgattgcagcgaaacatggtgatgttcagacatgaagcatgcagtttcgaccatgtggacatgcagtgcaaaaatggtgttttccgtgtttgatgattttatgtataaaagttatatggacccgtttgaaaattgtttaaaagnaaanaccgg

SEQ ID NO: 87135 - DNA, 508 bp, Triticum aestivum
  unsure (1)..(508): unsure at all n locations
  Clone ID: PAT_TA_87135
gccactgcgggtgatgcggggatcgctagtccagtcaacgcgggcgatcgatctacaaaggacaaaggaggggatccagccgacgcagctgattcaagccgacccttcgtctgcaagaaactgctccacggagatttcaagggcgcaattattcttcagtttttgtgcacaattcatggcgggggtgatgtgcatctcctttcctctacctccgggtacaggtgcatacattcctcaagaatattggccggtgaaccaagccttattgagaaattagttagcctctccatggctcaggcggaatattcgattcngtaaatgtatgtggtgtgctttcattcttcaactatgtggtcangaaactataccctcacagttggcaaattcaagcaccctcataatctccantttttaatccaactgaacttttgcgtcacagcaacaagaacacttacatgctgaaagatgttagtattttgcaaaaaaaattgtgcattganaaaaaaga

SEQ ID NO: 87136 - DNA, 653 bp, Triticum aestivum
  unsure (1)..(653): unsure at all n locations
  Clone ID: PAT_TA_87136
ccaaatttgaattcagtgtctgtgaacaagagaagctgaagaagaattttgaggcagagaagaaaatttgggctcatgaaaaggcttcactggtgacccgggctgagacggcagaggcattacttgcagaagcaacaacggagctatccggcttaaaacgccagatatctcaaatggtctcaacaatctttggtcctacgagcacaaacctcaagcagaacatgttgatcaagctgaaggcggtttatactcttgtggaggagctctacagcgggtcacaacgtgctctcgccattgtagctttatcaagatgacgttcctcacctcctgcaaaacgtattgaaacggcttgcttcactacctcaacggattcaagatctaaagngggcatccgcaagaaccggggccgtagctgcgttgagcccggcgaaatctggatccggaactagacccgaccgactcgctcttggataaccantcntaaagaagatgggatctattgatggacatgacttaacgcctgtgtaaagttatacgcccgtggcaccctattgggaacatactgatctacaagtacanccggctanacacgagaatccgnnatccacaactccctttgtaagtagcctgattcncaacngtagcaacttttg

SEQ ID NO: 87137 - DNA, 636 bp, Triticum aestivum
  unsure (1)..(636): unsure at all n locations
  Clone ID: PAT_TA_87137
ctcgtgttgacgtcagcaagaggacagacgcagatgacgacggaggaggatccgatgatggttcagacggcagcgacatgcactccatcgagctgaacatggacggcagaagcaaggacggcggctggagctacagcactggcaccgcttccaaggagatgatgacagcgacggccaagaaggcggcgtctgcggacagcaggggaacggagtacgcggatccgtgggccggtgaccagcgatcgctggaggaatcggaaggaggtcngcggtgggacgacgacgagggcgcagcgacgtcnaccaggaggactcngagaggtaccaaggccatcaagaactcaangggagcaaatgctcgccggccaagggctgggttccaatttcctgcccgggagcatacgaaggaaattatacggctgaagagaaaacatgatgagattggtttggcaanggagcgatgaattggatcggttggcgctctcctctcccntgaaactgtttgcaatagcttgtgggttcagtcctcccggacaacaatccttcctttttaaaagtggacaaccgttctttctttttaaaggngncnacaattcntcatagaactcatccgttttgannaaaattttttttcaa

SEQ ID NO: 87138 - DNA, 645 bp, Triticum aestivum
  unsure (1)..(645): unsure at all n locations
  Clone ID: PAT_TA_87138
ctctcatccttcacaagctacacgtactctcttcatcaaagctccccactccccttccancaagagaacacatanaacaccaaaggctttacaccgacatacataatcatgcatcagcaggcaatgtggaagccagcatggttagaggccctcagcacagagaagttctttgtggcatgctccttccatgagcacgccaagaagaacgagaagaacatatgctgccttgactgctgcaccagcatctgcccacactgtgtgtcgacacaccgggtacaccggctcctgcaggtccggcgatatgtctaccacgacgtccgttcggctggaggaccttgagaagcttattgactgttccggtgttcaatcatacacgattaacagctctaagtcgttttcctgaagaagagaccacaagaataagcaatttaaggggtcagggaatatttgcacctcctgcgacangagccttcaagagccctatttctactgctctctggantgcaaggttgagtacatattacgggagaanaaagactgtcngcatacttcgtcannaagacttgaactggtctgactctcantcccangaagctatatagacgaccatcaacnctggtgatgtnagancctangatnacaann

SEQ ID NO: 87139 - DNA, 281 bp, Triticum aestivum
  unsure (1)..(281): unsure at all n locations
  Clone ID: PAT_TA_87139
ttttttttttttttttccctgcattacantaacagcaaanttttantttcccaacaagatacgcacctaccaanttcacaagcgctaatgtgtttnganatgntgtatanaatcaatgtggatcctacctttttctagttctatatatanaccaccaacacactaaaacnattcttgcanaatatagcatttcctttttccaantttacaggctnaccaaaattcacnggcaaccnatgggctnnattaacacgcaancgtgtggcgtcaangnatgtcag

SEQ ID NO: 87140 - DNA, 263 bp, Triticum aestivum
  unsure (1)..(263): unsure at all n locations
  Clone ID: PAT_TA_87140
gaagattgagtcaatanccaagttctatggtgctaatggtgttgaatactctgaacaggccnnaaaagcatatccacatgtacaccancncaaggcttctccancctccctatatgcatggcgaagactcactactccttttctcatgttccatccatgatccggcncgccatctgactttgtgctgctcgataacagatgtgcnggccatccatcngaactggnttcatctanccgctcgtcggnaccatgagcanantgcc

SEQ ID NO: 87141 - DNA, 199 bp, Triticum aestivum
  unsure (1)..(199): unsure at all n locations
  Clone ID: PAT_TA_87141
ctcagttgaagcccccanaaataacanaagttgtaaatgatgnagcctaagtcaangccaaangtaancctcgccgatactcgcanatgaaccttgggnaggtgaccatangatganngttaacangnacttcatgagctttgngtctttgcaagatttgggcantacttgttatctcaanaanggtctnactgagtag

SEQ ID NO: 87142 - DNA, 214 bp, Triticum aestivum
  unsure (1)..(214): unsure at all n locations
  Clone ID: PAT_TA_87142
cctgcgccagcccggcgtcccacctcanctgggacggnatccacctcaccggaggacgcctacangcagnctnaccgacngctggctcaacggcttccttctgccacncaggcatcacccactanccagtcactcncactgggtcgatcantcagcttatgcatcgtcntcnacggatccatcattaatcagntgcatgtcgaaggacnntatt

SEQ ID NO: 87143 - DNA, 154 bp, Triticum aestivum
  unsure (1)..(154): unsure at all n locations
  Clone ID: PAT_TA_87143
nattcggtgattatcgggctatccttgggcgtttcgcaaangcccatctancatttnntcctcggtggttgncgggcctccacnttccattatngtcgttngagnngttttgccttgggtggttgnatttctgtntgcagcntttcactatttt

SEQ ID NO: 87144 - DNA, 631 bp, Triticum aestivum
  unsure (1)..(631): unsure at all n locations
  Clone ID: PAT_TA_87144
gcagtacaaacaggttagcagctttccaccgtctctaattctcagccataacaagctcataggtgccatattgccgggctttgggagcctcaagaacctgtatgtattggacctcagcaacaacaatatttctggtatcattcctgatgagctatcaggcatgtctagcttggaatccttggatttgtcacataacaatctcaccggaagcattccctattcattgacaaagttgaattttctatcaagcttcagtgtggcatacaataatctgatgggcacagttccattaagagggcaatctcaacattcactggttctgattatgaggggaacccaacctttggtgggcacccgctttgggcttatccccatgtcaagtcgaatcatgctcccatcatctctgcaaacgggaaacgngaagaacaagggtctcatattaaggaataattatggnaatgcaattgggagcaacaatggtttgtctgttgctgttgtacctgcgttgaagagaagctcagaaggcaggtnatatattaaggcgttgtggatacaatgtacantcagttggaacagcgtcacngtacttcgtttcaaanaagatatacangnattncaacatgcattttga

SEQ ID NO: 87145 - DNA, 625 bp, Triticum aestivum
  unsure (1)..(625): unsure at all n locations
  Clone ID: PAT_TA_87145
gatagatgccgcgtttgaatccaccgtgactggtgaagcatatctattcaaaggctcaaattatgctcttatcaactactataagaaagaactcatcgctataactcccatagcagttgggtttcagtgtctgcgcgactctgagtttgaaggagatatcggtgctgcctttgcctcgcacatatgcaaggaggcttacctgttcaaaggtaacaggtatatcctccttcattttacccctggagagaacaaggactacattgttgacggaccgaaggacatcgtccctgggaaactggccctcgctcgatggcgtcctaccctgcagaaacatagggctcgatgttattggggtttccccatggtaacctttgcctgaggcatctaaccatggcaatcctatgctgggacgcgtctccccatggtaaccttgtgccggccgancactcccggatgaatctgtaataagtctatacatggatgtatgtctttccttttcccacttgtttaactaactctggacantgtgcaaaataagggtatttttgcttcaatcatgttgtanaacgttatgtttcngtttcngtatcaaagcttattgtataaatcggggnggttttcgctn

SEQ ID NO: 87146 - DNA, 433 bp, Triticum aestivum
  unsure (1)..(433): unsure at all n locations
  Clone ID: PAT_TA_87146
ccgctgccggcctccgcgctgtgcaccaacaagaccgccatgaagaaagagaaacggacgaggttcatggcggtgccggacgagatcatcggatgacgaagcgggacggggtgcttcatggcattcttgcctctctgtgagctctgcgtttttggcggaattgctgggtttggagcgtgagaagctgccgggaaatgttggcttcctatcctgtctccccagcgaattctggactaggaacggtncccatgaagcgacnacctttctctccctccctgccttcctcttatatattgtancactaagcatgacgagaaagaactcaaaagagaagaanaaatcactgtgcttagctaggccgtgtaaatatcccgctgctaatctaatgactctgcctngccaaaaaggngggggggcccgntancncttcacc

SEQ ID NO: 87147 - DNA, 609 bp, Triticum aestivum
  unsure (1)..(609): unsure at all n locations
  Clone ID: PAT_TA_87147
gtcttctcttctccagtaacgacaccacgcctgtgatctgagctgtttttagctatccagggtggatgccgactttatttctctctattcaacaactgtcatgagttccgagctgctttccgaccgtctcgtatagctgttgagtttctttttgtgacagtggcccttttctctgagttgcttttcggccgtcttagggaactgacactttcttcttatcaacacggtctcatgctctgagccgcttttcggccgtcttgagccatggttgacttatttcagtgatgtcccagatctgagttgtaacgaccgttctggtggctattgatttatttatcgatttcttgcaagggtttgggatgatcatttccctacggtcagaacttggagagacgatgaactgcaattgaatgatgttaccatgttagaagangaggataaaagtatgcctgtcagaatatacacccgacaatanctaaggtcacacnaagaacaatagaccaaatcttcagcaaancnccagacaaagaaaacantaagaagggtaagacggaaatgttnaangaccantggggcagtacccggaatcgatcacatgatacaagaagt

SEQ ID NO: 87148 - DNA, 255 bp, Triticum aestivum
  Clone ID: PAT_TA_87148
ccttcaagctcgccgccaacgccggcgtccgctagctagcgtcagtgcggaggcgctcctcctcctcctcctcgtccttccttgggccgagcagagcggaaagatggcgaagcttgctctgttttttgtccggtgagagaggcagagtattcgtgtatatgttggttcttcttagtcccctgtttcttttttattttattaatggtcttgtaatgataggaattataaactatactttcctgcaaaaaaaaaaaa

SEQ ID NO: 87149 - DNA, 445 bp, Triticum aestivum
  Clone ID: PAT_TA_87149
cgaaagtgtcaaggccgcctcctcaaccagaagcgtcgacaagaggccaccgcggtccacgtccaaacttggggaagcaagagtagccgccgccgtcctggctcaggcggcagcggaggaggcgcggcgcgtgacgcgtgagatgacgtgctccgagttctgcgtgaggaacgcctggagatttccaggcaaatacagcggctgcatggtttggtgtgaggaaaacccccacgtcaccaaacagatcaacaacaatgtcgacaagcatcgcgccgatggcgtgtcttctttcgcaaaatagccatttgtccgtcgtgagctgagctcgtttctatggcgtcccaaactttgtttgctctttttgtaatattagcttcaatgaacgttgtggttctgcagtctacgtatgtactgtgcttcttcttggatcgccaaaaaaaaaaaa

SEQ ID NO: 87150 - DNA, 425 bp, Triticum aestivum
  unsure (1)..(425): unsure at all n locations
  Clone ID: PAT_TA_87150
ggccggcggtggcatgccgttcggtgttgatccgtcggggggctcgacaggagctgggctccagttcttcaacctgccgatgggcatgccgccaatgcccgtggacgggcacaacggctggccgggcgctgccggtggcgtcgagaggccgccgttctcgtgacggatcttggccggcggtgaggacagcaggtgcgtccgaggacacggacatgtacaacaacagttagcctctacttcttatcacggtcgatcgattatctctttttcattgtgatgaaggaaatctcctgatattttttgcgttaacctggataaatttgggttggtgttagtttgctgggtccctgtttgtttaattggaatatatgttgcgagaacgtgcactcataaattcaccaatttaaattaanaaaaaaaaaaaa

SEQ ID NO: 87151 - DNA, 628 bp, Triticum aestivum
  unsure (1)..(628): unsure at all n locations
  Clone ID: PAT_TA_87151
ctctccgcccccccaaaacccactccggacccgatcgacgccccttccaagcaggccccggtcgacgtcccttcttccaagccggccccggtcgacgctccttccaaggcggcccaggtcgacgccccttccatggcggcccagggtggcgctcctcccaaggcggccaccggtcccggtctctactccgagatcggcaagaaggccagagatcttctgtacaaggatttcaccacggaccaagaagcttaccctcaccacttacgccgcaaatggaactgcaatcactgctacaagcacaacgaaaaaagaagtatccttaacgagatccagacccatttaagtacaacaatgtcaaagttgatgtgaaagcaattcaagactctcaagtgttaatcacaaccacatccgatttcggtacataccaaggcttggaagagaattgtgacatccctttggacaaacaanatccctgctaaggctgaattgcaatacttcaangactacnctggatcagtgtgggtttggcctacactcaaaactctgattaagttcanctctgggtggaacaaagctcttgctcctggggctgagttgctatgatatgaactggggattcacaagtgaa

SEQ ID NO: 87152 - DNA, 496 bp, Triticum aestivum
  Clone ID: PAT_TA_87152
gtttttttttgaacgatgaatccatcggtctgtctccaattgactcatcgttcaagaaaatacaagatcatctccattcatcctctattaggtccatgggttttggggtgagataagagagatagagagggatacacacaatgcaaacaatggttttgaagagataggtttttattgtggctgtcggaaaaacaacaaacaaatgacagctcacaaacgtcgcacctaacgtaagtatataacaggggtttgggtcttctaaaggtcaataaaactttaaagcttcaaactccgtcaagcttgttcatgtctccgatgactacttccgatcgtgcttgtccttctcaattcttttgccaagtcaactccgggtaacgcgaatctcttgtgacgtcctttaatgttcctgggagttgcattccaaactccggggtttcaacatccttgggcatgaacatggtcctactgtcctcaattcctggacgaactcctgttt

SEQ ID NO: 87153 - DNA, 447 bp, Triticum aestivum
  Clone ID: PAT_TA_87153
agcaattggaagaagtgctgcttctcttggtggaggttatcataaatgtccataagtgtaccattgccaggctacctgcacaaattgggccgagtgtgcctaacagagaaccttgggaatcatacgcactgcctcactggttcataatgttgaatgattcaaattgtaactttaggtgggtgtgcttactaataattttattgttagctagtgcttgtaaatgttaatgacgagtctggtttagcttgcatatttgggttctgatttttattgtgaataaataagatcaatgcattgtaatgtagctttatctttatttttatatttcacaatttacaagaattagctgcagccccaagggaatgtttcaccaaagggaaatatgacagccagggcttaatttggaggtggctggaaaagtgataatttatcctcaaaaaaaaaaaa

SEQ ID NO: 87154 - DNA, 627 bp, Triticum aestivum
  unsure (1)..(627): unsure at all n locations
  Clone ID: PAT_TA_87154
gagagaactagtctcgacttttttttttttttttttttttggtgccttttaaatgaaaatgtgcatgaagggtgtcgtccttggactcggatccaagcacatagatcatataatgggttttaggagaggaagtccaaccagacaacgcattcaacaagggagcaaaaccaccactatcaagaacaactactcaaggttaggcctaataatttcacccggacacatggaatttgatactcgaagttgccgacaccaacatgccaagaaagaatctcaagagtccttccctccgagaatactcctacaccaccgttggaggacgcctctgtcaaggaatcctccttgccacctacttgcatgccgtctttcaacgccctttatctgtgcaagcccacgacgaagtaaaaaaatgcaaaatgaagtgaccaatgttgacatctccnagtcgatcacatgatatctggacttatatccgggggaactgcatccttcgggccactgcatattacaacttctaatttagagatgtacntgcacataaagcgtttaaatggtgtggnaatccaagngcatacccaagggggggccggtaccattcccctaagtgagtctattaccgngccacgg

SEQ ID NO: 87155 - DNA, 621 bp, Triticum aestivum
  unsure (1)..(621): unsure at all n locations
  Clone ID: PAT_TA_87155
tctgcatttcgatctacatattggaatgaagtctatatcttcatcaaggaaaagtatgttctcgtgaactacgcgcctggatcaactaatgacaggatactcaatggcccacactacataggcgatagcttcccctttcttgtggggactgcttttgccgagtacgggatagacgcttctttcggttctcatagcagtgttgaagcaatcatcttttctggggaacctctgcgcacggataaacttccgcaccaaagacaccggtggttacattggtagaggggatcacaaccatcaagacagatgttccctttctttaanagggaccgtcttcngagaaggggataagatgccgcgtttggaatccaccgtggactggtgaaagcatatctattccaaaggtccaaatatgctccttatcaaactactaataagaaagaaccaacgctataatccccaatacaattggggtttcaagtgtctgcgcnactctgantttgaagggagatacggtgctgcctttgcctcgcacatatgcaanggagnctaactgttcaaaggtacangtatanccccttaatttaccctggagaagaacaaggctacattgttacgggccga

SEQ ID NO: 87156 - DNA, 642 bp, Triticum aestivum
  unsure (1)..(642): unsure at all n locations
  Clone ID: PAT_TA_87156
tttttttttaaggttagtaacccttgaactcttctattatcagtaaaattcacataggtcaagaaatacataggaattccaaaaaaagggctcgtgcagaataaataaaaagacacaaatagtcatttctggatagaactaaggagaaaaacaaaacaaaaatgtctcgcatacatagactaagtatatactcacaggcatgttcctaagtatatatctaataacaaagatgcgatgtccgatcaattaaacagaagttaatagtagtaggttgtcctgtaaagcaagtgaccatgttgtttctttccttgggaataaaagaggtgtaacttccccatgggccttaatcctcaactttcnaaccattggtatatgacattttgggtggattctgcacttcaaattggatagattcaataaaccttggtattacagttaccggacttagcgtgtactgctccaataaaccgggntaccttccngaatgaaagtgcacctaaagaaaggttaacacaattccaaagtccaatcccaatcatangtatatctcggaagaattcccaaaangttcagtacagatcctgggcacatatgtcactacaaaggggtatatgctanggccacatggacatgatcacatan

SEQ ID NO: 87157 - DNA, 598 bp, Triticum aestivum
  unsure (1)..(598): unsure at all n locations
  Clone ID: PAT_TA_87157
aacatgcagatcctgcccaccttgaagtcataaatccagtgaagtcaatttcagtatattcaggacatagccagtagcttagcaatttccacgagtatgttttgtttacaataaagttgtgtgcaaaatgtatatgctacattatgcatgattctctcttttatcaaagtatatccatgtgtttattttgtcatcccgttgcaatgcacggggaccttcgatttgattcagttttatgttctactacaaatagggaaatgtggacgctgggatatccatttcttaggtgtcaatcctgggtacttangctgtataatacagggcagantcttccagctactaatcacgtaatctgatttaaagcccaagcacttttccttaagcataagttacctaatcaatgggtgatcaaccatccgtcaacacacgccatacaaacaatcaaggangaggccgcttgttgagcatgcgccnggcgccaaaggcctgcgattatcaacccggggaccatcctggtccatcgtgggaagcgcttccacagagatcatgcgtcaaggaacttaccatgcaatcatgcgcacancntgtaggnggcctt

SEQ ID NO: 87158 - DNA, 334 bp, Triticum aestivum
  Clone ID: PAT_TA_87158
gctagttgtatatggtgtacattttttgggaggaaattatacaacacagcaagagctcagaaaccgcttcggtgaagatatttcatctgcgaagttggattatctctaccaagatcgcggcgaaaggaagatgttttggatctcatggtgtttggcgctgcgtttcataccagggataccgttttggtctttcttttctcgaatatatacttttttctcttttgtaaagttgtttttgtctgggttgattgggtttgtaagttgtgcactaataaactgggtgggtgccatatattgtgagagggtatcttttttgcactggaaaaaaaaaaaa

SEQ ID NO: 87159 - DNA, 379 bp, Triticum aestivum
  unsure (1)..(379): unsure at all n locations
  Clone ID: PAT_TA_87159
ggaagaagggcgccggcggcaaaggcggcggcgggcagaagaagggcgggaaaggctggtggcggtgggaggaaggccggcgacggcaaaggagggccgcgttgagtagtttgacaggaggcgtatggatgagcagctcggcgtgtcgcctgctgaaagttttcgcctgttggatggctcgctctctgctgccgaaatttttgcctgccctgggtagctaagctgtttttttttttggagctgtaatacgttgatgctatgagagctgtttcagtgtgtgagaaaantttgtaagttacgcttgtatccggacgattttgtgggacaataatttgttatcgtggtgaaacctggcagtatcataatcaaaaaaaaaaaa

SEQ ID NO: 87160 - DNA, 578 bp, Triticum aestivum
  unsure (1)..(578): unsure at all n locations
  Clone ID: PAT_TA_87160
ccatggccgaccacccgccctgtgccagacattccggcgatgatgtggccatcgtggaggcaggccaaggcatgatccggatgtttgtgcctaaacccgacacatctcgccttaaatacaacatttggcgaaacaattctgggatttctacccagtggcagatggagaagaggacattctcgctggattctgggtccttgctcacgggtgcggtggggaggcacttgctcctatatcagtgtggaagctccttggtcaagtcgggtgggtttcacggtggacgtcgacacattgcagtgtgagagggtgtgcgcttctttgcctaaaccgtctcacatatattgcaacttcccaccgtcgttattagcggcaccgacagtgtcaaatggtaaccttctgttgaatgccagaaactgctcccttcatatcactatcacacagttacagtcaaatgatcacaatatttatctcctcctaaacaaaatgtttgtcatgcaaaataatacgtactcctttccttgaaatccaantgtttcaattcaacatangttatctcccctcctgacaccancctgatt

SEQ ID NO: 87161 - DNA, 456 bp, Triticum aestivum
  unsure (1)..(456): unsure at all n locations
  Clone ID: PAT_TA_87161
cttttttttctttattcaatatctattctttgtttcttatattccgctaattgttatctttaatgtatctttatgcttaatagataactggtgatgctagagctgtcaagaaggcattgtttgcagtatcaaccatcatctacaaatgcccatcaaaagagaccatttctctggaaacttctgtccctccaagcattgtacatccttcagagcttcctgtctatcctgctagtaacttctactcagtgtcagatgcagctataccttatggaatggacatccaaatctagctatcttaagcaaaggaagtggcattcaaatctacaggttttcctctttagccttttccgcccagcgttgtcattattgacacgtttttgcgatncctgtttttgagatcctcaatgactaccaccaagaaagggatgtgaccacatcctaattaaaaaaaagaan

SEQ ID NO: 87162 - DNA, 493 bp, Triticum aestivum
  unsure (1)..(493): unsure at all n locations
  Clone ID: PAT_TA_87162
acaagaagctcatagccaatcaaagcctctccatctccgaagctccaaccgaaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcgatcatatcgatctactactaccataccatgtaacccgctacctgatccaaggccttatctatgcacctgactgcatcagcatcaagtgccatgccatcttgttgtaaacaagccccctaaataaatctccctggnttaactaaaaaaaaaaaa

SEQ ID NO: 87163 - DNA, 449 bp, Triticum aestivum
  unsure (1)..(449): unsure at all n locations
  Clone ID: PAT_TA_87163
tccctgttcatcgatatctactccanncgctgtgttgttcgaactcacacgaagccagaacccatcaantgctgctatctgcgcctgcggggtatctgctcgcttgctaagcccagacgcagctgcaagcgcgacttcanctgagaaagaaaactcaaccagttcagcttcagacgcaggtaagtcgtggtttggctggggcgcacaggcatcncangccgttgtacgatcaggagaaacacagtccgaggagcaacaaaacggctggtttggaagaatcncccgttccatatggggatgatcagtgaggtgctttgcaagcatcccacatcgaaccaacaaannacaaacaaacaccccccaaaatgatgatgatcccatcttccatcattgctgttgctgatagaccttctcgcacttgtgaataatatcctttccttttcaaaaac

SEQ ID NO: 87164 - DNA, 251 bp, Triticum aestivum
  Clone ID: PAT_TA_87164
gcaactccatcatcatcgaggtgttgaggtggaggacgatggccccggctcaacccgcgccgcactcgcaggccaccacgtgtcgcgcagcagcagcatccggctccgacatccagtcatccttcagctgcagaggagggacagcgtagcgccaccgtcgacgtcgagaaccccgccatccctcaagcatagatcttatgtagttagaaacaatgtgctgttggttgacgctcgaagggggggcccggtac

SEQ ID NO: 87165 - DNA, 575 bp, Triticum aestivum
  unsure (1)..(575): unsure at all n locations
  Clone ID: PAT_TA_87165
ttcggaggtcgagttcttaccgcggtatccggatggttgtagtcaaggctgatgtcttcggtggtatccggccactgttttcgtgtcccgaaaaataatttccacattcctttgtgtgtagtgccgaagaagtgttgaagagtccgtgacccttctggattaaactcccacatacggagaggccgtctctggcacggcagggtccgacgaaccagcattacctgaataacgttgataagatcgatgtccttctcaaggaggctccggacgcggctctgcagagtctgcacctcatcaactgatccccagtccaatcccttattaatccatgatgcgtgctgaatcggagggctccgatcgaaatgcgggcgtaaccgcccacttggaaccacggggctcggtgatatagaaccactcccgctgccataatcggaagatttgtggaaggnccttttgggcaaagacactattaacctgctcactatggcacaccgcactccgactgctccctctancaactgcgactcacatgaangtcttgagccanaaccgaagnccgagggntcgaggaangn

SEQ ID NO: 87166 - DNA, 398 bp, Triticum aestivum
  unsure (1)..(398): unsure at all n locations
  Clone ID: PAT_TA_87166
taaatccaacaattttcacagcacatatatatgacatatatagatatatttcacaangcaattacagagcaaacatataagatatccaacacataacttcatcatacatgcatagttccatccaaccataccaagttccatgcatagttccatcatacatagcatgttcaacatagaggcatccaaccatatatattacaatagtttcatccaacgatacatgcatagttcaacgatacaaaagaaatagagaaagggataaggagcactccatctatgcaagctttcgtcaagtgaatgaaatctgcaaaatgaaaaataagaaagttaagaaataggtgactaagaataagaagactanaacaagaagagtagaacanaaaaaancccaggggggg

SEQ ID NO: 87167 - DNA, 579 bp, Triticum aestivum
  unsure (1)..(579): unsure at all n locations
  Clone ID: PAT_TA_87167
aagagaacagcagctcaggactcatacagctatggttcccatgtgatgcaatacggttctttggacctgaatgctcaacaactctttttgtacatcggctcaaatcctgctaacaataacactacatttgttgaagataactcactgccgtccttctcaagagctgttaatcagagggatgctgatcttgtttacttctggcacaaggtacggtttataattatttcatgagaaatatctcatgttgattggttgtcacgtcatccctagatcattgccatactttacccacaaaaatagaatatgcataaataatctcagtacaaaaaagatgggaactgattggatttcttttcttctacatgtagtaccggaaattggctgagagtcccctggagaaaaacgatgcccggaaccaattggctccnaaatgacgagtcatagatcgcatatcgacaatangtccaactgattggaaacntctgtttgggtttgccgatgggccaatggtctaaagacgttcgccaaccggtgagcccttgttgatgacnggagttgtccaagtcncggtaggtcant

SEQ ID NO: 87168 - DNA, 594 bp, Triticum aestivum
  unsure (1)..(594): unsure at all n locations
  Clone ID: PAT_TA_87168
tttttttttttttttcacaggagatcacagaaactgtaatgcagtagagtccggccacccaggcacagctaagtttgtacaattttgctgcctacctcaagggcaaaatatctaatttgaactatatgcatgatgggctacatttagatcacaccaattttttacattctatggacaagagaatacaacaacaaatcaccacaacatacactcttatataacctatgtaaacagaaaacacagcagctttgccatctatgatctatcaactctattaattatgggtgaattaggaataccattgcccttcaaaactccatcatctaatcgcaaacctgaaagcgttaaataaactctacatgctagccaaacaaaatggaacttatgataccgttcttccataacaaatgggaggccaagtagagatttttgcccattctccttcacatgctggctcgggaaagcagatgttcctaagggttcctgcgttcatcagcaggcttcntccggggagctcaagataatgcgtcnggcccaggtncagcagtagcgtgatgcgataacatatccaacgccggtgaacncctcacttgg

SEQ ID NO: 87169 - DNA, 603 bp, Triticum aestivum
  unsure (1)..(603): unsure at all n locations
  Clone ID: PAT_TA_87169
tcagtttacttgtccctcttggttttctgatggagctaaaaggctgattcccaggattctggatcccaatccttctactcgcataactatcccacaactattgaaagacccatggttcaaaaaaggatataagccacctgtttttgatgagaaacatcaaactagtttggatgatgttgatgctgctttcggagactcagaagaaaaacaagttgaggaggaaatggaagggcagccagcttcgatgaacgcattccgagttgatatcactgaataaaggactgaacctacgcaattttttgaagctggataagaagtacagaagagaaacaagattacatcgcaatgtcctcctggaagaaacatcaatccggatagaagaggctgctaaccacttggctttggacatccaaaagaagaactacaagatgcgaatgaagaactaagaacaggaagaaaaggaaactaatgttgcaactgaggtttccaaagtggctccatccttgtttggtgttganctgaaaaaaggnaaaaggagatactctgggaattcagaagttcacaanacactctcgcacagataaaggatgttgtttggtttgn

SEQ ID NO: 87170 - DNA, 286 bp, Triticum aestivum
  Clone ID: PAT_TA_87170
gcaagggcctgcggtactaccgctccggagagcagtactatcgcatgccccagatcagcaacactaggagtccttcattttgcagagaagacaacaaagggaaacagtaaaaccagaactgccataacttctgcaaatgatctccgaattgagcaaactcaagcttgttggttatagtaagaagaggcaggggaggtatgcctaacaagagaggagagaaactccaacagagaagaaccgacagaacctccaacatcgaaaacatcatagaagatgcatgtgaatc

SEQ ID NO: 87171 - DNA, 618 bp, Triticum aestivum
  unsure (1)..(618): unsure at all n locations
  Clone ID: PAT_TA_87171
tcagcactccacacctcccacctacctcgcttccgccgttgaccatcgcctgagcagaagctttgagatggaggaagaagctttgagggcggcgatggaagacgctttcctggagggcgcggttcaatggcgcgcggataccatcctccagaccctgcggatggacaagctagatgcgtggatccgtggagaggggctttccgatgacatcgaggcgctaaaatctgagatcgatgaagtcaaggcgacggtctctgatgtaaaggggagggcgatcggcaacaggcggctggctaggtctctcgccgcgctcaagcagaagctcttcgacgccgatgacgcgatcgacgagctcgactactacagacttctacaccaggtcgaaggaggccaacacctgctgccatcttcgtccaacacgcacaattgcttcgcctccgacgattcactcaaccntgtacccaactgcaatgactaccccgttacttgcangagcctgaagnatcatgaagtacacaactagattatggacattgagggcatgatatatactgcaagaancggtctggnaaaaacgtcaagnatggatgatttaagacatagaatatatggaagact

SEQ ID NO: 87172 - DNA, 594 bp, Triticum aestivum
  unsure (1)..(594): unsure at all n locations
  Clone ID: PAT_TA_87172
gcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatgggaaagaagcttgaggatatcgttccttcatcccacaactgtgacgtcccccatgtttgaccgccaaagattatcagctgattgacataactgatgatggatattcagccttccnaactgagaatgggcaacacgaaggatgactggaacttccaactgatgatttctgcttggcanttaaagactgggtttgctgaaggcaaagacctgatctgtctgtgattccgcatgggtgaagaacaattgcctgtgaaaggaaatccgtggtggaantaaacaactgtgcgtggtgcctactgcatacttgtaccatgcttctg

SEQ ID NO: 87173 - DNA, 588 bp, Triticum aestivum
  unsure (1)..(588): unsure at all n locations
  Clone ID: PAT_TA_87173
ccgggacgaccacgggcgcgcaggacctcaccgcctcggatgctatgctgctaggctgcagagcagaagttgccttggatgctgtggctgtgctaagcctgctccgataacagcggtcgatgagccttcaaaaggtttgaggatccaaggccgctccataaggaagacaaacttgtccgagggcttctggagcacgagtgcacacgggattggaaacagcgcgctacaatcgcagaggagcatgtcttcaatctgtacagcgccgcaatccagcgaccagcatggagctggaagtagcagcaacccaaacgagtttgtaaatcaaggtcttgtccagtggaaccagactaagacaacagtgggttggaaacaaaaaatgcaaatctcgacttgaaaagaccaagaaccaaagataagttgggacacaacgtacgagacctgctangaagcaataaactaatctaccaaaccaatcctcntgcgggaaatgtagactgcntgtggacgtgtgggaacaagaaggactatacggntagacagggaaaagaacattgtttcagtcacgttatgagatattngatgtcagaa

SEQ ID NO: 87174 - DNA, 599 bp, Triticum aestivum
  unsure (1)..(599): unsure at all n locations
  Clone ID: PAT_TA_87174
gccacctgcaactacagaatctggtgatgtggattcacctccagcaatcacagactctggtgatgtgaatgctcctcgagcaatcacagaatctggcgatgtggatgcacctccagtaatcactgaatctggtgacacggagatggtggcacctcctggaaccgcaggtcctgatgaagatatggaggtggctgcctctccatcaatcacagaacctgataaaaacatggaggatgtgtcaccacctgcagttgccgtacccgtggatggcccagcagatgatgcaacaggattaatcatagaacatattgatggctcgcaggaggtccttcaagcaaatgaagaccaaggtgatactgtagaggttgtgcctccagcgttcaacagaacatctggccaagtcaaggatgatcctccttctgtggctactcctaacagtgggagagntgactccatgcatgcagcanttgaaaaaagatatggatgangttactgatgacagcctgggggatgtgaagtgaatgcatctaactttgtttcggagttggatgttgttcaagtggcgcccaagattgtaagggtgttgtggagggaaggaa

SEQ ID NO: 87175 - DNA, 435 bp, Triticum aestivum
  Clone ID: PAT_TA_87175
ccaacccaaccctggctttaagaacaagacttcgtctcaagctccaagatcaagtgctccgtatcaccctccgctttcagaggtcacgtgcaacaagtgccaacagaagggtcactatgccaacaaatgcttcaactagaggcgtcttcctcctcctcctcctgtgagattggcaagtacagttgtggtcaagcataaccccaagctcgccaaggtcaacttgatgaatgcagctcaggcagaggactccgtcagatgtcatcatgggtaaccttcctgttaatgatattcctgcaagagtctttttgacactggtgcatcgcattgtttcatgtcgagaccttttgcatctaagcatgattttgttactcaagtgttgtcgaaaccgttggctattgtctctccggcccgtcaaatgacatctccgaggggggg

SEQ ID NO: 87176 - DNA, 247 bp, Triticum aestivum
  Clone ID: PAT_TA_87176
ccacactctcagtacaacttctctacgacctcatgttcacaaatcttgtagtacattttttctataaaaatcttgtagtactgtgtaaagcaagcgtggccaacacatagtttaggtgtcgcagtagtacgcactgttgatggtggccttcctttgtggcgctactactttgccacctactctaatgacatgtacttgccaacaattatgtataataaatcatggcattatatgtaaaaaaaaaaaa

SEQ ID NO: 87177 - DNA, 592 bp, Triticum aestivum
  unsure (1)..(592): unsure at all n locations
  Clone ID: PAT_TA_87177
gcgcccgtctgcgtccccgacaactgccccatctgcgtcgagggggcctgccgcttctgcattcccggccaatcccggtgcgtgacctgcgtccggctctgcttctgcgactgcaacctggagacctcccagtgcaacgggatctgcttcaacaaatgcatgcaggggacgccgctgccctaggacnacgtaccctggtgatgggcgtgcgtgcatgcctgtggnagtgaggccgtgaccagccggcgggcaagcatgcgttccatcgattcgtatgatttgatattccacgtgcctgttgttctttttcgttcttgtgtcatcngtcgctgcttttcgttccgcttcgaataaggatcgatcnatnccggccatgcatatgcatgcaagtagtacanttatcatggggttgtcattaantcgtcaaacagtctactncntccaaaatataagtacagttttaaggctaacttaaccnaaaaaactctanatttgacggngaaataaacnntgccgtagtcctcaaagaaaaagtgtagnagtaccttgggtaaaaaaaaanaaaaaccagggggccggnccaatccccaaa

SEQ ID NO: 87178 - DNA, 565 bp, Triticum aestivum
  unsure (1)..(565): unsure at all n locations
  Clone ID: PAT_TA_87178
tccagaaggaatccaccctccaccttgtcctccgccttcgtggtggcatgcaaatctttgtcaagaccctcaccggcaagaccatcaccctggaggttgagtcctcggacaccattgacaatgtgaaggccaagatccangacaaggagggcatccccctggaccangcagcgcctgatctttgccggcaagcagctcgaggatggtcgcacccttgcggattacaacatccangaaggagtccacccttcacttggtgctcangctccgtggtggcatgcacatatttgtgaacaccctcaccggcaagaccatcaccctgtangtggatcatctnacaccatttacaacgtnaaaggctaagtncangacaaggagggaatcccccggaccancagcgtctcatcttnccggtaagcactttaggagggcgcaccttggcgggctaaacatcagaaggntcnacctcacttggggcccttnccttgnggcantaacnccnggcatgnnctgctctncccgggttaaattccggggncccgtaccccnagggntncggcgntcg

SEQ ID NO: 87179 - DNA, 437 bp, Triticum aestivum
  unsure (1)..(437): unsure at all n locations
  Clone ID: PAT_TA_87179
acactgctcacacacagagcaacgaacaaagcactacttactcactagagcacatcgatatctatacgatccttcaattagtccgatggcaaacggcancgggaaggcgacggcctcgtcctgcgcggcggcgatgagcgtgggcgcggcgcggacacggtggaggcgctcaaggagcgacgcgcctggctgtgccgatggaatcaccacgagctctctcgtgcgtccaagcatcggctttctaaaaatgaaataaggttctcccgcccatcccccggtgatacttctagcatcatcagaggacgtgtgaaggtattatcttatgggatccgngtcaagcgtntgtccgncgtggatacgcctgaattcngtcttccgtccgtccgcntccgtgtgtctgcnggttnggtcattccgatttancctctccttcattg

SEQ ID NO: 87180 - DNA, 647 bp, Triticum aestivum
  unsure (1)..(647): unsure at all n locations
  Clone ID: PAT_TA_87180
acgccgtgctgcagcacccgctgtgcacggagtcggccatgaagcagatcgaggagaacaacacgctcaccttcatcgtcgacctcaagtccaacaagcgccagatcgccgctgccgtgcaggagctgtacgacatcaaggtggtgcgcgtcaacacgctcatccgcccggacggaatcaagaaggcgtatgtgcgtttgagccccgaccatgaggcgctcgaggtcgccaacaccatcggcatcatctaaagcgcgtgtcacttgcccttcccgatgctctttgctcttgggagtcggcgcagttggccgcggagcagacgcagcagcgctctctacgcatggcgtgggacggcccttggnatgacagcgagcagctcgccttggctcgttctgcgcgcgcgcttnttgcgccntngctgctcccctctgcccctctctctcttggngccacggttccaagntttcaacttccgatgcaaccaaaaattcgaaaaaanananaaaaatcnagggggggccggtacaatcgcctatagtagtcnnttagcgccnaagggcgtctttaaagtctgacgggaaccngggttaccaattaatncctgagnaacccttncaacgggtatacnaaagccgncgtncctcaaa

SEQ ID NO: 87181 - DNA, 638 bp, Triticum aestivum
  unsure (1)..(638): unsure at all n locations
  Clone ID: PAT_TA_87181
ctcaacctccagtccaacaaggggctcctgcactccgaccaggcgttgtacaacgccaccgcaaccagcggtgacaccgaagtcatcgttaacagcttcgcttctgcccaggccgtgttctttaaggccttcgcctcggccatggtgaagatgtccaacctcggcccgtcgcctggctctcctcagggccagatcaggaaagagtgctccatccccaactaagatcaccatttgcaccgaaatgacagcgtggaccaacaacctgctgctgtgagagtccacccgtatttttgccgtacaatgaaccatgcgtgtcctttcagcaccttgcattgtagtaccacgtattccattatttcnatccttttcnatgtncactttttttaccccaacattcntcctanagttaccctccttcccggaaattcgtnntnacatactgccaatgataagtatttccggttngaaaaaggggggccggtaccaatcgcctanagtgatcntttaccccccnaatgggcgtcgtttanaattcggacgggaaanctgggttaccaagttaccccttgagantcccctngcaacgggnatacnanaggccacgntgcctccaaattncncctaatgnaagggacccc

SEQ ID NO: 87182 - DNA, 254 bp, Triticum aestivum
  unsure (1)..(254): unsure at all n locations
  Clone ID: PAT_TA_87182
ngtggagcaaaagatgtcgctcaccctgttcangaagaacgggctccgcgtgaacgtcaagccaagggacctcgccggctacgtcgcgccgccgccggaggaggcgccgccactggggtcagtcgtgatcccaaccaccactgccgccgctgcatagtcttgcgtctgcctacgtacattggtttctgaattctgatgcttgttcattcttcccgctgaatttgttcttcttcataaaaaaanaaanaanaaaa

SEQ ID NO: 87183 - DNA, 428 bp, Triticum aestivum
  unsure (1)..(428): unsure at all n locations
  Clone ID: PAT_TA_87183
ccgacttgaagttcatttggccacccatatttttggatataggcagtaggactaggattaggcctgagaggcatccgagaatgcaacgtttcagattcttgaagtgtcacgacattctttgtctggtcgtctagagacaaccgtacaaggtcttcaacggtatgtcatttaaccacctccgggttaggcgctacctctgttgtcgccttgaactccttgaggtggtggggatggtcttcggagtcatactgtatgagcgcaatgctcctatgaatccttgttgtttgcctgcaagttgccagggtcccctccatcctggaccttgcactccttaatttggttgacatgtgctggtatccgatgattaaccagtggtgctcccgccctgtcaagggtngncctcctctacaagaattgttgttaagncc

SEQ ID NO: 87184 - DNA, 231 bp, Triticum aestivum
  unsure (1)..(231): unsure at all n locations
  Clone ID: PAT_TA_87184
gtgcacgctgatngtggtggtcacagaagccacagccgatgaggaagccaagattgcnaaactcagggtcatgaactacaanaagctcacccggnagganaancagctcatgccgcancggcttancgangtcacccccaagtgggctcgcaaaaggaaagaggangaggangctggtgcttcatcngtatnacnaatttccgtttgcnncacggtccntcnttcattccc

SEQ ID NO: 87185 - DNA, 240 bp, Triticum aestivum
  unsure (1)..(240): unsure at all n locations
  Clone ID: PAT_TA_87185
ctaaggtggcnacgctgcanaaggctgccattgaaggcctgctcgagggaggngccgccatggccgcgctggactaggtggcgagcaagtggacaggtgccgagcatgcatgactangcgtcggcggatactttgccacctccanttctgttgtatgatttgttaagtnaaattctcatgcatgcactggntgtttgtaanttgcgttggaaatatttacgggaatccnattttgttcaa

SEQ ID NO: 87186 - DNA, 157 bp, Triticum aestivum
  unsure (1)..(157): unsure at all n locations
  Clone ID: PAT_TA_87186
tcgacgagttcatccacgcgtccatggatgagcacaagacctgcttcangaanaccattcanaanatgtttgggatgtcnaaggttgtcgcggngcggtccgctgcancaaaggaagctgaagtcgaaagcgctttgccccttcagaccagtgtgtc

SEQ ID NO: 87187 - DNA, 305 bp, Triticum aestivum
  unsure (1)..(305): unsure at all n locations
  Clone ID: PAT_TA_87187
acngggtcggccccctcancggcggcggccncnccgggcgtcancnacgagctgctcttcatctcncgcacccacgagcagctccccaccaccgactactgaccagcnagctcagcgcagccagcctgcttgcttgcntgcaagcccgccgcctgcctgcccgtccgtccgtgtgatctatnatcgctcctcgccttccttgccatcancagngantcntttaantttgcttcccngggtngatnantttgtggtganttcgngganctgtaaaaccgtggncgacactgtcaatttgcttcccg

SEQ ID NO: 87188 - DNA, 506 bp, Triticum aestivum
  unsure (1)..(506): unsure at all n locations
  Clone ID: PAT_TA_87188
ggccgccaagccgaaggccgtcaaggctgataagcccaagaagagaaaggaccccaacgcgcccaagggagcactcaccgcatacatcctgttcagcaatgccaagcgcgacatggtgaagaaggagaaccccgacatcgctttcggcgctgttgccaagaagatctccgagctgtggaaggatgtgacctcgtcggagaaggccaagttcgcaaagatggccgaggacgacaagaagcgttatgagaaggagatggccgactacaaggcgcgcngtggcggtgccggtgatgagaagcccgccaangaaggcanagaacccgccaaggccgcttccgagtctgacggcgangatgaggacgacgacgangaggangattanacaaaaacgcatcatccaccatccaagttgatctcccccngctcgacttcctcggtaatctctcctnncggtctccgttcgncgcattttttttgctcccgttggaatcctcaacgcggacgca

SEQ ID NO: 87189 - DNA, 328 bp, Triticum aestivum
  unsure (1)..(328): unsure at all n locations
  Clone ID: PAT_TA_87189
cccacccggcgccccaccgcgaccgccagcgaggagaccgacctacctagggttcgcgcctccccgccggtccccgcccgccgatcctccccccgccgccgccgccgccgcagcctccacgcccgctcccgtcggtcgccgctccggatccgcgcccctcgactccgntganctccgtccccgcccgcncggggccnctgaaagatgataaaccttttttaatatcaaggggcataagaaggaanatgcagccaactcaaatgggagggcctccngttancaagcanaagtccangggaattacngtntccatanantatanttgcgg

SEQ ID NO: 87190 - DNA, 201 bp, Triticum aestivum
  unsure (1)..(201): unsure at all n locations
  Clone ID: PAT_TA_87190
ctcaacaccaacacctgcgacgccggcaaagtgtgcgggcactacacgcaggtggtgtggcgcaagtcgacccgcatcngctgctcgcgcgtggtctgcgccgggaaccggggnntcntcatcaactgcaactacaancccccgggcancttcaanggncaccgcccgttcgcgttcctcagccttgacnccgnaagccaa

SEQ ID NO: 87191 - DNA, 416 bp, Triticum aestivum
  unsure (1)..(416): unsure at all n locations
  Clone ID: PAT_TA_87191
cccaaatccagctanctattggtatccgttcagttcagagcaagcaagcaagcctcgtcggcgacggcgccgtgtcngaatgaattgcaagatcatgcagaggctgacgcanaggtacggcgggtcgccggcggaggcaacagtggtggcgagacggctgcgtccaggcggtctctggggcagagggctccgtcgccgccgtcgcctctgccgaacaagaggctggccactaanatgccggctcccccgccacccttggcgtaattgtgaacgacgatcgactccctgttcanttgcgcgtgctgaacataccanccanctaaactttttttttttttcnganctgaactgaagagaacagcannancagattttcngtatgaagttcttnatattcgccaaataaaaaggggggg

SEQ ID NO: 87192 - DNA, 426 bp, Triticum aestivum
  unsure (1)..(426): unsure at all n locations
  Clone ID: PAT_TA_87192
tgtagatgcatctctctctctctcattgctagatgaactcatanattgatcttggtgaacctaggaaaattttattttatgcaacgttccccaacagaaaggcgtgtgccacagatcaatgacatggcacacatccatcaaccatccatccacatccatccatccanatatcccacaccacggtgacctcctccatccactccttcctcncaaactctaantcccactcccccggttcagatcgaaccganngcgacaccgcacanccttcccttccactgccanctcccaggcacttccncccttccaccaccgtcagggcaccttttcncttccgncaactcgtcntctcnnctgctctcgtcnctatcgannancgctcgntgtanntcctctgcncctcggcggggtgacccggatctgggc

SEQ ID NO: 87193 - DNA, 263 bp, Triticum aestivum
  unsure (1)..(263): unsure at all n locations
  Clone ID: PAT_TA_87193
gtggantcttccncaactggttgcattatatgatggggnaaccanatcangnatttgtgtgtcngaaatagttgactaccctctaaaagcacttgtgttcaccagcaccaatgttaatacacttgtcnangtagtgantgaancatgcttggagtttgcangagaacaatactgtgcacancccaanggtgtccancaacggcagaaatgttttcntanntcacccangtgnaanatctggncactgggtgctgttctttctg

SEQ ID NO: 87194 - DNA, 404 bp, Triticum aestivum
  unsure (1)..(404): unsure at all n locations
  Clone ID: PAT_TA_87194
cttcccaatgatcctccggccttgcctctgcacatctccacatgtcagccttgcctctttatcacacgccagcaanccgctgcctcatccaacccttcctctgctcccanattattanttttagaaaatgttggttgtttggttttttgcactatttgaacttggtcataaaaaggaaaacttttcangtaaatttcangtggtggnttccccttcctctacaaaaatcccatcctcttccctcanctctcttcttcacccatcgatatcccctcgtcctctcctcgtttggtgtantgccgccaccaggaggagtgccttgcccgatcnggcgcctccnncactgctttgatggcctcgtgcaaccgttgtatcnncnaacatcaancaggtcgctaacccag

SEQ ID NO: 87195 - DNA, 604 bp, Triticum aestivum
  unsure (1)..(604): unsure at all n locations
  Clone ID: PAT_TA_87195
aggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttcattcccaagactggtnagaactacaggcttctgtatgacaccaagggccgcttccgccttcactctgtcagggatgaggatgctaattcaagnncgcaaggtcagtctgtcaagttnggcanaanggcatccctacctaacactatgatggcgnacaaccgctaccanacctctcanaagcatgcactatcaantcactggngacaacagatgtgactcacaattcactttgaacggcatggactgcggccaaatggcgtttg

SEQ ID NO: 87196 - DNA, 319 bp, Triticum aestivum
  Clone ID: PAT_TA_87196
agcaaagcaagctgagcgtccagcattcagcattccaacttccaactcaactcacaggcttcacggctgacacacctcacagcccggccggcggcgacaaaaccacgcaggagaggctgccgttccgtgcgatccggccgagcaaaggtgccctagctacctctctcttgggcaaaggtgtctcctcctgattactcactcaagtactgcttcttccatgtgtgttttcctgtgtattttcggttggctgtgtgcatcttagttacgcagaggccggctgtgtgctcattgtgttatatatcctcttgatgcgtaaata

SEQ ID NO: 87197 - DNA, 385 bp, Triticum aestivum
  unsure (1)..(385): unsure at all n locations
  Clone ID: PAT_TA_87197
cgagaagggcaacggcaccatgatcttcaacgccttcgtgctctgccaggtgttcaacgagttcaacgcgcgggagatcgagaagaagaacgtgttcgccggggtgctcaacaacaggatgttcctcgtcatcatcgccgtcacgctcgtcntgcaggtggtcatggtggaggtgctcaccaggttcgccggcactaagaggctggggctgnggcagtggggcgtctgcctcgcnatcgccgctgtgtcgtggcccatcngntgggcccgtcaangttcatcccccgtggccgggaccgggactcctccatgacatccttantcggccggnnatcctcatggattcantcaatnctaccgcagtgttcaatatttaacagagcta

SEQ ID NO: 87198 - DNA, 398 bp, Triticum aestivum
  unsure (1)..(398): unsure at all n locations
  Clone ID: PAT_TA_87198
tggggtcgaaggaatgttgggacaacttagtttgaactgaatttgctatatgcactgaagttcctggagattgtcaagggattgattgatcagaaaaatcattgctgtttcgcttttgctttgatttcttcaggtcgtttcgttctctccgtaatctatgtaacctgngcagtccagttcttttccttccttttgttgttgttttccgtgtctctgccgtgtgcagtggggtcgtgtaatctgttcancttcagtgtagctacttcagttgaggctgtagcaatctgagattagttttttttacttcntaagttatcggggatctattggctganggtaagtttaaaaaaatgtatgcggccangatananattattaacctaanccagatnactaca

SEQ ID NO: 87199 - DNA, 263 bp, Triticum aestivum
  unsure (1)..(263): unsure at all n locations
  Clone ID: PAT_TA_87199
nncaaggnaganacgagatacttctgcacatgtcncagctcagaaactattggcacaagcattaantggaggactaacaacgagtaacactgaagtaacagcaaactgcangcatgcaagcggcaaccccngctanggtttgatgcatctgcacctttgcannnatggatttcatcnaccantcggccatnccttttcagctgntgactgcacacnaagtgcactatnactagnncaatcaacngagcactgccggggatact

SEQ ID NO: 87200 - DNA, 645 bp, Triticum aestivum
  unsure (1)..(645): unsure at all n locations
  Clone ID: PAT_TA_87200
ttttttttttaacatcaagtcccactttacntcaattagtataattgngttgcacactagtaggattccctacaattgtcacctacacatacttggcngttacaacaagaattgtaacagtgcatatgttggctanacaaagaagtcataaatattgcatcaaatacntcatctctcatgantgtgttnaatccttcaggtaaatcctgctgaactacngaactttgcacatacanagtggttattttgtaggnaagcaggtgcctcatgatgcanggaacttngtgagtcacagtacactcttagnctccgctgtgccgcgagcagaagacttgagcctgtcaagccgtcttccanaggaagacggtctgantgcnaacgttattccggaccattcctgtacccacancaatcctgggcaaaanatcactgacncctcctttgncagtttcaacanatnccagncacnttgagtcctgnaagganncaatcaattcaccattacancaaggacctccggttgctggnaagtgatccacngatccctgactcccacatanacncgggtgctcagattcacggctgtcaaaatctgttgtgtccanagttcggatgncctanaantcagntaagntttaggtcntn

SEQ ID NO: 87201 - DNA, 406 bp, Triticum aestivum
  unsure (1)..(406): unsure at all n locations
  Clone ID: PAT_TA_87201
agagcgtggagacgtncaagatctacatcttcaaggtgctgaagcaggtgcacccggacatcggcatctcctccaaggccatgtccatcatgaactccttcatcaacgacatcttcgagaagctcnccggcgagtccgccaagctcgcccgctacaacaagaanccaaccatcacgtccagggangatccagacctccgtacgcctccgtcctccccggcgantcgnccangcacncagtgtccganggcaccaaggccgtcaccaagttcacctcctcctagaccacgatggtctctgtaacantcacctgtttanaccatgtcgtcctgtacttgcnttggtcctgtgggaacacactgtttcattacctcaatgaatgnannggggctccttttgtcaaaaaa

SEQ ID NO: 87202 - DNA, 642 bp, Triticum aestivum
  unsure (1)..(642): unsure at all n locations
  Clone ID: PAT_TA_87202
cgccgtcacgccatgtcagagcacctgtgcctgcggagtggcggaggcatgtgcctgcaatgacgagggaaggagaaggccaggagagtcccctcgctcgaggccgcaggggcattgctgttcagttttttgttcttgtttttgctattgaaaatcttcagtgcgcggcgagggatggctccggggctcctccggcgtcctccggtgcctgatttcctccacttcctctgttgtgcaagtccgacagcactcccagcgttgatgcagctcacttcatcccgtatcgggtggtttttgttcaaactgcagtcacttcggtcacagcgtctgggcaacagcgtgagggtgcgggcgcccttccctgcatttggcgatccactccacaaatgagtcgtcaaaagtnnaagagcggcagtgtggtgccctttcaatttcagtgatcaatcatgcatgcttcagtgtggcagcgtgcaactagactantgtcatctacggcctcaagcncagnctctctgtctngtcnncccgaggaaaaagncatgcataggtggcgngacnactanctttagaataacttgntagtcaattacagttgggtccttgnganctcatnanttagggatantttaagnggtaaanang

SEQ ID NO: 87203 - DNA, 602 bp, Triticum aestivum
  unsure (1)..(602): unsure at all n locations
  Clone ID: PAT_TA_87203
gttctatctaccttttcatacaaatgtcctcccagatgaagctgtaccaggtggtcggccgcaaggcccctaccgccaccgatgagaaccctcctgcttacagaatgaagttgttcgctcgcaacgaggtcactgctaagtccagattctggtacttcatgcaccagatgcgcaagatgaagaagaccactggtgagatcctcgatgtcaacgagattgtggagaaagaaccccagatacattaagaactatggcatctggattaagtacaactcccgctccggcactcacaatatgtaccgtgagtacagagacgtcactccttaacaacgccattnacactttatataacgacatggccggtcgccacagattccgcaaccagtccatccagattatcaagactgccaccgttcccgccaaggactgcaagagagtgtctacctccanatcacaacagcagtccgctcccccttctcacgnatgggagacttctccaagcaagncgatctgtatccgcaacagactacaccactncagtaatggttgtatntggtggttagaaanattcgncanaatgntgctccagttgnggtaacctt

SEQ ID NO: 87204 - DNA, 631 bp, Triticum aestivum
  unsure (1)..(631): unsure at all n locations
  Clone ID: PAT_TA_87204
agcttagaggaagaaagagcggaagagctccctgcctcccgtcaggtggtaaaaggagacaataacaaggatggctgatgcactgggcagcgtgacaaaggctctcgatattgtgttcaagatcaaagaggctgtggatacagttaaacaaaacgaaaaggattgtgaacagatcaagaagcgtgtggagagggtccaacacacgctcactctgttccaacaggatgtggagctgatgaactccgcggggagccgcactgcactggaggcgttgcgtgaggtcctcaccgaggccctcgagctcgtcacaggctgcaaggaagagactaatctgtgttgtctcctcataaaggctggggaagtgtccaagaagctgaacaaggcanacaaggcatatctaatataaactctgaagtgtcgcttacatcatctctcattgcgccgcacacacaaaccacttaaatctacaaacacggataacatggcgtcgctcaattggcaaacaacacaaacgtgcactacantctgaatngcggggaacaggaacgtggcanatcaaaggacaggaaangatgaattanacnttgaagggtaagncnccttaanttggaatanactanaggcctcattg

SEQ ID NO: 87205 - DNA, 405 bp, Triticum aestivum
  unsure (1)..(405): unsure at all n locations
  Clone ID: PAT_TA_87205
gctgctcaccgggtcgccggagacggccatgtatgtgaaccagttcgccgagagcccggacgcgttcttcgagacgttcgtgcaggggatggggaggatggggcagctggacctcaaccccgacggcaacgtcaggctcaactgcaggctcctcaactagcccgcccgcccgtatatatataatatatcggcatgcaagataagtacgtatatatagcatggccaggccaatgtaataataagcctacacgtacgtatatatgcatgcgtgctccatgcatgtataaacgtgctaagtangtaagtgcaaccccagtatatgattgatcatatgtgtacacttnaacttctgcatgcatgcaaagcatgatnaaagaaacgactttcaaaggagggagaaaaaaa

SEQ ID NO: 87206 - DNA, 556 bp, Triticum aestivum
  unsure (1)..(556): unsure at all n locations
  Clone ID: PAT_TA_87206
gtttttttttttttttttttgttttaaaataaattgtgaaataagagcatgttcacaaataaaataaaaaaatcatgccatgtcccgacatgctactatagtacactttcatgaagacggttttttcacactcagtaatatcaaaagaaatgtcttacattatgagagggacttagcagaacctggctagccactagtctagtggnaagggcactcngaccaccggaacaagcagaaggtcacggngcagccgcacggtgactcccatctcctccgtcatgtcgagctccccgggctccgcnccgcccgggcagttcccaagtcnaaatggtacaggagcccggcgagagcgagctcaacattggcaagncgtacgacatccccgaggnaatccgccngncgncccgaacgngtgtactcaagtccgccccttgaatcnattcgccgatcgggggggggcccngnaccanttgccctanaggannctttagccgtnaanggcgtcnttaaaaggcnggnnggaaacctgngttaccaantaangctncanaaaccc

SEQ ID NO: 87207 - DNA, 488 bp, Triticum aestivum
  unsure (1)..(488): unsure at all n locations
  Clone ID: PAT_TA_87207
tttgtacaccgagccctatttcgacggtcgagtggtacttggtattcacatccttggcagtcattctttcccagctcccgaatctcaactcgattgctgggctttcgcttatcggtggcgccacagcgataatgtactgcaccatgtcgtgggttctctctgtgagccancaacggccggcggcagtctcttatgaacaagtgagatccacttcttttggctcatcactgttttctaccttgaatgctcttgggataatagccttccgcattcangggacacaatcttttgttgaactgtcacgttcattgtatgtacacttgtgttgatgattatcctgtaatctgttgtaactaggtaggctagcctcaggatcctccctatctaacgcaaccacaacgagactgccctgaagtaggggtctcaattaaattaaccnagctccgctctctcgcaataacatagagtttangntcaaaaaaaaaaaa

SEQ ID NO: 87208 - DNA, 567 bp, Triticum aestivum
  unsure (1)..(567): unsure at all n locations
  Clone ID: PAT_TA_87208
cactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaagtctccggcgtgcccggcaagtgcggctcagcgtgccctccccatcagcattccacaactgcaacaatgnaactagtcaatatataatccttcctacgtcatcaaggacgccttgcgtggagctaattcacttgatggantctcatacatgtgantctaaaataaanaanttcctgntngttattcatangngcaagtcgncctgcaacaacg

SEQ ID NO: 87209 - DNA, 561 bp, Triticum aestivum
  unsure (1)..(561): unsure at all n locations
  Clone ID: PAT_TA_87209
cctcctcagtcctcacagcatcctctcagtccttagcttccttccctcgccgccacccaccaaggaaaggaggatgtcttgctgcggcggcaactgcgggtgcggcgccggctgcaagtgcggcaacggctgcggcgggtgcaagatgttccccgacgtggaggccaccgccggcgccgccgccatggtcatgcccaccgcctcccacaaggggagctccggcgggttcgagacggccggggagaccggcggctgcgactgcaccacctgcaagtgcggcaccgcgtgcggctgctcctgctgcagctgcaactgaagccggcgcccaaggaggccggccggcagaggcgagcacgangatgangaaggacaagcaacaagcacatcaccaccagttcacaacaccagcgtatcatcacagcgccgcatgcgctcgcgggcgcgcgcgctgaataaataaaacaccgttcgtgttcgtantctgtatgcccttcnctgtgtcgacaatatgtcttctcgtgctcacttcaaggaatattgcgctnacttaaaaaaaaaaaa

SEQ ID NO: 87210 - DNA, 600 bp, Triticum aestivum
  unsure (1)..(600): unsure at all n locations
  Clone ID: PAT_TA_87210
agaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaggggcaacggcaccggaggcgagtccatctacggcgagaagttcgccgacgagaattctccacaagcacaccaagcccgggattctctccatggcaacgccgggcccaacacaacggtccagttctcatctgaacgtccctgcaantggtcgacggaagcactggtcttcgcaagtctcganggatgacgtctcaagaantcanaagtgggtccgancggactgtcaacagtcntaacccgantgggcagtcaaatcgccgccgcggtccntttcgcatnncctggtcctgtcgtcgcattaanaaatccgnncgcntcctg

SEQ ID NO: 87211 - DNA, 217 bp, Triticum aestivum
  unsure (1)..(217): unsure at all n locations
  Clone ID: PAT_TA_87211
accatcaatcaatcctgaattaaagacctcctacctgctccccaacggntaccantccaatccaatggcnacgacnccggcncgnccatcgcagagcggggccggaggaggcggtggcgaggcggtgtcggtgcagcangtggncaaggcntcctcnnacganctgctccgcaagttctcgacncggacnacgactacgacnccgccaagnagggac

SEQ ID NO: 87212 - DNA, 432 bp, Triticum aestivum
  unsure (1)..(432): unsure at all n locations
  Clone ID: PAT_TA_87212
gttgtggactccccttgctgtctggtgactggcgaagtatgggtggacccgccaacaatggagagggatnaataanggccaagcctttaggggaactccnagcatggttggctacaatgtcaagcaagaagaccatggngattaaacccctgagaaacgccatcatggacaagctccgcaaagcgcgccgnacgcccgacnaagaacgacaagtcantcaaaggacctggtgatgctgctccttcnanactccctgctnacctccgggttnagcctttagggacccaacaccttttggaccaaggattcaccgcatgctcaagcttnggcctgagcatttacaaggacaattaggcnccttanaacgacaccgaatnccncccctgaggacaacctgnttaaanaanatgaggagttcaanaaacncaattt

SEQ ID NO: 87213 - DNA, 278 bp, Triticum aestivum
  unsure (1)..(278): unsure at all n locations
  Clone ID: PAT_TA_87213
gtccccgcttcctcctcctcttcctcccgctcactcccgaagcgaagcctcgagaggtcccaatggcttccaccacattctcctccgccttctccatcctctctctcccctcctcctcaacatccccctccgcctcgggccccaaggaacctaacccgtcgccaaancggcgncgccgcgccgtncccgttccctncaantgcaanggagtncccgaaaggncttnaactncgggaanccaattgcngggtnaacctttaagnaggtncnaanctttt

SEQ ID NO: 87214 - DNA, 622 bp, Triticum aestivum
  unsure (1)..(622): unsure at all n locations
  Clone ID: PAT_TA_87214
agcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcnnagttcaagcaaggttgggtttatcttcccgtngagcacaacgcatcccctgggtactacgatgggcggtactgggacaatgtggaagctgcctatgttcggggtgcaccgacgccacgcaagtgatcaacaagtggaggagtcaagaaggagtacctgacgcgtatttcgcatatcggatcgacaacatcgcaagtgaatggtcnctcatcgcctnaagcaacggctcaagatccgcaaggctaaacactantcacacggcacattaaggcattcggtttgaactcgnattctttgtttctttcattacctcctgttgtccaaa

SEQ ID NO: 87215 - DNA, 586 bp, Triticum aestivum
  unsure (1)..(586): unsure at all n locations
  Clone ID: PAT_TA_87215
tttttttttgaaaaaccaccgcaaatctgctgttaagaagctttgtgcatatttcccttccgacatctgctatcacccctctggacccttgtttaatcccattgaaatcgtcgtcctcgtcgcacagatcaaagatggccatcacagactgcggaagctccagctgttggaaccgaaaccctctagctacctctcctctcactcgaacgaaggtggaagaagaagaacaatggacacaaggttttccggccggcgcacgaaacgccgccacggggcgcacacaagatggccaacacagactgcggaagctccagctctccgctactgccttttgnagggcctcaatgcttngcaatacagagcaatccacatggataaccttgtnaacttngattttgatactcaaggtgtgggnaataccttganttgccacggatgcncaaatccagacaancaaggatgtanaantgttccttggtggaaccccnaaaancattactttcggcgganaancatgtttncccgnatccgagngccaataangnggggacaattaacctnaaccagggnntangttgagtcaaca

SEQ ID NO: 87216 - DNA, 533 bp, Triticum aestivum
  unsure (1)..(533): unsure at all n locations
  Clone ID: PAT_TA_87216
ctcgccgtcacgctcgccgtcgtaaggatgtacctcggctgggcctacgtcgggaaccgcctgctcagcgccaccgtcgagtatgaggagacgggatggtacgacgggcagatgctatgactgctcaagagcaactggcttttagtgaaccaagcagcgggatgtaaggggtttgaattgtggaagcgactggcggcgctgaatacagtataatataagtggcgtgacgccaccaaaatatcactggataagtaatataattagcatcacaccatcaaaagaccactgagtaattgaccgagatagcatcacgccaccaaaatatcattcacaatagttgttcgcttgcttataagttagaactcctgtacctgaaattactggatgttcaaatgggtacntaccanaaggacgntnactgagtttannaaaaaactcccnaggggggggcccggtacccnaattcgccctaatagnggagtcgtnttacgccggngtcactgggccgtccgttttanaacgtcncngaactg

SEQ ID NO: 87217 - DNA, 521 bp, Triticum aestivum
  unsure (1)..(521): unsure at all n locations
  Clone ID: PAT_TA_87217
gtgaaataatgtattacttaattcataaaattcatataatcaggaatagctatctttgttgtatctactgggccaaaaccaaccttggtcatagttttaccttcactacgagcaaacttagctaggctatcgctaacctagatgagtaatacaagtttcacccgtgcaattaccccggttgacagcaagagcatgcaacgcagtccgaacttacacgtgttggccctagcccggatcaagtgcgtgaccctcgccggtgctacacatattggcctgctcaagcttgcccgttcgcggtcgccgcgaagtgctggggatacctttgcgccagtccgaacaggccgagggttccgccggtgtggatcatgggcactttgggccctctgccgtctccgcggacagatcacggctgctccaagcgggcagggtgtacacnggatcaacaagatgctgttgctgagccactgccggaacacgcgattcgcaaccaagaacntgccgaanctctcgngaaaaggggg

SEQ ID NO: 87218 - DNA, 518 bp, Triticum aestivum
  unsure (1)..(518): unsure at all n locations
  Clone ID: PAT_TA_87218
gccgacgccgccgccgccgtcgccgccgccgactgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgcctgatggcggtggtgcacaacccgcgccagttcaaggtgccggactgggtcctcaacagaaagaaggactacaaggacgggaggtctcccaagtcgtgtccaacccgttgggacatgaactcaagnatgaccttnaagaggtcaagaagtncaaggaacatcgntggtctgctcactactggggtgttncgtgtccgccggtcaagcacaccaagatacgggcaagagaggaaagctgttgggngtctccaaagnangcgaataagctgcttaanaaagg

SEQ ID NO: 87219 - DNA, 527 bp, Triticum aestivum
  unsure (1)..(527): unsure at all n locations
  Clone ID: PAT_TA_87219
ttggagggggttaacataacattcagcgaaacagtagtcaacttccacggcggaaaaccgagtcttctcacgcaaatacataccacggctcaagagtttacagtgaatatatggacgaatcacctgattgtgcgttgcttgttttcattcatcagggatcgaacagagcatcttgagcaatcagtttcagtttattcttaacaacgagtggcggcttcagtcaccgctggcacaccccttgcacccgcagtgggacacattctatcaccgtctcttccctgaggtgcttggggaccctgcagacgcaggtggtcgcgaagttgtggtctcgtgtcctgtatgcagcggaggcagcagaggcgctcataacctggcttagcattgaaacttggtaaactccnggtgattactatacanactagagagagaactggaacatgatccaacatactgtaagnctttttcaatttagcaatcaanatttttggnctggcataaccttggtccaaagcaaaaaccatacagcc

SEQ ID NO: 87220 - DNA, 507 bp, Triticum aestivum
  unsure (1)..(507): unsure at all n locations
  Clone ID: PAT_TA_87220
ccaggttgaagttcctgttggcagaggaaaaccaccggtacttgttgaaaaagacaagagcctagagccctagacagggtaatttttttcaaacacaaaagctggaaacaatgaactatagggctatcccatgtttttttgttagcagtgtctgtaaatccttttaaaacaaccaaattattctgtaaaaaacaaattatgtctgtctccattctgtatcaagtgttttcatgcattctgtagcgaaatataaaatgtaccaggctcaaagaaatattaaggcagtacacactcctggttattggcaaagttgctgatagttgtcctgtagttaattaaaacaaggaaagtatgtcatttatcctgtataacctttttaatgttatactactactaagtaataaggagnattttaagcctcttaagnttggcccaagcgaaacngaggaagtccgcccaagttcaaaggagaacactggtaccgttactgctgggaaagctccanga

SEQ ID NO: 87221 - DNA, 321 bp, Triticum aestivum
  Clone ID: PAT_TA_87221
gccaagcgtaggcgtgctatccatgtcgttcaggggtcggttccgagccccggcgtcggccatcactagctcctcgatcttctaatcaagtgaataaatttctttacattttacacatctcgatctataattctatatgatggtacatatgccgtccaacataatggctagctagctgcagccaaagcttagctattgaagctacacaagcatatacatgtaaaaagggcatcatgctcgcactgcctcgatttgtatcttattttaagttattttatggaccggctatatgtaagttgcctgaaagttaaaaaaaaaaaa

SEQ ID NO: 87222 - DNA, 412 bp, Triticum aestivum
  unsure (1)..(412): unsure at all n locations
  Clone ID: PAT_TA_87222
aaccctcgcaaaccaagcccctgccacttgcaacgcacacttacaccgcttgcagagctccagctcgacctctagctagcatccatggcgcagcctctcactcgccgccgtctcctccttcctccgcctctgcttctgctgangctcctcctcgctctcgccgcccaacatcaggncgnttccgacccaggggagacccanggnggtatgcgagccagcggnaccaggtccctgctccagcagcagccgcctcctcccaggctagactgccccaaggtgtgcgcgggccggtgcgccaacaacnggaggangggagatgtgcancgaaaggtgcaaangtctgctgccaggcgctgnaactgcgtgccccccgggaaccgggcagnanncccgccanatctgccccgggnta

SEQ ID NO: 87223 - DNA, 531 bp, Triticum aestivum
  unsure (1)..(531): unsure at all n locations
  Clone ID: PAT_TA_87223
ttttttttgaaagttaaacagcccacagcccgaaatcaataatttcactgcaaagtatataccacagcaatgtacccaactatttcgaaggggtaaaaatggacacagaaatttcacaatccacaacaaggtagaaagtgaaacgtgaggaaagcaaaacctccagacatgagaagcacgcggctcaagctttaacatcgcactgcctgaaatcacctcactggaaggccttttctgggtgaattccatcgattttgggaatgatgagggaagtccgtgcggcatatcttcaggtttcaagaccagctcctctcaaaggcctgcacgacctccttggtgggaccaaggcgtttccttccggcgtcaagatgcagtccatcacttaagtaaatttctgccaaccttcaagctgcntgcatctttggaccaaatatcaatgcagtgaacaccaattccttggctaagtcctaagcattgacctgcatagacaccaaccattcaattgtcccttcaaggaacctctcgcatctc

SEQ ID NO: 87224 - DNA, 522 bp, Triticum aestivum
  Clone ID: PAT_TA_87224
gcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggccactggaagcacagtgacatcaagctcaaggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaagtggtcatctctgccccaagcaaagatgcccctatgtttgtggttggtgtcaacgaggacaagtacacctcagacgttaacattgtctcaaatgctactgcacactaactgcctgctccctagctaagatatt

SEQ ID NO: 87225 - DNA, 471 bp, Triticum aestivum
  unsure (1)..(471): unsure at all n locations
  Clone ID: PAT_TA_87225
ctgaagcttatgttattcacaatcgcgtggctttagaacatccatgcatgtcgagtaatattcttcgattacaatagcagctccagtgtggcagtaggcgatggtaaaaactgaagtcgggaatgagtgttgctgggtacatctggcagcagatattctgaagtttgttggtgaataacaaatgccacaacatcagttgatgtcattggggtcgtgcgggcaagcaacattctccacctgggtgtactctctgtctctttctctttgcagttctaatctatttgtagattctatctcacgtacctgtcatagtagcatactagtagtgttgtatggtcaagctgtgttaagggagttgtggagcgcactataatgtctagttgaacccacatggtcacttttaataatcctaaactactccnganaaaatttatgtggtatccttttcctcaaggaagccatttttagtcc

SEQ ID NO: 87226 - DNA, 509 bp, Triticum aestivum
  unsure (1)..(509): unsure at all n locations
  Clone ID: PAT_TA_87226
attctttcgccntttactaangaataccgtgtgcacgccacactgagcagcataccctaatttttagagggtgttttctccttgtgagaaagcccccccaattcaatgtttcaaatgttattacagatctgatgtttggtgtgancccttgataaattagggnaaatcnaangtgttgctcctgcgtanggaantatttgtagtttctagtttttcagaccttacgcccgtgcantggaatttctgcttgggtttgtacttccgttctgaattacttgtcgcagatatggatgtatctagttctagacattanggatgtatctaagnactatcttgntgtctcttcagactcaattcaagancgtggnttatcgaanaacattcaancannacgatatctgaatctggattaagncttcnagctccngattgnttgtctcaggcttgnaagcccaantgttgcacccgaatctccccnggtncctgttcaaggtccggntcttggagtn

SEQ ID NO: 87227 - DNA, 526 bp, Triticum aestivum
  unsure (1)..(526): unsure at all n locations
  Clone ID: PAT_TA_87227
gaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggtttgaggccgccggcgccaccctcctcgtctccgccaccgccacccacaaggcgagctccggcgggatggagatggncggccggagaacggncggctgcggctgcacccaagtgcaagtgcggaccagctgcggctgctcctgctgcagctgctagattcatcatccgatcatgcatgcaaccgtgccgtgcgtgcaacaatcgatcggtancgatctactactaccatacaatgttaaccgcaactgattggaaggcttnagttangcacctggactgcatcagcaatcaaggtgccatgccatgattgtaaacaagcccccctaaaataaaactccctngattaactatnanaagaaaaaaaactcnaggggggggccggtt

SEQ ID NO: 87228 - DNA, 513 bp, Triticum aestivum
  unsure (1)..(513): unsure at all n locations
  Clone ID: PAT_TA_87228
gcaccgggtaccaccaaaggatcatcatcagctgtagacacagtgccaacctctgccaataactatccatcatcaaagtttgcaaataaggcatctggtgcttccataacaaaagggcatcttccgtccagcaagtttgtggttcatactaaccaagggaaaggaagcctttatcaaagtaaaggcattaatttgaatgaaagtggtagaaactgcaacgggaatgagaagctgaaggccagaagcaagctaaatgaattggtgaccgtgacatatcaagataaacacaatggatgagtcaaaaattttttttggagcccaaggagcagttcgttttgggatgtcaagtgtacaggaggttaacgaatgacataccttcactttgttgcagtaaggaanagatccatataacctccctggattttggttacnaaattatgagcaantttatcctccgcattaanccttatatgaggatgatatcacaagagtacaaatacaatgtttgggcaa

SEQ ID NO: 87229 - DNA, 471 bp, Triticum aestivum
  unsure (1)..(471): unsure at all n locations
  Clone ID: PAT_TA_87229
acaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggtggcatggagaatggcggtcgaagatcggcggctgcggntgcacccagtgnaagtgcggcaccagctgcgnggtgctcctgctgcagctgctagatcattgatcatcgatcatgnatgcaccgcgcntgcagcatcgatcatatcgatnnactactaccataccatgttncgctactgatcgaggncttatctatgcanctgactncatcagcatcaggngcnatccatgcntgttgttaaaaggccccctanataaaattccctg

SEQ ID NO: 87230 - DNA, 521 bp, Triticum aestivum
  unsure (1)..(521): unsure at all n locations
  Clone ID: PAT_TA_87230
gccgcctgcgcgccgccacacgaaccccccacccaacccgagcgagcaccggccgaggaggaagaggaaggtgagatggctcgcggcacggcggcgacggcggcggcggctgccaagggcaagaagaaggggtccgtctccttcgtgatcgactgcaccaagcccgtggaggacaagatcatggagatcgcgtcgctggagaagttcctccaggagcgcatcaaggtcgccggcggcaaggccgggaatctcggcgactccgtcaccgtcacgcgcgacaagagcaaggtcaccgtcacctccgacggngccttctccaagaggtacctcaagtacttgacaaangaagtacntgaagaagcacaacgttcgggacnggattcgtgtnatcgcancnaacaangatcgcanggtganagctcnggtacntcaacatcnctgagaacaaggcgatgtaggaggattagagtgcattgtnanattgtantgctgttnagtttanncttgatntnagactccnn

SEQ ID NO: 87231 - DNA, 601 bp, Triticum aestivum
  unsure (1)..(601): unsure at all n locations
  Clone ID: PAT_TA_87231
aaaatctcaatctcagtctccatctccatctccaaaccgcagcagcagcccatccctcgccgccgcccgcctcccgcagctccgatggcccgcaccaagcagactgcccgcaagtccaccggcggcaaggcgcccaggaagcagctcgccaccaaggcggcgcgcaagtcggcgccggccaccggcggcgtcaagaagccccaccgcttccgcccgggaaccgtcgcgctccgtgagatccgcaagtaccagaagagcacggagctgctcatccgcaagctccccttccaacgcctcgtccgggagatngcccaggacttcaaagaccgacctccgcttcaatcctccgccgtctccgcgctccaagangccgccgaagngtactggtccggctgttcgaggacacaacctgtcgcatccaagcnaaggggtcacatcatgccaangaatcaagtncgcccgccgatcgcggggaacccccaagtcttntcgcccgttaantgccttaatccccnaatnttaaaccngnatttnggccccctaagttcccctgnntnaaaggggcacaatgtnaatccggttgaaaaggataccaatttgg

SEQ ID NO: 87232 - DNA, 265 bp, Triticum aestivum
  Clone ID: PAT_TA_87232
cgatggcgtcgtcagagccagcgacaaatgctctgctcctcccggagggagaatagctcattagtttgttcagttaggcatttctggtcctttttttaatgtattaacctgctgttaggttagtttgccgcgttttttttacttttcagatgaattcagccatcgatacagctaccctttagtatggagtttgtcatagtcttttttttagaaagagtttgtcatatctatattgagcgtagacatgttgagtaaaaaaaaaaaa

SEQ ID NO: 87233 - DNA, 277 bp, Triticum aestivum
  unsure (1)..(277): unsure at all n locations
  Clone ID: PAT_TA_87233
ggcaagttccctcggagcctccagttaaaccttccctatccgaatttttccaagctccaactccctcctttcttctacaagcaacaactccagcacaccagcatccatccatccatccatccatccatccaaaggggggagaaaagggttatagaggangaagnnaganggcgnggagctgcctctgaaagcaagccatcattaggccgccaaatgcgggaatgcgtattggctaacangacaacaagtcgaggaccaanggancangagctgcgtc

SEQ ID NO: 87234 - DNA, 313 bp, Triticum aestivum
  unsure (1)..(313): unsure at all n locations
  Clone ID: PAT_TA_87234
gtacaccgcagcacactgcacacgcctccggcctccgctccgcctcagccatggtctccccccgcttccccaccgccaccttcgcccgtctcccccctcccccgcctccccaccgtgccgccatcgctgccgcaattgccgccgccgcggcggcggcagccgcagccggcttcgccctgaccgccaaatctgccggtcggccgctcccgcgcccggcgcactctgcacccctctgggcctccctctcccttgccgaaagcggngcccccggcaacgtcgagccccgcancggcgccgcattcnccttcgagac

SEQ ID NO: 87235 - DNA, 429 bp, Triticum aestivum
  unsure (1)..(429): unsure at all n locations
  Clone ID: PAT_TA_87235
cctatgataattgtggctgtctatctgcattggctaagcatgaagatgttcaagcatgcctgaagaaccacaaattagttttacggatgaagcctgcaatccttgctgaaatggtggatcatggggttcatgaagacaattttggccaataaatatgtgaagggaatcctttcttgttgcataccccgacggagagagacagtgatgatgaggctcaaaaagatgatgatgatagatgatgaggcttgagggtgtattggaaacctgttgttctttctattcagttcaaagtagttgagttacaaatatagtatatttttcaaaagtagatgttccaacataaatataaatctcaacctgcttacacnagtttttaaaactaagcattgcgtgtcatctgccgaancaatgtatttacctttttattaa

SEQ ID NO: 87236 - DNA, 586 bp, Triticum aestivum
  unsure (1)..(586): unsure at all n locations
  Clone ID: PAT_TA_87236
ccgccttccacctcgcccacctccgatctctatccctctgtccccctctctctctctgcgcgcgcgccaatcgctccttgtagcggcagcggcagcggatccgctcttgctaaaattggcactgccagccatacttaatccagcccggccgcgccgtccgaccggctgattaaagcagctcgagctcgctcgcccgcccgcccgctgctccccatcacgagtaccgcggccgctgtctggctggctggagctcgcacacctgtgaggctctgactcgcggcgcttttcgattcgcctcggctgattggcgggattnnggcatggattttcccgggaggganccggcnggccgaacaagcatcagnaanacaacaacaaccgctgcgccgatgacgccngctgccgctgacgcgcaagggtctcnggtcnatcgctcaagttcgacaagttcaaaacgnctcggcggccgggcaaaggacttgggtcaagaacatgacgaactcctccgnaaaattggacggcgaggatccaaggantggngcgggccaaanncggggctctctcgcgggggggaagcaanggggat

SEQ ID NO: 87237 - DNA, 513 bp, Triticum aestivum
  unsure (1)..(513): unsure at all n locations
  Clone ID: PAT_TA_87237
ctagcttcagctagccaccctcttccactccgggcattttcttgcatccacgacggcaatggccaccgctgatgtccagaacccgacggccgcgctgacggaggaggcgcccgcggtggagacgcccgtcgccgccgaggaggccacgaagacggaggaggtccccgcgccggcggaggccgaggtcgaggcgcttgtccccgtcgaggttgaggagaccaaggaggaggcgccggcagccgctgagacggaggagaccaaggagcccgagccaagcaagctgccgccgagccggaaggccgangcgcccaaagagccanaggcgccaaaccgtcgtcnaaggaagagaccaaaggaggccgtggcttgaggnaaagccggaatcctcnnaagaagtnaangaagaagcnggccctngtgcccaagcaaaagtgccggcgtcgnccaggaaacaacgggtgcaacggancggcancgctgcgcggaaaagaacggccgcgcgttgcaacgtaa

SEQ ID NO: 87238 - DNA, 541 bp, Triticum aestivum
  unsure (1)..(541): unsure at all n locations
  Clone ID: PAT_TA_87238
ggggactggttttgaaccgacgacaagcttgttggcgggcatctggcaggatcggtgaacatcctctacatgtacaataccagctcaggcaattattagaactctgtcagttagttaagctcttgtgatcatgaanagggaggggggattaaggtgtttccatcaacaaccatttattggtcgagtggactcagaactggattcgtactgaaaaatcagggttggcatcatgataacaagcatggtcaccttaagtctcaactctgagcctcctcttggaaaaaatgcccgcattccaaacaagtccatttacagactctaaacctcctctatgagcaccaagtagacactctctttgctatgttttgggcacaaagagccagacatcaagtactacgtgtgcacaatcaacaggacatttgccaaaccaggccagcgcatgaccgcatctgctcgccgaatgttgcatcatgctaggaatggcaaaagggcactataacaccaactggctgagtttgtnccgcgcaanatcgcaaggaaa

SEQ ID NO: 87239 - DNA, 523 bp, Triticum aestivum
  unsure (1)..(523): unsure at all n locations
  Clone ID: PAT_TA_87239
cagagtagcggtgttgatatgtttcgtgttggccgtatttagttttttttttcgtttttcacttttcttttttctttttcacttgtattttttatttaccaaatgcgtgaaccttttcaatttggtcaacttctctcaaattcgagacttattttataaattgtaaactttttcttttttttactaacttctttcacattagatttttttaaaatgtactagttttttttttctaattatgaactttcccaagtcatgacatttaaaaacaattgtgaaccttttcaaataatttgtgattttttccaaattcattaacgttttccaactaatgagcattattttaagattttgtattttttttaaaacantgtcatgaatgttttcacaaaaaatcgatggtcanaagcaagtcaacaagtcaatgtcgnggcaatgtnaatgagaacagcgaacnaaggagctgaccgangtgtagggctncagcggggaaggttagcgaggcgatccaanagcaggggtg

SEQ ID NO: 87240 - DNA, 313 bp, Triticum aestivum
  unsure (1)..(313): unsure at all n locations
  Clone ID: PAT_TA_87240
aggaaccagaggtgggctgacaaggcatacaagaagagccacttgggtaacgagtggaagaaacccttcgccgggtcatctcacgccaagggcattgttttggagaagatcggtattgaggccaagcagcctaactctgccatccgtaagtgtgctcgtgtgcagcttgtgaagaacggaaagaagattgctgccttcgttccnaatganggttgcctgaactcaaccgnggaanaatgaccagggtgctnnattgctggattcnggccgnaagggggnancccgtgggnaaaatttcccgggtgnccgggtt

SEQ ID NO: 87241 - DNA, 399 bp, Triticum aestivum
  unsure (1)..(399): unsure at all n locations
  Clone ID: PAT_TA_87241
tttttttgtatgtccccgaatgggagcctatacaataccaataaacgataagcataacaagaaaaatagcaaaggtactatcgaatgggagcctaatttcttgtttcagtattgtctgcagctttgtttcaggaagatacaattctgtaatttttttatgtcgcatttgaaggtgtcggcaagtaagcggctctacatcttgccaattccatttctaataggcatgaaccccctgtgttttggacaactaaggttacatgcatgtgttcatatcataatcatgtaccaattctgagtcagacgcgtgcatttggattgggatattgaaccgagcccgccattttattactctgaaagaactatacagtgatatttggctatggcttncagtattagnga

SEQ ID NO: 87242 - DNA, 188 bp, Triticum aestivum
  unsure (1)..(188): unsure at all n locations
  Clone ID: PAT_TA_87242
gtcagcgccttcgcgctcgtcggctccatccagggcgtcatcagccagaagctaggctagtacaatatatatgtgctcacgatagagagattccccttccggttggaactgggttgctgcttttccagtagtgtaatggctatggagaatgtcactaccgtgttatagcganaggggannatnaggtt

SEQ ID NO: 87243 - DNA, 274 bp, Triticum aestivum
  unsure (1)..(274): unsure at all n locations
  Clone ID: PAT_TA_87243
gaccaacctagctttgagcagaaactggatgaaagttttgcatttgatgattgtgaggctgtcatcgtggaccggctagcggaagaacattctgaattcgaaaagattatcggtgtcaaaggtccttgtgacagtgaaatagtccagtcagcatgccgctcttccatcgacaggctgagcttgagaggatcccctctagcaaggggagcatctgaaagacnctctcgtcannagagccatttaganaaatngnccccgntcngaaagggaactt

SEQ ID NO: 87244 - DNA, 537 bp, Triticum aestivum
  unsure (1)..(537): unsure at all n locations
  Clone ID: PAT_TA_87244
cgaggccgtcggcagcgcctgccctctcctcaagcgcttccgtctgagcaagaaccaattctgcaagtggaacaccaagaacatcgaccaggaggccatggccatcgctaccatgggcgggctgcggtcgcttcagctcttcgccaaccctctcagcgacgacgntggngggccatccttgacggatgcccgcgcctcgagtctctcgacatccgccattgcttcaacgttgggatgagcgctgctgcaatccgagcacggtgtcctgggatcgagacactgaggctcccggatgattcgacgatcgattacgatctgaagttctctcccccggatatgacccgttggnacaccaggacgagcatcagtgtgattgggacgagttagccatttcagttcatgggagtctagggtactggngtgcacctacccaacaagatacgcttgctgtaagtaggagtacaaccaaatggatgggttaataatggcaatgatacttttttggtcgttgnttgtacgacatgccaaanacaatng

SEQ ID NO: 87245 - DNA, 349 bp, Triticum aestivum
  unsure (1)..(349): unsure at all n locations
  Clone ID: PAT_TA_87245
ggcggcggcgcgcgcatgtgcccgggcaacgagttcactagggtggagacgctggtggccatgcactacatcgtcaccaggttcgagtggaagctcgacgaaagctgcgacggcagcttctccaggtacccgatgccgtcccctgctcgggggctcctcatcgacatcgagccaatagacacaaccaccacaggtgcagcaggcatcagcaaatgatttcgaagaatttagtancctgatccgaataatgcatccaccattcaagctgtatgattgcaaatgaaatgtagtacgattataaacactattgcaatcatgcccaagtatttctcacacaaagggggggggn

SEQ ID NO: 87246 - DNA, 517 bp, Triticum aestivum
  unsure (1)..(517): unsure at all n locations
  Clone ID: PAT_TA_87246
gtcgacgaactcgaccccatgctgcaggtactcgatgatgaagtcacgtacctagggtagggtcattgaacctgaccaaggtaccctccctaaggatatcctttaggagaagccgtcttccagtcgaccaagaggaactccactcgacggactagaagacactcgacgaacctgaagacactcgaccatgaagactcactcgaccaccaggagttcaagatctactctgtacccaaacggtctgtaattaagtagtcttaatggtcatgatgacactttatgtaaggcgttaccaagtaacacgagaccttaatgtactttaaccctctgctacgtgggctggctggggccttggcgtcctcctatataagcaccccttcaanggggaagaaagggttcgggacccctggtnatctcanacatatatcctatcgacngcctccggggnttcngaggaaaaaaanaaaagaaaacccnagggggggggccgggtaccaattcgccctatnggngtctg

SEQ ID NO: 87247 - DNA, 523 bp, Triticum aestivum
  unsure (1)..(523): unsure at all n locations
  Clone ID: PAT_TA_87247
aaaaccttctaaaaatgatcaacattaaaatcttctcaaagaagtccaagaaaatgttcctcttagtctctgaaaatattgcaaagaggtaaaactcaaaacaatatttttggtatctcagagttaattattttgggcctttgaattaaataaataactatttgcattggatatatatttcttaagttaattaatatatgtccaataattctgatctttgatgaagggctttggaataatcctaccagtccctaccataagtatcagaagcaataaaaatgatttagtgtctaaaactaaatcaaaacaaactacagannatagaaaacagaattaantaganatagaaggagagagagagagaagggacttatctgggggctcacctggtangccaaancggnccagcacngcangctggnncgtccagcncggcaccgctnaccccctgtcgtcttctccctcgncagcagggnacggtgcacgngcccgggcacctctngntcgtagcctgcctggnttg

SEQ ID NO: 87248 - DNA, 487 bp, Triticum aestivum
  unsure (1)..(487): unsure at all n locations
  Clone ID: PAT_TA_87248
gcgtcccttccagcttacctggcgcgccgatgtctcggtggctaaggccacggcagctcggatctgcgtctctccagtcctagtttgtcggcattgctggacgccgtcgtcccatgccctccgtgtggctcacttcgtcgcctgccctaccccagaggcctcaaagcctccccttttgctggatccaacgctcgtgggtgcgggggcggtgccaccctccgacggcaagtgtagccccgccaaccccttcccgacgtggtgattccggggcaacatggactttctcatcttcgattccagactcgggagtgatgggattgctcaagcttcaggccagagagagatccctgctcggctttccgngtgctgggagcgatgggcgcccngcgggtgtcggttccttcttgggngggacttcaanggcttaagntttggccctcttcgaactnaagggaaancctaggaccgggtacctcggaaccggnta

SEQ ID NO: 87249 - DNA, 378 bp, Triticum aestivum
  unsure (1)..(378): unsure at all n locations
  Clone ID: PAT_TA_87249
attgatgttgttgctatgcggttattctgcaagctgtgtggttgagtggttccggtacctacaggccgtgaaatgcattggtagaaattatctgaactttgctattctgttaactgccgtgctccatcagtgcttgcctgaatttatggtggtgatcactactactgtactaaaacctgctctcgatttcaggcctgcatgccgcatgatctaaggatctgtaaaactgttttagtttcctttcagtactctttatttctgcctgaactgctcctcttagtgagctgctgtaagacaagttggtgcgctggtttcattctgagtaaatggaaccggggaggggagcctccctgttcatctaaaanngganaaaaaaaa

SEQ ID NO: 87250 - DNA, 489 bp, Triticum aestivum
  unsure (1)..(489): unsure at all n locations
  Clone ID: PAT_TA_87250
cctaaatgaggatggcgtgttcctaccccctccgttggagaggagcattatgccagtttttggcagttcttggtgctcgatgcctaggtagtctttactcgagcagcctgcaagtttgacttatctaaattttaacctgtaatccaagtccaccagaacaagttaggattcaccagtgtttacggaaggctgtctgcaatttctgaatttgttataactatggtgggtgcaacacaggctagccaagtactaccatggnttgtcaagaaatctttcgataactataactccaatgtatgagcttatgcctgctgtccaagcagncagtggattgcactcttctcagaatctttataatctaatcgcttagtcatttaaccacgtgtttcccgctgtggtgcagtgaacgaagaatatgagcaggagggccatccacaaggcacttttcgagtcggcgcgctcatcgcaagccaaggtcatcaaggtctn

SEQ ID NO: 87251 - DNA, 318 bp, Triticum aestivum
  unsure (1)..(318): unsure at all n locations
  Clone ID: PAT_TA_87251
gtctccctcgccttcttcttctttattgagaaacgcaagaagaataactaaacttctttttgtcctttgcaatgtactcctatagtgtacatgtaatgtaatgtaagagagtgttggtgtttccttttcggggagctcacgtgattggaccgctccacttcaccaaagtcagttcaatttcatcaaatctacgttggagcagtttcatcccagagttgcagctccaccaaatagcaatttatcatgtttggcttctaaatagctccagcttcangaatgagaaaaatttgttgtgaaatgttaatttggctaaaaaaa

SEQ ID NO: 87252 - DNA, 424 bp, Triticum aestivum
  unsure (1)..(424): unsure at all n locations
  Clone ID: PAT_TA_87252
actcggggcttctgagtttgtgaaggaagtttctggaacatacggcatttatgacgcagaccaacacaacataataatgtcactgaaattcatcaccaatgtgaaggcttatgggcctttcggagaagcgaatggaacccctttcaccatacctgtggaaaacaatagcagcatagtgggcttcttcgggcgtagtgggatatatctcgatgcgcttggtgtctacgtgcgcccgctctaagcaacaacagctaatgttcttattttcggcgtttgtttctcatttcaaataagaagatgggatcgttgtcctttctcatccggaagatcctatgtagccacccggacttttaggtccctttgttgtgatgaataaaaatatcagttttcttaaaanaannaaaaaaaaactccaagggggggg

SEQ ID NO: 87253 - DNA, 287 bp, Triticum aestivum
  unsure (1)..(287): unsure at all n locations
  Clone ID: PAT_TA_87253
gttcctcaataccgttccacagaatggatgtaggatatacaacactgacaggataatctcttaatcagtccggatggcgcaatcattggcacctcacgatattgtataacaagactacatgccaagttatacttcaagacgtatcatcctagaacaataataatatttgaaaataaaaatacatagcgatagcatcgccatgattttttttttanaaaaggaggacgaccctanagnattgaaatgcatgcggaanttggaattgnaaaaaaaaacattgagggcca

SEQ ID NO: 87254 - DNA, 422 bp, Triticum aestivum
  unsure (1)..(422): unsure at all n locations
  Clone ID: PAT_TA_87254
gaagctcatagccattcaaagcctcttcatctccgaagctccaacccaaccgaggatgtcttgctgcggaggaaactgcggctgcggcaccgcctgcaagtgcggcaacggctgcggcggntgcaacatgtacccagaggccgaggccgccggcgccaccctcctcgtctccgccaccgccacccacaaaggcgagctccggcggcatgngatgttcnggccngaanaacggcnggttgcggctgcacccantgcangtgcgggcaccangntgcggctgctcctgctgnagctgctatttnatcatcgacatatgcatgcaccgttgcgtgngtgcatcatcngttcatatcnattctactactaccattccaatgtaaccgcaacctgntcggngggctttacnaatgcacctngacctt

SEQ ID NO: 87255 - DNA, 394 bp, Triticum aestivum
  unsure (1)..(394): unsure at all n locations
  Clone ID: PAT_TA_87255
gttgggatggtcccatgacaaggaaataggctgcccatcctgatgagatcaagcaagccgcctcatcagaagaaaaatgtgcacacgccaaaaatctatggaagagccctacatgccaaaaatctatggaagagccattctgctgaactttcttaagcaactaattgactgagcacttgattgattgtgtgtgtctaagtctattctttttgttacaaaatgacagcatgctgttgctctttgctgtaactaacgttatagccggcgaactgtaccccgacagtccgcccgacatcttctgctgtttacgctctaagcaaccttgtacgaaggtatcactatcaagaagtacagtacaccgtttaaaanaaaaaaaacgccncaaggggggggg

SEQ ID NO: 87256 - DNA, 178 bp, Triticum aestivum
  Clone ID: PAT_TA_87256
cgcagttggctagcatggctaaaataaatgcgataggtcgagagttcgagacttacgtcacccgaagaccagcgttgtgatgaaacgctcggtggcaacttgggtcgccacatatacacctgaatcatcaggtgaaatcgagcaagtctgaacctggtctattgagaaaaaaaaaaaa

SEQ ID NO: 87257 - DNA, 392 bp, Triticum aestivum
  unsure (1)..(392): unsure at all n locations
  Clone ID: PAT_TA_87257
ccgcgctcggctggctttacttctacgccttcgttcccgagacgcgcgggcagccgcttgaggacatagggaagcttttcggcatgaaggacgccgccgtcgaagacgacgacaccgccaccaaagacaagcaggtgaaagcagctgtggagatgaactagctaacgtacggccggagagtgggtttcctcctaacatgcatgcatgcatgcaagggatgggatnaccatccattgggggtcttttgagttcctgctacttctttcctggggtttttgatcaattcgcccggtttccggggatgttcattgngtttttnattttccaaccaaagtgtatcaaaatgtttccgtcncctactgacaaataagatgtgccttgtcttaaatttg

SEQ ID NO: 87258 - DNA, 541 bp, Triticum aestivum
  unsure (1)..(541): unsure at all n locations
  Clone ID: PAT_TA_87258
ccgcgccctagcctcacgccagagccgagaggggtcaaggagcggcctcttcggcgccggcgagcgcgagaggcggcgaactcgcgagccttgctccgtcgtttctccccggcggtaatctcctcacctcgtctctgctccccggccaccaaatcagcccacaaattcccattcccctctgcctttcgaatgtctcggcgaaggatatgaaatccgtttgccggtagcatcctgggatcatcttgttttgggtagatctaacgtgctgggacatatgaaactaaagtctacgcatggtcaagtcaaaacagctgacatgactattcaagtgtactgggtccaaaattttgactttccgnatgtggatagttcgtccacttaacggggatgatgcatcggtactgcttctccttagatcccaaccganggantctctgtctccatcacacacaatcgtagtagtggctcctttttaggagaganaacattacacaagggatacattatacgagtaaccaactgaataatagtagtacactnc

SEQ ID NO: 87259 - DNA, 358 bp, Triticum aestivum
  unsure (1)..(358): unsure at all n locations
  Clone ID: PAT_TA_87259
cgcaccacaagggnganataangaggcagtgntccgccgtcaanccgccgtcngcctcctccttggngcctgccgccatgagcncgnacgccntgntactcgcganctgtttcgtctccatcgttactcnggagcttgtgatctagccagcancttgtntgaagtactatttgnattggggtctgtttttgtctccgttcattcgcggtggnaantataaatnttgccaagtatngcattcttgatgttttcgnacatcttaatgggtgcaagagactggagtgnaattggtatttcacgaaanttaatatatttcttttaatcgnggaaaaaaantgaattccangggggggggggc

SEQ ID NO: 87260 - DNA, 558 bp, Triticum aestivum
  unsure (1)..(558): unsure at all n locations
  Clone ID: PAT_TA_87260
tgtaatagtgcttcaactgtccattgtactgcagctgttactgagcaatcagtgcataccggccaacctggaggcccagtcaattagtactagcaccaaatgtgctgtcctgtgtactaaatatctagatattttgtagtctacaataggagcatttgggtgtgactctgagagcattcttgccttgggggcatgtctgggtacatgccaaagcaatgccctaccaagatccgcccgaccgttggttaagccacaaaagattcggttagagagatccttgacctcctgttggccaaaaaaaatgggtaacatttggtgaggnagggttgccaaaggttgcataagnaaccaaccaagacaggggtccaaaaggttcccaagttttngggcaaggcaantttgggcccaaccaaaattanggcccaattttggcgtgctgctgattgcattgggtcgaaacaagttgtgtaattgggntgggtaatgaaatggtgttgccaacaanaaaaaaanaaanaaaaaaacncaggggggccgtaaccaantcgcccanaggng

SEQ ID NO: 87261 - DNA, 418 bp, Triticum aestivum
  unsure (1)..(418): unsure at all n locations
  Clone ID: PAT_TA_87261
acggcgtgcggctcaggctgatggacgtgacccggatcatgctgcgacgtccggacgggcaccccgatcggtacggacacggcgccggcgaccacggcggcttcgacatcgactgcctgcactggtgcttacccggaccgatcgatgtgtggaacgagctgctgcttcagatcatggccggttagactcgtccgggttcctgtctgtttttgcattgttgcgcgcganttctctgtatccttacacgagcatgatttgncccttgcatnaatttcgcctancctcatangaacccctctggnagggngncattttttttctcccgaggggtatnaggngaacacccnaaggnnagaacattcctacttcgnacccgtttgggtccacacggacaaaaaaacacgccaaaaaaaaaaaa

SEQ ID NO: 87262 - DNA, 286 bp, Triticum aestivum
  unsure (1)..(286): unsure at all n locations
  Clone ID: PAT_TA_87262
ccgtgccattgctggtgctggtgtgctctccggctatgatcagctccagatcctcttcttcggcaagaagtacggctcaggcggtgcctagaggggacgaaatgatgacgaacaagagaagtttgttcccagtcctacccttcgaggatctggtgaacttttatctttttaacgttggaaggcaataattattgtagaggatgggattttcccaacattccgtttttggtgggaggcatccgaactccagaggtttgtccgtaggttggngnaaggttcncaaaaa

SEQ ID NO: 87263 - DNA, 254 bp, Triticum aestivum
  unsure (1)..(254): unsure at all n locations
  Clone ID: PAT_TA_87263
ctgctacggngcttcgcgcgcagcatcggnaggctcaacacgctcttccggatgcgcccggccgccgagcccgggttgcagcagctcggcgccaaggctaccgccgacgccaaggtgctcttccagcgccgccgccgccattccatctcgtaaatacacccaccaccgcctcacgatcaagcgtgttggaatcttgcgccttctcctatgtgtgcatagcaagtgataaaacgccgtgaccgtgattcaaaaaa

SEQ ID NO: 87264 - DNA, 263 bp, Triticum aestivum
  unsure (1)..(263): unsure at all n locations
  Clone ID: PAT_TA_87264
gtgatacgagtttttacaccgttggaagtgagatccaatggcttgggagtattctttgtaattatccgcaatttccaaactctccaaaggtttttttgcaaataaaacattcaggcctcgtgtgtgccgctgcatcttcgatccaacggctccccggtgctcatattaggtgctccccatagcttaattacactactagggaaaagcctagcagcagcgcgggttttaggcctatcagtagcgcggggggcnatgcatacgga

SEQ ID NO: 87265 - DNA, 350 bp, Triticum aestivum
  unsure (1)..(350): unsure at all n locations
  Clone ID: PAT_TA_87265
gaaggctggatcgacgtgctcggcgagcagtgtgaagaagcttgcgattcaccagcagcaaccaaggggccggctgatgtgtcgagcagggcgccaagcaaggtgctcgggtccccggcggcgccagctgaagacgcagctgtcgtcggcaccctttcaagtgacgaattggacgcagaggatgagcctttcggtgacgatatcatcctggccgctgatcctttggtggaccgccagatccaagtgtgttggagttcaagatagatatgtgctttcatcatcacttgtaccctgtaatatcggaatcgatgcaatagaaaattccgggtttccacaanaaaaaaaaaaaa

SEQ ID NO: 87266 - DNA, 518 bp, Triticum aestivum
  unsure (1)..(518): unsure at all n locations
  Clone ID: PAT_TA_87266
gagtaccgcctcgagaccaatgagaatggccctccacaggaggaagggtgggtagtatgcanggtgttcaagaagagattacccacaacaagaagagatttagaccatgatgcaccatgctggtacgtcgacgatgatgggcccttcatgcatgacctcaactctccgatgagagggatgccgcctcaccacagcatggcgctgcaagaacaacacctccagatgctcaacagcacctataagagggagctgaagctgcaataccaaatgccaaaccaccatcatgttctcaacaccattcctcacgagctagagagcccttcttccttccattctcttttggtatcgccagacgatnaccagatcaatgtgcaccatgcccagcaccaccatgttcaacttantgacatgccgtcgacgaccaaagtgccactgactggaganntctggacaagttcgtcgcgtctcagcttagtaatgatgcagcaaggtgtcnttatctcatgangngcatctca

SEQ ID NO: 87267 - DNA, 314 bp, Triticum aestivum
  unsure (1)..(314): unsure at all n locations
  Clone ID: PAT_TA_87267
agcctcacaggcaccatcccgccactcttctccaaatccactcttctcccagtccttttgctctccgacanccacctctccggctccatcccagccgagttcgctgnagtcggnttcctgcaagtcgacctctcccacaacgctctcaccggcgacgcgtcngtgttcttcggnaggacaanggagctgcaaagcancctgtcccacaacgccctcagcttcgacntctccggcgtggagttcccggaggagatgcangcatggntgcgagccacaaggccatccgcggtggcatcccagcgcaggtgngcgaa

SEQ ID NO: 87268 - DNA, 526 bp, Triticum aestivum
  unsure (1)..(526): unsure at all n locations
  Clone ID: PAT_TA_87268
ggaaggttagcgaaggaataaaattgttgtctgctcttgttttcttttgttcttgacattgaagtcgaacaacctagtgacatagtgtttgaaaactttgattgctatattgttgatgttgttcactctcgcaaaattgaaacctgtcctcagaactctcgagttctctcatggcaatgaatgaagttgttatttaagcttgtgctcaattcctagattgctactttgataagtttgtggcaagtgtccctgtccgaagtctatgaggattttaataatagtttgcacatgagcacttgtgtgcaatctctctatgctaagctttcaggaatttcagaagtacatgggcgatttgaagcaggaaagcaagtaatgtaaagaaatttggtctgccatgccatgtactgtgggttcagataccctttccccccttgagtgggggatcaccaagggagggagaaggngacaacttcctttgnagaagaatgtcagtgaanatgaatgtatacgattccttattgttttg

SEQ ID NO: 87269 - DNA, 541 bp, Triticum aestivum
  unsure (1)..(541): unsure at all n locations
  Clone ID: PAT_TA_87269
cggccctatgctctgtatgcttgaaggcttgaatggcctgataatttttcgaagagccggggggagtcggttaggctacccgtggccatttactccgacagtactccccgaagctggttgggcttcgaggttgagtggaggtcgagaagttcggtcagcttcttatcttgacgagccagtagctaggagccggctttggttgggcgcgccgtcttggaattttttttaaagtcggagggcgggagtctgttggtgcgtgcgccgggctgcgggccggccgctcgccgcctgcaaaccacgtggcatcccttgggccgaaaagagcctgccagcccacgagcacgaccagacgtcgctgcaggtcgggggcccaacactcngtacgcccaagggccaagcacggattctctgcggccaaagccgtccgcacgtcttcccgcggnggtttccgcacncgttanggcgcaataccgcgggacttggggantccgtgnagtaatccacgtcctgcccaagcctcgctctcggnttgcggaagtgg

SEQ ID NO: 87270 - DNA, 240 bp, Triticum aestivum
  Clone ID: PAT_TA_87270
gccggcagaggcgagcacgaggatgaggaggagaagcaagcaccatcaccagttcaccaccacccagcgtatcagtttgatcaccagccgctgcatgcgcccgcgcgcgcgcgctaaaataaaataaaaccgtcgtgttccaccttaattaattctgtatgccctgcgtgtgttcgaccagtgtccttcctcatgcctccacttccaatgaatatatggcgcctcaactttcaatgatct

SEQ ID NO: 87271 - DNA, 247 bp, Triticum aestivum
  Clone ID: PAT_TA_87271
tctcagcccgccgccggccacctcgccgggaaaaggagctactgcagctgagttaggatccagacatagatagatccctctggcctctgcccatatctgtaaaacccggaaaaaaaggagataacagcatgatcagctcgaaatcaccatcgtcgaatccctagttgttacagcttgccagagaccaatatcgctttttttttgcgaaatcaatatcacttcttctggattgcgcaaaaaaaaaaaa

SEQ ID NO: 87272 - DNA, 530 bp, Triticum aestivum
  unsure (1)..(530): unsure at all n locations
  Clone ID: PAT_TA_87272
cgagtttttttttttttttttttctaataaaagaatgtgatttgaatttgaagagaccaattcctttacatcctaaaattgtaagtataaacattgtttacattggttcctcgtccccccaactaaaccaaatataaccccaaattcaaaactatgtgaaaaaagtagcgttgtagtagattacatgagctacgatacgtatacaaaacatatacgtcgttgaatcttggtcacgtctccgagcctccggtacgtgataacacgtaattaactacagataaccggagtccggcgacgtgctaaacaccggcttgtccttgtcgacgacggtggcgaccacggtggcgctgctgctcttccggcgcggcttggcctccgcgagcatggtcacacgtcgcgcatggtcggctgtccttgggggacttgggcgtgcacaggaccgcgatcgcanacagangatctctccgganngtcncgcgccccgagcgggtcagcagtctcacccgngttggtcaggggggccgtaccan

SEQ ID NO: 87273 - DNA, 247 bp, Triticum aestivum
  unsure (1)..(247): unsure at all n locations
  Clone ID: PAT_TA_87273
gccatggcgctcctcctgtcccccaccgtctccttcctcgccccctccccctcctccgctcctcgtgcccgagctctctcaagctcaaccgccaccgccaacggccgcanncaataatgccttcctttacctcgcctcgagacttnagttgaangattggngcctcagtcagcaatgttcctcttgcnangaangttgcccttggttgtccaaggcttnttgaananggttgtccaacttgatgcgg

SEQ ID NO: 87274 - DNA, 557 bp, Triticum aestivum
  unsure (1)..(557): unsure at all n locations
  Clone ID: PAT_TA_87274
gtcttttcctacctgaagaaggtcggatacaaccctgacaaggttccctttgtccccatctctgggtttgagggtgacaacatgattgagaggtccaccaaccttgactggtacaagggccctacccttcttgaggctcttgaccagatcaacgagcccaagaggccctcagacaagcccctccgtcttccccttcaggacgtttacaagattggtggcattggaactgtgcctgttggccgtgttgagactggtgtcatcaagcctggtatggttgttacctttggtcccactggtctgacaactgaggtcaagtctgttgagatgcaccacgagtctctcctggaggcgcttcctggtgacaacgtcggcttcaacgtcaagaacgttgctgtgaaggatctgaagcgtggctttgttgcatccaactccaaggatgacctgcaaaggaagcggcaacttaactccaagtcatatcatgaaccacctggcagatnggaacggtacgcccantgtngacggcaaactccanatgnctgtangtcgccanctgggan

SEQ ID NO: 87275 - DNA, 571 bp, Triticum aestivum
  unsure (1)..(571): unsure at all n locations
  Clone ID: PAT_TA_87275
agtttattacagaagtacatacattcattagagaatatatgtagtcatttcctctatagaaaaggattgccattcgattgcttgagagaactgatgatcatcctctgcaaatttcgtcatatctatgtatctttgtcatgttccccttggttcgatgatatacgttgcctatgaatgtacgcatatattattgtcatgttccccctatccctgcagtaccgaacaatgctgccaaactgatgttcctttgctccatgttacacactgccatttgttttgtcgagcttactaactgatttgtttttacattctcatgaatgtgctttagacctgatatacacatgcctcttctctgttttgggtggccctttgccaagtatcttcattctctgattttactcatgttttcctatataaaacatggaagattgtggatcttacatggatgaactcgaaaaattangaattcagtgaacngctaaagatcagcacatagatttgctttatnanaattgaagatgcnctgataaaactgaggggtttgcatatatatacagnaaacggngtggag

SEQ ID NO: 87276 - DNA, 561 bp, Triticum aestivum
  unsure (1)..(561): unsure at all n locations
  Clone ID: PAT_TA_87276
gagccatatgccacccaccaccctcaaaactatacccatcacctggccgttcgcggtccgggggcttgacatggttggaccccttaaagggggaacccacaagcaaaagtacctattggtcatggtagacaaattcaccaaatggatagaggccaagccagttaaaacggcagagtccggaccagtgatagacttcatagccggggtagtacaccgttatggcgtcccccatagcatcattaccgataacggcacgaacttcacggcagacgaggttaaatcatggtgcaaaaatatgggcattaagctcgattacgcttcagtctatcatcctcaaaccaacggtcaagtggaacgagcaaatggtctaataatgagcggcatcaaacccagactaagtgcggtcccttacgggatctaacacgcactgggtagaggagttgactccgtactctgggggctgcggcaacaccaancgtactacggggtcacacaatttcatggatacacgcanaggagtttgcctgcgaatcatcatactcactcagggggggccggtac

SEQ ID NO: 87277 - DNA, 555 bp, Triticum aestivum
  unsure (1)..(555): unsure at all n locations
  Clone ID: PAT_TA_87277
cggcacgagggccaagcttggtcgtagtcgcggcagcaaagggatgaaacgaggagaccgcacccaccttgttcctgcctccgtcaaaagcgtgagaaaggtcgagcgacgtcggaaggcggcagggcctgttgtcgggagatgaaatgtctgtccgagggataccaaggatttgctccttggcgtgggttcaacccgcgagacaaataacccggcaagcatccccttttcattaaaaaacatcccactcaggtacagtccatagaggatgaaaaacatgaaagagaggattacaagttttagatacagctaaggcccgaaggcttacaaattaaaaagataagatgcccgtaatccctttcctgtcctctcctcaggaggcaggtcaaggaggcgaaaagggcaaaaggagcgcctaggcgagctacgggtgccagaagacacaagagaacatcccgggggccgtccgaaggctggacggcgatggcggcctgggaacangctcgaagacggggcggnagactcagcaccttcagggacaagcctctactcgag

SEQ ID NO: 87278 - DNA, 541 bp, Triticum aestivum
  unsure (1)..(541): unsure at all n locations
  Clone ID: PAT_TA_87278
ccaaaaggggtttatgggtgagccaaatgagattaaaccaggaaaaggtgaatttcacgagcaccctatggactgcatttgtgcaaggacaaagagaagaactgggcatagtaagccgaacctaagcaatcgtgctgttgaagctcccgggaatcataccagtgatgctgagtttgactggagcgatttggactatggagagaatacacccttgggaggggattcatcaaatgagactgatccagactacggccgtattgctggaccagacattcctgaattgggaggacatactctcagactaaaattgatagctattatataggttagtcacttagaaaggaaatttggtgaagtttttgtgtacagaactactgcagaattacctctccngtttccttgcatgagaatcaaggaagagcttctacagaagnagncagnagtaggcacaatatgagcaagacaaangncagcaattgctggnctgcacaaatgctgattggaaattaaggacttttgctnggttgcataaaaanttagg

SEQ ID NO: 87279 - DNA, 440 bp, Triticum aestivum
  Clone ID: PAT_TA_87279
cctatcctagccaattccatggcggagacagcgatcgcagctgttctctcgaaactcggagagtttgcgaccaaggaggcgaggttactgctccaggtgggcgacgacatcatgctgctgcgtgacaggctggagtggctgcaggccttcattcgcgacgcggaccggaaacgccggatcggcgccgacgacctgacccgagtgtgggtgcgtcagacgcgcgatgtcgccttcgaagccgaggacgcgctcgacgacttcttccacaagcaacacgagcaatgctgggccggcccactatagcggcgctgagggcgccgaaagaggagctctccccgcccaatcgtccagccgaccgatcgagcgctcatgatctaactagtgtacctatgaacattgttatgaatgaataaagcttagcaagtttcttagaagaaaaa

SEQ ID NO: 87280 - DNA, 166 bp, Triticum aestivum
  Clone ID: PAT_TA_87280
gcgagaggtgctcgtcgacctgtgctgctccgtcgtcagcgccgtcgccgtgctcagcttcctcgcctccgtcgtgctccggtagagtccgtcaggcagggtccggatatctgggtaactcgtgaaacatgtagtacaacagtttttccactagaaaaaaaaaaaa

SEQ ID NO: 87281 - DNA, 555 bp, Triticum aestivum
  unsure (1)..(555): unsure at all n locations
  Clone ID: PAT_TA_87281
attccaccccccccactgcgcgcgtaatctgagtcctgcgttctgactggccagaacccaaaccccacggatcgtacgtgtgcaccgttggatgctcccagatcgaatgacaaccctgagccctttcgacagcacatgcactacatgggtaagcactgtgcgcatgtgttgtgtagctcacgcttccttctctactaggttttcattcgaaatagactaccatttctcgccactcctctcatcgggtttcccgcctcttctcccaagatatgcatgatgtagatgttcgtttaatcttatagttcatctcatccaaaatcaattangtttgtaaaaaaactattttaagattcatgggattgtgcattgtaaaggtaaaaacaaaaggtgacaatcaatttannaaaaaggttggggcaattaaagatatgggnagatccnggagaacaaatgagaagtgctggtgtttgaggccgtgcataagcttaagtnaaccatggagctccagatgtcaagtggnagatcggnggaatgtaatgatnccacggcattagg

SEQ ID NO: 87282 - DNA, 436 bp, Triticum aestivum
  unsure (1)..(436): unsure at all n locations
  Clone ID: PAT_TA_87282
cgacaccactgcctcgggccgcgggacaagttccttatcctcgcctcggacgggctctacgagtacttcaccaacgaggaggtggtggggcacgtggaggcgttcaccgccaggttccccgatgaggatcccgccaagtacctcagccacgagatcctcctccgcgccgctaggcaagccggaatggggttccatgagttgctcgaggtacggcaaggggaacggcgacagtaccatgacgacgtctcaatcatcatcatctcattgggaggggaagatatggagatcttcagcctgaatgatcatggtcgattacaaaactataatggatctagtgatagcatacatggntgcatttacggtttcaangaattagccatgagcagagtagtgcataacaaatttngtacgtataagtgagggtttattttaanga

SEQ ID NO: 87283 - DNA, 549 bp, Triticum aestivum
  unsure (1)..(549): unsure at all n locations
  Clone ID: PAT_TA_87283
ctcgtgccgctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggcnaggtgccagctttgcaggatggtgacttgtacgtcttccgaatcacgtgctatttgcagnnatgcttgccncaaggaacaanccaaagttgttgaaggagggcgacatcaaggngcagnaangggggatgnttggtccagggtgngaggncaatcagtaaacgccggtctgagcccatctcttcgagngcttatcatcctatgctngggggaccactgacaagaaggcattgacnaaacttggtaanataaagaanngctggaaggtanaggccactgagnancaaatactggtggagnncctcancttnggacttaacag

SEQ ID NO: 87284 - DNA, 465 bp, Triticum aestivum
  unsure (1)..(465): unsure at all n locations
  Clone ID: PAT_TA_87284
atacaatctattcgagtcttgggtattttcataccatgctcccccagattactacatcttcactaaaattggggtatctttaaactttattatttgggtttattctgttaaaactttcttctttatggcacgtttaagcaccgtcttagtattccttactctgctttagaaaatataaaagatccaggaatacaactatttcttttctttagggatattatcatcattcttaatttatctcgtatttatttctccccctcggaaatgtggcaagaacttttctgccacaatttcaaaaaaccattcataactcttggtgaatgaggaaacttccgattatctacttcatttatctgcttggcttcatacgaaatgaagttatctgttaactgggtatgggagtactttcctcatccatttcaaaaacccgngggggggccnggtancaatncnccaaagnggggg

SEQ ID NO: 87285 - DNA, 306 bp, Triticum aestivum
  unsure (1)..(306): unsure at all n locations
  Clone ID: PAT_TA_87285
ggactgtcgagctcgagctcgagccacgcatgcatcgtttctgcggtttcttttgcccggncgtaattagctgtgtttagcaccggcccggtttcttttcttcgtccaatatattcgagtacgtacgtaaattgtattcagctgcttgtgggtagctctggccatcgcttacgctggagtggatccattgacctctcanccaggtagatagctagtggcttgctctgcatgcatgccangtgtgtgttgcacttgcacatatatatatatgtatgtgtgtatgttgtcatanatctgtgtgagtca

SEQ ID NO: 87286 - DNA, 405 bp, Triticum aestivum
  unsure (1)..(405): unsure at all n locations
  Clone ID: PAT_TA_87286
agagcctcgacccagctgattccatggctgcttttggccaaggccaatgggtctatgcaactccgctgattgcagcgccactaattcctttgtcgcggatcgctttgcgcaaccatccccgagcaagaaacttcgcattctgggcacttgtcgcaggttttatgacgcatggcttcattctttacagcaagtccccaagagtctaaagatccaaataacgaatcaactccgattctgatgtaccgggtgaggtaattcatattaagaatagcgcaacaagcagcacaccaacagaaggcaaacagattacagagatcgacaaataagccgaagcagcagtagtacaaacaaggnaaaaaaaantcccagggggggggggcggggaaaccaanncncctaaggggg

SEQ ID NO: 87287 - DNA, 518 bp, Triticum aestivum
  unsure (1)..(518): unsure at all n locations
  Clone ID: PAT_TA_87287
ctctgctggaatataaatgtagggcattatttacttatagaacaattatgtggtagtgttggtcttgctgtcaatatttatacaggacaaaagcagaacttcgatccagtaagtaaaacgcgtaattgctatatgtgtacaattggttccatgccggatccatgtaaaagaacacctaacagatcaattgagaaagtatcattgtttccttgcttatttactgaaactgaatctcttccactgcaagttagggcaacaatttaattctgataatcattttcaagtttgaagaagttccggttttaaatgcctccntttaaaggacaatgtcaaatgactaactgggttttgtgcccaaggctaattnacctggttcctgattaaggggttgatggcctgtaacaattgccaccccggaaaatatacactttgggccaagcaattaacttggtcccngataaagggttnanggctgtaacaanttgcanccngangtaaaaatggnantcccngggacc

SEQ ID NO: 87288 - DNA, 535 bp, Triticum aestivum
  unsure (1)..(535): unsure at all n locations
  Clone ID: PAT_TA_87288
ccangcgctcggcggccacatgcggcgccaccgcgccatggccgcggncggnggcggtggcctcatggacatgacgccaccgncagcagcgatagagaagcatggtggcggcaacggcgctgttgtcggcatgaaacgcgggctgtggctcgacctgaaccacccaccttgcgacgantacggcgccagctgcganggcgacgacgagtgcggccacgatgcagctgccgccgggtacacgttccaccagttcctgggatatcggcaccatggcggntgggactgcgtctagctaccccattctccacctattaccgggtttttgcccgaatagtacaatatttttccttttgngctcttttggnagtaacttcctttttacctttttcctcctcntttcctttttaatgcatggagagtcaatattttgtagagtagntgantggctgnaagatatgcatgggacataagcanctctttctctttgggatgataattaaggcttaatttgggggtncggagtaacaaanttacc

SEQ ID NO: 87289 - DNA, 509 bp, Triticum aestivum
  unsure (1)..(509): unsure at all n locations
  Clone ID: PAT_TA_87289
gcgatccgcactaacgttgtacagtaagaactactagtacaggtgaagccatcagagcaacacggggagatcgatgacaatgaggccgctcgtccttcttgccctggccgccgtgctcgcagccggtatcggcagcgctgagggagctggcgagtgcgcgagggccatcgccagggtcccgcaactggctcggtgcgccccggcggggcgcaacccgcagtccgcgccgacggccatctgctgcgtggcggtgcgcaaggtcagcatggcgagccccgattgcgtgtgcgccgtcttcctgaacgacgccttcaaactgttgggagtgaagcctgaggtcgcactcacgatccccaagcgctgtggcatagccgactgcggagataacacgtttccttgatggctacctatcaaaattcacgactacgtcgtggaaagctttgtgtgagaataaaaacgagtcatgccangaatggaattgcggcggatttagcnttggccgctctttg

SEQ ID NO: 87290 - DNA, 533 bp, Triticum aestivum
  unsure (1)..(533): unsure at all n locations
  Clone ID: PAT_TA_87290
tttttttttttttttttttttgaagaagtaatcagcgtgttgtattcatcctcaaggggtacaatatatagagttacagggaggatgaggagaagaagatacacacgcacgcacactctgtaaccaattacagttagagatcctatctagtaggacttgccgacgttgcatgctgcatggatagatgcagtcgttgagtagcctgtagaagcggtattcagtctaacacccgcttctcgtcgtcgccgaaggccttctcatagaggtccttgtcctggaactcgctgtagacgttgtagcagacggggtggccctcgcggtcggcgccgcggtagaacaccacgttctccagctccggcactccgaggtcggcgccgaggagcgcgtcgatgccgaagctcttgcgccacagcacggncgccttgagtggtagccggcattttgggcacggacaaaatctggnatcttccgatttgtattgagagtgatcccaacttgatgatcacaagggcttcantgtcaagtgaagctag

SEQ ID NO: 87291 - DNA, 327 bp, Triticum aestivum
  Clone ID: PAT_TA_87291
cagaaacctcattgccattggatcaattcaaatccattcatggtcaattaccagagacataattaatgggtagtagtaccgcaagaagaatctccaggcgtggtgcaagtctgctctgctctgctctccgatctgtatgaatgcaactctgtgctcatcttgaagaagattttgattgctggtctgtgactctgtgtacttgaggtatctggaccatcctgtcctgaccccgtggtaagttttactggtacttcagtagtagtagcagagtggcgatgaggaggtcaatgagatatactacctgttgtgtttgttaaaaaaaaaaaa

SEQ ID NO: 87292 - DNA, 201 bp, Triticum aestivum
  unsure (1)..(201): unsure at all n locations
  Clone ID: PAT_TA_87292
gcgcgctcggcgggctcatgggcacgtttgcgccggaaggaggggcggagctccccgtgccgcagncgcctcccggtctcnaccccangggcatggccaccttcangcaaggcgcagggtttggcaaggtnggccactgggtgcangctngaaattttgcaattatgccnggtncnaatncaagggatntcttggtattat

SEQ ID NO: 87293 - DNA, 509 bp, Triticum aestivum
  unsure (1)..(509): unsure at all n locations
  Clone ID: PAT_TA_87293
ctcccatttagatggcgaggtgccgccggcagcaatggctgccaccccaacggnaacactggcagaacaacgtcatcttcagatcccgtggngacatgtgaagcaggttccccgctcttgctgccgaagcagggagtgccgaggactccagccaaagctactgaggagacgagcatcggagcagaggcgaggaagacgaagacatcggctgcggcggaggagaacgggtgggcgccanagttgcagctaagcctgagccccaacgcggcggcagacactgtagaaaagggcangaagaggaacagcnntgggcaggaggtgagcagcgacaaggtgccactctctctctcgctgtcattacatggnggcgtcgtcnacnacnacgacggtggtggncggnattgnaggaggttaaggtancgacaggtnnaacaacnagaaggccctctggggctgantacttgntctgacatgtcaacaaggattgggtgaattttaagtactngncg

SEQ ID NO: 87294 - DNA, 512 bp, Triticum aestivum
  unsure (1)..(512): unsure at all n locations
  Clone ID: PAT_TA_87294
gcgagtcgtcgtcgtcgagagctggctcgagaaaatcaccgccggtggacctgacaaaaaggatgcccaagtccctgcgccgacgcctgctgttcgactaacagcccgcagttgggttctcctgacggtactcttgctgccactgctgtacatgctctcggtgaatgttttagtgtttctcttggccccttagatgtaaattagttatgtagtccatcttctgtatagtgaagacacgatcttattattgtggaggaaagagagcaggcttttgttttagttgaactcgagtgttgcagcctcttgtggtgtgtgcttgtgattaccaggccagatactggtgttgatgctatttttgttgaattacaacatgtagagccctttttttttagcggacttcgcttgatttgacgactagaattcatgtaanttgaatagctccttaaagtttgcctaaaggaattatgtaaatttgaaaancncttaangtttgactgaagactctcgagggg

SEQ ID NO: 87295 - DNA, 524 bp, Triticum aestivum
  unsure (1)..(524): unsure at all n locations
  Clone ID: PAT_TA_87295
gcgacgtggagctcgccggaggtgtccggaagggcggagcgggtgaggcggtataaggagaagcgacatgcccggctgttctccaagcggatccggtacgaggttcgccggctcaatgccgtcaggcggccgcncttgaagggtcgtttcatcaaggaaaacgaaggtgttgcgatggccgattgagacgagctgcagccttcatcatagaccttgcttcatccggttacaagaatgggtgatggacccattccattccgtctgtaaaatgtaaatgatcaggttagtctccaggctgtcataccaaaaccggatttgtatctgctgtttcccggccaagctgcaagctccgcttgcaagctctgtgngctcggcgcggatcntgttgtttggcagttttgttgtangatgaaaataatataacntgatttggtcataaattcgctctggngctgcacttttaaaaaacaaanaaaaactcnagggggggccngnaccaattcgcccanantagtcgnattacn

SEQ ID NO: 87296 - DNA, 334 bp, Triticum aestivum
  Clone ID: PAT_TA_87296
gcgcctgctacaacgactggaagaccaaggagggacaccccaagtgcccctagttgcaggattctgcctcgccgttgaagccattgctcgatcagccaggccggagccgggcggttacatgtagcaggtttgccgcttccggcgacgccggtgtaagaactcgatcgagatctgggttgttgtagtatgtcgcatgcgtccgcctcttctctggcggcgcacgcggttgtatcgtgggttcaaacacagtttgttgcacgttggaggcacgccgacgcagttgttgtagcactacaatacacgtagtaaatcgtgtaatcctaaaaaaaaaaaa

SEQ ID NO: 87297 - DNA, 298 bp, Triticum aestivum
  Clone ID: PAT_TA_87297
gagaacctctactggctgctcaccgtgctcgtcgccgtcaacttgggctacttccttacgtgcgccaagctgtacaggtaccagaacatcggcaagtagctcaagctcaggacgcaacacactcgttgtgcatggggtgtgtgcttgctttcggtgtgacgaacgatcagtttggcaaccgctcctagcgatccaaacagattccgtgatccgttcaaaaagtttgcgattcatgttggtactaagactagaaggagggttgggcgcgtttcgctgcgtcgttgtcaaaaaaaaaaaa

SEQ ID NO: 87298 - DNA, 514 bp, Triticum aestivum
  unsure (1)..(514): unsure at all n locations
  Clone ID: PAT_TA_87298
agaaagggaaatccttttgagctttttgaggttagaagtttttttattttaaccacagcatcgttgatttcatgcagatatttccatcgaaggccattttggctcaaaattttctctgaaatgtatcctagcacaatcgattagcctattaataaacatgtcctaacatatgcttccttctcttttggcacattttccaattaattgcagctagtttgtccgaaaaatgatattctaggtctttgtttgctgttttgcaaatatttacacatagagcaacacttcatcctttctgaggttactcctttatctctgatgattgcaaacaacatggcaatatttttcattaanttcataagggaagttctgttgtaaccttttcggtataatttgggcatgtttttccaattgactacttcatcaaatcantctgaattaaccttgtcatggaaggagaagctcanctttgtaacaaggtcgaaaactcttaaacaaatgcaatgctgaagattgn

SEQ ID NO: 87299 - DNA, 526 bp, Triticum aestivum
  unsure (1)..(526): unsure at all n locations
  Clone ID: PAT_TA_87299
tataaccattacaagaacgcagcttcgatcggggtacatgagagcaacagccggtttatgtccccacctgacccgatggattatgaacaagagtccatcatgaggaaccccgagatccgtgctattggagggtgtgaaggtgtgactagagccgatgatggcaatcgctcgcgggacctaaatatcaggaaggacaaggagaagagtatactccatcaacgcaagcttccgtgatctaaagcaaatctgcaaattgggaaagaagaaagttagaacatgaagaagaataagaaggagaagaagaatactagaagaagaagatgaagaatttttcttccctttctttttctcctcttctttcttcttcttctaactaagctaccctaggtatttttgtagctaactaagcatattaagtcatcttggaggaaaaaaatgtgaagtgtagtcattttagagctaactangttaataagtcantttggagctaagtaaggtattantcatttcaagacataactaagta

SEQ ID NO: 87300 - DNA, 373 bp, Triticum aestivum
  unsure (1)..(373): unsure at all n locations
  Clone ID: PAT_TA_87300
actgcgcgaggctgtcgcggcgatggcgctggtggagcgcgtctccccggatcgtcaggcgcggggccaagccgccgcccgtggaggaggtgcctgccgcgctgccgctgccggagccatgaagtgttcgttaagctgccggtcatccggttcctgctggcgtgttcttgtccagtgcaggctccggttagcacagtaagtagtagtgatccgtcttanactcttagtgtatctacgccagtacggagtacatcgttgtgctctccgtgccattggaggattttcttgatagatttatgtcctcgttcctttgtactcgggttactcaaaataataatgcacttctgattaccaaaaaantaaaaaaaaaaaa

SEQ ID NO: 87301 - DNA, 412 bp, Triticum aestivum
  unsure (1)..(412): unsure at all n locations
  Clone ID: PAT_TA_87301
gtctgagaccataaagtcttatattggagtttcgtaggctaacatttgtgtttcattgtacaactaaactaagtactcccacaaactaaggataacacatagacaactaaactaagtactcccacaaactaaactaagtactcccaaagatttatacaatcactgtataaccttgtttcatcgtgttgaaactatggtagtgaaaaaccctttgagaaagggaaaaaaaagtcatacgccaaaaagagtcaccatgccaatctggcatcatgggaaaaaacttgctgaactgttcgtcagaaaaaaatggtctacgttgctactaactagagagacctgaacctcaactagaagatgagggtcacaaggagcngttgatgaggccacgcaccacgaccataccaaggggggg

SEQ ID NO: 87302 - DNA, 242 bp, Triticum aestivum
  Clone ID: PAT_TA_87302
cgtcgatgctgtcgtgtcgtgggagaacaccgagcacaaggctcttgacgtgaagctctgaacgccagaggactcgattctgaatctggaccttgcctagttcagagcttcacgttcagatgctgaatctggacactttagttgcaactaaagtgtcttcacaactgcaggagaaacttgagaaaaaggcagaataggcggaggagaaacggcgggaacaggtagtgacgatccagaacaag

SEQ ID NO: 87303 - DNA, 364 bp, Triticum aestivum
  unsure (1)..(364): unsure at all n locations
  Clone ID: PAT_TA_87303
gagagagaagagaagcaaagaggaagggagatggagggagcaggagcaggagcaggtcccagatccatccgccacggccgtcctcgacctggtggagctccatccctactcaaatcgccagcggccgtgcgtgaggagagggataactgtttgcggggatctcatcagttttgtagccatctattcatgtcgcttaaccattgtggttatctatttaggcaagttaaaaaggttgtgtcatgcttgctgctgccccatgattatctgtttgttattttgtaccaagtggatactgaccacatcagttttcatcatttacatttatatggttaaatgaatgaagctttagttgatcaaaaaaaan

SEQ ID NO: 87304 - DNA, 508 bp, Triticum aestivum
  unsure (1)..(508): unsure at all n locations
  Clone ID: PAT_TA_87304
gcctcgcgcccgcaccccaggaagttcaagaggcttttctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctggaaaggaacaaattagaccagtaccagatcctcaagtacccgcttaccactgagtctgcgatgaagaagattgaagacaacaacaccttgtcttcattgtcgacctcaaggncgacaagaagaaaataaagctgctgtcaaagaaatgtatgacattcangccaagaaggttacacctcatcangcctgatggcaagaagaaggctactnaagctgacacaagactacatctcttgacgtggcaacaagatcggatcattaancagaggg

SEQ ID NO: 87305 - DNA, 526 bp, Triticum aestivum
  unsure (1)..(526): unsure at all n locations
  Clone ID: PAT_TA_87305
gtcaagcctgcgatctatcacagggacatcaaggcgaccaacatattgctcgacaatgagatgcgggcacgcgtggcggatttcgggctagccaggaggagccgagaagggcagtctcacctcacgacgcgggttgccggcacacatggctacttggcgccggagtacgcgctctatggacaattgacagagaagagcgacgtctacagcttcggcgttctggtgcttgagatattgagtgggcggcatgtgcttgacatgacggcttcgaatgggccagtgctgatcaccgactgggcgtggacgctcatcaaggctggccagtcaagggaggtgctcgacgatgcattgtcgacgtgcgagagcccaagaggtgaggccatcgaaaggttgttcttgttggatcctctgcgctcatgtgatggttgcgctcccgaccgaccatcaacgangccgtgaagatgcttgaggggacatggncatacaagagatacaaatngggcgctgcaattgggcanacttttgg

SEQ ID NO: 87306 - DNA, 170 bp, Triticum aestivum
  Clone ID: PAT_TA_87306
gcaaggcgagggagctgcggatggatgtagcccgttcatggatcgtgggtagtttttttttaccgcgcccgagacggaatcctgacgaggctgctcccccgagctgtaacaacaatgtactgatgcagtgttaccacttctaatgatgatttccttttaaaaaaaaaaaa

SEQ ID NO: 87307 - DNA, 529 bp, Triticum aestivum
  unsure (1)..(529): unsure at all n locations
  Clone ID: PAT_TA_87307
gtgacggcatctcccatcatcaagcttgtaggtgtggcgtggtagcttttagttgtttgatgtatgtttttgccagaactttattgaataatttaacaaagatgactgtgtgcatctttcgatgcggaggtccggggtctttttcgaaagaaaaaaaacttggtgcatcaaattgatcatgggctttgggaccaagaggagaaccgatatgtcagtgctacaaaataggaaagtaaattgagtaaatggttttttctcaatatcctcttttcatagcacatactttgggacccactagccaaccatttttttcccactcaataccttttccccaccgaaacagccccttgttcttgtttttagctatgacatgccccctatagcggtgaagattcctctagactcagtgcttcaacaagaaccgatagtaatgcttattttcttaccgcgggatgagcaatgttggtcgacattggggtgccaaggttcttagcaacactcaactcgtactaaacantgggggaatggg

SEQ ID NO: 87308 - DNA, 165 bp, Triticum aestivum
  unsure (1)..(165): unsure at all n locations
  Clone ID: PAT_TA_87308
gttgatgctnnttgccngtctttgaaagtttttctacatgggcgntcattgtcattgagtgntnataaatgcaatatctgatanacantgccatnaagcttagtnagattcanaacaagttctgctggnaatntcttgnataanaatacaaaanactttttttta

SEQ ID NO: 87309 - DNA, 539 bp, Triticum aestivum
  unsure (1)..(539): unsure at all n locations
  Clone ID: PAT_TA_87309
gttctctctcaagtgggtcacctagtcaaggggatttgtcgataaaaacatcaagtaagttcaagactgttgatcaacttgagcgcctcaagaagatggatggtctaagagatcagctaaataggctttctagcaacaagggcttggagaaaaggtatcagaagaaagacctggaataccagccacaacaactgaatacctatgatgttgagcaacagtttcgaagtgttgatactgattccatcccaagttcttgtactctaagactcctattatggtcatggaaagccaccaaggtaccccccgccaaatcctttctcaccaccccattcatgtgcacactgccattttggacatgtgcaagcgcacatcccgcacaactttgatgcntgggagttgaattcatattaccaatcctcanaagctggnagctcaatccccgancacnatcgctcaagtcaagcttanngaacagaagctgtggggagaaacatatttgcggctcgtcagggctcacatatacgtctgaanantgttct

SEQ ID NO: 87310 - DNA, 339 bp, Triticum aestivum
  Clone ID: PAT_TA_87310
cgaactccagcttgcgcggggtctgtcggcccacgcttcggcgtcggcgtcgtcggggagctacgagcgcgaggagtgaacgccatggacaaggacggacgaatggctgtgtttccttcgcgttcgcgcaccgaatgctcttgacaacaagctagtcgatcggatctcttttcttctccggttgtgtttgtttgcatgacagacagcaatgactcaatcaaacagcaggcatacagccggcgcataatcaaggctagcagtagtacgaggagtacttcgcaactttatatgatcgacataacggaagtccgtctatgcttccccggcaaaaaaaaaaaa

SEQ ID NO: 87311 - DNA, 553 bp, Triticum aestivum
  unsure (1)..(553): unsure at all n locations
  Clone ID: PAT_TA_87311
taaacgaaaaaacaaacaaaaagaaaaaaaatagaaagaagaaaaggaaacagaaaagcggnaaaaagaaaaaggaaaaccaaaaaccaaaaaacccaagaagaaacaggatcaaaaccagctggctagattttgtataatgggccggcccattgctagcgatgcggtgcttcaccagtgcgttgcgtcggcattttgacgcaatgagcggcgcatanggttttcccttccattctgtgagctggagtcaaccatttcatccgttagattttgttgcagcttcctgtgcactagntaggagcacttctttacttttgtgaatcccttattcttgagagaaatataaaggtccacatccanatcaattcaaaactgaatttaccgactccctaanttcctactccatcatacgtttgcacatccattaactcacgtcactcgctcaaccctccatttgnaanacancactatgcccctcaattgtacttaacaggatcccaaagnggtcancnattaaggaggngacaancccangggaaatnccgggattacc

SEQ ID NO: 87312 - DNA, 564 bp, Triticum aestivum
  unsure (1)..(564): unsure at all n locations
  Clone ID: PAT_TA_87312
gttaaaaaagggttgtgctgagtattgacagaatgacaggtgttgtctattcatgagttacctcatactttttaaaaccagaatcacatttctatacattcgtatgaacacccaaaccgtcatggatctccaagtcaactcatatagtagtatacttcactgaagtggcacgccttcaaaaagttcgatttcaccaatactagtttgcaaaaagaatgtgaattgtgcaatttaaggtaaaggatattaaaaaagaatagacagctacagattagcaatagtgatttcatacaatgatagcttgttggcatattttgatgccacaactgttgattttgctaaattagagccaacctttcttaattcgtatttttcactcatatgttcattatcttcatctcgcttatgcaccctcatgtctagccatctacggtgttgtattatttgtctctctttacattcttaatttgtgtaactgtctctctttacactctctgcatgacgacattcgtcatccctatggatgggcaaactacaagggagaaggagagngaagcgacaggg

SEQ ID NO: 87313 - DNA, 487 bp, Triticum aestivum
  unsure (1)..(487): unsure at all n locations
  Clone ID: PAT_TA_87313
gttgttanggagtatnttaaatctggatagttatttgattacattgttgagaanggaanattacaagaggaagaagctcgtcgctttttccagcaaattaaatctggngtgnnatattgccatanaaatatggnaattcaccgngatctgnacacanagaaccttcngttggattcnaaatgtaatgttantattgcanannttggcttaagtaatgntangcgtgacngtnactttctgaagactaggtgtggtagnccaaattatgcaagcgcccgacgngatatcangtaaactgtacgctgggacctgaagttgatgtttggngctgtggcgttattctgnaaggccttcnttgaggnactcttccagttnatgatgatcaacatnccaaacctttttaagaanctaaaangtggaatatacaaccttcctantcacttgcacccttaacaacatattgattccaagaatgctggntgttgtc

SEQ ID NO: 87314 - DNA, 525 bp, Triticum aestivum
  unsure (1)..(525): unsure at all n locations
  Clone ID: PAT_TA_87314
gccagaatatactactacctctgtttttaaatacacaagacgttttgccagtttaaattgaactgccaaagcgtcttacatttagacagaggatgtaatatcttatctgagcaacataattaggagctcctgcaagagatatacccgggtaaatgtaataaataaaatctaaaactattatttcagttctaacgaaatacgcctacactcgtgtcatgaaatcgataaacttcctaagagaagatggagcacatcaaatacaaacatcattcctagatagcccgctcaactctgcaaactgatcggtgcaggtaattttcaaccttaacagatacagcgggaaaaaaacgtctccaacgctattcagatgacctcanggttgccacaagccattgttgggcatattacgttgaccaagacaccttatccttgcatgatgggcagatgaggccgtaattacaacctgcgtccatcgacggggcaaaatggtggaactggtgttgcacaagtgcatactgctgcnag

SEQ ID NO: 87315 - DNA, 382 bp, Triticum aestivum
  unsure (1)..(382): unsure at all n locations
  Clone ID: PAT_TA_87315
gtcaatccacttcctccgatagaagaagagtgtttccctttaccagagacattttatcgagaccccatccagttaccgttttcattttagacgtccctgctgtgtttgttattgcagcatttattgttacgttgtaacttatgcatggtacctcgaaattgtgcgacgagtcgagtatttagttttcactagtatgagtagttttcgtcgtgattaacttgtgtaaccgcgaagaatcctagaatgagatttcttttccctgagttaccgcatcgttcatcccctcactacatgggattatttttattcacgtagcacacggcagcaggctcacaaccgctcgaactcatgtggaatatctgtttttcacaacagctcttan

SEQ ID NO: 87316 - DNA, 180 bp, Triticum aestivum
  Clone ID: PAT_TA_87316
gatctgcaagatggttccttgtactttggcatagctcgctttttttatcttttgtttcatgttcagtcggcgggttgcatgtgagttagggtaattatgttatctgtcaagataacaccttttaaaactattgtattccctctgttcctaaatataagtcctttatataaaaaaaaaaaa

SEQ ID NO: 87317 - DNA, 502 bp, Triticum aestivum
  unsure (1)..(502): unsure at all n locations
  Clone ID: PAT_TA_87317
gccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatcattgatcatcgatcatgcatgcaccgcgcgcatgcatcatatctatgatcgattcatccatccatctagtaccatgtaacgctacctgatcaaggtctttgtatgtatgtaagcacctgcaacatgacanagcagtgcactccatgcatgtaaccgaccctaaataaatctcccgtggttaacctatacattgttgggttannacaaaaaagcatn

SEQ ID NO: 87318 - DNA, 505 bp, Triticum aestivum
  Clone ID: PAT_TA_87318
ggttcccgagtgtggtgggcagcaccattttcaagctatgctttcattttttctctctttttgtgatttcttcatgtgttgtgctagaagctgctctatcagcttattgtatcgttcaactgttttttcttgttggtcttgtgtaattcctgtctggttgatgagtacctaatagacttggtcgtctagatccctgagaccactcactcacctatttgctggtgtcagagtgaacacctttggggggcaaagggactcatttatgtcaccactaggacacaagaaccaagacctacacgaaacgacactacacacgtgatgaaatcctagcctcttctattttcgaggaggagttgaaacagaccaaatgacattacaacacacaccatactagagagcaccatcaaagagaaagcgctagcctgcaagaaaaagcatcgctcgcaacaacgcttgaaactcaaagcaaccggcatctccaacaatgacacaatcctccaaagac

SEQ ID NO: 87319 - DNA, 519 bp, Triticum aestivum
  unsure (1)..(519): unsure at all n locations
  Clone ID: PAT_TA_87319
gaaagaagggacagggtagaggaatttgttgagaattacagggcatcacatgaaggaaaatttccgtctgctacatatgttcgtaagcaggttggagggtcctattacgtattgtgggcattactccaggaactggagtacaattcgaagctgaggagtgatgtcagtgatgcctctttcaactcaaccagagatgccaggaccagcttcgagggcataaaggaagagacggatctacccgaagtccacaagagaatgacaagagaagaaagaatggccagggtagaggaatttgttgaaaatttcagggcttcacacgaaggaaaatttccacatgcgacatatgttcgtcagcaggttggngggtcctactatacagtgctggcattactccaggaattggagtataantcaagactcaagaatgatgtaagaaatgcctctttcagctcagnnnactcaaggaaaatacgggctcacaatatcgatctctcccaagagtgctgctacaacttcang

SEQ ID NO: 87320 - DNA, 181 bp, Triticum aestivum
  Clone ID: PAT_TA_87320
aaggctctttttactccttataccttatgccttctgatctgagtcatcttatctttcctgcggggattaagaactaggctatctcttctttctatcaggatcacgtgttactaatccgtagacttatagattgttggacttaagcctcgtttcagttcctactacttctgtatgttaatta

SEQ ID NO: 87321 - DNA, 530 bp, Triticum aestivum
  unsure (1)..(530): unsure at all n locations
  Clone ID: PAT_TA_87321
cgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtggcatgcagatcttccgtgaagaccctcactggaaagactatcacccttgagttgagagctctgacaccatcgacaatgtcaaggccaagatccaagacaaggagggcattcccccggaccagcagcgcctggatctttgctggcaagcagtggaggatggtcgcaccctcgccgactacaacaccagngggatccacccttcactgggggcnccccccgttggggggcantaattgccctctnactcnactgctgctgctgctgtacctgtgtcgcctgtgggtgcnctttgtcaaagtgctgnccctttgtgtaaatcctacngttcgggttaanggacatcnancctggggtttggngaaaannttnagg

SEQ ID NO: 87322 - DNA, 263 bp, Triticum aestivum
  unsure (1)..(263): unsure at all n locations
  Clone ID: PAT_TA_87322
gggggtaccacgtgggtgtactgggtcgggcccctcancggcggcggcctcgccggcgtcatctacgagctgctcttcanctcccgnacccacgagnagctccccaccaccgactactaagcanccaagcttgcatacgagctcgccntccatccgtgtgatgatngatngcgtctcgtcatcgnctcnttccttgcnatcgccatgantcgttttagnttgccttgnactgaatcnanccatccctgtgtcgatcngtcgcg

SEQ ID NO: 87323 - DNA, 289 bp, Triticum aestivum
  unsure (1)..(289): unsure at all n locations
  Clone ID: PAT_TA_87323
aaactggttgtccgcaaacttgtacagtgaagtgagaattctgtactgctagagatccttaacccgaagtatcaatcggcatcagctggcctgctcttactcgagtttctaatacgtctgtgcagctgtacagttgtaggataggttgtatgtggcgtcaaagcccttctatagtatgtataaattaatatacgcaccatgattgtagcctgcacctttcccacctccgggtgggaaattttgtaaacccctacttaggatgnaggnccccnnggagntttaaggggga

SEQ ID NO: 87324 - DNA, 346 bp, Triticum aestivum
  unsure (1)..(346): unsure at all n locations
  Clone ID: PAT_TA_87324
ccgccgtccatcgtccattattccattttgactgattggttcgattgattggtcggtcggttgtgctccacgtacgtaggtaggcaaaaagtggccgtgctaactgtattggaagaacgaacgaacaaagtggttgggtgtagaaattttggcaccgggttttcgtaccttacgaagccacgtacgtaggtggctgctaacactttggttatttattttttgcgagactttggggcttgggttcatatgtacnactccagatgggaatgcctgtntggtgctcatttncatcttaantgtcatgaaatggacangatgtnaataggtgnttgaaattgcacacaag

SEQ ID NO: 87325 - DNA, 271 bp, Triticum aestivum
  unsure (1)..(271): unsure at all n locations
  Clone ID: PAT_TA_87325
gngcnatactnccctccgtnagcgcccctgancataanatcntggtgctgcttnacgaatgcgacgtncctganagccanagacctgctaaatgannctgnataccgtctcgactgtntctgtaaattgctgtatcttcantcacagncttcaatcacagncntcnctacgagctgcaanacancccgtgttaaactccgngttgcaactatagcaacaggttttgtgtgnaattgtttctatatatatgtagacactttatatacgagtg

SEQ ID NO: 87326 - DNA, 456 bp, Triticum aestivum
  unsure (1)..(456): unsure at all n locations
  Clone ID: PAT_TA_87326
gaactccaaaccctagtagcgccgccgccgccaggtaagaggcgagatggtgtccggctccggcgtgtgcgccaagcgcgtggtgggtgggacgcccgccaccacatgctcggccgcctggcgtcgatcgtcgccaaggagctgctaaacgggcaggttgtgtggngggtccgctgcgaaggaagattctgcatggcncnggggggctcctccgncagaaagatgaagtaccttccgctttctccgcaaggaggatgaaaccaaagcctcccaagggcccatccattttcggcgccccgccaaagatctcncgggcgnaccatcccgncggtatgatcccgcacaaaccgnnggggcgaaagggccgcgttcnccaagtcaanggtacnaanngggcttncgccnccgtncgacaagaccaacgatggcaccccggaccgctcaagtttctgaggc

SEQ ID NO: 87327 - DNA, 393 bp, Triticum aestivum
  unsure (1)..(393): unsure at all n locations
  Clone ID: PAT_TA_87327
cgccgagctgctggagctcgccggaaacgccgccaaggacaacaagaagagccgcatcatcccgcgccacctgctgctcgctgtcaggaacgacgaaggagctcggaaagctgctggccggcgtcaccatcgcgcacggtggcgttgatccccaagatcaacccggtgctcctccccaagagncgccgggagaaaggagggcaagggagcccaagtctcctaagaaagacgaccaagtcccccaagaaagaccaccaaaggttaagttcgatgcgttccatgtcgttagtgtcttccgtagnngnccggttgtgttcctgnaccggtttccgttcatcttgttatgttcatgtttaatggnaagaactcaagatctctctgacttgctcaaaa

SEQ ID NO: 87328 - DNA, 311 bp, Triticum aestivum
  Clone ID: PAT_TA_87328
ctctaagctaagaacagagtgggcccgtgaaggacagctcttctcattattgtctagagcggtgaatgggttcaggaggttagtctgaaggggggtggggatcggttggtaccattgatatcaactatatctaggttttgcccttttttctttttagtactgttaggtgtattttcattatctctgtttgtagtggtgttgttaagatgtcaagtgcagattctccccaaaaagaaaatatggtaaggtgtaagtatttcatacctgcacaatattttttgtggcatgtaacataagaatgattacactgg

SEQ ID NO: 87329 - DNA, 426 bp, Triticum aestivum
  unsure (1)..(426): unsure at all n locations
  Clone ID: PAT_TA_87329
gttttaccctactgatgacagtgtcgcgatagtaattcaacctagtacgagaggaaccgttgattcacacaattggtcatcgcgcttggttgaaaagccagtggcgcgaagctaccgtgtgccggattatgactgaacgcctctaagtcagaatccaagctagcatgcgacgcctggcgcccgccgcccgccccgacccagttagggggcgcttgcgcccccaaanggcccgtgccattgggctaagcccggccggtccgaagtcgccggnncgggccgcctcgaaagtcccttcccaaaggggcggtgnggctgaatcctttgcagncgacttaaaatacngacggggcattgttanttgnaaanttnggccttgctgccaacgattcactgagatcaacccaatgtcgnangattcnttaaaaa

SEQ ID NO: 87330 - DNA, 609 bp, Triticum aestivum
  unsure (1)..(609): unsure at all n locations
  Clone ID: PAT_TA_87330
ggaggagatggctttgaagtggatgaaagtgcaggacatacggttcagcatggacatgttccccatgttcttcgagcggatatcgagcctcctcaagcgaggccgatgaatgatcgccgtaacttggtattgtagagctctagatagatgtgacatgactgaaactgatcgactgttggcggaacgaactgtccttactatcttgggagggctgaagatggtttggtctgttcctttanctgctgaaccttggggacttggtactgcatagttaatgagcgnaggcaagactgtggntgatatctgggatggccaacgggttaagcgccccntaaggaggaaccgttacgaataatttnatgcaacggtggatgantttgaaanattgcccggtnaaccgntttacggggatggaaaccggttgtttgcaataagtggcagtgattgtttcccctccaaaaaaaggggggcccggtcccaatnnccccnagaggatcgtataccgcccaatngcgtcgtttaaaagccggacgggaaacctggggtacaactaacgcctgaaaaaccccttccaacgggtatacaagagcccacatccctccaaattga

SEQ ID NO: 87331 - DNA, 407 bp, Triticum aestivum
  unsure (1)..(407): unsure at all n locations
  Clone ID: PAT_TA_87331
gtgccatgtgcatgccttttttttaatatagaacagtgggagcctttcctgctgtaagttatcaaaaaagaaagttgatattgttttttggaaagatacatgtggcaacttgataatctgccctaaatccgagattctgttcctgtaatgcttttgatgagcatttttgccatttcctgttgtgaattgttttcttttgccaaaaactaagggcaatggctcaggttgggaaattgagtggtggcgtgttgtctattgcaaggtacataccttcgncctttgaatgtgggnaaagtggctacaaaactggtgagcaagagcacattgganggacacaaagtccgagcacatggaaggtacatacctttggccccggtgtattgccgctggagaagtggtgaatatgg

SEQ ID NO: 87332 - DNA, 350 bp, Triticum aestivum
  unsure (1)..(350): unsure at all n locations
  Clone ID: PAT_TA_87332
tgggaccacgtcctcagctactggcgcgcgagcacggcgatgccggacaaggtgctcttcctgcggtacgaggagctgctccgcgacccggccaagaacgtccgaaagctggcgcggttcatcggaatgccattctccgcagcggaggacgaaggccggcaccgtcgacagcatcgtccagctctgcagcttccgggcacctcaagggcttggacgccaacanaaccgggcacttgggntccactcntccccgtcccgcgtgatgcgctcttcagggatgggggcgtcccggnnattgggggtnaaccanatgacccggnaatgngcnaccgccgggaaagntctagcct

SEQ ID NO: 87333 - DNA, 371 bp, Triticum aestivum
  unsure (1)..(371): unsure at all n locations
  Clone ID: PAT_TA_87333
ctcaatcccatggtctctatatgccacttcctattccatatcacccatgggaagatatcagtatggactttgtgcttggcttgcttagaactcaaaatggcaaagatttcttgtttgttgttctggaccgattctctaaaatggnacatttcatcccatgcaacaagattaatgatgcttcacatgttgcaaatcttttttgtngggaaatattgnacctacatggnctgccaaagactattgncacggnccgcgacgtcaagttcttgagcnactttcagggagaccttangtgccaagctcgggatcangcncttggnctcttcggganancatcaagngncggntggnagacgancggnacgaaccgg

SEQ ID NO: 87334 - DNA, 634 bp, Triticum aestivum
  unsure (1)..(634): unsure at all n locations
  Clone ID: PAT_TA_87334
ggatgtcgggggtcaggacaagatcaggcccctgtggaggcactacttccagaacacccagggtctcatttttgtcgtggacagcaatgacagagagcgtgttgttgaggcaagagatgagcttcaccggatgctgaatgaggatgagctgcgtgatgctgtgctgctggtgtttgcaaacaagcaagatcttcctaatgccatgaacgctgctgaaatcactgacaagcttgggcctgcattctctgcgccagcgacactggtacatccaagagcacatgtgctacctctggagagggttgtacgaggggttgactggctgtccancaacattgccaacaagcttgancatctcggcaggggttctatggatctgggataagctggatattcnggnctaatacgcctttacgtagtantaaacnatatagtctngacaaataagtgggtgttttggnaagataaanctctgtcaaagagctactatcagattgtttcntggtgtaaattgccgtgcctttggtgccacaagggntacnagtcgctcgtcctgtccgcatccgaagantgntaatgtgnntgctgcntgatagaaaaaangaagaancnggggccgaacaattcccaaggggct

SEQ ID NO: 87335 - DNA, 256 bp, Triticum aestivum
  unsure (1)..(256): unsure at all n locations
  Clone ID: PAT_TA_87335
agcacaagcagntaatctttatgcagtatataggtcacaaattaatacgtagtctatctttggttaantnttactcgngnagttcacattacttaggtgtagcaaagtttttggggnaccttgcgctcttaaggaagagtgnatggncaaatngntaagtggatgagtcgctgctgatttttcataagnagcttatnnctcccagggannagggtttttcangggggtgtaggctccatanaaanngagctcatgg

SEQ ID NO: 87336 - DNA, 328 bp, Triticum aestivum
  unsure (1)..(328): unsure at all n locations
  Clone ID: PAT_TA_87336
ctcttgctcacccctcacgtctccctcngcggnncgcttagctccctctcncgcccctctctctctctctcatccgacaggaacaggcagacggcggcggnaggaggtgannggcgggagcgggaaccggnaggcggnacagctggaagaangngagcggcagcaggnggtgnctgctctgcttgtanttgtccctgcctccggcanncancatcgggggnacnagggnagncnccccctcctcntacgccntgngttcttgggtgctgggnncacttcctcagtcgcanatgcgggccatgggccgcaagnttngccttcancagga

SEQ ID NO: 87337 - DNA, 644 bp, Triticum aestivum
  unsure (1)..(644): unsure at all n locations
  Clone ID: PAT_TA_87337
gatccgcaagggtctccgcggtgactccatcgtgctcatgggcaagaacaccctcatccgccgctgcatcaaggtgcactcggagaagaccggcaacaaggacttccttgagctcagcaacctcctcgtcggtaacgttggcctcatcttcaccaagggtgacctcaaggaggttcgcgaggaggtcgccaagtacaaggttgggtgctcctgctccgtgttgggctagttgcacctgttgatgtggttggttccccctgggcaacactgggctggatccctcccagacgtccttcttccaaggtgctcaacattcccaccaaagattaacaagggactgtggaaatactaccctgtggagctgataaagaagggtgacaaggtgggtcctctgatcctgccctgcttgccaactttggtaccgccctcctcttaagggcnggcaacctgcaagtctangaaacggtcatcctcaaccctgagtcttgactcaccgaggaaactgatgacaagttgcttcggggtgtcaaggtgctnngncctgggattataccacaaggcgntgcgcaananttctaatgaaaaagaagtctgcgtgcttggaagataccanagntaagcgataataggnnactaggccaagg

SEQ ID NO: 87338 - DNA, 230 bp, Triticum aestivum
  unsure (1)..(230): unsure at all n locations
  Clone ID: PAT_TA_87338
aacattgaatgagccttatgagactctggtaccaatgtccttgtaccaggcccatgggatcgatcaccttgtgattgccacaagagactacctgtttgcaccatccctcgaagatatttgtcgagccatcgattttatccaccgtaatgcatcacaaggtggcactacttatgttcactgtnaagctggaagaggncgangcaccactattgtgttgtgctatttgatca

SEQ ID NO: 87339 - DNA, 196 bp, Triticum aestivum
  unsure (1)..(196): unsure at all n locations
  Clone ID: PAT_TA_87339
gcataccactcctgctgcagcgcctcagccagctccccgacgccgacantgtcaccattgccttcccagatgatggggcgtggaagcncttccacaagtcgttgnncaacttcccggtgnntcantctgntcttctgtgtgcntgnttggatnntggctatgntttcantgncgcctttcngtttgcntnaaacac

SEQ ID NO: 87340 - DNA, 184 bp, Triticum aestivum
  unsure (1)..(184): unsure at all n locations
  Clone ID: PAT_TA_87340
ctttctttgaagatcaatgttaaggtatgaatcaatttctagctgtgcaacaatcaggcctgcagaatgctgagaccgttgctgttttgtgattangttgggggtcggaatacagtacttgnagatgctttgtacaagagganacaccttctgantgatgtgnctacaatantttttgaaagct

SEQ ID NO: 87341 - DNA, 217 bp, Triticum aestivum
  unsure (1)..(217): unsure at all n locations
  Clone ID: PAT_TA_87341
ccgtcgccgggatggnctacttcatcgtcgccgacaagaccatcctctccatggccaggaagcactccttcgacgacgcgccggagcacctcaanaacanctccttccactaattagactataagtagtagatccattagtagtgtgcanttaanactgcanggcacttatcnganaatgntgttcatgacagctgacantncgacaanntatctga

SEQ ID NO: 87342 - DNA, 217 bp, Triticum aestivum
  unsure (1)..(217): unsure at all n locations
  Clone ID: PAT_TA_87342
cctgcccgcgcggcgccgtcgtggggctagtcccctgtgcgcagggcggcacgcccatcgccaactggtcccgcggctccgagatgtacgagcggatggtgacccgtgcccgtgtcgctggcgcagggaccggcaggatcgcagccttgctgtggntccaaggggganggncgacgccatncggngtgaggacgcgttggcctacaccggganggat

SEQ ID NO: 87343 - DNA, 181 bp, Triticum aestivum
  unsure (1)..(181): unsure at all n locations
  Clone ID: PAT_TA_87343
ctgagtgcactcgaggctgaacgcgagaagaacaagaagttcgcagagtttctcgcgacacaggacttgaagcccgaggtggnaggacgcaaccttccngncttcttgatcatgcnnattcaangtntgccannctatcanatgctnntgcnttaggttgctcanatatatgntanaccga

SEQ ID NO: 87344 - DNA, 420 bp, Triticum aestivum
  unsure (1)..(420): unsure at all n locations
  Clone ID: PAT_TA_87344
ctggaatccagattctgaatactcccaacctactggtggttttagtgttgcattctctctgtcagttgttcagagcgagtgccagcaacttctgtgtgaaattttgcgggcaactccagaagctgctactgcagatgcagctgttcagacagctaggcttgcaaataaggacccagtgaaggaaaagagggatggatcagagaggcctttcttttgcttttcgcgttacagatgcagcaatctctgtgcaaaatgaaggtcaaggagtggagnaaganacccagctgtaccccaagacagggtatggaacagtaagcatcatacctgatcaangggantttcctagctgcatcagtttaacgtcctgtctttgngtttaggantaaantaggnntgangcttcctcgnaagnatcacaac

SEQ ID NO: 87345 - DNA, 382 bp, Triticum aestivum
  unsure (1)..(382): unsure at all n locations
  Clone ID: PAT_TA_87345
gttctgtcatcagttgtccctgaaacctcaactactgatgttgctgaggctcctgcagctgatgatgacgatgacagcgatgttgacctttttggagaggaaaccgaggaggagaaaaaggcagctgaagagcgcgctgccaaagcaaaggcttctaccaagaagaaagaatctggcaagtcatcagttttgcttgatgttaagccatgggacgaatgagaccgacatggtcaanctggaggaantgtccgaagcatcaagatggaggggccttctgtggggtgcttcnaagctnatgcccnttgntatggaatnagaanccccagntnggangccancattgangaccncgnctcggncaaaccccttatnaaaaccatct

SEQ ID NO: 87346 - DNA, 381 bp, Triticum aestivum
  unsure (1)..(381): unsure at all n locations
  Clone ID: PAT_TA_87346
ttttttttttttttttttcatcacaaagttacagtagaactgagcaaattacaatacatctcaaataaattgtgttttcaacaagtcgaatcttcaaacaaggaatgttcagttcaatacagagcaagcacaccaaaaataaatgaacaaggataattcagaggctggaaatcaataggaatcgacatccacttcatttcctacaaaccaatatcattgangcaggtcaagactnctcctgaaaatacgcaagtgagggaagctcaatcaataccaacncgtgccaantcaattnctcacgtttaatcagtnncagaatccgancagnaaatantcgccataaaaaacngcacnggaaaaaccgnctaaaatccggaggtt

SEQ ID NO: 87347 - DNA, 524 bp, Triticum aestivum
  unsure (1)..(524): unsure at all n locations
  Clone ID: PAT_TA_87347
ggcaagaaatggctgagatcgacttcacccaactccgtctccttgatgctggaccaaatgcgctacagcccaaagtatttccttacgttcctcctaatattgttgatgacgaggacgccgctcttctagatgatattccaagcgatgatgatttttaggaggatgatgctctgctcatcaaccaagaggaccttgaaggggaagccgctcacaagcttgttcctcctactcactccaagctgacaagacggattcagttgttctatctcttatctattctatccagttatgcttagcagatgtctctgccgcggatcatccatgtgggtcgcttggggtccaatctatctgtattaaatgtactcctcctaanggtgtgttttggagcaatcgactataattacaactccgtttgggcaacngcaatgtggttgttttgcaattgaattggccaanaaggttgattgtgtggaaaacaaaatgccccaaagaagtgggttcccttacnanaaantttgcaattg

SEQ ID NO: 87348 - DNA, 372 bp, Triticum aestivum
  unsure (1)..(372): unsure at all n locations
  Clone ID: PAT_TA_87348
gatctgtgagggtctgcagtaccttcacgataatcatattattcacctggatctgaaacccgccaatatactgctcgacgataacatggaaccgaaaattactgattttggcctatcaagatgctttgatgaaaatcaaagccgggatattaccaaaactatattaggaacaataggatatttggcaccagaaattcgcgaaggaggtgtaatcgcacgcagcgctgacttgtatagtgttggtgtcattatcctggaaatactgaccgggcagaaggggtatcaagatattggggatgtaagaacaaatatatgccattgttataaagataaaagctcaatttcctttttggncnaagaaagattgacttt

SEQ ID NO: 87349 - DNA, 398 bp, Triticum aestivum
  unsure (1)..(398): unsure at all n locations
  Clone ID: PAT_TA_87349
ccgtcgtcttgtaatctatctaagcaagctttcaatctggatgttcctcatgtaacttgggtcctggaattgtgtggagatgggatttttttggggaccggctattggtaagttggctgaaacaaaacttgggtcagtgtgtaagtcatttgcctttttttttcttagcctgtttaagttgatttgctctcagctgacaatacgtgcgtacaacgtttgacgcagggccttgatccacacgcattgggtttatctgctcgcatgcacgtacgtgccatcctgtttcgtatggttcagcacgtgttatgtttgtaatcacagtcaccgggtgttttgttactttattactctatctgtcccataatataaaagcatttttaacaancaaaaaaaaaaaa

SEQ ID NO: 87350 - DNA, 629 bp, Triticum aestivum
  unsure (1)..(629): unsure at all n locations
  Clone ID: PAT_TA_87350
ctttcctcgtcatagttaaaagagttaagaaatggagatgctataactctttgtaatactccctctgtaaagaaatatatgagctcttatatttgtttacagagggctatttcctaatgtctgaatcgctgttgcatacaaaactcttccactcgtatgctgttaaatgcttggctgtctgattcatgtctattttcttcctgggatattgacttacactaaacctgcttcctttgccttgccagggatcagactgtgtgcagcccttcatcgcgctgcagaactgcatcaaaggagaaccaacggcattttcctaaggagattttgggaagangaggagaaggacgaggangctgagaatccaacctgcaattagactccaacatggtctanagaaccaaatccaaacaaaactttgagatccngtggataagctgacaacctgatacagagattacctgatcaaatctcaactgttccccaaaaatctccttaatagnaagtaacatcaagatctcgnanaataacanagttgtgtgganaatactcacttttttggananataacttttanaacggaaactgatcaanaacantntaaggttncaanngttttcaaaaaaaaaaaa

SEQ ID NO: 87351 - DNA, 573 bp, Triticum aestivum
  unsure (1)..(573): unsure at all n locations
  Clone ID: PAT_TA_87351
ggcgttcctgaggaccaagtgccccgccgacgggtcgtcggacccgatggtgctcatggaccaggccacgccggcgctcttcgacaaccagtactaccggaacctgcaggacggcggggggctgctcgcctccgaccagctcctctacaacgacaaccgcacgcggcccctcgtcaactcgtgggccaacagcacggccgccttcagccggggcttccgtggacgccatcaccaagctcggccgcgtcggggtcaagtccggcagcgacggcaacatacgcaagctgtgcgactcttcaactgatgacgagagggatcgatcnatgcgtttgatatacaccggggttgctatactacctgtctgagttatgtacgtcatgcgtcaaagtgcatgtgtncacaaatgtgtggnctgtnacacggagatccttgggttcaaaattcgtgtggctgtaataatgnanattgttgtttgatcgttgattcaantccaatattcaataaatgataatcatccataataaggggacttaatgcaaaaaanggggccggaccaatccctaatgatctata

SEQ ID NO: 87352 - DNA, 648 bp, Triticum aestivum
  unsure (1)..(648): unsure at all n locations
  Clone ID: PAT_TA_87352
gcttttcacaatttttgttttagtgagtaactacatatttggtagctagattgtccacttccgacaattggatattagacgtctaattgtacgcgcactccagaccattctataaaccaggtatgcctaatatttgtttgaaatgactacatggttgtgtccatggagccatgtgctactttctagtgcggggtaataagccggtatgtaacaatacccttgatgttgcatgctatttgggcactatgtgtgtcacatggcttggtttaagcattcaagtattacataggcattgccttggttatccgaaaatagttagatgtatcatcgtttgcttaaatttgggctanagttgagatgaanctcctagctatgagataacatagtatacagagtgtctgcactagattagataggtggtgatctactttcctccggtcaagattcantttgggtgcacctgcaagtctatggagagaacatgtagcacanttgntaacccaaatatccgaatatggtgatgctttttgngtgtgctccgcggnttgagaanttatcatgggtaggaataaattggacttgaattcaggatncaaanttnatgnganttntaagattcagtgtgaatgaattctcnaacataagaag

SEQ ID NO: 87353 - DNA, 517 bp, Triticum aestivum
  unsure (1)..(517): unsure at all n locations
  Clone ID: PAT_TA_87353
cctgcccacctgctgcgctgacgggagaggccttcctttgccatcgattttgtgctattgcttccttcctccacttcaacctccaatggggaggcccgctctgcggtttcagggaagggaagcgctggtgtgagattgttggtgcagcagattactctgtgtaaaaataacctgccgatccagcggtgttcttccaccgtcgcatgtgctcagccatcttctttggcgccggctggctcctcgtcctcggctccactaggtggtctgctcggaggatttttaccgcgtgtcccttccgccgatctgggtggcaaccgggaacgacgaaccgagaagtctgctctgggtcaagcggctgtgcctcaagttggactcaatgctccgtccgctgtgcactctgtcntcaaggaagctcacgcactcctaacatgtcatttatctcctgtaggggacacngcttggtggcatcctgtanctttaattcctgggatcaactgtaanaacnaaaaaaaaaaaa

SEQ ID NO: 87354 - DNA, 640 bp, Triticum aestivum
  unsure (1)..(640): unsure at all n locations
  Clone ID: PAT_TA_87354
atgatccactggagctaattctaaaggcgggaactttaatctcccctgaagtgtgcaagttaatctggtgcaaattcatggttgaagttgatcctattgtcaccgcggccctagatgctgagaaagcacacaagtggaagaaacggatgcgcaggattcatattggattgatagttcttaatgtggctgccagcacggcggtattccgtgacgactggggtagtaataccgattttttgatgccgcggcagaattgttcggccttcaacagtgcaggattgggactatatagctctaacgaactcttgaatttatttagcaccgaggttatcaatccggtataactgtccatccggaacagtaaaataaacttttttctctccataatttattaagtaataatgccaccgggtatccctatactaaaagtgcggaaacatattttaaatcctagaaagaaaatagataccngggattgaggaacccttaaattgtcnagatgatgcaaaataatttatgattncgcataaacannaatctgcatcaacacaannnaaaaaaaaacccagggggccggtacaatcgccanagggtcnttagccccaaggcgtcgttaaagtcnacngaaanccgngtacaa

SEQ ID NO: 87355 - DNA, 574 bp, Triticum aestivum
  unsure (1)..(574): unsure at all n locations
  Clone ID: PAT_TA_87355
cctcaggagacctcctcccctgagcgctcccctccctcaggagacctcctccccgacctctcgttttctctaccgacggccgacgtggtggtgtaccgccgccgtcacggcgctgaaaccggcgagatcctgcgtccccatcgtggcccagattccctatgccaccaagtacaccgaacacctcaagatcggtatgtgaaaggaggtgcatgggagaaaagatgccagagttgcgttagtggagtgtgataatatatcaancaaaggaaagtgttggtgaccaacacgattatccatcacgtccaancggggacgctgcaagaacatggccccatgtgtgctatgtccaacacagcgctgcctttcaaactactccacccggttgtgttttccctanaanaaggagccttgggngtccggattttatccngagggggaaaaacnccaagngaaaaacaagatgattgtcnataacgggtgatattcacaatttaacattancanggaaggataaagtcaactaggaaggatttaaagganaacanatctggaaaatnnatggggtaaaataagt

SEQ ID NO: 87356 - DNA, 623 bp, Triticum aestivum
  unsure (1)..(623): unsure at all n locations
  Clone ID: PAT_TA_87356
gatggccggaaggaagggcggtgacaggaagaaggcggtgacccgctccgtcaaggccgggctccagttccccgtaggccgcatcgggcgttacctcaagaagggccgctacgcccagcgcgtcggctccggcgcccccgtctaccttgccgccgtcctcgagtacctggccgccgaggtcctgggagcttgccggcaacgcggccaaggacaacaagaagacccgcatcatccccgcgccacctgcttctccgcccgtccgcaacgaccaaggagtcggcaagtgctccgccggcgtgaccatccgcccacggcggcgtcatccccaaacatcaatctgtgctgtcccccaagaancccccggccgccgccgagaaggaggcaatccccaagaagaagacggcaccaancccccaagaagaagccctgcaccaaggataccgccccatactattggtgttcttaattcattctcatggacaagataatcctgcatgtatgctgtatcttantncgtcagncctcaacaagataatgtctgtgatctgtagatggtaaaatnacaatnantcgtgtcaaaaagggggccggtacaatnnccaaagagtctatanccgnaangg

SEQ ID NO: 87357 - DNA, 393 bp, Triticum aestivum
  unsure (1)..(393): unsure at all n locations
  Clone ID: PAT_TA_87357
cggcgcggccgagagcaggatcagagcattggcctgccctgcgtcggcgctcccggactgggactcggacgagggctggatcgatgtgctctccgggccaacagaagcgcctgtcgccgcgccggccaaggtgacgactggcaccaccgtggaggacgttatcaccagtgacgcagagtccggcgctctcgacattaccgtggacgtggagcacagcagcgtgctcaacgcaggacaagaggcggacgatgatgaggatgaatcaagtagtagggcacactaggcaccagcctccggagattctagatctcaccaggttagtgtcatgtaaattgttactgttatgtngcaacaagatcaattaatgcatcgaatttgttcatcatgccaaaa

SEQ ID NO: 87358 - DNA, 643 bp, Triticum aestivum
  unsure (1)..(643): unsure at all n locations
  Clone ID: PAT_TA_87358
gaaaaacaacaaaaacacaaccaagcacttcctacaacaccagaacctgaaaaccgaaggagaaaaaggaaaaagagagtttcacagcaccgaaagaaacccaagagctagctgcatgtctggttaccttccgggacacattttaccaatcgatcctcaacaccgtcggcgccctcctagagatctcgggacacaactttcagcaggcgtcttgccgcttcttttgcactgtttcaatggtggaagtaactcaagtcgcagttgtattttctgcgctcctgttcaaaggcttccttatctatctatctancctgtccnatgttgaagtcaatacaaatcctactattgctgacgagatnaagaatggtaacgattgcctgcaatggagcaatggatcttgtggaagagttgaattggatcaatcattgctcaaagatggagacatgagtgcgttttgaggctggatggctgcggtggtccttcnccctggggccaacttcttaccaaaggcganaacaaggcaactgggggcngccaanctaaaaaggccttaaaggccaaataggnggttnagccaanaaaggaaaanatgtgtgaanccatcatttcncaggcatcagggtgtttccacnggaaggctagn

SEQ ID NO: 87359 - DNA, 617 bp, Triticum aestivum
  unsure (1)..(617): unsure at all n locations
  Clone ID: PAT_TA_87359
ttttttttttggaaaggatgcacaccaaacgtgcatggtccaatatatttctgtggacatgatgacattataaaacacatacagagtacagtatatagtaagtacagtatatagtaggaaagcgccctcacctaaaagacaaagtgaaagcatacagtaaccgcaccgaacgaatgggcagtacgataacattatcctccgtcaaccttaattattgtcccaaaaaacaccctccgccaactttgtttgttccttcctacagcttccgacacggcgagcacgggagagtcnaacacaatgggcacctaatgggtttngagggcccattctcccggggtcaagngctttggctcccgccgccttgcccacctgctctgccctcgtccgggacttcaatggtactccggtgacacaatgccaccaatggcgncgggctctcccaaaacccnaccgatccaaggcacggcggaaccacaacacacgngcanatnaaacccaagccgtnggctgcanccatgctcggnaaagcggcctnacgggnactcangananttgccnacttntnaanatagnaaggtttntcacnagggggccgncaatncccnaaggtcttaccn

SEQ ID NO: 87360 - DNA, 644 bp, Triticum aestivum
  unsure (1)..(644): unsure at all n locations
  Clone ID: PAT_TA_87360
tgcaattaatgaaagaattaataagggaagataagattcacatataaatatactatcctagaaatcttttgtgattgtgagccctcatcaaaatattatatgccaaaattgttgacgttggacaaggaagacaactttatggtttatgtttgtttatattcaaatagaagtcatattgtcatggatcctttaacatgtggcgcttgaccctatctttgctagccaaaaatccacactaagtaagagatactacttgtgcatccaaaaaccttaaacccaaacttattttcaaagtgtccaccatacctacctaaggaatngacaagtccctccaantaagtgtcatccggtgcaaaaaggcaataaaatgcttcctaaagtgtgagtcatttaagtgtaagagaattgagcgttgcacgacttgtgatggtgaagaataaaaacgacagacngcataataaaggcattaccacaagggcaatgcaactgactcctttgcactaaggggtgacaatcaaacaaataacgcagggaactcngctcctctannaanggctactttactttaagcattattaatgtaagncaagttgncctcagtccttaatttcccttgaacacantggnggaagttagaatantcg
